United States Patent 10,900,036 (RNA INTERACTOME OF POLYCOMB REPRESSIVE COMPLEX 1 (PRC1)) - sequence listing, part 6

SEQ ID NO: 11268 - DNA, 9156 bp, Homo sapiens
caacgtggagggggctttaggagaggattcatcccttacgtgtttggccccaaatgagactttagtatttgtacctggtatcaaggaaatctgttgacactcagttttattcctgagcacttttatttctgggttgtcaatcatgaatgacacctattaacggtggttccttggagattgcggggtggctcttaaggggtgttaggctggcaagattcggtgggcttggggcaccccagcaccaaccccctcctggccttgggcatgctggttcgtttggactgaacgctccgtgccatgctgtgttcctggaaatcacgagctggtctgagcctccttgtcttgcccaggtgaacttcacggtagaccagatccgcgccatcatggacaagaaggccaacatccgcaacatgtctgtcatcgcccacgtggaccatggcaagtccacgctgacagactccctggtgtgcaaggcgggcatcatcgcctcggcccgggccggggagacacgcttcactgatacccggaaggacgagcaggagcgttgcatcaccatcaagtcaacgtgagctccctgtgccctctgtacccaggcagggaggtgctggcctggcagctggaggccactgggccagggtgcgcggggagagacttggcaacgtctctttcccctggtttcttaattcatgggagaatgagtgaggttcagtccagcgagacaggatggagaggcacagggattcggggtactgcgagctggaaggttttcttgaggagggggcttaactccgtggttctccctccctgggggacttgcccccactcctacaatatctggagaggtttggctgtcacacctgggaggggagggtgttctagtgcttgggacgctgggaagctcctgtgttgcactggatgatgttcattccatgtcagtttctggccccgatatgagtagggggagcgcagagtacggtgaccccaactgctttttgtcctgggttggtacattggtgagggactctggctaaggctcttcatttcccctggagcaggggcagaagtgaggaggggagggtcggagtctctggaggcttttgccgtcctgctgggtcttttagttgctactttgagtcaggtgtgatgaatcttgggaccaagtcggtggggcaggatgtctggtcaggagggctctgaggatctggctatggggctggtaccaggagttccctgtcatgggggtggcatgtctcggacagaggcaaaggacaagggtgggttggctcttgtgggagcctctccagggatgagtcatggagggaggagcagcctggcttctgacagcatcccagactccctgggccaggtgtgtggctcctgtccccctgacgagtccctccctccatcagtgccatctccctcttctacgagctctcggagaatgacttgaacttcatcaagcagagcaaggacggtgccggcttcctcatcaacctcattgactcccccgggcatgtcgacttctcctcggaggtgactgctgccctccgagtcaccgatggcgcattggtggtggtggactgcgtgtcaggtaagcagtgggtccccctgaggcacggcctggaaccgggggccatccttgcttgaggatgacagcgccgccctgtcccccgtgtccccaggcgtgtgcgtgcagacggagacagtgctgcggcaggccattgccgagcgcatcaagcctgtgctgatgatgaacaagatggaccgcgccctgctggagctgcagctggagcccgaggagctctaccagactttccagcgcatcgtggagaacgtgaacgtcatcatctccacctacggcgagggcgagagcggccccatgggcaacatcatggtacggccctccctagctgggtggtgggcttgccgcagcgggatctgcaggagccggtggggagtggagttgagctgagggggactggaagtgtgtttttgccaggaatgttgggtgacagagaagggggctggaatgttttcatccgacttgacccagcccttgatctttgggcagctggaagagacgagctcagggaacgctgccctgggtggtggaggggctggcccccctattcgtgatgactgatcatttcttcactttgaccagatgtctactgaagaaagcctgcgtctgaggcccatgcccaaggcgcccagcccgtagcttcaggctctgcgcaggggccctcacggctgcttctcgtttctcacacttccagatcgatcctgtcctcggtaccgtgggctttgggtctggcctccacgggtgggccttcaccctgaagcagtttgccgagatgtatgtggccaagttcgccgccaagggggagggccagttggggcctgccgagcgggccaagaaagtagaggacatgatgaagaagctgtggggtgacaggtgagccccgcgggatatggtgggggattcctgacacctgggggtagtggcagcgacgtaggggcgtggtgtgctattcacagcgtggctcaagcccaccaggtcttgcccaagcatgtccccttggcgaccaccctccccaagtcatcccctggagaccctaacttgatttggcttggcctctccttgccaggtactttgacccagccaacggcaagttcagcaagtcagccaccagccccgaagggaagaagctgccacgcaccttctgccagctgatcctggaccccatcttcaaggtgagtgagggctgcgccaggcaccccgccgatgcgactattggccctcggccctgtgggctccggccggtagcctgtcggctgactgggcccgtctccttgtggggcagatgcgagatgggaggaggcacagctcctaactgaggtggagtcagggctcctctcttaagatctggactgcatagccagagccttgggacctctcctgcattgagggggttgaataacttgtggctttggcggttcagtgcttgtaagtcagaacttgggtccttgtctgagtcagagtgggctttttcctctgctccaccacgaggtttcctccagctcccgatccgctcagctggctgggcccgtggtaggcaggccaggcctgctcctgctcccgtgctgcgtccccctgcgctgacctgagtcttccaagcaggaagcagtgccaggcttcctcctgctgttcccaaatgggctttcttgtttcttggtggggaatgtaggtgtttgatgcgatcatgaatttcaagaaagaggagacagcaaaactgatagagaaactggacatcaaactggacagcgaggacaaggacaaagaaggcaaacccctgctgaaggtgcggcctgggcccagccctcggggtggagggaacacaggctgctgtttccggatgctctgacagcccaggcctgggggctgaagtcctcagctgggcagggacagctgctgcccctttcgctttagactctgggtgctgctggagacacatcccagcagccagccccatccgggacaggtgtgggtgagggccttggcaggagtgtgcatggcctttgccgccttccagaagggactgtgctttggagaacgttagtcctgactttggcttccttggcttcaagagaggaagcgtgtacggggtggggccatcctgggctccccaggtgtctcatgcaccgctctctgcccccgcaggctgtgatgcgccgctggctgcctgccggagacgccttgttgcagatgatcaccatccacctgccctcccctgtgacggcccagaagtaccgctgcgagctcctgtacgaggggcccccggacgacgaggctgccatgggtacgtggtcccggtggccgggccctgagatgcagccggatgacttcctgttgcccaaggttgtgggttgcagggttccagaaggctgagctgcactggaataaagcttgcgggttttctctgtccctcaggcattaaaagctgtgaccccaaaggccctcttatgatgtatatttccaaaatggtgccaacctccgacaaaggtcggttctacgcctttggacgagtcttctcggggctggtctccactggcctgaaggtcaggatcatggggcccaactatacccctgggaagaaggaggacctctacctgaagccaatccagaggtgagcagctgggtgatgtgcaggccccttggcactgttgcgggccctgccctgctccaagtcttgggctcctcagtcgggagctagaagtaaggagcatagaaggaatatagggtgatacttgtgccagccacaacttttgttcttagcccagtgagggcatttctggagaagctccaagccccagggcacagcacacccctgctcatctgtgtccctgggcacaggtgggtggcggccgtcgacccatacccagggaggagggcagtgattctgaagaggatgtttcctgacagccccgacgcagcagtcagggccttgtggaagccaccagtctgccctgggacctggcaggagggccaccaactccgggagggacctgccctggccctccagggtccagcacaaccatccctgcggcctgctgccgccttctgcttcttccagaacaatcttgatgatgggccgctacgtggagcccatcgaggatgtgccttgtgggaacattgtgggcctcgtgggcgtggaccagttcctggtgaagacgggcaccatcaccaccttcgagcacgcgcacaacatgcgggtgatgaagttcagcgtcagccctgttgtcagagtggccgtggaggccaagaacccggctgacctgcccaagctggtggaggggctgaagcggctggccaagtccgaccccatggtgcaggtgggcacggagtgcacctgctgggagcagacaccctgaggggggacggcttgtgtcctgagttgtggctgtgtgggttgctgtggttggtggattggggtgactggtcatgaaaggaggggttcttggctgtggctgtaaatggagactcctgcccaggcagccaccaccctctcctaggctgctctgcgcgtgttcactgtagcttgtgggacttaacatttcttcaggagtttgtgctggtcccagtttcccagcaccttccctgaaatcttgttctggcggggtccctagctaaagggaagctgggagcctggtcccgcctgttccgagccgcctacccctttggtgctgacccgcatccctttcagtgcatcatcgaggagtcgggagagcatatcatcgcgggcgccggcgagctgcacctggagatctgcctgaaggacctggaggaggaccacgcctgcatccccatcaaggtgaggcgccagtgaccagccttccccacgccccaccccggacacctgccctctgctttaaagctgagctgagctaggctctgcagacgcctagacttgatctcggtcttggtctcagcttcttaagttcctcaagtttcttctttgcagtcttccacaggcatgtggggctgtttttgttgttgttgttgttttttttgagatagtctcgctgtgtcatccaggctggagtgcagtggcgtgatcttggctcgctagaacctccacctcccgggttcaagcgattctcttgcctcactcagcttcctgagtaactgggactacaggcgcgtgctaccacgcccggctaatttttttttgtatttttagtagaggcggggtttcactgtgttagtaagtcaagatggtctcgatctcctgacctcgtgatccccctgcctcggcctcccaaagtgctgggattacaggtgtgagccaccatgcctggcccagggctattttttttttttttttttttttttttttgagacaagagtcttgctctgttgcttaggctggagtgcaatggcgtgatcttggctcactgcaagctctgcttcccaggttcacgccattctcctgcctcagcctcctgtagctgggacttcaggcgcctgccatcatgcccggctaattttttgcatttttagtagagacggggtttcaccgtgttagccaggatggtctggatctcctgacctcgtgatccacccgcctcggcctcccaaagtgctgggattacaggcgtgagccaccacgcccggcctccggggcagtttttgagttacatcctgctgtcttctgtccacaaacaacacaaatgctctggaggggttgggacaggcctgctccagacctcgtttcttccctgttaatgcttaaaattccacaagcccgtggtttctgcgccggagagctcagtggagcccctgctccttgtccttgtctggagtgagatgcgcttggcactgcaacactgactccgcttcgttctgattgacgtggctctaccaggctgtatgaggtccgccttgctaggaaaagcttttaaggatgcgtctgtgtgtaaggtcacctctttctccaggcaagagtgggacttaacctctttttgcagaaatctgacccggtcgtctcgtaccgcgagacggtcagtgaagagtcgaacgtgctctgcctctccaagtcccccaacaagcacaaccggctgtacatgaaggcgcggcccttccccgacggcctggccgaggacatcgataaaggcgaggtgtccgcccgtcaggagctcaagcagcgggcgcgctacctggccgagaagtacgagtgggacgtggctgaggcccgcaagatctggtgctttgggcccgacggcaccggccccaacatcctcaccgacatcaccaagggtgtgcagtacctcaacgagatcaaggacagtgtggtggccggcttccagtgggccaccaaggaggtgaggcacggctcagcatgtgcagaccacacccgtttccaggctctagagggacctcatggtcctgcctcccgagacagagaccctaatggggccaaggcgggcaaggccccaggtccccctggtggagacctgcaggacttggcaggtggagggcaagcagccgaggtgtgtccggcccttgacggtggctctccccctcccccagggcgcactgtgtgaggagaacatgcggggtgtgcgcttcgacgtccacgacgtcaccctgcacgccgacgccatccaccgcggagggggccagatcatccccacagcacggcgctgcctctatgccagtgtgctgaccgcccagccacgcctcatggagcccatctaccttgtggagatccaggtgaggtctacccgcccaccgctgaccctgccaccgtcctgcccagcggccactgacaggttttctttcccttctggcagtgtccagagcaggtggtcggtggcatctacggggttttgaacaggaagcggggccacgtgttcgaggagtcccaggtggccggcacccccatgtttgtggtcaaggcctatctgcccgtcaacgagtcctttggtgagtgcctgcccggtgtggcctgcagagcctggcaggctggtttgggggacagaagcccagttaagcttagcaaggtgttaaaggaggcgtcctgatgggagcaggtgatggatggagcaggtggtccagtttctgacagcttgtggaccccctaaatcactgaattcccaggggaggggctctcctatccccagtgtgagaagggctctgggcctggagctctgaaggcctacgccctgggccggtagagcagccgagctgtagcacagggttgtcccaaacgagcagcggcatgaggcccatgagtggcctgctaggcccttcgtgaagtgctgggcaccaggccgagtgtctggtctgcagggtgactcaggctgaggaactagcctgagctcctgacaggactttccttctgccctgccaccttctcgatggcccagtgagcctctcgcttccctctgcaggcttcaccgctgacctgaggtccaacacgggcggccaggcgttcccccagtgtgtgtttgaccactggcagatcctgcccggagaccccttcgacaacagcagccgccccagccaggtggtggcggagacccgcaagcgcaagggcctgaaagaaggcatccctgccctggacaacttcctggacaaattgtaggcggcccttcctgcagcgcctgccgccccggggactcgcagcacccacagcaccacgtcctcgaattctcagacgacacctggagactgtcccgacacagcgacgctcccctgagaggtttctggggcccgctgcgtgccatcactcaaccataacacttgatgccgtttctttcaatatttatttccagagtccggaggcagcagacacgccctcttagtagggacttaatgggccggtcggggagggggaggcgggatgggacacccaacactttttccatttcttcagagggaaactcagatgtccaaactaattttaacaaacgcattaagaggtttatttgggtacatggcccgcagtggcttttgccccagaaaggggaaaggaacacgcgggtagatgatttctagcaggcaggaagtcctgtgcggtgtcaccatgagcacctccagctgtactagtgccattggaataataaatttgataaggtggtgactctgttctgcatttttcacggtgtcttcgcaggggagcggggctgcccagtactgggctccctggagcctagaaggggacccgggccctagttaggtgcagcctggggctgcctcagtgttaggtggaacgttctggaatggtgggaatgccctacccctgtgtcattcagagaagcagctgccagctgcgcgggtctgctgagcatttgaagtaggatcagtgcggcaaggaattacgagatgtcactttgaacgcatttggatggccctgtggagcgaggggctctggattgaacttcgcaggtttcagcaactttccgaattgctgacgagctcacaagttctatctgccatcaggattttctgtggtcaccccagtcctgactagtttattagaaacccattttttttttttttttttttgagatggagtctcaccgtttgctaggctggagtggaatggcaccatctctgctcactgcaacctccacctcccgggttcaagcaat

SEQ ID NO: 11269 - DNA, 9156 bp, Homo sapiens; identical to SEQ ID NO: 11268

SEQ ID NO: 11270 - DNA, 1254 bp, Homo sapiens
tttggtccactgctatatctacaaaacccctaacaatgcctggtgtatagatgctcagtatgcatttgtgggatcagtgattccgatgcctgcttcttataaagtttttatttagaaataattacaggtaaggagttgcaaaaacagtatagtggtcgcgagtgtcctttttccctcggcttctcccaggggtatcgtcttacgtaacaatgtccaaacagggaaattgacttgggtataatccacagactctattcaccttgtaaattggttttaatagaagtactggacaacttgtaagctaatatcgttgctatggttctcgttctcagctaaaacggcgctctttactttgtgcacctgaacactgcacaccgagggcgaccaccgcccccgagatgcccagcttctattctagagcgccgcgccggcgccgaatgggttaacgggcggggggacacgcctccgtgcgcttgcgcggcgtcccttcgccccgccttcgcagcgcagtcacatgacccgcccaaccggcgtccgcctataaaaagctgagtgttgacgtcagcgttctcttccgccgtcgtcgccgccatcctcggcgcgactcgcttctttcggttctacctgggagaatccaccgccatccgccaccatggtgagtaaccctgcctcgctggtgccccggagcggcggcggggcctccgcggggcctacgctgcctagcctgggacgctggggccccccgtgccaggaggagacgtagcggcggcggggccggaggacccggggctggggaagcggccgccgccatgtctgtgcgccgcgctgttcaccgagccctttctccgtttccgagggcgccataaccttgcccagacctggttggagctgggttgttagcggggatgggggtggggaatgatgatgtggcaggcgtagtaatggcgggcaccgcggtggaagcggggagacagggaggcgccttatgtaacccgcgggccgcgagtttgagatcgattttctgccgggggactaggggcggcagggaatggcagaacgagcaaagcgacacctgaaaggctccccttttccttccaaataccttctcctgatgctgttaatcgtcgaccttaggcacttgtccttcctatgactcccagatgtacaaagactcttattgagacacgaggtgtaggcttgtggcagttagggccgttccggctccccgttatttcctggggtgggtggccttgt

SEQ ID NO: 11271 - DNA, 1220 bp, Homo sapiens
tttttgtattttttagtagagacggggtttcactgtgttagccaggatggtctccatcccctgacctcatgatctgcctgtctcggcctcccaaagtgctgggattacaggcgtgagccaccgcgccaggccgaggccaggggtttgagaccagcctggccaacatggtgatagcctgtctctgtattaaagacacacaaaaaagaaaagaggctggaggcagggcatgtatcgctttggtgcacagctggggaagctggggctggaaaggcgcgacatctgaccgccttcacgtgcaggtgggaatgtgaggctgggggagcagggtggaacgctgcttctcaagggcctcgggcccttgtcagtgggcacaggaacccccgcacccccactcacgagcgccctctccttccccactgctgcaggtctcggcgcggaagatggccggcggcgtggacggccccatcgggatcccgttccccgaccacagcagcgacatcctgagtgggctgaacgagcagcggacgcagggcctgctgtgcgacgtggtgatcctggtggagggccgcgagttccccacgcaccgctcggtgctggccgcctgcagccagtacttcaagaagctgttcacgtcgggcgccgtggtggaccagcagaacgtgtacgagatcgacttcgtcagcgccgaggcgctcaccgcgctcatggacttcgcctacacggccacgctcaccgtcagcacagccaacgtgggtgacatcctcagcgccgcccgcctgctggagatccccgccgtgagccacgtgtgcgccgacctcctggaccggcagatcctggcggccgacgcgggcgccgacgccgggcagctggaccttgtagatcaaattgatcagcgcaacctcctccgcgccaaggagtacctcgagttcttccagagcaaccccatgaacagcctgccccccgcggccgccgccgccgctgccagcttcccgtggtccgcctttggggcgtccgatgatgacctggatgccaccaaggaggccgtggccgccgctgtggccgccgtggccgcgggcgactgcaacggcttagacttctatgggccgggccccccggccgagcggcccccgacgggggacggggacgagggcgacagcaacccgggtctgtggccagagcgggatgaggacgcccccaccgggggtctctttccgccgccg

SEQ ID NO: 11272 - DNA, 1105 bp, Homo sapiens
ggccgtgggctgctgggtagaaatgcctggtgcttgccaggagtggtggctcacgcctgtaatcccagcactttgggaggctgaggcaggcggatcacgaggtcaggagatcaagaccatcctgaccaacatggtgaaaccccatctctactaaagatacaaaaattagccaggtgtggtggcgcacgcctgtaatcccagctactcaggaggctgaggcaggagaatcgcttgaagctgggaggcggaggttgcagtgagccgagatcgcgccactgcactctagcctgggtgacagggcgagactctgtctcaaaaaaaaaaaaagaaatgcctgctgcacagagctgtgctcccgggaggggctgcgggaggggcgcattgctggggcgaggggttcagagccggggctagggccgctgcacttgggtgagccaggcctcttctcttggtggccagattcgccgttacaaagcgaacaaggacgtaatggagaaggcagcagaagtctatacccggctcaagtcgcgggtcctcggcccaaagatcgaggcggtgcagaaagtgaacaaggctgggatggagaaggagaaggccgaggagaagctggccggggaggagctggccggggaggagctggccggggaggaggccccccaggagaaggcggaggacaagcccagcaccggtgaggggcgggtggggtgggccctgtacctcagtctcctcagctgaagaaacagatgctttgcagaacattccagaaggggagtacagctctactctctgccccaaacctgccagagtgtcatgtcctgttggggtctccgtgcagacccggctttaatccctggggcagccagtgaggggcattcaggtcctaccgtgtgccaggcagccagcatgcaggtaacttggggctcacgccagaggggtgacggggacagtgcatgacagcacacgcctccaccgtctcccaccctgggacgcccagagaggggggtggctctgtgcagcgggggcaaagagtgggggcattgttcagagaggcagtcggtggaggctcgggggcggaggcctcaggtgcccttgcttgcctggtggg

SEQ ID NO: 11273 - DNA, 1215 bp, Homo sapiens
tccatgctaggagcttctcccagtggcgacaaccacaaatgtcccagacgtggcccagcgtcccccggggtctgaatcatgtttggttgagaagcagtgacagaggtgacacatgttcactgtcacaaaagctgccgtaagcacgaagtattaggaaaaactcccaagacccccatgtgtgcgtggtgccccgtgatgatgttttgtgcttctgggtgcttcctgcatgcagtgccaaaagccctcgctagaggggcctgagaccctgagggaagggactggggtgccgcttgtgagcgggacagccccctggcatggcccaggtatcatggctctttactctgatgcagattgccccccccccacaagggctgggacacagtgtttggttcatcactggtgcccacagatgcccacttggcatttggtggctaaacagcgtctgcctctggtgtccctgcagatggaggacggccataccctcttcgactacgaggtccgcctgaatgacaccatccagctcctggtccgccagagcctcgtgctcccccacagcaccaaggagcgggactccgagctctccgacaccgactccggctgctgcctgggccagagtgagtcagacaagtcctccacccacggtgaggcggccgccgagactgacagcaggccagccgatgaggacatgtgggatgagacggaattggggctgtacaaggtgagcctcccctccgcagctgctctggggttggacgttctccctgccattctggtctttgcatacccagggctcacaggaggggcttcccacgcgcctctctagctctggctgggcagaaatggccaaggggtggtttcctgcacgttccttgaggggaacatggtaccctgggattcctttgtggacctctagagcagagtcctgttcggggcctgcaggtgtcttctccgtgaagcttgcagtggctgtgacgtttctgaacttgctgctaccatgtaagatcaggaaatgtcacagaaagatctgggtttccagcttttttatttttttattttttttttggcagggtctcactttgttgcccagcctggggtgcagccgtgtgatcacagctcactgtagcctcgaactcctgggctcaagtgatcctcccacctcagcctcctgagtagctgatgttataggcatgtgccaccacgcccagctaattttat

SEQ ID NO: 11274 - DNA, 1147 bp, Homo sapiens
taatttttgtattttcagtggaggcgggggttcaccatgttggccaggctggtctcgaactcctgacctcggcctcccagtgttggtattacaggcgtgagccactgcgccctgttccgtttcatgttgcttctgtgagtgcagctttgattgctagggggcgtagctgagctgttgccccaggcatcccgagaacccgtggtgttcaagtgctgtgagtagatttaggggcctcggcaggccagaatgttccagcgtcctcgttccttgcagggatgattctctgaacgactgtcggatcatcttcgtggacgaagtcttcaagattgagcggccgggtgaagggagccccatggttgacaaccccatgagacgtgagttctgagccagcctttccccatcttccgcggtgggcacggggcgggggctcttgtcccgtctctggcttggccgggccccgccggagctgaccctgccgccccgtgcccagggaagagcgggccgtcctgcaagcactgcaaggacgacgtgaacagactctgccgggtctgcgcctgccacctgtgcgggggccggcaggaccccgacaagcagctcatgtgcgatgagtgcgacatggccttccacatctactgcctggacccgcccctcagcagtgttcccagcgaggacgagtggtgagtgcggccctgcccgccgcggggagaccagagcgccccctacaaatccccagaggggcactgaggagatacaggagaggggcaggcgcgggggctcacgcctgcaatcccagtgctttgggaggccgaggcgggaggatcacttgagctcaggagttcaagagcagcctgggcaacacaagaccagcctgggggacgtagagactctgtttctttttttgtttgtttttttgagacggagtcttttttcttttctttttcttttcttttttttttgcggcggagtctcgctgtctcccaggctggagtgcagtggcgcgatctcagctcactgcaagctccgcctctcgggttcacgccattctcctgcctcagcctcccgagtagctgggactacaggcgcccgcctccacgcctggctaattttttgtatttttagtagagatggggtttcaccttgttagcca

SEQ ID NO: 11275 - DNA, 1560 bp, Homo sapiens
ccacagtcctgggagaggtggccaggagcaaacctgatggtgtggatggcacttctcacgcgcctgctgtgtcttacaggactgcctggacagatcctttcgggcacaggtgttcagctgccctgcctgccgctacgacctgggccgcagctatgccatgcaggtgaaccagcctctgcagaccgtcctcaaccagctcttccccggctacggcaatggccggtgatctccaagcacttctcgacaggcgttttgctgaaaacgtgtcggagggctcgttcatcggcactgattttgttcttagtgggcttaacttaaacaggtagtgtttcctccgttccctaaaaaggtttgtcttcctttttttttttatttttatttttcaaatctatacattttcaggaatttatgtattctggctaaaagttggacttctcagtattgtgtttagttctttgaaaacataaaagcctgcaatttctcgacaaaacaacacaagattttttaaagatggaatcagaaactacgtggtgtggaggctgttgatgtttctggtgtcaagttctcagaagttgctgccaccaactctttaagaaggcgacaggatcagtccttctctcgggttctggcccccaaggtcagagcaagcatcttcctgacagcattttgtcatctaaagtccagtgacatggttccccgtggtggcccgtggcagcccgtggcatggcgtggctcagctgtctgttgaagttgttgcaaggaaaagaggaaacatctcgggcctagttcaaacctttgcctcaaagccatcccccaccagactgcttagcgtctgagatccgcgtgaaaagtcctctgcccacgagagcagggagttggggccacgcagaaatggcctcaaggggactctgctccacgtggggccaggcgtgtgactgacgctgtccgacgaaggcggccacggacggacgccagcacacgaagtcacgtgcaagtgcctttgattcgttccttctttctaaagacgacagtctttgttgttagcactgaattattgaaaatgtcaaccagattctagaaactgcggtcatccagttcttcctgacaccggatgggtgcttgggaaccgtttgagccttatagatcatttacattcaatttttttaactcagcaagtgagaacttacaagagggtttttttaaaatttttttttctcttaatgaacacattttctaaatgaattttttttgtagttactgtatatgtaccaagaaagatataacgttagggtttggttgtttttgtttttgtattttttttcttttgaaagggtttgttaatttttctaattttaccaaagtttgcagcctatacctcaataaaacagggatattttaaatcacatacctgcagacaaactggagcaatgttatttttaaagggtttttttcacctccttattcttagattattaatgtattagggaagaatgagacaattttgtgtaggctttttctaaagtccagtactttgtccagattttagattctcagaataaa

SEQ ID NO: 11276 - DNA, 1281 bp, Homo sapiens
gggacccggggggctcctccccgctctgcagcctggggacactgggctgggaccagaatccagctttcttttaaaactctcagtgtaactgtatcccgtgacatttcattttttttaaatagtgtatttttttttccatttttttttttaagagaaacaaacaaaagactcgccagtcaatgactttcaaagagaactaactttggcttattcatattctgttcaaagacagtctattttttcactgtagaaagcgtccttgtgtgatagttacgttcgcaaacgcgcacgccaggcccatggctgtaccttggcttttttttttttttttttttttttaatttttcctaccatcagaaagtgtgctttgctcacagaagaatgggatgtccttttttctttcttggctttttttttccccctttttgtttcatttttataaattaaattttcagacatatcaaatacagttctgagggtaaggtcatgggggagctcggacccagtggcgttgggtgcggttgagggggacgctgctgtaagaggagagagatgacagtggtcctcctctgagagcctgagctgtctccccgtctcccgcccccaaggagacagagaggatcctacttcttcggggacagtggctgtatggctgtgctgccccacatcagggaccctttccccctgggactgtggggcagtttgggagcaaaaccagaaggacaggcccccctctacccgcctaccctgagcaagcgagttgttcctctttgtacaagggcaggtctgcggttactttcaacactgtttattccagcggaagcagccgggtggttttcccacccccgtgtatgtagatatatcgactttgtattaaaggaagatcgtctgaccccggcccattgtggagtctttgttgcgcccctgcctgtccagtttcatccctggggtggaggtcggtggggtcctggagagctgatctcgtttccttgtgtgaacagtcagaggaggagttggcccagagaggtggtggtgcttgtccaagaccacacaccgctgaggcgggtggatcacaaggtcaggagtttgagaccagcctggccaacatggtgaaacccagcctggccaacatggtgaaactcaactctactaaaaatacaaaaattagccaggcgcagtggcgggcgcctgtaatcccagttactcaggaggctgaggcaggagaatcgcttgaacccaggagttagaggttgcagtgagctgagatcatgccattgcact

SEQ ID NO: 11277 - DNA, 1189 bp, Homo sapiens
gtgattccatctgttctatcagtggttctcaattggggtaattctgacaccctgaggatatttcttattttcatgagtactactggtactgcctgggtggggaccaggcatgctgctcagcatcctacagtacacagaacagcttgtctcagagaacaatccagcgccaaatgtcaatagcactgagattgagaaatcctggcaaaggaggggagggtgttcctggcagagggtgccacatgtgcaaaggcccggggctgagagcttggcccacgcaagcaactgaaagtagggcagtggcccttgaaggagatggagggaagaaatcaggagaggttagtggatagtcccgcagctttgtcaagggatttgaatttgtcatgagactggtggtttccccacatgcaaaatgggatcaccaggaggggaagtggtgcacccagcagccattcctggcaggcagtggggtggtaggtgtagctgtcactggcttggtcctgaccctcccgggcagcatcaggtgagtaccacgccgggtctccctgccggccctgggctcatacccccaacgcctgcaggcagcagaaggcctacatcgcgacacaggggccgctggcggagaccacggaagacttctggcgcatgctgtgggagaacaattcgacgatcgtggtgatgctgaccaagctgcgggagatgggccgggtgagctaggggccacagcagggaagggcgagggccagactgtggctcagacagcgctgaccacggccgccatctcctccacaggagaagtgtcaccagtactggccggccgagcgctctgcccgctaccagtactttgtggtagatccgatggcagaatacaacatgcctcagtatatcctgcgagagttcaaggtcacagatgcccgggtgagtgaagagacagactggcgggaggggctggagccttagtgatctggaaagggctgccctggttggtgatggatacaaaggccaagggttaggcataagcattgggaatcaggagaagtgtcagctgaccagttggccacttgcttctactgccacataggtggaagagagggtcttatctctgtgctgaccctgcagtgtctccactcactagggaacatggccccaggggatgatattcaaggaagtgaatggggctttcctctggaag

SEQ ID NO: 11278 - DNA, 1230 bp, Homo sapiens
cacttctggtttttcggcaagattgagaggtgttatacaaaataatgaaaagcttccagggtggggtctggccacagtcggtacacaaccagtgactgtagaaagcccagcaggcagactttggaatctggtttccccaccgttgacgcggggtggcgggtggggagtgacagttctgaccacctgaggggttgtgagaattaaatgagataatgcatgcattaaatgagatgatacatgcgttaaatgagataatacatgaaacatgggctgagggtgctgcacctgcagtaggcgtgcagaaaatgaagtttattatcactaatgccctcagcacagcgtctggccatagtaggcacgcaacacatagagacttactgattcataagcctttaacacacagacagttccctttaatatgcgggaactctcagtgttattcagcaaagaccttaacatactgcctggcacacagtaggtgccccattaatacagccactgttttaaatctacatatggattggcacagtgctgggcacctagttggcactcagtaaatggaagctattagcagtttataacaagcttagcctagtgccaggcgcacagtaggtactcaaaacatgggtggcaacaattattgttctgcaaacctcttggcacaatggctgacatacagtaagtgctcaataagtggcacttgctataaagaggtggcctaagtgtgaggcacgtagtagatgctcagatgggcaccattatcagtttgaaagggtgtgggatagggctggttacacagtttttactgaaaacattcacttattatctgcaaagcccttggcacagtgtgtgcaaatagtaggtgctcaataagaactattactatttttatataaggtattgagtgcaatgcctggcacacggtgccaggtgctgttacagttatccaataaagcccttagcacgatgcttggcacacagtaggtgcttaagaaatgaaaactattggccgggcgcggcggctcatgcctgtaatcccagcactttgggaggccgaggtgggcggatcacgaggtcaggagatcgagaccatcctggccaacatggtgaaaatccgtctcccctaaaaatacaaaaaattagccgagcgtggtggcgggcgcctgtagtcccagctactcgggaggctgagacaggagaatggcgtgaacccgagcagcagagcttgca

SEQ ID NO: 11279 - DNA, 1185 bp, Homo sapiens
ttttttagattctctctttctttttttaaattgcttttgctttgttatttcatttgttcttcctggttttgttttggacgtcgataccgtttttctgtccttgaataattagctccccccacgctcatttccccattgtgttctgtttccatgacaactcagccttggcatcttacctgtgcctcgctgtgggtgccggcggctggcctggaccgcgtccgctggctggccggaccccattctccccccacacccccaccctccacccagccctaccagaaagccacccgccccccccatctcacggcacctcgcccctcacctccactctgtgtgcatggcccttctgtctccccatgccccgactcctcccctggagcagtaccctccactccctccatcctgtctccagtgcgacttctggacttttcgtggggcttctttttccgaagggctgccagcttccggaccccactcccacgcctgccgacgtccccccttctctttgcctcccgcccggattcaggaaggcaggggttgggatttccagctaggaaccgaggctggaagggagggagttggggccacctccctttatccccttgaacctcctcctcagcatcgtagaccagaccccctgagaccaccccctgaggctgcacctcccaatcccgtatgaaaatcagaggcaggtgttgatggggatcctaactgagcctccagtccgtcatctgtgcagttgaaacaagactccttcacccatccaaagctggggacgcacccatgtgtcttctttaggacctgagactgtcacccagggacaaccccttttcctgctagaaggatttattaggttcacccgagtccttcccacagcagttaaacagcccccgtgggccagcagtgctctttgcaagttcaggtgcccactggcctcctccccttccccctgtcctggaacccatctgacttccgaaaacggagcccccgaaatgcatcctgctgccttcatggtctttgagagaaggttgcatccacttccccgctaagaaacgcacagaacatgtccctgttctctcaacgttcaagttcattcccttgtttattattattaattattattattattattattattaatatactatttattattctgccagggctgtgatgtgacaatgtggc

SEQ ID NO: 11280 - DNA, 1108 bp, Homo sapiens
agccacagtggacttcgtggacacgttccccaggtggagcatcatctgtggccaagcaagcatggctgcgcagcctccagccagggccctgcccgccttacttgctctaccagctccatgctgtgtggcctcaagcaaagccctgccctctctgagtcttcttcacagtgcagtgtacacagcaccactgcacacagaaggaactttacaactctcaatacacgcccatgatcacacgtgcacattgacacattccgcatgtcttcacatgcctttgcatgcctgtcacatgggcttgcagacatttgtcaccctcacacatgcacacaacaccctgttcttatatgtacccaaatctggtccctgtctgcggcgcatttatactggacaccgacacacgtgcacattcagcctgcagcaattctcccagtcacccccaggatcatggggctgactgccattcccctacagcccagcctagcccagcctagacaggaaccttcctgggaccccagcctcactctgttcttttttcccctgcccatggcagacgattgagtttgatgagagtgcaggggcagtgctgaggatccagccgctgaggacaccgcgggatgaaaacgtgtacgagtgtgtggcccagaactcggttggggagatcacagtccatgccaagcttactgtcctccgaggtattgggctcctcagggcgggcggaggataaactgggccctgggctttggggacaagcacaaaaggaatacatgaaagttaccccaaaccctcctgctttgtgttttttgggaggaccttgatctcccttatccaaccagtaacagtctcagggcccagcgcctactggtggggatttattgtgcctttgcaagaaagaaaggaattgagagactagaatcatcctaatttataatcttcatcatgtgcttctgatgacaaaaggctgatccaactcagatgggttcaagcgagaaaggtaattgatgtgcagaattaaaattccatggagtggctggcttcaggttcagctggatccaggggctcattgaattttctcagagctcactctctgtctcttggctttgtttccttc

SEQ ID NO: 11281 - DNA, 1135 bp, Homo sapiens
ggccttgtaaactgttctaggatctattatgctttggtacgaaatccttctgatgacagttcattatggtcatctgtgtattgcagcagtacatggccagggctgctggcagggcaggaggtcagctttggggcgagagagatggcaggtgcacttgacagagcccctcggggtggaggctcacgtggtcttcctgagcggaggtggctgtgtagggctccagaagccatctgcaggcagcccataggactgactgcttaactaatggctccctctttggaaaaccgaggccgcttttcatcaggggaggtgggtgcatgggacaaaacaaaacaactgtgcagtcactggggtcaaatcagaccttgcctcctataggagagaacactcttggtgaaagtcatcctggttctgtgaagtgctaggggccagctcccacaaaggtgatagatacatttggggtgggggatccctctatctctgtctcatgtcccctcacaggcgagatgatgcctattggccggaagccaagcgggccgccctggatgagcgctaccattctgactttaaccgccaggaccgcttccacgactttgaccacagggaccgcggccgctaccccgaccactcggtggacaggtcagttgggcccctgctgggcgtgcgggttttctttttcctggctcattctgactgagaacaaggactcctgggctctctgaacccactccgttcatcagatgtatgctgagtcagacccgcaggtctcctgccttcagttagggaaattatgcttttcattgggggcctgatggtcctctctttgtgaacaagcctcttcttccccttacggtttgatttaaattgccttttcaggagagaaggttcaaggtcaatgatgggagaacgagaaggacaggtaagtctgaagctacagtggtagccacagaatttcccatagaatgggttcttttcccttcagcgtgccttcttcctgccctttctttgagcaagaggcaaaatgaggaaagagaaaagtaaagcactagaaaagtctaggtttgtggaatggaaatttgggattatttggggttagtcttggctgtcagtccaaacagttactctgaagctgttt

SEQ ID NO: 11282 - DNA, 1226 bp, Homo sapiens
cccagtggggtgcccggccaagcaagggcttagcagcagtggggtctgaacagcctccctcctctgtctcgcaggcctgaccgccgctgcctacagagtcacactcaatcctccgggcaccttccttgaaggagtggctaaggttggacaatacacgttcactgcaggtgagcacgctgggctgggcatggctgggccctctcctggcacagccccagctctcagagcacatttgacggctgcctcttctctctgactccccagcccgtgtccacagtgctggccatccggagaaagtggggtgttcctttatcaggaatacatgtagggtggggaggcccaggagaacagctccaggactggggccaggaggctgccatgcacagcgagcagccgactcgtggcatctctctccatccagacactggcagtgagcgcccaagaggctcctgctgtgcccgtctcgaggcccttgctcttcccgtctaccccgcagctgctgtcggggccgtgtttggcctcaccacctgcatcagcgcccatgtccgcgagaagcccgacgaccccctgaactacttcctcggtggctgcgccggaggcctgactctgggagcacgcagtgagtggccccctccccacccccaccctcctcccagcctggcagaatgacccctgacctctgctcatcctccaccctctctgttccatcccggacaagaagtaaagcagccttcttgaacaccagccatttcagtcatagcgacagctgctgctgctgcttaagcacctactgtggccctccctgacctgccctgtcccctccccaccctcccctcctcactctgctccagccacacgggcctcctcactgctcctcccacatgccaggtacagtcctgccccagggcctttgcatgggcagtgcactgcgtggaatgctgttcccctcactgtcctgaccaccctgtgtacaagccagcatccccgccgccctcgctctgtgccgccttccttctgtgtgccttgtcagaggacacaggtcaccaaggtcaccccctgtctctgccactggcctgtgagtcagagaggaggatggatggagtctcgccctgccatctctctccctgcacctggagccctgcaggggagctgcccccgcaaccttcactttacagaaaagggtattagggctcagggagggaattaagtggcccgaggtcacctgg

SEQ ID NO: 11283 - DNA, 1675 bp, Homo sapiens
ctcagcaccaggcccagactaggcagcccctggtctcctgcgcccacgcccagcaggagagtgggacaggcaggccagagggacccccgggccccgtctctgtcccatgcgggtgggaggaccccagaggccccagccctgtggggagcaggccccaggcccgtcggcgctgggaaagggaggcacagggcagaggctctttcgcctggcccgagctgggggcacctctgggtaacggcaggtggggaggacaggtcagcctggagcagaggccgaggtggggtccacaggctgccatgtatcctcggtgccctgcctggcgtgccggagcagttctcggaacgtgcacttccttctctccctctcgtgccctcctgatgatggacactgaccctacccctccctccgcagatgacatgggcgatgagcagcgtggcagcgaggcgggcccagacgcccgcagcctgggtgagcccctggtaaagcgggagcgcagtgaccccaaccactccctgcagggcatctagcagccccggccggcgcctcctcgaggttccaaaagatgccgcctggtcactctgggaacctggatttcaccggctccaccaaattagtgcctcttagatgatgtgatgtttactttgactcaagcgggggctcccggggtcagtgttcaagaaggaaagcagttgttgaagctacagaagcccaggccagggctcccactggctgtagctgtgctctgggtccccaggtccctgcgcagccaccagggccccaccagaccatgggttccttattctggacaaaccctcctctgctggaaccctggactttggccccagtccctttaagagctgaaagggctgtgctgagagcactggcctctgcactcaactggaaccaattttcaccatgattttaaaaattaaaaaaacctggcagagcccgactagaaagggacggcctctcccctcctacctgccaccgctggggaggcacagagctcgccagcgtccctggagtcccctcaggaatggaaagtggagtgcccttgtctggtagcaccatgtgggagggacccagctgggcgcagcgccctgtggccttttagatccagacctccctgccggatgccccgaggcgggaggccggctgtgctgcaggaacccatctccagatgccaaaggacttgaggggcagctgacaatcgctgtgtcccggcagatccgcagctcgaaaaagaacaagccacagaaacgggctcgctcgtgccaggacacagcagtgtctttcaaaaaatcaaaaccagaagttttatcagcagcaggaaggatgtgggactctgtccaagttcaccgtcaccatcaagccactggctgtggaaggagtttgtccaacagggtcagtgtcacagccacaacttcagaaagcagccatcccgcgtgtcgtccaaacagcagtgcctgcgtcccgctccacggagtcttccagaacacctccctctgaactaatcccggagcaccccacccccagcgagtcccacctggacctcttcaaagtcaaaactcttctctcgggacaaacaaatattcgggactttcgaagccctgaacttgagacaccaagtttgtctccatggaaacacgtagccgctgcagttggacagctgcgt

SEQ ID NO: 11284 - DNA, 1818 bp, Homo sapiens
gcccctcgcccagccttgggaccagcccccactgctcggcgggctgtgcggcgtcgctgccccagcctttctgagcagcggatcgacggctggggggcatctccagcctcccgaatggttcagaacacaccctccgcccaccctggacctcagaaggccctgcctgtgtgtctgcgtcgtcctccgtgtagacctagcgccggctcctccccggctcgcgctgcgctggggtctgtgctgtatagttctctctattatatatgtgtgtgcactgtctggtcaagagcagtgtccatgtgcgtttctgtggcagcagtgcacgtggggtgggtggggggtgcgtacggtggggcttgtaggttaagatgtctctgcggtggtgtggggctggaggccgagccaggcacggcagctggccctctccaggcgcatggaggaattctccctttgccgttccaaggatgccgccgcctcctaccggggctcccgggggggtcagccaacactacaaagggcagcgagtcctcagggcgcccgggagccaccagtctgctctcgggctctactcagactagcgccaacagtctccgcggacagactcgcatcagccgccctggggctcggcctcctcccataggctcctcttcctctctttcattcaagtcttcaaactttgaaaaaaatatgagcttttgccaaataagacgggatagtttatggagttttctgaggcgcattgaactctggtcagcccctcgagcgtgggctcggccatcagcaggcccggtgggttggccgggctggccctcccaggctgcctttctctctggtcgcggcctggcccgccccggcctccaccgccgcaattcatgctggtgccgcgcccgcagccccactcctggtatgcctgagattctccaggggccaagccggtcctccttcccggcccactcttccagggccaggacgctcccgcggagccagcccatcgtggctgggggtcccaggggctggaggcctgcctggttagcctctgtttcccagacattgactcgaggcgcctccagtcctctcaaccccctgactttcaagtcctttcaagtccttgtgccctgaccaagttatgaggaaaagagggctgagggcctggaggtgggctcgcaccccctcgaacccacctagatgtctcctcctccccagcctatgagttcagacttggggggctccatctgtccctccctgaggtccctcatcttgtccctgctctgattctgtcagcagatcctgaacactccttggtggggacccatgcctccaaggctgcccccaatgccagctgtcctggggaaactccccagaactctcggggaaaggcccgagaaccttcggaggaagcctccgggactcctcgccacctgctctgtttctctcccggccccactgccttcaggtatcaggaagagggcaggcccctgtgccccctctccccttcccagggcggccaacaatactccaccatggggcgcttcctttcttctctggaaactaagacattggactgaaggaactggcctgaggggggctgaccgggggcccgtgctgctgggagctctacgcacaagaggccgccggggtcacggacaggaacctcagcccagggtgctggcctttctccttcgcaggagtcccccaaaatccacacagcgactcgagcagccttccactcagccagaggagggtcgggctcccccgcctgctctcggtggtggcgtctggcccttcctgccgtttccaaggcctccggaagcaccaacccag

SEQ ID NO: 11285 - DNA, 1882 bp, Homo sapiens
gtgggtagcgccggaaaccccttcccctgcggggtgtgcccttgatgcctgcagcgggggccgtgtggccggaggtctccgggagtccccacgcaccgccagggaagcattcgctgggtccagaggttaaacgaagaggcctccctgcgccggctgcttgttcctgtgtgccgctgtcgtgatgctggggagcgctgagactcgcaggcgggacttctgaactgctggggagtcggggggcaggcagacagcgcggacggtgggcaccggcccggccgccaccacctcgctcacaatctggccacttgggaagaaaacgtctattttttccccttctctgcatcacttttttggtttttgttctttttattcttttattttttaaacccatgatcttttttcctgtgtccaagtgactgtgttgcaggcggcctggctctggcagggactggtggggacgcggggagcggcccaggcccctgccccgccgggctcagcctcccatgcgctcgcgcttgcctgtgtcccgggcttgtctgtgaagtgggcgtgaagatcgttgccaccttccaacctacctcacaggggtgttgtggggacaccatgatctctggattgttcatgtcgtcgtgctgcgccgggagccaccgccctccggagacagggcagctcccctacgaccctagcgcctccgccctccgcggcccctctcctctcttcctgctctgtccctccttctccatcagggagcagcgtgacttcagcgagtcccgcgagcacctggctagacagttaacaagcacgtccttccagcctgagccagcgcaggtttgggagggggcttcctggccccccccacggtgttccagcccctcctctcttccgccccctagtctcccacccttccctccccgtagtgaccaattcctatctcttccctctccgcaggctcaatgaatcgaatgaatgtgaacttcttcatctgtgaaaaatcttttttttttccattttgttctgtttgggggcttctgttttgtttggcgagagagcgatggctgccgtggggagtactggggagccctcgcggcaagcagggtgggggggacttgggggcatgccgggccctcactctctcgcctgttctgtgtctcacatgctttttctttcaaaattgggatccttccatgttgagccagccagagaagatagcgagatctaaatctctgccaaaaaaaaaaaaaaacttaaaaattaaaaacacaaagagcaaagcagaacttataaaattatatatatatatattaaaaagtctctattcttcaccccccagccttcctgaacctgcctctctgaggataaagcaattcattttctcccaccctcggccctcttgtttttaaaataaacttttaaaaaggaaaaaaaaaagtcactcttgctatttcttttttttagttagaggtggaacattccttggaccaggtgttgtattgcaggaccccttcccccagcagccaagccccctcttctctccctcccgccctggctcagctcccgcggccccgcccgtcccccctcccaggactggtctgttgtcttttcatctgttcaagaggagattgaaactgaaaacaaaatgagaacaacaaaaaaaattgtatggcagtttttactttttatcgctcgtttttaacttcacaaataaatgataacaaaacctccccgtctgcgggtgctgtctgtctccccccctttccttccctccctgtagttttgaagcggatgtttgttctttatagatgttgtttaaaaagcctgataatggtgattgaaatttacaaactttgtgtttttttttttttaagaaaaatataaaatagtt

SEQ ID NO: 11286 - DNA, 1237 bp, Homo sapiens
cactcagtcaaggccaagacccaaccagccgtcaagaacatgtaccgctcggtgaggctgagctggacaggccactcttgctggggtgacgagggggaggggacagaggacactttgacctcccaaggatggagtattttgaccctggcagacactttaaacacaaatgatttaatcagaactgaaccagcagttaaaccattaacaactcttcccccttttattttttatttattatactcattttttgttggaatcctacccgcccccctccgccccgcccacggcccctttaaaattgacagccaagatttgctggcaaacattctttttgtccttggatgctacaattccaggttctgccttttatctcccaagctcagaagtttcctggggccaatttttgcagctcaaaattgtccgtgcgattttgttcttcaccgctttgaaacaggaacaccttgccctgttgctttgccactccccattttctttggggatgactgcctccaggaatactcattttatattagtcaaaggggtgaaagtttgcattgacttcttaggtggtgtatggggggtggtgaacgtatttgagacatgcagatggcaaaaaaaaaagctatcttaggggacagaaggctgagctctcaaatgcccaggatcccaccacccttgggtaattctctgtccactcctttataggccaagagtggcttgaagggggtgcagagccttctaatgtataaggtaagatcaactggccgggtgcagtggctcacccctgtaatcccagcactttgggaggccgaggcaggaggattgcttgagcccaggagtttgagaccagcttgggcaatatagtggggccttgtctctacaaaaaaatagttaaaaattatctgaatatggattgcttgagtctagaaggcggaggttgcagtaagctgagatagcgccactgtacaccagcctgggtgacagagagaccctgtctcaaaaaaaagaagactgtggctgggcacggtggctcacgcctgtaaccccagcactttgggaggccgaggagggtggatcacttgaggtcaggagttctagaccagcccgaccaacatggtgaaaccccatctctactaaaaatacagaattagctgggtatggtggcgcacgcctgtaatcccagctacttgggaagctgaggcatgagaatcgcttgaacctgggagtcagaggttgc

SEQ ID NO: 11287 - DNA, 2914 bp, Homo sapiens
tgactgcttccttttcttcttctcttaagagttgtgggcttaagaatgggatagagtcataatggcaacctccaagccctctcaattcttgattaagaacacaggtagacatgaatcccaattgtctattgctatcttatttatatgattcgggaaaatacagcatgtaaaaatattgctgaggagcctcagtgattgggtacaagaagcaagagtacagaaattatttttgccaaatttattttgtaaatatgagggtctgtacctaaatttaaaaaaaaaacacgtagaactaggtattttgttctcttcttagtaaatttgtagtggttgtatactacactagctgcaattttcacatttttctaattcagaaaggtttttcttatattaggggaaaaagtatttattttaatatataaaatcactctgaaaatcactctcataaaaaatggagcgcatgtaaatttttatcaaagaaaaataaacaggtgaatgggggatagtgattttcttttttcagcacagtctacctcagtgtattgttaagatgtgattcaatcatggacatctttgagatttcagaattctacctggaaccggtctgaatcagggaacgtgtgtatcagctgattcgaatgccagggaccagtaagaattttgagggagggagttgggatggagaaggtatggcctttatgcgagcatagatccttttcttcctggctggtaatattcttctctgaatttaatcttcctttaaaaaaaaatcctccatctattgtcactatgttccccaaacataaactaagttccaggctgtcatgatgtatctgatatatggggtaacccagcaaggtgtaccttcctttggtgagagatggctgccggggcaaagacgggctttgattcagagcaagcattcccacctgttccatggaatccccctgaagtgagcacaaaggtgccctgggctccctgatggtttatgcccactcctttcaggctggtgatgcaccttacacacaaacacctaatgcaatgtctttttaaattctccaagtgggatgggagcatgtgagggaaattccaatccaaaacccattaatgtgctgaacgctttttttttttttttttttttttttgcaacaacaccttggacctctgtgttggggtttgactgacctcaagctgatattattggaccttgtgcagctttgataacccatgtgagagtctaggcaggaccagtggggcccaaatcttgctgctcttgtacttttaggcactgcccttgcagactcacctttctccacctgccctggagaaaggtagggtgtgctgggcctgccccttgcaaatgggattcaccagtttcatttatttgactctactgccacagtgaaaagagcaaacagctattgggttgcaaacctcctttgacattaggaaatgttgactttgtaacaataaaactttggtcctagaaagacacggttgtcctgggagtttgtagtgttaagttgcaacaacaacaacaaaaagcaacaaaaccagcttaggataacactttttgttgcttgttcttaaagatgtctcactatgattaaaacccttttcattaatgtagtgaaagccacacaggagttccttcttccaggaggagaataccaagcacatcactttctctctgcatcagtgatgtcaaatacgcatcagaaaatgttcaggttttaggagctgtcctaggtgctgtttcatcattggaagcagtgagaaagagaagcactgctgcttgtctggatataggctgaggatgattgagagaagctgtgggaactgacacaagggtctgcataggtcatcctgtgaccctggggactatgttaccaactgacagacagatctttcactgtatcctagcagggcaggtagtccaccaagaaatgtgcttattggattgggaggtgtttatttgtagtctgctgtaacacgtgtgaaagagcaggagcgtcatcagcatatgacttgcgctggtcatccggtaaatggatgtgctgtagtcccagtgctaatcatttctctccttcacagtgggtggaagtttagggttaaatgtcctttgaatgtcacctggtgagtccttgacaccttaggctcttcagaaacaatggttttgttgaggatggggaacagggaatgccgattttatatacatggtacacagagaggggtgtcacttcagaaaatcttccagcatgttcttcagaatattaatttatatgcgaggtgaggttgggaatgaaaagaacaggtcagcacttttttttttcctagaacatacaaaagaacatggtggactttcagggagtgcaatggaaggtgaatatttccttaagggtccccgagaaatgggagtgaggggaggggacacaatggctttttgagcttacttttaccttctgatactagtcaaggtccagaaccagccaccagccaaatttctatctgggtgcgggccactgaaaatccttgttaaaaaccagatcacaaatctggggctcttggtcccattggagaaggaaggaagagcctcaaaataagtgtgcacccatgcacatattcaggaacagcttgtttagtctttacactttgcctgaaagttgcttctcctcgtccctttgtgtgcctgggtggcctcggccctgtgcgttggcaacgcaggatcaaatgtgctgcagcttttgcagaaaacaactcagaaacacaaaaccccccaacagctcaattattattttttcaatgttttcctacaagagccaagtagcaccatgtacagaagacgcctttttttttggaatattgaaatcgttctgcatgtaaaatatgggataatgacctgtttatattaaaa

SEQ ID NO: 11288 - DNA, 1172 bp, Homo sapiens
tcccggcgtgtgctcacgtgtgtatgcacgtgtgtgtgtccattagacacggctgatgtgtgtgcaaagtatccatgcggagttgatgctttgggaattggctcatgaaggttcttctcaagggtgcgagctcatccccctctctccttccttcttattgactgggagactgtgctctcgacagattcttcttgtgtcagaagtctagcctcaggtttctaccctcccttcacattggtggccaagggaggagcatttcatttggagtgattatgaatcttttcaagaccaaaccaagctaggacattaaaaaaaaaaaaagaaaaagaaagaaaaaacaaaatggaaaaaggaaaaaaaaaaagaactgagatgacagagttttgagaatatatttgtaccatatttaatttttaaagtctctggtattagcctcataagttattgactattccccggggttggcggggagtggggacatgagttggtctgcctgttgtggggccgggaaggggagggagtcaggcacaagtggcctctttgtttggtcttaaaggcatccatttctgggaatgaagccatgttcgctgctaacacttttggatgttgtgaggccacgtggagtgtgtgagagactaggttttatggatggtctggttcaggtaccaggtctgctggaaggttcctgttcggataagctggtagctacctagctctgagcctgccttcaagaacacctgtgttcatcctctgattctctgtgtgtacctcttgtggcgtttcctctcccgggtgtgaacatcctaaccgttattgtgcaaacccaagaacgtcagatcccaaagcacaacaacctggatggactttgggaacatctaagcaatgtaagagagaggtgcactgagagtacgtcttggtcccctccaccctgagagcatctgacggtcctcagtactgaactcccggaagctgctctgagcccggtgacctcatctgggccaggtgtggtgcctgagctgaatgctcaggtgcttacagtgttgcaatccctaagagagtagagtctggaggagaaaccgtgaaaaagaccttacacaccaccaagaacttccgaatgggcgtgaatccaccgtttcttctctttgcaaaaagaaccaccacagctgctcaaa

SEQ ID NO: 11289 - DNA, 1102 bp, Homo sapiens
tgtgtgatttgtgtggtgtgtgtgcggtgtgtggtgtggtgtgtgaggtgtgcatgtagtgtgtgtgtggtgcgtgtatggtgtgtgtgtggtgcgtgtgtgtggtgtgtggtgtgtgtggtgtgtgtgtggttgtgtgtttgtggtgtgtgtatgtgtggtgtgttgtgtggtgtgtgtggtgtgtggtgtgtgtgtgtggttgtgtgtttgtggtgtgtgtatgtgtggtgtgttgtgtgatgtgtgtggtgtgtgtgtgtgggggggtgtgtggtgtgtgtgtgtgtggtgtgtgtgtgtggtgtgtgtgtgtgtggggtgtgtgtgtgtgtgtatgtgtgttcagccgcagagacttgagccccccttttctgtttctttctccagggctgaagctgccctcgaggacctggtctccaccattcgagtctgaagattctcagaagcacaaccagagtgagtatgaggattcggccggcgaatgctgctcctgtccaaagacagactctcagatcctgaaggagctggaggagtcctcgtttaggaagacgtttgaggattacctgcacaacgtggttttcgtccccaggtcaggacttggcgctgggctctcttagtgggtgccaattggcttggtgttggtggaaggtcattacttagggaccgagaggtagtgggacccagagacggcagaagggtgggtggagtctgaatggagccctttcctgggtggaggaagagatcttgcagtttcgaaatttcgaggggaattttatcaggaagagcaaataatcgcacaaaaggggaaaaatggacaaaactcagcatttgcctttcttacctctcctgagctggtctccacgtgagttccaaaacaaactccgttagacgattaacatttttttttttctctctctctcttttttttttttttttgacagagtctcactctatcgtccaggctggagtgcggtggtgcgatttcagctcaccctttccgggttcgagtgattcttgtgcctcagcctcccaagtagctgggactacaggtgcgcagcaccacgcccagctaatttttatatttttagtagagacgggg

SEQ ID NO: 11290 - DNA, 1205 bp, Homo sapiens
ctcaacctcctgaatagctgggattacaagcatctgccaccatgcccagataatttttgtatttttagtagagacggggtttcaccatgttggccaggctggtctcgaactcctgacttctggtgatccgccattctcggcctcccaaagtgctgggattacaggcgtgagccactgcacttggccaagtctcaagtgttttgaataagggatgcccaagctgtgttttttcattgagatgtcagggttgacagttcctttctctttggctgttcccgagttattttttcttgtggcattagattgttgggtgagtaacatgtgaccctatgggatgtaacttcccaggcctcatctgcacggcactcagtgtgacggtcttgtaagggtaactgccttctgctgttttgtcttgaaagcccttatcagaatgtgacggagttcgacgggcaggatgcgtgtggttccaacagttggacggtggtagacattgacccacccctgaggtccaacgaccccaaatcacagaaccacccagggtggctgatgcggggtctcaagccctggacccagtatgccatctttgtgaagaccctggtcaccttttcggatgaacgccggacctatggggccaagagtgacatcatttatgtccagacagatgccaccagtgagtgtgtcttgggaatgtgaattcgtatgtgaatcagacctcttgcttttaataggctgatgcagtgaggttgtataaaatgctccttgatatggttattggctttttttttttttttagacagggtcttactttgtcacccaggctagagtgcaatgcagtggggtgatcatggctcactgcagcctcaaactcctgggctcaagcaatccttctgcctcagcctcctaagtagaaggaactaccagagtataccaccatgtgtggcttttttttttttttttctttgagatgaagtctcactctgtcacccggactggagtgcaatggcatgatctcggctcactgcaacctccgcctcccaggttcaagtaattctcccacctcagcctcctgagtagctgggactacaggcatgcaccactatacccagctaatttttgtatttcttgtagagacagaacgttgctgtgttacccaggctggtcttgaacccctggcctcaagtgatcctcctgcctcggcctcccaa

SEQ ID NO: 11291 - DNA, 1114 bp, Homo sapiens
acatgttcttggtcttggtctggcatgcaatatactagagggtctggtccattgcaactacagctatttcctgtcacctattggccaaaacaggctactttgctcttccctgaactcagcttaggtgcctctgtgttatcagtatttcccctatttgcagaaattggtttctgcaaaacctattcctcagtccatcacagactcaccacccctcttcaagactgagctgagcctccttcctggccatgaaaacttcctcaacttcctctgttatccacattcaacaaatatgtgttgagtatgtgccaagcaagtggagaggattaggcacgtagcactgaacaagatcaactccgagcatggccacaccatcttggagttgtagaagaccagccgttgaatgactagatgtgtgtgttttttccataggaactactccttctatgccttggacaaccagaacctaaggcagctctgggactggagcaaacacaacctcaccatcactcaggggaaactcttcttccactataaccccaaactctgcttgtcagaaatccacaagatggaagaagtttcaggaaccaaggggcgccaggagagaaacgacattgccctgaagaccaatggggaccaggcatcctgtaagtcactggtccccaacctttttggcatgagggaccggtgtagtggaagatggtttttccatggactggtggtgggtggggatggtttcagcatgattcaagtgcattacatttactatgcactttattcctattatgattacattgtaatatataatgaaagaattgtacaactcaccatcatgtagaatcaatgggaaccctgagcttgtgttcctgcaactagatggtcccagctgggggtgatgggagacagtgacagatcatcaggcattagattttcataaggagtgtgcagtctaggtacctcatgtacacagttcacaatagggttcacacccctgtgagaatctaatgccgccgctaatctgacaggaggcagaactcaggtggtcatgcaagcgatggggagtgactgtaaatacagatgaagcttcacttgctcacctatcactcacctcctgctg

SEQ ID NO: 11292 - DNA, 1205 bp, Homo sapiens
caggtcaggagagcagtccgggaaggaaagtcagccagcgaggtgggaggattgacaaaacaaatacatttagctttccttgccccatttctgaccgcgggcacctttatccccgtaaattatctcctgaagatcttctatgttgacgcactggagacagttcccctttctccttctgcacctgccgcgttactcaatcccctgtaatcccattgtcccgactgcatcatttcagaggtggtgattttaaggattttaacagggcttgccaaaagaattattttcttggcgttttgaaagtaattacttaggcatgggtactttacagagaaagctactcatcccggctggctgcagagtttacagggcccgggatgaaaacacagggcccaggtttcctgtccatgaagccggctctgcccctgatccttctgatgcatccaccgtgcgtctgctcacctgtcttgctttctgttcattttctcttgtagtgtgtcccggcatggatatccggaacaacctcactaggttgcatgagctggagaattgctctgtcatcgaaggacacttgcagatactcttgatgttcaaaacgaggcccgaagatttccgagacctcagtttccccaaactcatcatgatcactgattacttgctgctcttccgggtctatgggctcgagagcctgaaggacctgttccccaacctcacggtcatccggggatcacgactgttctttaactacgcgctggtcatcttcgagatggttcacctcaaggaactcggcctctacaacctgatgaacatcacccggggttctgtccgcatcgagaagaacaatgagctctgttacttggccactatcgactggtcccgtatcctggattccgtggaggataattacatcgtgttgaacaaagatgacaacgaggagtgtggagacatctgtccgggtaccgcgaagggcaagaccaactgccccgccaccgtcatcaacgggcagtttgtcgaacgatgttggactcatagtcactgccagaaaggtacgccggggatacagggttctaagcagtgtctcgtgccttgttctagaaagcttaaaatgttttatggcttaaaaatgttaaatggtcattaggtaggggccggggaatagtgggtggtggcattcactagcccagggagtggcagacattttctgtaaa

SEQ ID NO: 11293 - DNA, 1148 bp, Homo sapiens
ggactgggtcctggctgatcgtccttgttcccagtggggtacatgtgagcccctgccagggccaagtccttctcccgaacccagggtcctgggaactgcagatcccggggggattcagcccttctcccactgtgctggcagaggcactcctgtgacgctgaatacagtgaacagggacattcccgccactcggggacagatgggcacaagggaggggaaactccatcaggaagtgctcccctgggcagaggcgcccactgggtgctgtgggctcaggagggggcggggcaggagctggtgccaaccgggaaccagagccccacagccatacagcccattggtgacaaggtcctgagaacacagtggccaggtgtccccaggctcctggcccctccgacgacctcaactctgcccagcccggtccctggccatcagcgacgctgtccgccccccgtcagatcccatgtgtgccatgtttatcatcagtgttttgtatttttgtactgagtatcggagcactttacagaagctgactgtacattcctgttctgttgtgaagagaacattcccagaccctggcaccctcctgagccggcgtgtgccggtccagccctccgagatgccacaattccttggatgggggagaagttcaaggaatttctgctcggccacgcggtgggaaccccgcgtccccgccatgtggcagaggggtctcagtcgtgctaggcatcgggcggcagcgccgacagcccttccctcgccagtgcccctcggccactcctgggttggagcccgattttatttgtaaagttgacagtcgagcaaatgttcctattttcgtgggatctgcacacgtctttgtcagttgtggtcatgatcttagtcacctgctaattatttttacaatgattacaacatttcctcactgcgggatatttctgacccgctttagaacttaagacctgattctagcaataaacgtgtccgagatgagcggtgactggcgtgcacgttcttggaggttttatttgaggattttcttctgcccaaacgttgctgcaggagtagcaggttctgttgggggctccccatggctcctgcccctcagctcgctcacctgccctccgtgtcctgcttaacgctctgaa

SEQ ID NO: 11294 - DNA, 1213 bp, Homo sapiens
ccagtcctggctcctcccaagttccctctatcagtcttggctcctttcaagctttgtcgattaagcctagctcctcccatcaggcttggctcctcccccaggttcctcccaccaggcctggctcctcccctcaagcgctattaagcctagttcctcccacgaggtctggctcctcccctcaagcgctatccattaagcctagctcctatcagtcttggctccttcccttaagctatgtccatcaaacctagctcctcctatcatcagtcttggctctgtcccttaagctctgtccatcaaacctagctcctcccaccagtccaggctcctcccctcaagctctgttcattaagcctagctcttccccccagccctggctcctcccctcaagctcttcccatcaagcctggcccctcccatcaaacccagctccccaaaaaggcgctactctggcccttgaggatttgtgtacacagcccaccctatcctaacgcctagcatctgacctcaaagtcccacccatcgtgcgtggcttttccgggaccccatttcttgttccttcccttaaggccccacccatgaaccactggccccgccccctcaagccccaccccccccgtcaagtccctcccatctgcaggttcttccttttcccaggcccttgggggccgaggtgcgcctcctgcagctctcaggtctcaccctctagcgcttgcccccacagggagcccacctagctgtcattgatgccctcatggctgcctttgccttcgagtggacaaagaccctgccaggtcccttggccctgaccagcttggagcacaagctgcttttctgggtggacacggtaggtggggttgggcctggggtgggttcggggaccagcatcgtccagtggccagaccactgaccccctccctgccctccagaccgtccggcggctgcaggagaagaccgagcaggaagcggcccagcgagcctctccagcagcccctgcagacggggcggccccggcgcagccctcggtgaggccagggcatagaaccgtcagaaggatgggggaccggagatctgggagggcagggctgtgcttcctggacactcctgaagtggggagggggctagaggtgacacactctctctttcttcccccctctctcaatctctctgtgccctgcccgtcccctgtgccggtacccgctgccctcctctc

SEQ ID NO: 11295 - DNA, 1172 bp, Homo sapiens
gccgcgaacgggactgggaaaatggcagcaatgcctcctccccagcgtcagtgcccgagtacacaggtaagcaggggctctgggtgatgtgaggagcaacaggcaccctcctccacagcccctgctcattcctgctgccccccaccccctcccactgcctcaccctctaggtccacggctgtacaaagaacccagcgccaagtccaacaagttcatcatccacaatgccctatcacactgctgcctggcgggcaaggtgaacgaaccgcagaagaatcgcattctggaggtgagcccgcccacacgtgggagttgggggctggtgggtgggtgggtggcctgacttggccagctgaccatttccagcactcctgcccaggaaattgagaaaagcaaggccaaccacttcctgatcctctttcgcgactcgagctgccagttccgggcgctctacacgctgtcgggggagacagaggagctgtcgcggctggcagggtatgggccccggaccgtcacgcccgccatggtggaaggcatctacaagtacaactcggaccgcaagcgcttcacccagatccccgccaagaccatgtccatgagcgtcgatgccttcaccatccagggacacctctggcagggcaagaaacccaccactcccaagaagggcggcggcacccccaaatagccccacccgggcggtccacgggccgggccctgtgtgctgcggccgccatcccctggaggacagtcagtcggtattcctgggtcctgtctgtccccaaccgtgtctgggtggggctggagtctccaccctctgactttgagtccagtcctgctgtgggggctgagctgggaggttcagggactcagggctcagctcagtccccttgtctgtcctcccccacttcttgaataaaataatttaaagagaagttgaaccttgtccccccctccgaggctggccggggtcccacactccctggctgtgtttttagtctcctgttctttctcaaaccaactcctgtcttcaacccccataatcccctaatgcagcttcagccagggcactcccagcccccagccagggctgtttcgaagctgcctctgaactgatctctcaggctcgaggtgtcccactggcccttcctgtggccttggccacccccgcttgc

SEQ ID NO: 11296 - DNA, 1099 bp, Homo sapiens
tggagccttggagaggtgggacctgggtgaggggtggagcctcggagaggtgggacctgggtgaggtgtggaacctcggagaggtgggacctgggtgaggggtggaacctcggagaggtgggacctgggtgaggggtggagcctcggagagctgggacctgggtgaggggtggagccttggagagctgggacctgggtgaggggtggagccttggagaggtagtctcaggatagtggtgtgacctgtgtgtaggtgggtggggcactggaaaggtgggacctgggtgaggagcagggcctgtggagagactgtccctggacaggggtgggaccttgagagacctggtgctgagatgaggtaggacccaaatgtcctcttgccgaggatcctggggatgtccttggcccgcctctcccatccccttccctgacacatagcggccggtggacggctgaccccatgcccgcaggacctggccatgggctccgacgcagagggggagaagatcaaggactccatgaagctgatcgttccggtgctgctggacgcggcggtgcccgcctacgacaagatccgggtcctgctgctctacatcctccttcggaatggtgggtgggggctgcagggagttggaacgtccccatttgccagcgtctcccacgatcctgggaactgctgaaccccacagctctccttgggtcatttgcactcaccgggctcaccaacccccacagctacccctctggacccgggaaccctcctccattggcttggggattcctccactgaggtgagggctccctgctaacgtagaaaccctcacatctgtgattcctatagatgtggggctccctcagctcatctggaggagcccctgatctaccccctccaggtttcccactcttgctcacactagcacagggtactgaggccctccccactgcaaggttctctcatcagagtcctgggagctcctcagcccaccccaaactcccctaaacctgggagctcacctggccgccgcctccaccctgcccattcccgtcccccaggtgtgagtgaggagaacctggccaagctgatccagcatgccaatgt

SEQ ID NO: 11297 - DNA, 1178 bp, Homo sapiens
cagggcagcaccatccaatggcaatgggcctggggcggcttcctggcttcctccttgtccctctaagagccccggcccctctttctgcgtgggggccagagacctgggcctcctcatccccatggaccttgaatacctggacttctggggctctgaggggctgagagcccagacactgggttccccaaagggctgggggtattgactgatggtccccaagggcctggaggcccagactactgggttgccgaggaactgtgggtttagacttctgggtacccaaggagttatggaattagattcgtgggtccccagtgagttatggatctagatttctaggtccccaatggactagaggcctagactcctgggtcccccagaggcaggaggtggagatgctggttcctgtctgccaggatcttggcccctgaataccccgtggggggcactcctgaccccggaccccatgcctggggttcctcccctaacctgcctctcggccgccaggacgccgtggaggaccggctggacaggaacctgtggcccttcgtatccgaccccgcccccacggccagctcccaggccgctgtcaggtgaggccccggggccgcccccgcccacgcctgggtctgtgttaggtgggcggcctggcggcggtgagggcctcctgcctggactttctgcccctgccctgcacagtgcccgcttcggtcactggcacaagaacaaggctggcatagaagcccgggcgggcccccggctcatcgtgtatgtcatgggcggtgtggccatgtcagagatgagggccgcctacgaggtgaccagggccaccgagggcaagtgggaggtgctcattggtaagtcaccaggactgggaccctggggtctggggcttgggttcccggggcctgggcttgtaccttctaggtgtctggactccagagtccttggagtcagggacctggtttgctgagggacagggacagccccacaccagccgggaccgggagcctgtcaaagacgaaggcagcgccccccaacatcttccccaaacctctgcccctgcacaggctcctcacacatcctcaccccgacccgcttcctggatgacctgaaggcactggacaagaagctggaggacattgccctgccctgacccctggccccgccccctaccc

SEQ ID NO: 11298 - DNA, 1266 bp, Homo sapiens
tcgggcactggggagctgggctggggctgctgctctggggtctccgggggccacagcttggggtgagttgaagacctcaggggatgtggaggggtctgcggggccctggccgcacaggatggccttcagggaaggtggtcttggggcatggtgcagagcaggtgaccggagggaatcggtgacggagcggggccaagggaggggtccggagggagtcagggatggagggcagagggagtggatgtgggggtttgaggacgtgtgacaagctccagcaggggtgggggccgggctgagggtgggggtgcgaggtggtcactcccatcgtgcccctggccgtccctccactcacccacacctggcccagtccacgttgaggtccaggactgggaaggaccgggtgagtgcaccggggacccaggccaggtgccccccggagcctgctggggtggccagagcaggagggggtgtgtttcctttttgtgggtgttgcatgcaaatcaagtggacaagaaaaaataacaaaacaaaaaacaagaaaaaaaaaacacaaaaccccgtaaaatcacaaagaaaatccaacaccaaaggcgcagaagccggctggccgtggtgggggcagcgtaggcgtagcatccctctcctctcacttagcctgttgactcttgttattatcatgatattcacaaaacgccgcatgtttaaaaagtcatagatgtcatcttctctctgcccccagggaggaaagccaccttctcttgccccttggcccctttgtcaggggccaggggtctgccgggtgggggtgccaacaggcctggccctttcctcccctgcatccagccatgggggcctctgcgattgccggaaggttgcatggctggtcccagggccagcacaggcccgaggccgggctgcctggttttatttttatttaactttattttctgttttatgagtgtgtgtccgcccacccccacccccttcagtgttaagtggggagccctgggggagtctctcctgcctcccagcctctcccaagacctcccccctcgtcaccagccatccctctggaccaggcagagggcggaccgggtgggcaggggcctgagggtggctcgggccagcccaccagccaatggacccctcctcaggccgccagtgtcgccctgcccctttttaaaacaaaatgccctcgtttgtaaacccttagacgcttgagaataaaccccttccttttcttccaccgagtctgtggtgtgtcat

SEQ ID NO: 11299 - DNA, 1212 bp, Homo sapiens
ccggtgctgggcctggtgctggagccttctcctagcagggcctaggcgcaggggtttcacctccaggggagcagccgggctgtcctctgaggcacatcccccctctcggcccctctgcagctggccatgggcaagatgatggagcaggggccggtgctgatcatcaccttccaggcacagctggtgatggtggtcaggaaccccaaaggcgaggtggtggagggtgacccggtgagtgagggagtgggatggggcaggcacatgacaccgcctgtccccaagatctgtgtgtggccacctggcagagaccccagctcagagccctgaagctctgggactgggtggggatgtggagaaacctctgggccagagtttggggttgagggaggtcggagaccagcagacctgtctgtttttaccaaggctgagtggttcctgagtctaggcaattgtgctggcctctgctcccagcccctggggaagttgccggtggctcctgccccacagagcctggcccccccccagagctgcctgggtcacctcaaccctctcaacagtgcccttcccaccccaccctgcaggacaaggtgctgcggatgctgtacgtgtgggcgctctgccgagaccaggacgagctcaacccctacgcggcctggcggctcctggacatctcggcctccagcaccgagcagattctctgagtgtggtgccggagccaggtagccccggcctgggtcatcaggcacagaggcaccgcaacaccacctgcggcaactccagacctctgggaacaagactgcgggctctgcccccagctctgccaggacggctgcaagaccagctggcccgggaggggacaacgggctgttgcgggtgcgcggcagctggagacactcccccgcagggccaacccctgccctgttgctctgccctgcaggggtcccggcgcctggtcacctggggtgcacacaggtcacacagtgccaagaggccccagggcccagggactccccccacagcagggtgggacccgggacccgcggctcagtggcccgctagccacgtcagccaagccactttaggtccattttttaattttaacagtgctcttccatcttgtgcataagcctgagatttggaaagaataaaacaccgaattgcagaagagcagctacggagtctgaagtgtcttctctggcgcgggagtggccg

SEQ ID NO: 11300 - DNA, 1910 bp, Homo sapiens
tcgatcacatgagcgggctctctggcgtcaacgtgccaggaaacgcctcctccggctggtgcattttcatctacaacctggggcaggatgccgacgaggggatcctctggcagatgtttgggccgtttggtgccgtcaccaatgtgaaagtgatccgcgacttcaacaccaacaagtgcaaagggtttggctttgtgaccatgacaaactatgaagaagccgcgatggccatagccagcctgaacggctaccgcctgggggacaaaatcttacaggtttccttcaaaaccaacaagtcccacaaataactcgctcatgcttttttttgtacggaatagataattaagagtgaaggagttgaaacttttcttgttagtgtacaactcattttgcgccaattttcacaagtgtttgtctttgtctgaatgagaagtgagaaggtttttatactctgggatgcaaccgacatgttcaaatgtttgaaatcccacaatgttagaccaatcttaagtttcgtaagttatttcctttaagatatatattaaacagaaatctaagtagaactgcattgactaaccagtccctctggatggtggtgaacctgaagcatgctttaacctctaagactgtctaacacgcgtttcattcaatgtctccacagactgggtagcaaaaaaatcaccttttagttttagtttttaatctaaagatgttagacagatgctgagtgtgcgttttctcaaccgcttcaacattgtaagcgatgtatgctttggttgacaggaagttccttttccaggcaggtcccgttgccacctcctgctcactcagtcccgggctctgccgagtggtcctgggaatggcggcgggcccgtccagcgtgggccaccactggggccgggggccacgggctgcatgctgggcgggccctccagagaaggacacaaacgtgtttcgtaagcccaggcaccaatgggaatggaccaaagagtttcagggaaactccagtatattccagagtcagatctaagctccaggcacgcctgaagatgtgttgctactctgacatcccgagtttctgtccacacattgcatgcacagcgccccacacattggatactgttgttcacgataatttctcccgttttccagagcatttaacatagcttggaggcgtaaaatggctctgtattttaataacacagaaacatttgagcattgtatttctcgcatcccttctcgtgagcgcttagacctttttctattttagtcggattttgttttggaattttgcttttgtatgaacactcagcagaaaagtacttacttcttgccagttatctattaaccaaaacctttgatttgtagttttaaagattaaccctcaaagttctcttcataactgccttgacattttgggttgttctgttctgttaattttcttttgcttttttgtgttttttgtttgtttttacttttgcatttaagaccattaaatttgattttgttttgctcgaattttgttttgttttttattttaccttttctttctttttggctagggaaggtgcaggtggcccagcattcagggaggagtcgtaagatcttaagaaaccaatccttgcctcaagcaaaagcatttctgaatctgtgacgcaagaatgtgcagttacaggctggtggcttttaaaccaggagcccggaggaagggtgaaagagaaagcctgtgaaataggcagggccagatcacccaaaactcctcaggactgggatctggcgtttataaataactagtttacagagagaatcacaaacaggataacttagtaccagcagtttttaaccttgacgtgagactaaaacgtgaccgtaggctgttttttagttattgctctcatgagatgatggct

SEQ ID NO: 11301 - DNA, 1182 bp, Homo sapiens
tatgcccctgtgcagctgaaccacatgaatggagtctgttcattcattcacccattggaggagatcctggttgcttccaggttttggcaattatgagtgaagccgctgtaaacatccatgtgcagatttttgtgtggctgtaagttaacatgcagcatagaaaagaatctctaagtgcagggccaggtgctgtggctcatgcctctaatcccagcactttgggaggccgaggcaggtggatcacctgagttcaggagtttgagaccagcctggccaacacgacgaaaccccgtctctactaaaaatacaaaaattagctgggcatggtggcagacgcctgtaatcccagctactcaggaggctgaggtaggagaatcacttgaacctgggacgcagaggttgcagtaagccgagattgtgccactgcactccagcctgggtgacagagtgagactctgtctcaaaaacaaaacaaaaaaaaaaaaaaagaaagaaagaaaatctctaagtgcaaatgcagttactagttttgccttcatatactgcaatatgaacattttgaatttacttgctctttttctcttggcagatttttgaaaaatacaatgtctaatggttatgaagaccacatggccgaagactgcaggggtgacatcgggagaacgaatttgatcgtcaactacctccctcagaacatgacccaggatgagttacgaagcctgttcagcagcattggtgaagttgaatctgcaaaacttattcgggataaagtagcaggtaaagaaatggaggcgttttagtaaaccgggtattggtggccatcctttgggcactgtctcctttgcctgtgactctgtggcattcctcagtgcaggataactacagccttgaaacgatggctgtgaagtttcatttttatttcaaactctgtccattgctcttgtataagatcggacataagttcccaaaagaggaaaaattcattgtaagacagagagcatgtacaaaataagacagtgggaggagaggaaggaaccagagacagggcattctgagagctggaaggggctggagaaccacagcctgacctggcttggcctgggcagattgattgggtcccacgtgtggaagggaccctggcgagtgtactgtccagggcaggtgcaggtaggcctgcccctg

SEQ ID NO: 11302 - DNA, 1123 bp, Homo sapiens
gatggtggtgaatgttcactcaacaggtatttggatttactatgcaccaaaagttggggttctgcagtgaatgagccccccagtcgagagtgagaagcaggaaaaagcagggctgggtgaaggtagcatctatgtgactgtggaaggagaaccaaagagaccgcagacccagggtgggaggttggattctcacctctgcacagcctgacacccatttccctgcaggagtcatggctgtgggcaccagtaatgtgctgggacaggtacccaaaccaggtgagtggcagagtgtgtgtgaatgcttggagggtgagggcgatgatcacagttgctgcagccatgggcatgggacccgaaccctgacactacactgtcattccccactgagtcccacgctctttgattcctctggggaatagagaggggccagaaaaccaagcaggagcttccaccaaaccactgcccttgattacctccagggatggggagctcactcattgggattcaagtatcctggttttgagcaaacggagtgggcccggagccatacccctgcccgattggagccttcgctccccacagctaaccttgtcctgtcctgctgcagactctgaagccatccctgtactggtggtacctcttggagctgggtttctacctctcactgctaatcaggctgccctttgatgtcaagcgcaaggtgaggccaaataagagtctggaagacccagtctctggccgggatgctggggtgctggggggtagggcagccttacaaccgcaccttgagagctccctggtgcctcctgcaggagatatagaggccatgggcccagaggccacaccaaccccctgaaaggacccacttcttggcccatagggtgggggaccttccagcatcaagcctcgtccccactatgacccaccgtctactgcaggatttcaaggagcaggtgatacaccacttcgtggcggtcatcctgatgaccttctcctacagtgccaacctgctgcgcattggctctctggtgctgctgttacacgattcctctgactacctgctggaggtgggcccgacccctgcctgacccttcccagctgctgtacccagccctcccaggtg

SEQ ID NO: 11303 - DNA, 1103 bp, Homo sapiens
gcgcatgctctatagcttcatgaagaagggccaggtatggctggacctccccgggggccccagccctaagctcctccttcctccctgctctgagctccatccctctctctgttccccagatggagaaggacattcgtagtgatgtagaagaatcagactccagtgaggaggcggcggcggcccaggaacctctgcagctaaagaacggggcagctggagggcccaggccagcccccactgatggccctcggagccgggtggccgggcgtctgaccaacaggcacacaacagccacatagccgggcggggctggctgtaaggggttgcccccccgccagtgccttggatatttctggggtgactggactggcgcccctgggccacctttctggagacagggagggccccacccggggtgggtgggaaggctgatgatctgtctccagccccttccttctgcccacccacccttcttccctctgggcaactggacagatctgggagccagcagctggatgctgtggctggccagagacacctccaggctgtggcctgggggctggggggagccccaggctgaaaagggtccaattaaaacaaatggagccaaattttctgcctgagaacttgggtccctatcaaagttccttcttcatccccagagacccccgagggagccaggcctctgcttacataccccacctacgggatactcactgccacccaaggatgcagggccccaggggccccagacagcaacagagctcagagaccacccgctccccacgctgttcccagatgagcccctgactcgccagccagtgactcaaacaagcccctccctccacccttagggtacccttgggtcagcctctcaaagacccccttgcagactagctctgaaaggtcaagtcctttgcccaagctcacaggtaggtcacagaccaggcctgtctctgcagtcctttcttaagtccggtagattgcccacctttgtggtccctggatccttccttgggacagtggagggagtgggctgaaatcccacagacttcccaagggttagcctggggaggtcactgtctcttcaagagctccaaaaa

SEQ ID NO: 11304 - DNA, 1395 bp, Homo sapiens
cccaagggctcccctgggcatctggccccctcacgccttcagtgctctctcctcaactactgaacgcctgggcttattgcaggaaccaatgagatcctcccggaaggggatgccacaaccatggggccccctgtgaccctggagagtgtcacctctctcaggaatgccacaaccatggggccccctgtgaccctggagagtgtcccctctgtcgggaatgccacatcctcctctgccggagaccagtctggaagcccaactgcctatggggttattgcagctgctggtaagagggacttaccctcccatgctgggggcttagagctccggggattcaggggaggtgggtggggagggatgagctgcagaactcccatccccatgtgtatggagcttggtgggtgtgggggctcttgccttccccctccttactcctctgtccatctgttccccacagcggtgctcagtgcaagcctggtcaccgccaccctcctccttttgtcctggctccgagcccaggagcgcctccgcccactggggttactggtggccatgaaggagtccctgctgctgtcagaacagaagacctcgctgccctgaggacaagcacttgccaccaccgtcactcagccctgggcgtagccggacaggaggagagcagtgatgcggatgggtacccgggcacaccagccctcagagacctgagctcttctggccacgtggaacctcgaacccgagctcctgcagaagtggccctggagattgagggtccctggacactccctatggagatccggggagctaggatggggaacctgccacagccagaactgaggggctggccccaggcagctcccagggggtagaacggccctgtgcttaagacactcctgctgccccgtctgagggtggcaattaaagttgcttcacatcctccgcctgcctctgggtctctgtctcccttggcctgggcagcctggggtcgctgctgcagcccctcctccatgagagcccagcccatagaaggtgggacatggacacccagccctgtgtgcagctactgtgctgcttgctttttgggagcaggggcagcagggctggggtggggagtctgcgttaacatcaggattcttggaagaagagcagagcttgggcagtgccttcccattcccaggtctggggacccccacccactgtggcttcctcctcagtgcagtggaagccaggtttcctgggatggtctcagactcaccctgttttaattattttttaattatgtttttagagactgcgttttggccgggcacagtggctcacacctgtaatcccagcactttgggaggccgagaggtgggcggatcacctgaggtcaggagttcgagaccagcctggcca

SEQ ID NO: 11305 - DNA, 1112 bp, Homo sapiens
ctggatgtggcggcaggcccctgtaatcccagctagtcaggaggctaaggcaggagaatcacttgaccctgggaggcagaggtttcagtgagtcgagattgcgccactgcactgcagcctgggcagcaaagggagaccccgtctcaaaagaaaaaataaagaaagaaacaaacaaacaaatagaataaagtgggcttgtaggaaggtagagctagtggggtctcaggggaagagcttgcagggaggcctgtccttagaaagtggagttaacagttgcagggggcggagccttaggaagggagcatttttttgggctcagctgttcttagagggtggggcttgcaggggatggggtttcagggagtacctgggccttcttgggtgggcatttgggacctgaccaaccctgtgccccagggattgagccatgtacccagaaagggcaatgcccaccgccccctggcctcccctgcccctgcaccggcgtcagtgactgctctgggggaactgacaagaaactgcgcaactgcagccgcctggcctgcctagcaggcgagctccgttgcacgctgagcgatgactgcattccactcacgtggcgctgcgacggccacccagactgtcccgactccagcgacgagctcggctgtggtatgcacctgcggggctggggtggactcgtgggtagatggggacacccactgcctgctggggcgtggccaggctgggggcgtggacacatgcctttgcccgtgcctgcatccctgtgggggaatcaagacatcattaggggccgggcccggtggctcacgcctgtaatcccagcactttgggaggctgaggtgggcggatcatctgaggtcaggatttcgagacctgcctggcaaacactgcgaaaccccgtctctactaaaagtacaaaaaaatttgctgggcatggtggcacacacctgtaatccgagctactcaggaggctgagtcaggagaaccgcttgaacctgggaggcagaggttgcagtgagctgagattgggccactgcacaccagtctgggtgacagcaaaactctgtctcaaaaaaatttaaaaaaggccgggcacggtggctaacgcc

SEQ ID NO: 11306 - DNA, 1104 bp, Homo sapiens
aatagctggaggccattgtcacctgatcgcttggcccttttgccagcatcctgttttgaggggcagcaggaatgggggtgggggccttgtgtacgctggagaccaaaagtgggaagggaggagcccagctctccacagtgggttctgggcctgggggccacagcagggggttcatacagggctcaggggagagaggaggcttgctagctcccacctggcgttggctgatcctctgaggggctgcgttggaggggttggcattctggaacaccctgctgtctgtcctgcaggtccagaaagtccctgtgggtgtgtttgtcccggggcaggtgtgggctccctcagatctttccacactgttctttggaaaccctcactgaagtctttccctcctccagctctgctgtagctgccactgagaagaaggcggtgactccagctcctcccataaagaggtgggagctgtcctcggaccagccttacctgtgacactgcaccctcacggccacccgactactttgcctccttggatttcctccagggagaatgtgacctaatttatgacaaatacgtagagctcaggtatcacttctagttttactttaaaaaataaaaaaatagagacagagtctcaccatgtttcccaggctgatcttgaactcctggcctcaagcgatcctcctgccttgacctcccaaagtgctgggattacaggcatgagccaccacacctggcctgattttatttttattttttagaccttcccactgaggcctctgcttgaccttggtcaccctgtagctcaacggggaaggcaaaggacagtgagggctgcttacagggaaggcagacctagggcagatcaggaaaggcctccctgagccagaaaccattatgctggggctgtgggatgagaatgagttagctccagaaggaaggcagctggttcctggggaggagatagaaatctggctgcaggagccagagttttcgcgcttgtcacccaggctggaacgcaacggcacgatctcaggtcactgcaacctctgcctcctgggctcaagcaattctgcctcagcctcccgagtagctgggactacgggt

SEQ ID NO: 11307 - DNA, 1202 bp, Homo sapiens
ggggctggctgtgaccagatgtgggtcctggctgggtgcgcagcccctgtccttgttacccctgatgtgatgggggcgctgtgggggtctggagagggcctctggagtcctgcagggaggggttcccctcggcaggcagggcacgtgctggctcaccccacgtccccctgtaccccctttgcagagatctaccgcatcgtgtcacagaaacagatcgcagaccgcgctgcccacgacgagtccccggggaacaacgtggtggacatcagcgtgccgcccaccacggacggacagaagcccaacaagctgcagtgctgccagaacctgtgacccctgcgcctccacccagcgtgcgtgcacgtcctccgcccgcccccgccacggtatcctctggcccctccctgctgtccctctgtggccggctcgttccagccctcccagtgagctctgcacggccgggccggggcccaggaaggacaggagccagtgctaccccgtcctgcccggggaaaagctagaagccccggtttgctgcacccatgaaactcgggtccccacagcgtcttggcggggtggggagggcggcaggatggacggggctggccagaggcgaggaggacgggcggacggcgccgccttctccccttttccttggccgactctagggagcgattgcctccctccctccgtgaccgggtggcccagccagcccgtcgtccccacccagaaccgtgctctgggccaaagcccgaagaaccaggcagcgggggccggggcaggcggaccccccgggctctcagcgcccacccgctcctccgcacacagcagctcgcacaggcctcccacctctgcctgttgattgatgcagggagaagcccgtccccccctctcccctctcccctcccctctcctgcacgcaacgcgccctctcggccctccctgtccccctcctctgtctcgtctccccatctggtctggaacctgtttgcaagtgaagcaatatctccgtgttttgtatatacaaccgctcttgtagcctttggtttttgttaatgtagagaaacacagattctttatacactttgtaagatttacgccaaaccccagctctcgatctcttcttctccctgtggcccctgcgctgttgccccgtccccgtcaccccgcccgttactgaaatgtataatctgacttcctgtaca

SEQ ID NO: 11308 - DNA, 1239 bp, Homo sapiens
ctcccttgcgggtggaggcctccgctcactgcagggctgccccacaggtctccttccgctaccactgccagctgtactccgagtggagaaagaccaaccagaaagttcgcctgaagatccgggaggcggacagccccgagggcccccagcattctccactggcagctggactcctgaagaaggtggcagaggagacaccagtatgaatgctgggctctccggaccctgcagcagagaggccagaggtagctggtgataccctgtcctgtggaaggacttccacttcaacacttccacttcaacagttcccgcacggcctgaacgcttcttaggccaagagacaccatgcagagcctagtctgtgatcctgtgtgaagatattttcagggtttttttttttttttttttgcatatggaggacaggtggacatggtcctgagctctggacggagcaggcaccctgatctcattctgaggtccacatggcaccttctgggccagcagctgtggccggtgtatcaagggcgcccttaaagctggaacattccagcaagcttcttgcgcttctctgcacccggcaggcccactttcctggcaccctcgactttatataaaagttgcactgcgtttcaaaaacccacccctgaatgaataaaaggagccctggctggacaaaatggacttgtcagttatgtttctcaaaggaggcctcccagggagggaccacatggaggtaaaaaaataacactggcggccagccaggtgtagtgactcactcctgtaatcccagcactttgggaggctgaggtgggtggatcacaaggtcaagagatcgagaccatcctggctaacatggtgaaaccctgtctctactaaaaatataaaaattacttgggcatggtggtgcgcgccggtaatcccaggtgctacacaggaagctgatgcaggagaatcgcttgcacctgggaggtggaggttgcagtgagctgagatggcgtcactgcactccaacctggcgacagagagagactccatctccaaaacaaaacaaaacaaaacaacaacaaaaaacactggttggccaggcacagtggctcatgcatggaattccagcactttgggaggctgaggtgggcggatcacaaggtcaggagttcgagaccagcctagccaatatggttaaatctcgtctctactaaaaatacaacatgagccaggcgtggtggcagatacctgtag

SEQ ID NO: 11309 - DNA, 1158 bp, Homo sapiens
acgctgaaggaaagtcaagggtaagtgtctgagagaatttcttctgtggatttactacatgaaaaatgtaactgtatggtggcgtggaatcgaatgaaatcaggaaggcagtgagtgctcatgttacagtagctatgtttgattttgccaaacatttgagtggggtgggaggggatttgcaaatgggagtcccgcttttccaaatggctggccaaagagctttttggtattctgtttggatgcccaatttggataactggggaccaatagcagcattgtctctttgttaacagaggaattggctgtgtgtgaattatgcatggaattttagcggtggtataattaatgtaaaacgtgtgttcttgtctagaaaatgttactcttggttgtttgctgaatttgaaagttgtgtgaaccaaagattccgaaaagttgcctttgtgccagtaaattgtaaaccaaatattaaaaacctgaatgttcaaaattggcctagtttaaagagaacataaactattttctgtcgtgcaatagaatggcttagaataatcaaaaggatgagcttaacttacggaagggatggatttaggaggaatatggtaaggactcgattgagtacagagggaagcagatctaaagttggtgtgatttcttggagaccctgaatttaggtctgcttattaaatgtcagcagctctagtgcaatgctggtaacgcgtaggagaaggagatattaaggagcccagcttttaacaaggaaggcgaggcgaggcacttctgtcagcttccccttagaagggttcattttaaaagactaactttgtgacataaatcatatttttagtttgtttataactgtcattgatatttactatttttttcttttctttttccccttccttgctcttctgactggtctctggcttcctccaaagggatgtgcgtaagtatcgtctagttacttattggtatttgagccttctaacttgtaggactggtttcactcgactcgtttccttttgactctatagtgttgttgaattcaagatggaagagagcatgaaaaaagctgcggaagtcctaaacaagcatagtctgagcggaagaccactgaaagtcaaagaagtaagctcttgcttaacactgcggatactgtgt

SEQ ID NO: 11310 - DNA, 1091 bp, Homo sapiens
gggagcgctgaggaaatgcagccagagtggcccccagcagagcatcctagagggacaggctgggaggggaaggtgggagtgactccgacttgtctccacataactcctgttcattaccctgggtggccccccgagtggggggtgtccatgcctccccctggagcatttctcagtgtctgctgatggagaaacctcagatgtctcaggaattgacgtccatggttcacaaagcttgtcacagacactagcacctcacagacacacatacaggggtgttctttagaagttgtgttatggaaatctcagctgtggcatagagcagagagaatgctgggaggcccccatgtgcccaccacacagctgtagctgttgtcaacatttgaggggtgtcttaatggtaaattatggtgggcctttacccctgatccatgcccatgagctgaagtggtctggcgtgttgtgcacacgcacactcaagttcttgacacccacctgtgttttgtgtccctgtttcaggtggaggtggaggaagcgtccctgggatcgagaggatgggtcctggcattgaccgcctcgggggtgccggcatggagcgcatgggcgcgggcctgggccacggcatggatcgcgtgggctccgagatcgagcgcatgggcctggtcatggaccgcatgggctccgtggagcgcatgggctccggcattgagcgcatgggcccgctgggcctcgaccacatggcctccagcattgagcgcatgggccagaccatggagcgcattggctctggcgtggagcgcatgggtgccggcatgggcttcggccttgagcgcatggccgctcccatcgaccgtgtgggccagaccattgagcgcatgggctctggcgtggagcgcatgggccctgccatcgagcgcatgggcctgagcatggagcgcatggtgcccgcaggtatgggagctggcctggagcgcatgggccccgtgatggatcgcatggccaccggcctggagcgcatgggcgccaacaatctggagcggatgggcctggagcgcatgggcgccaacagcctcgagcgcatgggcctggagcgc

SEQ ID NO: 11311 - DNA, 1366 bp, Homo sapiens
tactcctggagtagagcctttgccctctagggctctgtccacggcgttgacacatatctggatgcttaacgggtgctcaaatgaataagtgaaacctgctggctttcatttggacagtacagacgtgtccattggattgcggatggctttgtaaccaggggcggtggcatatcaaaaatgaagactttgtaaaatgtatgggaactttctgcctataaagctggctttacactgcgccttcttttttgaacttcctgaagcgtaaaggcgtgcattgaatccgccaggaaggcttttcatggggcaggggcaggctctgttagcagaagaatggcagtgtggctgagggggccgtagtcattggttctcgccattgtattctgagcctttgtgctctaggcttcagggcctctcctttttgactctgtccaccaaaatctaacaaaatcgggactgagtgtcgtctcttcttccctccctgtcctaggccacgtgctgtacgccgacatcaagatggagaatgggaagtccaaggggtgtggcgtggttaagttcgagtcgccagaggtggccgagagagcctgccggatgatgaatggcatgaagctgagtggccgagagattgacgttcgaattgatagaaacgcttaagcagttgccttttttaaacatcgatacgagacctctgaatttgtattttttcttgttaaccattttaatttgttggctggatgtataaagatgtttaaaaaattcagttgctttttggggtaatttgaattacttttttaatgactggggttccatttgactgtttgcattgagattgcaatgtgcgcaattttttttgtagttgtggcatcttgttgacatcgaatatgactttgataataaataccggttcctgaaaacggcctgcttgtgtgtgctgtgtgggcaaccacgcgaggtgtggggagctggggtcactcgagcttccagtccaagcagcagggatctcatcccctctcttgcttgtctgaggccccaggggtgggtgcctgcccacagatggggggagactcttccctggaaactgccttcctgtgggctgtaatcccccggcttacaatggagcgtttggctgtttagagccttctgaggccaggcgcggtggttcatggctgtagtcccagctactcaggaggctgaggcaggagaatcactcgaacccaggaggcggaggttgcagtgagtgagatcgcgccactgcactccagcctgggcaacagagcaagactccgtctcaaaaaaaaaaaaaaaaaagccccccgaaagccatcctgtctccctgttgtgaagttaacgccctggggcacaggccctg

SEQ ID NO: 11312 - DNA, 2250 bp, Homo sapiens
tccagttcctgtaaaaactgggaagacgaggcgttctcatcccataggaggtttgtgagaactcacgccgggggtgaaaatgtacgtctgtagcatggagaagccttcagggtacattcagctcttaacaaacacaggaggacttaatggcagcttggcatttaatgtcaaaatccaagccgtggcatttaatgtcaaaatgacttcagaccacttctagccttctgggcccatgagtaataatgagcacactagggagcatctctgtaaacacagtggctggggaaacccttcctagtctcacttgattcctcatgacggaaatcacactaaagagagaaatcagtgaagtaaggaacgtggaaggtcatgaatgggccgcaaaccacggccagctgcttgtctttgtatggcttgccagctaacaatagtggttccatctttaaggaagaagaatgtttgatggagaaaatttgtggccaatgaagtctgaaatacttcctgtcatctgcccctttccagaaaaacttggccgacccttggtctacagcacgggttctcagtcgggcgacgatttggctgtctaggcgtcatttggcaatgtctagagacatttttggtagttagaatggggggaagatactcctgacttgtaataagaagacatcagagatgctgctaagtcggctccagcacacaggagccccccacaacgaagagttagtgcccccaaacgtcactgttgctgaggttgaaaataatcatgcagtcattcctcaattactgcctgcagcaattcctccatttttatgaatcttgtgagcacttacgctaggagaaatttcttttacaaaacttttaaaatacaattagtgctgataattcctatgtggaaatgattccagccatggtcccctcacttgagcatgtgaatattctcacggagagaagccccagcgagattttccggtgaatacgggattgcacttactctttcatcacggaaacagaccccccgagagaagccccaacgagattttccggtgaatacgggactgcacgtactctctcatcatgaaaacagagccccgttcataaatttttcatctttatttttaaggttatactcctctaaataacccttaagcctcatcaagaaaggtttgtttatagtatttttactatagcttcatccttgataacgtcctaatttccttctggacaacctccttgaccaatggcatattgagatctatgtgacatgaggatatttctcagtaccactttgttactggtacctgatgcacacggattgcgaccagagcatgatgcctccatcaagtggtaatatgtttgcagcctgctgtccagccaagagtgacagatacttctagtgacttccccggtatccactctcatcttcttccaatatcaagagaatccaggttctgtcagattagtaaggtgtgctaatctaaattttaaaaaatctcttacaggttttcttgcagctggtaccatccatgtctcacagccctggccactgacagatcagcagatgtcaccacatgggcttctgagaaagctcttgaatggggatcgttcttaaacatgaattcctccctgtatgttttgttctttgctttacttttcaccttgcaaagagatccagtacctagtattggaagatccaccttaacgaccgtgcatatgaaaaccacagtctaaggaagtgactgcagaaagctcacagcgaccctggcctcccctgtggcctctttgagtgtctgcagcagccctggacttccagacttctatcacatgagaaaaaataaaactgattattggtttaagctgctatggatatttcattgtttttcttttaaatttatttattttaagatgggggtctccctatgttgcctaggctagattcgaactcctgggctcaaacaatcttcctgcctcagtctcccaagtagctgagaatacaggcatgtgccaccacacccagcttgtttttctatttcatttgtttattggtgggagggggtttctacacccagctggatgctgcctggagcccatacacctggtcattggtcagttgtgtggtttttttttgtttttttttttttgtttgtttgttttttgagacagagtcttgctctgtcacccaggctggagtgcaatggcgcgatctcggctcactgcaagctctgcctcccaagttcatgccattctcctgcc

SEQ ID NO: 11313 - DNA, 1123 bp, Homo sapiens
gctatgtatgtcctgggcaagttggccggcaggtgtgtcatggcatcatttaggtcagaaggagcaagggtagaagtgtcagggtgacattaagaaaccccctactgagtgtgtcagggtgaccttcacgttggagagaagaactggtgtccctggagagtggctgccaggccttagggtacacggggcgggtgcagttcacccagagggctgccctggcttgctggggctgtcgcaccactggcctagggaggacactggaagggacgcccgtttgtgtcagagcaagaggattggggtagggcaggctttggcccatgggcaccttcctgggggtggcctggagtcaggaaggcggtagccattcctcctgacctggcacgtgcacaagactgcatacacacacttgctcacacacagtcacaccacacacaccacgtgcacacacacgcagccctccccacttggcttccgaaacgtgagtcactcagatgctactctgctgccgtcttgccccctctgctggcagccctgttcctcctaactccaccagccctggcctcctccgcctcctggagagtcagagccgatgggctagtttgggccacacagggtggggccaccctgagttctgccagcatgcagactgtaggtggggagccgggagaagagctatgttgcctgcctctgggaccctggggctacagcccacgagtgtcccttgcagagcccaccagggtgccttggaggcccatcccagtgccaggctgttcttcccagatgggacagctggggccacaggctgccgtggcagtgctgggctttctctggacagctctcccacctctgcccagggggcccggggggccagccccctgcctgggtcagcctctccctgcctgctgctctcctctggcccatccagcttgtatgtagattttccctcacgtgtgtgtgtgtgtgtgcatgtgtgtgtgctggtgagagtgacagcgggagcagggatgtgagacctgcagggtggcagggctcatggatgactggcggggtgcattaagtgctcatgctcgtgaaaggcacctcttcttgggtgtgggtgaggacaggtgtgactgcgcatgca

SEQ ID NO: 11314 - DNA, 1372 bp, Homo sapiens
ccctcccggactggagggggctcctgcagggagggggatgggagcagacatggcttttagtgcctgaaggtggagcagagggaatcctggggtgggtggcggggagatggggtcccccgccagtgtgggggctgtggatgtggcatgcctgacccccatcccctgttcagtcggggggctgtgggtctgatggagaagtggttattcctgcatgccctgttccccctccacttgatggggaccagcccagattgcgggggtgcctggctggcagagcttagggacctgagcaactaaagcccggccccaggggacctcccctcccccaagcgctgagtttctaataaaggccaagcctcataaacaatcacctgtgcccgctcccatctggctggcttcgggagcaatcgctcattcgcctgctgcctgcctgccggagcatttgtcattaggaaggtttaatgggtttcctctcagctccagagggctggggagagccggctgcatggatacaccgccaggcagaatgttctcccatcgcctggtggaggggggttgggagtgaggcagccatgccaccattcacaccaacagttggatgtggggttggggaagtgactgcacccctcctggaacagtagaggccctgggtctggaaggatcggaaattagtggctggggcccagagggtttgctgagttccactccagggtgaagaatgggctttgtgtcctgaccatcagcagcagggcccagggaaggctgtgcatcgttctgtgtgggagccgctgcccccacccgtgtgtatgtgtgtctgcgtttgcccaagaatgtgtggggccatgtgactggtcgtctctctgtcctgtgcattttgggagtcctccggttctgagagtcctccggttctgagtgtgaccacctgcccctccaggtacccccttcccttgtctgtctgtgcagtggccaaaacccaaatgagaatgtcgctgttaggtaaacatgcctccagagcccacttcggggccggtgattcattattaagcagctgcgcattccctcacctcccacccaccccctcaccccctcctgtctagaaccagggcataaatcccaggcctttaggatggtgacagtgtagtcttccctagtgccacttacaggcacctcccaggccagacccgccccagggggtcagtctctacgtgcccctggcttctgtggccgctgggcagagctggagcaggtcaccttggggtaaacggtattactgccccaggacaggagttggcttcgctgtgcccacgtccatgatgagaggggaagtcagtgagttagcagtggatagccgaagacgcacacagattgatcc

SEQ ID NO: 11315 - DNA, 1146 bp, Homo sapiens
ggcagatggtcagagggaggagatccaaaatggctgtagtcaaaaggaagaggttgtgggtgatggtggtcaaaggaggaggttagagagagggaggaggtgggggaagaaaacacactggaagcccctcctctccacgtgggtttcccctggcaagggggctccaggcctgggatatagccctagggagcctgcgcgggagagcagggagagggggaccgttccactctggggcttaggccaggaagttttgattcatcccagaactaggtcaactttttttctcaccaaaaaccaaggggaaaaaaaaaaacagagtcaacaagctgctgaggtcggaacatctgtggggtggtgaggaggcggggggtgctgggggcccaggccggctccttcttcctgagccacaaacatggtgggagggagggagaggctgagccccctaaaaaaaccctgagcctctatcctggagtcctgggcttattctagctgttccccacctctgcctgacacccccggcttctctctgctgcagatcctgtggatgtcctgaaggccctgggtgtgcagggaggccaggctggggtccccgaggggcctggcttctgtccccagaggactccagagggtgaccgggcattcagaattggccaggccagcacgctcggcatccccacgtgggaactctttccaggtgagttggagtaggaggcctgggtacctccccggagggaggcactgctgggccctctgagctgccttgttccctctgcccacccagaaggccactttcctgagaacttctccttgctgatcaccttgcggggacagccagccaatcagtctgtcctgctgtccatttatgatgaaaggggtgcccggcagttgggcctggcactggggccagcgctgggtctcctaggtgaccccttccgccccctcccccagcaggtcaacctcacagatggcaggtgagcatggggagagtgggcgggggtccgtggataaggggtggggtgagaagcacccgcactgaggccgtccccttgcaggtggcaccgtgtggccgtcagcatagatggtgagatggtgaccctggtagctgactgtgaagctcagccccctgttttgggccatggcccccgc

SEQ ID NO: 11316 - DNA, 1241 bp, Homo sapiens
tcagtgcacgggttctgtccccactgctgccttcgtgctgtcatctcccgcacgacagtgcagcgggtttgatggtgccagactctcctcggggcgtctgtgccttcctaattggctgtacctcctatggttgggagacgggcgtctcccatatatgtgcgacttggcagctgtgactttgctggtggccctgtgactgtcctgatgagctgctgtctgtcggccccagggtgctgaccaccccacatcgtgtgtgcgcactgtgtgtatagtgtctccgttgcatgcctgtggctgtaccgtccgaattctttggtgggatttgctggtggcgagtgtgagagtgcagacgtgcacttgtcgcctgccacgcgagggggacctgggcgctgttcctgttgtgtgtcccatgtctgccgttgctgtgcatgtgaggctgctgcccctgttgtcctcccgccctctctggggtggggtcggggctcctcctcctcctcctccaccagtgtcgctggctgggagctcaaatggtgtcagcttctcaggtgtcaccttggtgtcctcgtggccaactggctgcctgtggtttggcacacagtgcctgcgctggctcaacactgaagcccgagcttcctggggcggctctgtccccacgcctgcgccacagtgaggttgaacttgactgtcttttggtccccagagctagagccggtgcaggccacgcagaacaagacagggaagtatgtgccgccgagcctgcgcgacggggccagccgccgcggggagtccatgcagcccaaccgcagaggtgaggggcaccccgacgccaggctggtgggtgggcacctcccggcacctcgtaattatccccgaagcgtgcacacgagggctgggcagcacacgagggctgggcagtgtcctccccctcacagccacctcccctctcccacacagccgacgacaacgccaccatccgtgtcaccaacttgtcagaggacacgcgtgagaccgacctgcaggagctcttccggcctttcggctccatctcccgcatctacctggctaaggacaagaccactggccaatccaaggtgggcaggcaggcaggcacggtggggctgtgtgagggtcacttgtcctagggtcgcctgtcctagctcgtgcccgaccccatcccgcccctccacagggctttgccttcatcagcttccaccgccgcgaggatgctgcgcgtgccattg

SEQ ID NO: 11317 - DNA, 1203 bp, Homo sapiens
ccctaactggggaggtctttaccctgcggttccataactggggggtctttaccctgcggttcccaactgggtcgggggtcattacctggcggttccctaattgtgggggaatctaccttgcagttccctaatgtgaggaggggatatctttaccctgtgattcccttactgggaggggtctttaccctgcgattccctaacttgggggatctttaccctgtggttccctaactagggggggtctttaccctgcagttccctaaatgggggggagtctaccttgcagttccccagtgtggggaggagatatctttaccctgcagttccctaactgagggggtctttaccctgcggttctcgaactagggggtctttaccctgcagttccctgagcaccccaggaacatggtactgtttaattcagcataagctcaccacaaaggagagctcctaacgaggcctctcccgctcgcaggcctgagaacacccacaagtccactccagcgagctaccacgcagacatcaacctgctctactggagcgacgaggaggccgtggtggacttcaaggctgtgcagggccgctgcaccgtggagtatggggaggacctgcccgagtgcgtccaggtgtactccatgggcggccccaaccgcttctacttcctcgaggtggtgcccctgcttgctagagggaaggcttcggggtcaaagttggccagaaggagtctgatgtcgggttatacacaaggcggcttggctgcagggtttcagcttttgtaagaagtgggtggttggctgacgtgaagctgttctgcaggagctttacgggggtctgagcagggttctccagagcacaagttgtatgagattcaagtggtcccggagtttaacactcctggtttttaaaaagtacgtcattagagaacctaacgttttagtgtcttggtgcaactgaacgttgaggaccatgaggcagcttccaccagcctgactggtgtcttagtatgagttggagaaggtgcccctgctcctgggtcccttgggccaggcgcctacgtccaggcccagcccacatgcctgtgcgggtggccctcgttatggagagggcccacgagtcagctgatcaagctcatgacttgtaaattgttggggcttggcctttccgtgttgttaccttaaaacgatacatccacgttctcccagg

SEQ ID NO: 11318 - DNA, 1174 bp, Homo sapiens
ccctccgaaaactgggccatggaggtgagtgcctggtgtccctcgtgagcccctgccttatcgtggagggtcactgctgacgtgcgttctgttttgttttgatttgtatttttttttaatttggttttttttttgtttttttttttgttttgagactgagtttcgctcttgttgcccaggctggagtgcaatggcatgatctcagctcactgcaacctccacctcctgggttcaagtgattctcctgcctcagcctcccgagtagttgggattacaggcacccaccatcacgtccagctaattttttgtatttttagtagagacggggtttcaccatgttggccaggctggtctcgaactcctgaccttaggtgatccacccgcctcggcctcccatagtgctgggaatacaggcatgagccactgcgcctggcctgacacgcattcttatctcccaagggaggcatggatcccgagtccctgctggagggggacgacgggaagacctacttctaccagctgtggtatgatcaagactacgcgagattcgagtcccctccaaaaacccagccaacagaggacaacaagttcaagtgagcactggggctggactcggggtcagcaggcactttcagcccacatcactcccttttcccgtgtgcttccgtctggttggcttccgccaacggccccccagtttgtgtctcttgctcgtcaaaggccagcctgactatgaatgatgctcaagtgtgtagatggcctggagttgctttaagtgtgtggatgacctggcgttgtctttgtaagagggttccctacccaggaacagggttcgtcttgccatttcaagacttcccgtgtgttcttcagtgtgtgcccagctcttgcatgtttttggctgtttcttagatattttctcctgtaaatgagacctcttatttgattcttttctttcctttttttttttctttttttttttttgagacggagtctcgctctgttgcccaggctggagtgcagtggtgcgatcttggcttactgcaaactcagcttcctgggttcatgccattctcctgcctcagcctcctgagttgctgggactacaggcgcctgccaccacacccggctagttttttgtatttttagtagagacgaggtttcactgtgttagcca

SEQ ID NO: 11319 - DNA, 1119 bp, Homo sapiens
gaggtaagagatcgagggtcctcagcatccgggattcccactggaaacttgccttcagaaccagcagacactgttcttcagttggatttaggccagtttggcttaagcatgagagaaacctgttctctttcaagaccacggttcctccttctggcctcaacttgaaccgcttcacagaggactccctcctgcgacacgcgcagtttgtggtggagcaggtggagagttatgacgaggccggggacagtgatgagcagcccatcttcctgacaccctgcatgcgggacctgatcaagctggctggggtcacgctgggacagaggtaaggatgcggcagggaccagagtgaagactggagaccggggagggtagagcatggcccacatcctctgtcccagtcctctgagatgctggaacctctcccgtaggcgagcccaggcgaggcggcagaccatcaggcattctaccagggagaaggacaggggacccacgaaagccaccaccaccaagctggtctaccagatcttcgatactttcttcgcagagcaaattgaaaaggatgacagagaagacaaggagaacgcctttaagcgccggcgatgtggcgtctgtgaggtaacctcacctgtgggtgctcccgctcccctaaggtggcccagcctctggcctgatctgaggactgctccatctttctctctgtggcttgagactctggctgctcaaatgtgacccctgagacagaaattagttagtggtctgggaggaccctgcatacttcattgaacgtcaataggacagatgtccacagaggcatgcttgggtgctttgctgataatgccactgtccttaattgaagagcctggcttctgggtggctctgctgtgcctgcatctcacagtctgaaggcccctgttggactgctaaaggggtattcacatctaagtgggcactttgtccagcttagatttgaggccctcaggaggcgtccctttctgtgagtttttaaaatatatgtttacttcactcaggaggaactaacttcctagtcctatgacccaaagaccaggactattttgatacctattacctgactttcttttggataaagactggcttcag

SEQ ID NO: 11320 - DNA, 1121 bp, Homo sapiens
tgctgttgcagacacacatacacttgatgcttaggtgggagaataaggtagaaactctgggtgatagaacgctgtcttaatccagtgttcccgcaaccaaaaaatgagtgtcggggccaggcatggtggttcagcctgtaatcccagcactttgggaggctgaggtgggtagatcactggagataaagagtttgagaccagcctgctacacatagtgaaaccccgtccctactaaaaatacaacaattagccgggcatggtggttcaggcctgtaatcccagctactcgggaggctgaggcaggagaattacttgaacccgggaggtggaggctgcagtgagccaagattatgccatcgcgctccagcctgagggatagagcaagactctgtctcaaaaacaaacaaaaaaagagtgtcagacttgtacattctctcattgcctcgtgcctgatctgaagtctgcacgaagacccgccttcacggcttagctggtaagcatgtgctttgtttcctgtctagtgtgtactgtaagcacggtcacctgtgtcccatcgacaccggcctcatcgagaagaatatcgaactcttcttttctggttcagcaaaaccaatctatgatgatgacccatctcttgaaggtaaggaatagtccgggattatgtttggggcacactttaaaaacagccaggcagggtggctcacatctgtaatcctagcactttgggggtctgaggccagaggatcacttgagcccgggagtttgagacgagcctggacaacatagcaagagcctgcctctattaaaaaaaaatatatagcatatatatatagtatacatatatacttatatatatgtataaataaaaaacatacttatgaagcaatagtcagctggagttgctgctgcctcttaaagttagggtgtgagactttgtgccaggagcagctgtaggccaagtcattgtgatgactgaggagcacccgacctggctgatgggatgtctgctgagtgggcgcttagagcgcctcctgggtttgggatgtgagtcagagcctttagtccatttcctttttctgctctaggtggtgttaatggcaaaaatcttggccccataaatg

SEQ ID NO: 11321 - DNA, 1126 bp, Homo sapiens
atcgtgctaggcgtctttatcgtctgctggctgcccgccttcagcatcctccttctggactatgcctgtcccgtccactcctgcccgatcctctacaaagcccactactttttcgccgtctccaccctgaattccctgctcaaccccgtcatctacacgtggcgcagccgggacctgcggcgggaggtgcttcggccgctgcagtgctggaggccgggggtgggggtgcaaggacggaggcggggcgggaccccgggccaccacctcctgccactccgcagctccagctccctggagaggggcatgcacatgcccacgtcacccacgtttctggagggcaacacggtggtctgagggtgggggtggaccaacaaccaggccagggcagaggggttcatggagaggccactgggtgaccccagatagagacttggggctactgagccagatgcccccgccccacagacctgggtgatgttgcaaatatttcacacctggaaaggccagataaggcactgactagtcacatagcagtgttgcagtgcggtcctgagggccagtccagtggctagtgtgacccctttagaactggatcctggggaggccagggcaggggacctgtgaagagccagggtgagggcaggcagcatttaaggggagctcagggcaggagcactttaccacctggtacaaaggatttttttttttttttgagacggaatcttgcactgctgcccaggctggagtgcagtggcgtgatctcggctcaccgcaagctccgcctcctgggttcatgtcgttctcctgcctcagcctcccaagtagctgggactataggcgcctgccaccacacctggctaattttttgtacctttagtagagatggggtttcaccgtgttagccaggatggtcttgatctcctgacctcgtgatccgcccgcctcggcctcccaaagtgctgggattacaggcgtgagccaccgtgcccggctttttttttttttttttttttttttttttttttttttgagatgaagtctcgctctgttgcccaggctggagagtgcagtggtacggtctcagctcactgcaacctccacctcccaggttcaagcgattctccag

SEQ ID NO: 11322 - DNA, 1189 bp, Homo sapiens
tgagccggcgggcagagctgggtgggggcaggggccatggacctaatgcaatcctcaccgcctgttgtatcctccccacagccccccggtatgagattgtcatcatcactgtggtagcagccgcagtcataatgggcactgcaggcctcagcacgtacctctataaccgccagcggaagatcaagaaatacagactacaacaggcccaaaaagggacccccatgaaaccgaacacacaagccacgcctccctgaacctatcccgggacagggcctcttcctcggccttcccatattggtggcagtggtgccacactgaacagagtggaagacatatgccatgcagctacacctaccggccctgggacgccggaggacagggcattgtcctcagtcagatacaacagcatttggggccatggtacctgcacacctaaaacactaggccacgcatctgatctgtagtcacatgactaagccaagaggaaggagcaagactcaagacatgattgatggatgttaaagtctagcctgatgagaggggaagtggtgggggagacatagccccaccatgaggacatacaactgggaaatactgaaacttgctgcctattgggtatgctgaggccccacagacttacagaagaagtggccctccatagacatgtgtagcatcaaaacacaaaggcccacacttcctgacggatgccagcttgggcactgctgtctactgaccccaacccttgatgatatgtatttattcatttgttattttaccagctatttattgagtgtcttttatgtaggctaaatgaacataggtctctggcctcacggagctcccagtcctaatcacattcaaggtcaccaggtacagttgtacaggttgtacactgcaggagagtgcctggcaaaaagatcaaatggggctgggacttctcattggccaacctgcctttccccagaaggagtgatttttctatcggcacaaaagcactatatggactggtaatggttacaggttcagagattacccagtgaggccttattcctcccttccccccaaaactgacacctttgttagccacctccccacccacatacatttctgccagtgttcacaatgacactcagcggtcatgtctggacatgagtgcccagggaatatgcccaagctatgccttgtcctc

SEQ ID NO: 11323 - DNA, 2022 bp, Homo sapiens
tgcttcctctggcccccagggagtgacctgttccacctctccatttctcccaggcaatcggctcttccccgctggggtccggagaagggctcctgggcctcagccccgggcctaatggtcacagccacctgctgaaggtacgggcagggggtggggacatgcagggctgggaagccccggccccccagcggcccctgacccgccccgccctgccctctgtctccagaccccactgggcggccagaaacgcagctttgcccacctgctgccctcgcccgagcccagcccagaaggcagctatgtgggccagcactcccagggcctcggcggccactacgcggactcctacctgaagcggaagaggattttctaagtggctggcaccagagataactcaagggcctgcaccaaatcgcttttgggttttctgatgttttgttttgtgttttttttaaaccattttctctctttcggtaatagaaaaatctctgaaagactttactgaccaatcagccggagccccaggagcccaaggggtgtgggggagtctggaggcctcattatgtctctggcttgctccccacgctgaaaccctgcagccttaagagagaggggccccggcctgctctccctccctccccccatctcctcctccgctgtgcccgtctctccggagccctcctgcctcattgctcctgtaattttggcctttcgagtgccttggaggtttccctgacctcccgtgaagatacagagactgtctcctttttttttaactttgacaactgacttctgtttccttttctaagttttatttttcaaaccaccccggacagcccccagctctgattccttcaaggcccggcctgtccgggccaccattccacaccttgcggtttgaaacagctgtttttcccacatttgctgcaggcatggctgtctcctgcccctgcctgcccatctggcctataccccagccgtggggcccggggtccctgccgcagccccctccccttctgatgccttaaaagctgggccccaggccctgctggccagagccacagatgccaagctctgggagcttgactatggaccaaacagctctggcctagggattgggccaccctacccaggatctccaccctggggacagtagaaggggaaagccttcatcttggcgaaccggccccaccaccccctcctacccgggcctccgtgcagagatgggctttctctgccagtcccctgctgtctgtctgtgggagtcggacattgtgcccatctcccggagcctctgctgtcactcgcttgttgaagatgaattcttgaattctgcctgcccacccccggccagatccctggagctggcctccttccagcccagtgccagaaaccagcactccatgaagataaactctgggcccgcccaccagcaggacctgtcgacctgaggtgaccctgggccttgcccccagccaactgggccaccagcttccctcccttgactctgggggtccacatccactccaaggggactattcccccgaccccaccccagtctccccacacggacctttgctgaattaaagtttgtaagtaaatggttttaaagaaatcagagttggctggttcttgggacaaacagtgggcttgagtgggaggtctgggatggccccgcgggtttacctgagatggattccgccctgctcttcccacctggtcaccgcaggccctaagcaaacatctgcgcttatgttccattgattatgggctttccctcgcctccctggcgcggcgcatgctcagtcggtgagtcacgtgatgcatgtcatggccgcctccatggcccggggaggcgtgagtgccagggttctactgcaggctgccaggggcacctggtggaacagacctgggggcacttccgggtcgggggagggggtggcgctggggacaaccagaaagtttcaagcgacaggtacctggggcgcccggggcgggcagcgttaatccgtcagatgccgg

SEQ ID NO: 11324 - DNA, 2022 bp, Homo sapiens; identical to SEQ ID NO: 11323

SEQ ID NO: 11325 - DNA, 1186 bp, Homo sapiens
ccgcggcaggcgagaagtcgctgcagctggtcatggagtacgtgcccctgggcagcctccgagactacctgccccggcacagcatcgggctggcccagctgctgctcttcgcccagcagatctgcgaggttggtcggccccgcccctgcttctggagcttgccccttcctcttcagcttgggctggcctgagcgatccggtgcagtctgctctcacgctccgcccctgctcgtttgcccaggctgtcttgtccttgcactgacctccgaactgtttggcttgcttggccacaccccctcctcccaagggaccacgcacagccggctcggcccctcccaactcgccctcctgcccagctttgctcgtctagccccgtccctgctttctggctcagcctccttttgcttggtgccacgtgccatccggccctctccagcggccgggtagccaccggcctgacctgactgtcccccagccctcctggctgctcaggtcctgccgccgcccccggccgaaccccgccccactgaaactcacgagccctgccccgtccccagggcatggcctatctgcacgcgcagcactacatccaccgagacctagccgcgcgcaacgtgctgctggacaacgacaggctggtcaagatcggggactttggcctagccaaggccgtgcccgaaggccacgagtactaccgcgtgcgcgaggatggggacagccccgtgttctggtgaccaggcggggtgcagtctgagggggtgctggggtcacttggaacaggcagggtggagtagacggatgctgggtatcatgatagggcatgatcccagtgaagcgcggcggggcctagcggtgcgggggtggggcctatggaggcaaggggcggtgtatagagtgcggcttggcctggtgggcggggttaacccggcctagccaatgagcggcctagccaatgagcatatcaccccgctcaggctgcgctcttaagggtgggtcccaactgagcccagagggtccttcagtctcaggtgagggcttcagcctggtctgatccccaagccctcagtgcagccccccgtggcctgagtgcccccctccccctaggtatgccccagagtgcctgaaggagtataagttctactatgcgtcagatgtctggtccttcggggtgaccctgtatgagctg

SEQ ID NO: 11326 - DNA, 1369 bp, Homo sapiens
ttagccaggcatggtgacaggcgtcggtaaccccagctacttgggaggctgaggcaggagaatcacttgaacctgggaggtggaggttgcagtgaaccgagattgcaccactgcactccagcctgggtgacagagtgagactccgtctcaaataggtaaaatatcaataggcaggaagccagcttggggatgtgcaagggacaacggggacaacggggaccaccggctggcggccccacctcatctgcctgccttctcctcacaggacgcaaagtaccacatgcagcgctgcattgactctggcctctgggtccccaactctaaggccagcgaggccaaggagggagaggaggcaggtcctggggacccattactggaagctgttcccaagacgggcgatgagaaggatgtcagtgtgtgacctgccccagctaccaccgccacctgcttccaggcccctatgtgccccttttcagaaaacagatagatgccatctcgcccgctcctgacttcctctacttgcgctgctcggcccagcctggggggcccgcccagccctccctggcctctccactgtctccactctccagcgcccattcaagtctctgctttgagtcaaggggcttcactgcctgcagccccccatcagcattatgccaaaggcccgggggtccggggaagggcagaggtcaccaggctggtctaccaggtagttggggagggtccccagccaaggggccggctctcgtcactgggctctgttttcactgttcgtctgctgtctgtgtcttctatttggcaaacagcaatgatcttccaataaaagatttcagatgctctctgggctgctgggagggccgttcaggcagcccatctcttgtaggtgggagggaaacttggtgggatattgggggctgagctgtgcttctctggtcctttgcccaccagccatcgtgggtcctcgcctcacacatgctgttccacaacttggaacagtcttcttccagaggcctcaaaagcccccaaccttcagtctcacccacccactcccttgtccctacttggacctccagaatgcagggtggcccaagctgatcaccaccagagggcagtagtgatctgcaaaccaagtcacattccctagggttttgtggatctggcgcacctgcccgcaccccacacctttccagcttcctacaaccttttggagcagcatcctggatggactatatctccccaccctatggccagcgctgcccccaaacagatttttttttttttttttttttgagagtccagctatcacccaggctggagtgcggtggtggaatctcggatcactacaacctccacctcccaggttcaagtg

SEQ ID NO: 11327 - DNA, 1253 bp, Homo sapiens
ggactctacccttatgggggcgagagatggccaccagccattctgggcacccaccctgtggtcactggaagggaaacgcaggttttgcagcaaaaatcccaggactgtcagtctttggctgagctgggtcacatgctcatggctgagccaatcactgtggccaggggatggaaggtgctgattggctgctctctcctggagaggtggtcctgagaagcacctactaaataaacctgggctaaggaatatggcttggcactgtttgtggctgaccctgtctccctcttcccgccaggtcctcagctcctcctcagccacagagcggtaccccatgttcaccctggccgagggccatgctcaggaccacagcctggacgacctctgctcccagctcgcccagcccacactccggctccctcgcacagggcggctcctcagggccaaacgccccagctctgaggactttgtgtttttataaagggaggggatgaggggaaagatacaacactatttatttttttatttatgtcatgtcgggtgtgggatcttgagctctggcagtgatgatggtacttcctgttgtcagcccctcaagcccagctgcaaccagtctggggccattcagccagggacagagcccacagagcccatacacctgtctcccaccagcggggccctcctggcagggtagggaaggaggaccccgggcacccccctcagggcctgactcacgtactgtagtttgcactggacgcccgggccctccctgtcccaaagcccccttgggggaactgtggctgctgggggccaataaagctgtgtaacttgatcgtgggtgtggctgggcgcagcgttctgaggggatgtggggtctgggaggtgtctcgaggtgagagctccaagtcacgggaagtttaagtcagcctcagtttccacatccataaaatgggacgacttccttacccacagctacacgtgttttttaatttttttttttttttcaagagacagggtcttgctttgttgcccaggctggagtgcagtggtgcaatcatagctctctgtagcctcaaactcatggccttaagtgatcttccttccccagcctcctgagtagctgggactacaggcatgtgtcaccacattttgtagagatggagtctcgctaagttgcccacgctggtctccaattcctgggctcaagtgatcctttcacctcggcctcccaaagtgctgggattacaggcgtgcct

SEQ ID NO: 11328 - DNA, 1165 bp, Homo sapiens
gacctggagaggaatgacggctcggccgagaggccttacttcatgtcttccaccctcaagaaactcttgaacaagaccaacaagaaggcagcggagtcctgaaggccccgtgctccccacctctcaaggagtctcatgccgcagggtgctcagtagctgggtctgttcccccagccccttgggctcacctgaagtcctatcactgccgctctgcccctccccatgagccagatcccaccagtttctggacgtggagagtctggggcatctccttcttatgccaaggggcgcttggagttttcatggctgcccctccagactgcgagaaacaagtaaaaacccattggggcctcttgatgtctgggatggcacgtggcccgacctccacaagctccctcatgcttcctgtcccccgcttacacgacaacgggccagaccacaggaaggacggtgtttgtgtctgagggagctgctggccacagtgaacacccacgtttattcctgcctgctccggccaggactgaaccccttctccacacctgaacagttggctcaagggccaccagaagcatttctttattattattattttttaacctggacatgcattaaagggtctattagctttctttccgtctgtctcaacagctgagatggggccgccaaggagtgccttccttttgctccctcctagctgggagtgacgggtgggagtgtgtgtgcccaggtgggggtgtctcctggctgggaaggagggaaagggagggagagttttgcgggggttggcagtggagagcaggctggagaggagatggctaatagctgtttaatggaaacctgctgggctggagggagttaggctgaatttcccgacttcctctgccagttattgacacagctctctttgtaagagaggaaagaaactaaacccacccaagggatgatgtcagggggagaggtggagggcagatgtcctgggcaaaccgggcccctctgcccacacacctcacttgatccttttgccaaacttgtcaaactcaggggaactggcttcccagttgcccctttgccatattccaagtccccctcagacttcatgtctctgctcatcagcactgtcccaggatcctggagagggagaactcctggccccaggggaaagagg

SEQ ID NO: 11329 - DNA, 1269 bp, Homo sapiens
gtcattcttgctactgtgtacctagctgctgaaatgaatcctataaattatatgaaactaaaaagattttctgatcttatagagttgaagtattgataacaccaaggaactctatcacaatttgaaaagataagcaaaagtttgatttccagacactacagaagaagtaaaaatggtaagtttgtttttgatcacagatactgtttcttcactcatgtacagagatgtttgtagccttttccaaagcatttgcttccattaccatttttattagcccttttggattataaagcaatattatctattctgtattccattctgatagtgtaggaacgaagtcagtgccccattactcccactgcccagagacaacagcttttcagtttgcttgtccctccttggttcttcagttgtgctcctgcaggctttgcttttacacacgagcgatatagcatcattctgaattgtgcagcttaaaagatgaacgttgggctgcttgctctctttacatcatttttaacttaattctcacatccctagcgtccaatgcgaatttttgtgaatgatgaccgccatgtgatggcaaagcattcttccgtttatccaacacaagaggagctggaggcagtccagaacatggtgtcccacacggagcgggcgctcaaagctgtgtccgactggatagacgagcaggaaaagggtagcagcgagcaggcagagtccgataacatggatgtgcccccagaggacgacagtaaagaaggggctgggtaagtgaggttttccgttgtccttttcttttttgtagggtagccagggtagaggttggcacctgttttctaagaaactccagcctctctggggacctctgggttgtggtcagactgaattcctcactgagctgggtgttggtctgtccctcagggaacagaagacggagcacatgaccagaaccctgcggggagtgatgcgggtgggcctggtggcaaagggcctcctactcaagggggacttggatctggagctggtgctgctgtgtaaggagaagcccacaaccgccctcctggacaaggtggccgacaacctggccatccagcttgctgtaagtgtggccaccactgccgggtaggtgggtgggggggtggtaggcatgctgattgaggatgtggggcccaggaagaagtgtcctgctaggctgtgctccaagaagcacatgccacacttgccctggcacttgctgtgcgtgtgccttctcagtaggtgacaacc

SEQ ID NO: 11330 - DNA, 1183 bp, Homo sapiens
tctgtcaagggctggggctagggcagtcccgcctggtgggcggagttggtcccctttgctgcagatgccttgggatggctgttgtgtgatgcagagagggagttcatttcctctccctcggcctttttaaattttttcctattgaacattttagcatagctaatttattgggagaacatggggaggaggcaagggaagaggattagaagataggctccacctatctctcccctccctcatgagattattccttttagaataactccccacttttgtttttatgtttgttttattttttctttttctttcttttttctttttctttttatttttggagggggcctccaatttttacaatttcctcacagggcagagttgaatgtgctctagtttctccttccctggtccagggtggagatgaattcagcttctgggaaactcagctgccctttagaaagctgccacatcccctttccacctgacagaaaccccttggtcaaactgtgccttgtcttcttattccatccatgaatagaaacgctatcagtcaacgaccccccggacgttctggacaggcagaaatgccttgctgccttggcgtccctccgacacgccaagtggttccaggtttgcattttgttcttctatttgtcttttggtagagaattcctaagttttaacttggctaactgtcaccataaagattccttaacattgacgatagccgtgccgagcttagcacctgcagctgcgcaggtcctaaaggagtgcacctcaacaaattcgaccccaaaagaggctgagactgagttggtgggctgctgctgctgctgctgctttgtgttaagagtaacactctcttgtacacgtagtgacattgcggctggccacagccttggtggtcgccagtgttgactgtttacccttggcaaagcagcaacctgacacttgtgtcgttcatgttgacttgtgccctgggcggtgcctcagactgaagagcctgtgttttgttcccctaggccagagccaacgggctgaagtcttgtgtcattgtgatccgggtcttgagggacctgtgcactcgcgtgcccacctggggtcccctccgaggctgggtaaggcatgttgctgtggctactgggggtggtgtgtgcagagtcttttggatatcccaggaacactt

SEQ ID NO: 11331 - DNA, 1216 bp, Homo sapiens
gaacccagtcatggagctgaacgagaagaggcgtgggctcaagtacgagctcatctccgagaccgggggcagccacgacaagcgcttcgtcatggaggtgcgcagcctgaagctgcctgctggggcagtcccatggggaggcctggggtccccctgcccctggagggaggcactgagtcatctccatctgcactttccaggtcgaagtggatggacagaagttccaaggtgctggttccaacaaaaaggtggcgaaggcctacgctgctcttgctgccctagaaaagcttttccctgacacccctctcgcccttgatgccaacaaaaagaagagagccccagtacccgtcagagggggaccgaaatttgctgctaaggtgagcagtggcccttgaacctccttgcccaggcatgggttcttctgcaatgtgagcacgaagggaatgtcacttccctgtgttctcttctagccacataaccctggcttcggcatgggaggccccatgcacaacgaagtgcccccaccccccaaccttcgagggcggggaagaggcgggagcatccggggacgagggcgcgggcgaggatttggtggcgccaaccatggaggctacatgaatgccggtaagggccctcatactgcactgtccccgccttccccacgtgcatgctctgggaacaaatgtgtggggctcctggggtgggccggagacactgctggaccccggtaaccctgtctttccctttccaggtgctgggtatggaagctatgggtacggaggcaactcggcgacagcaggctacagtaagtgtgcgtttctgtctgtctgacctgggaagcagctgcagtgtagcgtctgggcctgagttagcaaagggtggccagagcagcctcgaggaggctgtagaaggggcacacacctttttgcggtgattaggtcagacggccctcgacccccaccccttcccggccccacagtgggattgattgtgttaatacacgaactcgtgtaactgcaaagttccttaaaagttagaattttaaatttctctgctttaagccatgcgaagcaccaatcttgtgaatacgcttttccggccagtgcacagctcttgtcttgagaaggagccttcattggggggttacaggagcagagaaatctaaaacatgaatttcaaatgtggcgctctgtgccctttttcaaaagaattctaa

SEQ ID NO: 11332 - DNA, 1540 bp, Homo sapiens
acccaaagtgtccgtgctgtgtccctgtgcttcactgggtttctcaaccgtggcttttcaccgcagcttgtctgaaactcttagcctgcagaatttaagacaatggcagtttttatcgtgatttgcctttgaacttggtcctattgaagttcacaataagtggaaaacaattttttcagagaatgtatttttgtgcagaattgcacagaattctagagacagcgttgttcggcatcaaggcaaaagcccacctttgctttttatggaaagcattactttatttaaagagacagacaatgacgcattttaatctacctttgtcttaatttacagcaggttttgtatgaatttttaaccttttaacaaactcccaaatctggttgatgcctttgacagtgatgaaaacgatttcaccacatctgaatccagagaaaccggctttttttcttattgcgagcatgttaaaacgttgggaacatgtggggaattgtatattgcgctgaattaacttctcccgcctcttgtaatgctctggtgggttcttgtttgggaatgcgatattttgtggctggtttagctagagagtgaactctcaaaggtatcaaaactgtgcttccattattagtgcaagaaacagacaggctttaaggggtagatgacgtgaaattttgcaagtcttaattacagctgcagatgcatgggattctggatttttttgttgctttttagtttaatgggactttaaaagtaattgaggagaaagaaccgtgatgttccctgtttctccagtaaaggactggcttttgcttgggcagaggtggtgctgctgggtgtgcagctgccacagactccaaaggcgtagaagtttgtgccaacacacggagtcattctggctctctgctgaggcccctgttttctggcaggtgccctccttggaaactggttttggctctgatcagcggttctttttgcagcaaagcctgcatctgtgttgacttgcaagattttgcgtttattcaggcaaaaactggtcaaaatggttactacatgatttgttcccagaggtttgaaacattcagtgaaactttttaaaactttgattgcatgatgtattttttttttagaaagttattgtttgagaataatgtctttttataccaggaaaatagttatcctgaatgacgttgaaaactccccctcccctttatttttttttaatcaatacatgtgaaagtaacaagccctcggcccttgcgtcttcattcattcccggcttcaggcggggcgaggtggtgtgctcagtgcaggacactggggaagctggggctgtggggctgtggggtgtgggtcctggtgggggggttctgaagatcccatcctcccagtctcctcgctgagctgccgcatgttcgctttctggcattgtgggacacatcctcccccttggtgtcttggctttgtgatggcgggcgagggaggaggcctgcctgaagaacacaaactgaaggttgcagatagttctgtccacgttgtcatgcag

SEQ ID NO: 11333 - DNA, 1198 bp, Homo sapiens
tcttggtgccagcctgatccagtgatgtgtggtaggcaggcagagccgcacaggagcccataagtcttgcccacctgcatcctggccgaggcttgggtgtgggctgcctaacctgagccccgctggctgggcccctcggctctaatccaccactctctctcctaggaggctactcacagtcgaactacaactccccggggtccggccagaactacagtggccctcccagctcctaccagtcctcacaaggcggctatggcagaaacgcagaccacagcatgaactaccagtacagataagcccccgcggggcggagatttctaccttctgcacttactccccatcagaagatcgagttttatgcatcacagttaacatgtcagctggccctccaggcccccgcccccatcccgtccacgttgctgtgtcgtgaggtgcagcgggtcaccctgtggcccgtcctgtgacccatatttagccgtgtttgggactccgtgtcttcaatggtttgttagttgccattacaactttgtctgggtagagtttttgagtttttgcagttcagtatccctctgtctattcacacttcgtgttagtggtaactcagtttgtctttaaatagttacagaagggatacgtcatttgttaatgcttttgtgaagtgagttaaacgagctttctgtattttaatgctttagtgtttcagttttataagtgaagattttattttaaaaaccagtgggaaagagtggggggtttctttttatgtctgggtcattcaggcagtacatctgaattaagctgaatgtagacaaataaagaaaaacaaaactgcgcccgtcttaggcctgggtgtctgacccaccagcagtgcaatgggcaggtttccccactctattcctgctcttgggaaagcagcgtgggccatcaggatggtccctggtccttagagagggtccagttcaggcttctagacattttactcatgctcagcgaaggctggttcctggtcccctgggctgtgtagacccggtgtcccaccaggctccaggctcccaccatctacagaggggcttacagcgcccattctggtcttggggaacccatcacaaaataggctttttctgctccccgattctggtgtagttctaagtacacagtgatgtcctctgtaggggcgtgcctgtggtggaacata

SEQ ID NO: 11334 - DNA, 1116 bp, Homo sapiens
cattatccgcccagccgagccatccctgctcgactaggcctcgaggggggcgtgctctcgggggggcctcacgcacccgcggcgcaggagcttcagtggtctggggccctccgccgcccctatgctgggaccaggctcccagtgggcagccctggcctcttccttaacgctggccccggtccagggccggcccctgtgcctggctggacaccgcactgcgcaaaggggccctggagctccaggcagggggcgctggggtgttgcactttgggggatggagtctcagggtggcagaggggggaccagaacccttgacaccatcctgaatgaggggtccagcctgggggggactctaccaaggtcttcttgggctgggaaagcccatgtagggcaggccttctataagtgcgggcaccaagggcgcctacatccccaggccttgctggggtgcaggggtatatcaacttcccattagcaggagctccccagcggcaagcctggcccagtgggctcggtagtgcccagctggcaggcctgaggtgtacatagtccttcccggccatattaaccacacagcctgagcctggcccagcctcggctgccagaggtgcctttgctaggcccggagccgttggcccgggccggccttgccctattcctctcctcctcctcctcctgggtcccccagggtggctgggcttgggctatgtgggtggtggtggcggggggtcttgggggcctctcagctcccgcccatgcctccctgatgggtgggcccagggcggcctctctctgaggagacctcacccactcctcgctcagtttgaccactgtaagtgcctgcactctgtattctattaataaactaaaataaagggaagacgctgctggtggctgctgtgtgggcctcttgtgttagtgttcaggctggggacatgggtgccacctccatcaggcctcccataaggatgcccaagtccctgcactcataagtgcctcccatctccctgagggctctgctttcgggggtgtcacctttcagaggaagccactcgatacaggggagagcttttactttccttagcatgtgaggagtgggagcagatattctctgac

SEQ ID NO: 11335 - DNA, 1207 bp, Homo sapiens
gtcacagctctctttgctatgggaactgggacacttttttacacgatgttgccgccgtccccaccctaacccccacctcccggccctgagcgtgtgtcgctgccatattttacacaaaatcatgttgtgggagccctcgtcccccctcctgcccgctctaccctgacctgggcttgtcatctgctggaacaggcgccatggggcctgccagccctgcctgccaggtcccttagcacctgtccccctgcctgtctccagtgggaaggtagcctggccaggcggggcctccccttcgacgaccaggcctcggtcacaacggacgtgacatgctgctttttttaattttatttttttatgaaaagaaccagtgtcaatccgcagaccctctgtgaagccaggccggccgggccgagccagcagcccctctccctagactcagaggcgccgcggggaggggtggccccgccgaggcttcaggggccccctccccaccaaagggttcacctcacacttgaatgtacaacccaccccactgtcgggaaggcctccgtcctcggcccctgcctcttgctgctgtcctgtccccgagcccctgcaggtccccccccgcccccccactcaagagttagagcaggtggctgcaggccttgggcccggagggaaggccactgccggccacttggggcagacacagacacctcaaggatctgtcacggaaggcgtcctttttccttgtagctaacgttaggcctgagtagctcccctccatccttgtagacgctccagtccctactactgtgacggcatttccatccctcccctgcccgggaagggaccttgcagggacctctccctccaaaaaaagaaaaaaagaaaaagaaagaaaaaataaatgaggaaacgtgttgcagcacaggcagttttcttctccttctgctcccctgtttctcatacccccaaactcagatgctggagctcaggcccgccgtgtgtgcacccaggcaggagcgggcgctgtccaggctgggccgcccccttggctctccctcctgttccaggggagccataggagggaaagcaggtggcccgggggggatatgggggccccagccctgtcccaaagctccctgctcggctgcccctcgcccgcctttatataaattctctgaatcacctttgcatagaaaataaaagtgtttgctttgta

SEQ ID NO: 11336 - DNA, 1168 bp, Homo sapiens
ctcccaggtcctgtggctcatccctgtgccttggctgcagtggctctttggggcgctggccctgggcctgtcagccgccgggctggtattcaccctctggcccgtggtccgtgaggacaccaggctggtggccacagtgctgctgtccgtggtcgtgctgctccacgccctcctggccatgggctgtaaggtacgggtctggggtggccacaggtggggccgaggggctaggggggcatgggctggccctgcctctgaccccaggggtcttgtgcagttgtacttcttccagtcgctgcctccggagaacgtggctcctccaccccaaatcacatctctgccctcaaacatcgcgctgtcccctaccttgccgcagtccctggccccctcctaggaaggcccgggtcccacaggtaaggactattcccagctgggctaagggggctgccctcccactcccagtcaaggcgagaggttctggggccactcccagacaattctttctttcaggcaacacctaagtggaccaacccctctgcctgtcctgccccccagacgatgactgaaggctcctttgacaccttgagatgattctgctactttccagacttttcttacaaagcaaacacttttattttctatgcaaaggtgattcagagaatttatataaaggcgggcgaggggcagccgagcagggagctttgggacagggctggggcccccatatcccccccgggccacctgctttccctcctatggctcccctggaacaggagggagagccaagggggcggcccagcctggacagcgcccgctcctgcctgggtgcacacacggcgggcctgagctccagcatctgagtttgggggtatgagaaacaggggagcagaaggagaagaaaactgcctgtgctgcaacacgtttcctcatttattttttctttctttttctttttttctttttttggagggagaggtccctgcaaggtcccttcccgggcaggggagggatggaaatgccgtcacagtagtagggactggagcgtctacaaggatggaggggagctactcaggcctaacgttagctacaaggaaaaaggacgccttccgtgacagatccttgaggtgtctgtgtctgccccaagtggccggcagtggccttccctccg

SEQ ID NO: 11337 - DNA, 1229 bp, Homo sapiens
aaaataaataagtaaataaaagaaatagatggggagagtgtggaacagaggtgtcaacatcacctccgggtgaagggatttcaggagcacgttcttttctgtacagagaagatagttctttttttttggtcaagaaattcaaccattagttttttaaagacaagcttgggtggggtgcctgctgggggcagtgctggtctttcactgcagcccaggcaccccttgagagtcccagtgtgtgttatgccccgagccagtcaagctgaagggagagcgggtgcgggggccctcctccgtgtcccagcccggcccctgggattgcgtcgcggcctctgcttgtcgacctgggtgctggctgtcctattttactactattgaccctgaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacaggtaagcgaggaggcggggagggcgggggctgtaggggtccccgtgggagcaggcctggcatctgcactctgactctgcacactcaggcttgggccgctcactctttcactcatccacaaacactgactgaatctctgtgtctttgagcctggccctgaggaacatgctttctggaacagggaagcacacatgtatctgcggtgatgagagggaatgtcacatgtggtcgagaggagaggcaggggtgcgggtctcggagaaggggacattgcagcagagccttgagagaggggaggttggggagagtgcaccagcagaggccacagcaggcggagaggctctgccaaagttgtggcctggtggcctcaagggatgaggtgggatgaggggttatatggcagtaatgggtgctgcccgtgtggccaggaggttggggacaagaggctggcatgtctggagcagagaaagtggcagccctctcctgtccttgcaccctcccaggctacctgtgccatctctgtgttggtgagatggtggccacactcctgctctctgccaggccctgctccaagcctggagatcgctgtcc

SEQ ID NO: 11338 - DNA, 1219 bp, Homo sapiens
attctcctgcctcagcctcccaagtagctgggactacaggcgcccgccaccacgcccggctaattttttgtattttttagtagagacggggtttcaccgtgttagccaggatggtctcgatctcctgacctcgtgatccgcccgccttggccttccaaagtgctgggattacgggcgtgagccaccgtgcccggcccacatcagtgttttcttgagcaagtttatttaaagtttggcaggtccctggcaaggtgccctggcaggggtggccaacgcacactctctcctcctgtcccctctccaggaccgctcaggaagtggcagcgaagaagactgagccccgacattccagtctcgaccccgagcccctcgttccagagctgagatggcataggccttagcagtaacgggtagcagcagatgtagtttcagacttggagtaaaactgtataaacaaaagaatcttccatatttatacagcagagaagctgtaggactgtttgtgactggccctgtcctggcatcagtagcatctgtaacagcattaactgtcttaaagagagagagagagaattccgaattggggaacacacgatacctgtttttcttttccgttgctggcagtactgttgcgccgcagtttggagtcactgtagttaagtgtggatgcatgtgcgtcaccgtccactcctcctactgtattttattggacaggtcagactcgccgggggcccggcgagggtatgtcagtgtcactggatgtcaaacagtaataaattaaaccaacaacaaaacgcacagccttgcctgcaggtggacttgtgcctggctcccaccgtttctgccagcaggagtggcgggggccacctcatgtccaggtccctgtccttctcctggcaccagaacccatggggcccgtttcacagaggaggatactgaggccccggcaggggaagaggacttgtctggtcacgcgtgtggcctttgccactgcaggtctccagcatttgttcagctgagacctacagtgcagggagcaggcagctccatccgttccctgcccgtggcccagcctgggttggggagaccatcacagaaatgggcagatgccacatagagctctcagggccatgatgcaggaagctcagggcataatgggagcccaggtggtcagtgagggaagggacggagccgcctgctccctttcaaatccagaaca

SEQ ID NO: 11339 - DNA, 1138 bp, Homo sapiens
agccattgcgcatggcttgtgttcttgtgtttcttcctttttctttcgagatggcgtctcagtctgccacccaggctggagtgcagtggtgtgatcatagctcactgtagcctcaacttcctgggctcaagcaatcctcttgatttcagcctcccgggcctggccagcatggtgaaaccccgtctctactaaaaatacaaaaatgtagccaggcgtggtggtgggcgcctgtaatcccagctacaccagaggctgaggcaggagaatcgcttgagcctggaaggtggaggttgcagcaagccaagatcgtgccactgcactccagcctgggcaacagagacagactctgtctcaaaaaaaaaaaaaaaaaacccaaacaagccacatttggagtttggggttcccagcaggactatttcccaagcctgagcctggctgtttcttccagaattcgttgcacgcattggctgggatcctcccccgccctccagcctcacagctattctctgtcctcccaccagcttcatgtactggactgactggggaactcccgccaagatcaagaaagggggcctgaatggtgtggacatctactcgctggtgactgaaaacattcagtggcccaatggcatcaccctaggtatgttcgcaggacagccgtcccagccagggccgggcacaggctggaggacagacgggggttgccaggtggctctgggacaagcccaagctgctccctgaaggtttccctctttcttttctttgttttttctttttttgagatgaggtcttggtctgtcacccaggctggagtgcactggcgcaatcgtagctcactgcagcctccacctcccaggctcaagtgatcctcctgcctcaccctcctgagtagctgagattacagacacgtgccaccacggcagactaattttattttatttttgggaagagacaaagtcttgttatgttggcctggctggtctcaaactcagggtgcaagcgatcctcccgcctcagccttccaaactgctgggattacaggcgtgggccaccgtacccagcctccttgaagtttttctgacctgcaactcccctacctgcccattggagagggcgtcacaggggaggggttcaggct

SEQ ID NO: 11340 - DNA, 1229 bp, Homo sapiens
ctgtgatcccagctacttgggaggctgaggcaggaggatcgcctgagcccaggaggtggaggttgcagtgagccatgatcgagccactgcactccagcctgggcaacagatgaagaccctatttcagaaatacaactataaaaaaataaataaatcctccagtctggatcgtttgacgggacttcaggttctttctgaaatcgccgtgttactgttgcactgatgtccggagagacagtgacagcctccgtcagactcccgcgtgaagatgtcacaagggattggcaattgtccccagggacaaaacactgtgtcccccccagtgcagggaaccgtgataagcctttctggtttcggagcacgtaaatgcgtccctgtacagatagtggggattttttgttatgtttgcactttgtatattggttgaaactgttatcacttatatatatatatatacacacatatatataaaatctatttatttttgcaaaccctggttgctgtatttgttcagtgactattctcggggccctgtgtagggggttattgcctctgaaatgcctcttctttatgtacaaagattatttgcacgaactggactgtgtgcaacgctttttgggagaatgatgtccccgttgtatgtatgagtggcttctgggagatgggtgtcactttttaaaccactgtatagaaggtttttgtagcctgaatgtcttactgtgatcaattaaatttcttaaatgaaccaatttgtctaaactcgatgcacgttcttctgttcgcgcgcttctttttgtttttttttttttcctgagatggagcctggctctgtcacccctggctggagtgcagtggcatgatctcggcttactgcaagctccgcctcccaggttcaagcaattctcctgcctcagcctccctagtagctaggattacaggtgagtgccaccacgcctggccaattttttttttttttttttttttgagacagagtctcgctctgtcacccaggctggagtgcagtggtgtgatctcggctcactgcaagctctgcctcccaggttaatgccattctcctgtctcagcctcctgagtagctggggccacaggcgcctgccaccacgcccggctaatttttttttgtacttcttttagtacagacggggtttcaccatgttagccaggatggtctcgatctcctgaccttgtgatccacctgcttcggcctc

SEQ ID NO: 11341 - DNA, 1903 bp, Homo sapiens
gtgtccactgccccgctagacggctttcttaggggaattttcttctggttgtttcacaagacagattctgtccttgtcacccgggacagaaaactcagtcttttcaccctcattcagatgaagggactcaggacaggctctgtgacttacagggacccaatcaattcacaatgagaaattaccggccaggcgtggtgactcacgtctgtaatcccagcactttgggagggcaaggcaagagcttgagcttgagcctagacgttaaagaccagcctgggcaacacagcaagacccatctctacaagaaatttaaaaactagccaggcgtggtggtgcgcgcctgtagtcccagctacttgggaggctgagccctggaggtcgaggctacagtgagctatgatcacaccattgcacttcagcctgggcgacacagcgagaccctgtctcaagaaagaaaagaaaaagagacaaattacccagaaacccctcccttccccacatggaggccttggcaaatgttaattttcctagaaaatccttcagacctgaagacgcaggaaaagaatctggctctcagggtggcttctgcgtccccgccgccaggccccagactatggtcacagggccgtcctgttcctccccgggactccagaatttctctcctcaaaggaaagaaaacagggcatgcgcttgttggcaaaacgcagggccggctcccaaaaaccccatgtgtgtacgattaaaagttggccgtccccaggcctcccagcgcaaacttcaagagacagggctttgctgaaaaccaaacatgggccagctgggctttttaacaacctagagactttccggagctgcctggaacagagcctgcgggaaacggggcttgccagagacactcacagtttccttcatggcctgttttggtcccctaagaatctccacatcattgtctttcttgtgccttttccttggtgagcaacagaaagggaagggttccaagcctctaaaaatgtgctttgtgatcaggagtgcgctccaaaccaaatacgcgcgctgccctttcgaggccagtgagctcagcctccaaggctttaaagccacatttcagcaagagaaagcgctgagagctcgcaggttcattaaagaaggcaaagcactggtttctctccttagaaaagtaggtttcttggcttgatgtagactggcttgctttgatttttagtgaagggaatgtacgtaaaacaaaatagggcttggctggtcaaaggagacaagcaggatggatggatggatggatggatggatggatggatggatggatggatgaatagatagatggtgtttgcatgtaaattgcagagaaaacaaaaccaaagctgattggaaacaattaattgtgggtgtctgagggggaaggtcgcagctttgggcagctttgagaagcggtacaagagttctgtgcctgtgtgtccagccctggagccagccagtgcatttattttaagctcttagaagcaactccttggcccaggaatgcgtgacccctgagatgggtccacgcatctctctacacttccttctctccgtgggatactggactcgtgcctctgcgcccattctcttctcacgcatatccatgagctttaatttcactttctgatcacggtacgtccataaagccagtattacacttaaatgaagtattcttttttgtaatcgttttttttagaaggtaaacaaatttaataaagctaccaataatgttgatgattctgtgtcttttcttttttcgctgtgctcccttttaagctttaagatagatatctttccttttttttttcttttttctttttttgagacggagttttgcttctcgtcacccaggctggagtgcagtggcgcg

SEQ ID NO: 11342 - DNA, 1786 bp, Homo sapiens
acaggagcaggggaatgccatggaacaagggaaccagagccactgtcctagagtgagacacagccatcccttccctcagccatccaagcatttatggggtacctactgtatacccattcttgtgggcctcagggcacaggaaggagaatgccctagaacaaaggaggcagagcctccatcctagagtgagagacagccatccctctcctcagccatctatgcatgtattgggtacctgctgtataccctgtcccacgggcattagggacacacccgtaaacaatacagccccagtcctaacttcctattgcaatccatgccccaatgttctcagggccccctgcctgtgcccatgccctgatgttctcggggtcctcacactcccatcctgatattcgagacacctatctctggggcagggagacctccagcaggggcctcccggacaaccacaccctttctcacagccccagcgcgtgttcgggacgtatttccgcgtgggcttctacggcgcccacttcggtgacctggatgagcaggagtttgtgtacaaggagccatcgatcacgaagctggcagagatctcacaccggctggaggcacgtccttgtggttgggggtggaacggggcatggggctgccttggggctggagtaggggctgtccctgggtggccccgagtcagccctgtgtctccaggagttctacacggagagatttggcgacgacgtcgttgagattatcaaagactctaaccctgtggacaagtccaagcttgactcacaaaaggtgggtcccccaaccatttccccaaaatcttagattcacagagactccaagtgctgtttcctggggaccctcaaatcctctttctctgggaaaccccaaatcatatttcactgagggaccccaaaacctattcctcaggggattcccaaacatccagacataggaagacttggaaatgacaaagtccccagatcccctctctccaggaacagggcttgggctgtgcgtgctggggctgtgggatcctcacacctgaccctgcgcccaggcctacatccagatcacgtatgtggaaccgtactttgatacctacgagctcaaggaccgggtgacctactttgaccgcaactatgggcttcgcacattcctgttctgcacgccgttcacgccggatgggcgcgcacacggggagctgcccgagcaacacaagcgtaagacgctgctcagcaccgaccacgccttcccctacatcaagactcgcatccgtgtgtgccaccgggaggaggtgggtggggatcctgggcctggcgggggtggggaggtgaggggacatcagaccctgggaggggaggggagggtagacacagggacccagacccaaggtggttcacggacctcagacccagagaggggtggcacagggaccctagaccagatccccagggaggggaggggaggagaccagacccagggagacctgggaggcaagatgcagggaccccagacccagggtggcccagggattccagacccagaaagaggaggcagagggagcccagatctaggaaggcccagggaggagaggtgtggcccaggaagaggcccaggtaccccagaactgggctgagaagatatggagaccctgcattccaatctctaaactgaaacctctacctccagacccaggaggacccagggattctagactcacaaaggggaggcacagggactccaaatctaagaaggcccagggaggagaagcccagggattccagac

SEQ ID NO: 11343 - DNA, 1240 bp, Homo sapiens
ccattctcagcaatttcccagaaggactaacctctgatttctctcccctaaatcctaactcccagcccagtgttccatctgctatttctcagtcctctgacttttgactccgtgccctgttacatcacagatgggttaacgtcagcccctcacttctggccttgaaacccatgcccactgtcacctccagatgacttaacatcagtctttcatctgtggctattggcaccatgatttctgtcacctccaagatggctttaatggtgacctgccacctctgacccttgaccgctggcatcccccatttttcccccactctgcagagctccaccttctccagccaagccccggaccccaaggtgaccagcatgttcgaactgagtggaccattccggcagcagcacttcctagctgggctcctgctgacggagctggcactggccctcgaacctgaggctgaagggtgagcagagctcctgtctagccccaggacaggtgggacagtccaggagccatgtccaccctgtcctgagcacctcattaccccatagggcattcctgttgcacaagaaggccatcagtgctgtgcacagcctgctatgtggccatgacactgacccccgctacgccgaggccactgtgaaggctcgtgtggccgagctgtacctgccactgctatcgattgcacgggataccttgccacggctgcatgactttgctggtcagtgggccaggggaagatggggtcacatgatccagggacttggtcacagaaggcacaggatagtaaaggtgggagaacacagtcactggtatgagtatagacattaggattagcagagcaggttaaagtgctaggacagactacttaagtcataacatctctgagcctcaggtttctcccctgtaatggagacagtaacaacaccaactacttcataaggttatgtgaaaatgtggggggctgtagtactgagatattgtcagcctacaatagatgggagatattattgtaccatttattattttctaagaagagcaaaaagtagggaacatccaagtgagaaaatgattggagtacattcattcactcattttcaacaaacatttataggcattgttgaggggggtggtataacagtggttggaagtacaaaattgggatttgtgggtggatgcctttcatcagtttggggaaattcttagccattctcacttgaatttttttctgcctcatttt

SEQ ID NO: 11344 - DNA, 1778 bp, Homo sapiens
gctggtggaagatggttcatcttcctcgcacagtgtgggttcttggagttcatccagggaaggcggcgcctctttctcaggtcctgcaggctggtctctgagcctgcccccacgaactttctggattccaaggtgggatggtgatccctttgacccctgcagaccctctacttgcgaaaagcagcattgaagcagccttttcccattgtagaagggacagggagtcagatcccctcaaccccccggcttcagggaccccagaagtgccttccaagcttcccccaagatccacatcacccacgaccctgccactgtttttgctgtgttcaccacatctctgatcctgaagtgaattctggaactatggaccacattagactgggcagagattcgcccaacccctagcactccggctctgggctttcggccagaagttaattaacctcagagccaggagcctggggctggggcctccctcccaggccctgtttagctgtttagctggttgtgttttaagcaagttcttgcccaatcatgcatcctgctagaaaaggaaatgaagcaacgttcccagccaccgcaggcagttgtcggcgactttctgatgtaagcacctgggctccgacttgaggggggcccttcaagacccaatgtccatttcccaatccttgtcatcggcagggcccagggatgtgacaatttttgctaatggaggagtcacttctttttttttttttttctttttgagatggtctggctctgtcacccaggctggagtgcagtggtgcaatcatagctcaccacagcctcaaactaggggtcacttctaagggatgctgggggttgggcggaaggggtgaggaggtaggattgagtaacttgctgtcactgcttgtactttgtagacagcctgagagtggcaggaccttatgtgaatgggggggatggactgtgatcagtgccggggagtctctgaagctggggtccccacctccaggggcttctgctcagaggttacgtgtgcagtttgaagatgtacatcttgacctccggtttagaggcactttctgcccatcagattccaaactctaggggcgcagcaccttttctttgctcccaaacaccaaccaacaccccttcacaggaccagcactgttaggatggctaagtggatgttttatgttcccacgtccctgactctgtttcagaggttgtgtctgctctcccagcccctgaagccaaaatgacttcctgcagctttcatgagctcagcctcttccctggggtatgtgtgagggggaaagcctggttcaagtttagatttatttctagggagccctggtttcttcataccagaggctacccttagaactttggagtggggtatctttttttcatttgtttttttgatacagagtctcgctctattgcccaggctggagtgcggtggcacaatctcagcttactgcaacctccacctccagggttcaagcgattctcctgcctcagcctcccgagtagctggcattacaggcacctgccaccacacccggctaaattttgtatttttagtagagaaggggtttcaccatgttggtgaggcttgtctcaaactgacttcaagtgatccacttgcttcggcctcccaaagtgctgggattacaggcgtgagccatcacgcccagccgagggtatcttttataccaacaaattagatgactgaggtgtaatggacaaatcctatgcacaaagtgagggtatctgaatatgtgggcggg

SEQ ID NO: 11345 - DNA, 1250 bp, Homo sapiens
aataggccaggcgtcgtggctcacatctgtaatcccagcactttgggaggctgaggtgggcggatcacttgaggtcaggaggttgagaccagcctgaccaacatggtgtaaaaccccatctctactaaaaatacaaaaaaattagctgggtgtggtggtaggtgcctgtagttccagctgctcaagaggctgaagcacaagaatcacttgaacccaggaggtagaggttggagtgagccaagatcatgctactgcactctccagcctgggctacagagtgagactctcaaaaaaaaaaaataataataataagagaaaatagacaaggtctccaggctggtcaactcctggcctcaaatgatcctcccacctcagcctcccaagcagccgggactacaggcaaacatcaccatgtccagctgtccccagctttctaatctggtctttctcttgccccagaacctcaagaaggcatgaagccagcccctgcagtgccgtccacccgcccctctgggcctgcctgtggctctgttgccctcctctgtggcggcaggacctttgtggggcttcgtgccctgctctggggcccaggcggggctggtccacattcccaggccccaacagccttcaaagatgggtaaaggagcttgccctccctgggccccccaccttggtgactcgccccaccacccccagccctgtccctgccacccctcctagtggggactagtgaatgacttgacctgtgacctcaatacaataaatgtgatcccccacccaaacttgtctgtgtctgcctcgctttgctggggtgtggaccggggtgtgggcaggggttgagcgcaggggacgcagctttctgcagatcccacccgggcctcccccaccatctggggatcactcctgaagataccaggtggatggaccctggaccatttctgtcttgagcatccatccgggcccgtgtcccaccttccctgggtctcatctgtgctctgtggaggccaagggttccctcccggggccaaagcccctgctgcagacagacccaggcccagagaaggacgggggcctgggcgctactacacaggctgctcctgcgtgctccccgcgcagcggtgcagagatcacccaaggccttaagattctgaacttttattttctggcatgaaaagtacaaataattaaacaattccatgtaaaagtctgttaccgcggccaggcctgtgatcccggtaataaatagtcta

SEQ ID NO: 11346 - DNA, 1150 bp, Homo sapiens
gtaggggattgggggttacaagattatatccctactctcccttgcaggttcctttgcccaaagactcaacaggtgcagcagatcccccccagccccacatcgtaggtaagtccgagagcatgggggcagccaagtctctaaccttacccaggccctgccaggttctcgctgggcctaggctgggctccctgggcctctgggccgagtcccttgcagggcacagggcatgtatgtctccacaccaggaatccagagtcccgatcagcaggccgccctggcccgccacaatccagcccggcctgtctttgttgagggccccttctccctgtggctccgcaacaagtgtgtgtattaccacatcctcagagctgacttgctgcccccggaggagagggtgagggcttaaagcaaagcatgtgttggggctggggagtgggctggcactaccctgagggtgcatgggagaggctggaggagggagaccgagagagccctggcctctgaccccgcctgcactccccaccttggagtaggaagtggaagagacgccggaggagtggaacctctactacccgatgcagctggacctggagtatgtgaggagtggctgggacaactacgagtttgacatcaatgaaggtaaaaactgggccaggtgcggtggctcacatgtgtgctcgtaatcccagccctcctacaggctgaggtgggaggatcacttgagcccaggagttgaggttgcagtgaactattatagagccactgcactccagcctacatgatagaccctgtgtcaaaaaaaaaaaaaaaaaaggcaaaaacctggacaggcaggacttccaaacattccaaacaccacccaggatgaggggcggcctctggggtcaaggggtaggcccaggctgagacgcagtccacttacaccctcgtcctccggccgcacacactcatttgccccaggggctccagacctgaggtcacccagccctgttggcccttgttcattccctccctcctacaactctgtgctggctactgggtgtcaccaggacaaacctagtccctcgagtcagcaagggaacaggcaaattacactttggggagcttaggagaggagcatgccttgagtggggggtcaggaggccttcct

SEQ ID NO: 11347 - DNA, 1456 bp, Homo sapiens
cccgctgttctccatcctgccccttgcctcccttggtgaaggcgtcatcacccacaggcccaggacgcattgctcaccagtcccttctcttggtctgtttcagggaccgtgcccgcaacaccggagtcatctcttgtaccgtgtgcctagaggaattccagacgcccataacgtgtatccttggaaacctgggctttttccagagggtggggagggggctggagtccggaccctgctcatctggcccactgtgtgccctggtgcagggccaaagccgtccagaggaacaggtgccacctagtgatttctgtggggtgagaagatgcagggcagggttccaatgccaatgatcgcccttgacctaagtggcccagatctgtcagaacccgtggatgtgtacagtgattggatagacgcctgcgaggcggccaatcagtagcgacacagaggacccgccccctgagcagccccgcgtactgtggatccagctgttcggttctggtccagagacattccaggggtccagggtgtgggtcctgggctgtcacagccgtgtgtgtgtgtgtgtgtgtgtgtgtgtgtgtgtgtgtgtgtgtgtgtgtagtgggtgtgcgtgtgggtgtgggtgtgagtgagtgtgggtgtgtgtggctgcacgtgtcactggggtggccgtgagtgtgtgctcacaggtacgcggtggtgtcgggttcctgggcctgaggggcctgaactgatctcacttggctccgaaagcctttgctgtgttccctgcagcccctggccccccagccttggggctctggctccccccggcggaattgggggactgtttcctgacatcctggacaagggaagcccactagaggctggaacaggacctctccagcctcctcaccagcaccgtgcccatctcaactggacttcccgctctccttctccaccttctagtgcccgtggccggggattcaaagccgccgttccccaggtccctgggctgggccctgacagggagccgcccccctccccatggtaaccaggaagcccgtttcatgttcagttgcttttgtagaggaagcaagggctgggatggggacagctgtcaatcacaagcccttaaataaagcagccagcgcacatcccttgctgtccgtgatgtcttgggttctgcgtctgcctggtcaccagaagaaggagaggggacctgaggctctgacgttcgggaggtggcctggtggcccatgtgaccagcccttcaaaccacccagcgttttattcagtcagtaagcattcagggtggtggagcaggcagacatctggccaggtgtttacagcagtcacaataggaaatgggggaggtgagacagaacaggtggtcagaggaggcttctgggaggggcaggctgagacagtgacaccgtagggccacctctagccagacgctgacctctggcct

SEQ ID NO: 11348 - DNA, 1106 bp, Homo sapiens
cagcaatagcactttagggtcttgggaaagcttctgctgttaaagagtgtggactcagtccatcatctaatggctgctgttccccaccttccctccctgtcctctttttgaaggactgctcttccaggggcagccacataatgaccaacctctgacagtgtatacagtcccccctccactcccactctttacatttggggcaacccaggcatcagtcacaacttcactataaatacacaggtctcaggccgccactgcgagaggagccgccaccatgtccgcgcatctgcaatggatggtcgtgcagaactgctccagtttctgatcaagaggactatgccgacctacagcaccaagcccagtaacttgaaggccccagctccttccgctacaacgggctgattcaccacaagactgtgggcgtggagccggcagccgaggacaaaggtgtggtggtggtcacgaagcagagatccggccagccgaagcctgccacctcctacgcgcggaccaccatcaacaagaatgctggcgtcacgctcagcagcatcagacacatgatcctcaagaacaagtaccgccccgacctgcgcatggcagccatccgcagggtcagcgccatcctgtgcagccagaagcctgtgatggtgaagcggaagcggacccgcgccaccaagagctcctgagccccctgcccccaaagcaataaagagtcagctggctttctcaccaccagcccctcatgcccgcaaaaaacaaaaacaaaaacaaaaaaacaaaacaaaaacacaggtaggtccttgcccaggatgtaaacccaggaccactttaaggaaggccctactcccatactccagctccccaattccaaggaattatcaaaaactgtcaactaaagtcagctgaacctagaaccagacttggtagggctcaacaatggaagaaacacagagcagcacagcacaaagcatgtgctcccagtaagcagcagctcaaactctaaatgggccatagagcaggtcagcaattcagaacaagagaagatagacccatgagtggtggtcaatatctagacatcttgttcacagcaccaactgctagtcacc

SEQ ID NO: 11349 - DNA, 1484 bp, Homo sapiens
ggggcctggttcctggatgtgctccttgaaaatttgtctaagtcaccctctaaagacaaggattattacaggtgagccagagaggcccgagaagggcaccccagcatagttgtcctgctgcatagaatctggccacaggatgaaccccctgaaaaccttaaaaagtctccggattgagaccatcctggccaacatggtgaaaccccatctccactaaaaatacaaaaaatttctctttcccttcagtgtgccactgaagatcctggtgtcgccatgggccgccgccccgcccgttgttaccggtattgtaagaacaagccgtacccaaagtctcgcttctgccgaggtgtccctgatgccaagattcgcatttttgacctggggcggaaaaaggcaaaagtggatgagtttccgctctgtggccacatggtgtcagatgaatatgagcagctgtcctctgaagccctggaggctgcccgaatttgtgccaataagtacatggtaaaaagttgtggcaaagatggcttccatatccgggtgcggctccaccccttccacgtcatccgcatcaacaagatgtcgtcctgtgctggggctgacaggctccaaacaggaatgcgaggtgcctttggaaagccccagggcactgtggccagggttcacattggccaagttatcatgtccatccgcaccaagctgcagaacaaggagcgtgtgattgaggccctgcgcagggccaagttcaagtttcctggccgccagaagatccacatctcaaagaagtggggcttcaccaagttcaatgctgatgaatttgaagacatggtggctgaaaagcggctcatcccagatggctgtggggtcaagtatatccccaatcgtggccctctggacaagtggtgggccctgcactcatgagggcttccaatgtgctgcccccctcttaatactcaccaataaattctacttcctgtccacctaaaaaatacaaaaaaaaaaaaaacaacaacaaaaaattagctggtcatggtggcgggtgcctgtagtcccagctactcgggaggccgaggcaggagactggcatgaacccgggaagggagactgggactccctctatcacccatgttggagtgtgctggcctgatcaaaacacactgcaacctcagaatcctgggctcaagcaatccccccgtctcagcctcccaaagtgttgggatgacttgcttgagctgccatgcccagcctctccctaatttttctaagccagcctgtagaggctgggaatcagccctggccattcagggaatccgtggagggtggcccgggcccagcaggctaccctctgactgctttgggccgagacacaagttggagtgagaccctgaccaggtggcatctggtccggtaggggaaggtccaggtccggcgcagtcccaccggtggtcgggcgccactttgtgatcactctgatatcgtccccggag

SEQ ID NO: 11350 - DNA, 1295 bp, Homo sapiens
ctgatggggcgggacctgagatcggccgggagtggggctgcgatgacgctgggccgagaaagccccagtctttggtgaagtcaaggattcgagtcaggttggggatgtggcagattggtctgcgagtggggccaggctttgaagcaacttggagaggagttgtggaaaaagggcagggtcttaagcatgtgggatgtcagagtctctcttggtcctgagagacgcaggccagacagtaggactagaaaccacgtatctagagtatgccatgagcaggtgggactgaggaattccgggtggggcaaggtcccagctgcatcagatggaatcagtgggcatgatctggtgtctggaaaggtggcttcggggactcattgttgtgcctttcactaacctgcccacccacttacctttccctagctgaagtggtgtgcttgggtcgctgtctactgctccttcatcagctttgccaactctcggagctcggaggacacgaagcaaatgatgagtagcttcatgtgagacttgccctacagaacaagtgactcttgagtaaggggtggggggaccccagcctggccatcctagactgacacctctctcctgtctcaggctgtccatctctgccgtggtgatgtcctatctgcagaatcctcagcccatgacgcccccatggtgataccagcctagaagggtcacattttggaccctgtctatccactaggcctgggctttggctgctaaacctgctgccttcagctgccatcctggacttccctgaatgaggccgtctcggtgcccccagctggatagagggaacctggccctttcctagggaacaccctaggcttacccctcctgcctcccttcccctgcctgctgctgggggagatgctgtccatgtttctaggggtattcatttgctttctcgttgaaacctgttgttaataaagtttttcactctggctgtcagcctcttctgttcagtggggtgttcctcctacctggcgggaagggctctagccccataggcctggtgtggggccccagtctggaggcttctggctgttcatttgcttacttcataaaccttgtgtcttaagtcaggtgctagggacaagacagtgacttctgccctctggcaactcaccagatggccctgctgacctagataatctaggctttggtttccttttttttttttcctttttaagaaagaaaatggtcttgatctgtcatgcaggctgagtgcagtggcacaatctatgttcactgcagcctcaaactcctgggct

SEQ ID NO: 11351 - DNA, 1208 bp, Homo sapiens
cagatggcgccactgcactccagcctggcgacagagcaagactccatctcaaaaaaaaacagaaaaagaaaaagactcccaaagccaggcatggtggctcacacctgtagtcctagcactttgggaggccaaggcaggaggatcacttgaggccaggagttcgagaccagcctgggcaacatggtaagaccccatctctgctattttaaaaaataaaaaatcaataagaggctcccaagacttgcggcctgaacacctggtaggacagagctactgaggggctcagtctgaggtagattaattttgcagtgtctaggaggcaattagaggcaggtggctgaaggtcggggagaggtgactgagggcttcaggcaggactgagatggggggtgcccagggacctcagaaaccagggtacagcccagccacagataaccactccctacccctcgctccacagggtgcgctggctctggccctgcctgtgggttccggtgtggtgcagtcgctggcctaccacccaacagagccctgcctgctgaccgccatgggaggcagcgtccagtgctggcgagaggaggcctatgaggcagaggatggagcaggctgaagccaggggacccaccaacaggaccaaggaccgagacacagacatggaaggacttcagataccatcttattctagagacgtagctgaccaaaaagtaggggaggggctgggtctgcaaattaataaatagaagagggggtaagaccttcctgggaccgcagccgctcagtcctcgttcttctcatgcatgaaggcatccatcttctgggcaaaggtttcagccacaagcagggggaagaccagggaggcgtcagcatagacctgggtaggggggaacctgggtaagccatgggacccacactcatcgtcccagagaccctatgccccacccagccagcgcttaccttgacgggctgtgcatccacccggatcttgccccaggagacagcctcgtctggtcgggcacctgagtcagagccatcaaactcctgggctgtgttgatgtaaacagcgtagtcggccccgttccgctgtggggaggcgggggcacggtgggcccagtcagccagtcacaggagacagacacagagggaggacaccgtagccaaacaggctgagaggtgtgtcccagatgaaggaagcccttcacagacattcg

SEQ ID NO: 11352 - DNA, 2680 bp, Homo sapiens
ggagactgccaggtaaggagactgcagctggcaagtcagcactgtcttgggggccgaaaggtcccaggccatgaccttcctcctccccctgcaggtttctgtctgcgtcgtcgtcggagggattactggggagtgcgctgcatccggaagtcgctgtgccctggttgaggggggttagggaggagtgagtgggactcaaatccagatgccttccccgtccgtccgtccgtccgtccatccgtccacttgccctcctggcaggtgggtggggccaccatgctcatcctacaaacggggaggtgggggggacttctggtgggcaagggcccctgggctctaatagggtcatctctggcagcccacttgggccagctacgtgggagggaggaattacacagctgaccgaatccggcttcggatgaggtgagggaggagcaggtcaggaggggggccctcgtagggacgcgtacactcacacggacacacatggccacacgcatgtgcgggtgccataaccggcgaggctgggccagccgctccaccatttccccgactgcatggagacagtagaattagtgaacccctgagttaacccgtaaggccttccgtgtaacctgcatctagagtttaagaagcttctgctgttttgccggaattggcggtgactggggagggctgggtgggtggggggcctcaggcgggatctcggggcggggggaggaggatggtgaccttgggagtcgccctgtcagcacgcacatgcttgggacccactccacacactccctgccagctttgttgcagcctcagctggtggtgtctccgtccttatcctagcctagctcgcagggtgagaaccactggagtggctggggctggccagaggtcaccgtttctccttcctgtgtgctccagtggcttttgaagacactgggttgggacctttttcctgaagagagctgggtgtagccagagctactggcacctaccccgagcatctctctctgtaagcagcttcaggggcagtccgtttctctgtgcttctgaaacccccttctcacgtttcaggccccagttttaactcaaggcctggggcaggggcgtttaattgatgatgacagaggacacaggtttttgccagcaaaaaggaaaaccaaggcttggtggaagggaaaggtggtgtgtcccctgttccctattccatctccctgggacttcctgctcatcatagtacccagtgagcccagagatcctactagactgggtcagcaattctagagaaccttccggaatagtctgggaacatggtcaaggtggaaggggctcccctagagagggtgggggtgtagttacttcccagttggccagaaaactgggccttgcagacccccttagcattttttccctttttttccttccctgctttctacttctttggggagccccttgtgttttggagtctgactggagtctcgcatcctggggcctgctccatccatccctcctgggcgccagaccctccatccaagccctgtgtctttccatagtcagggtcaggccctgcatctattccaaggggcactcagtacacattccataaattagctgggtgtccctgcacgcccaccccatgaaactcgagcaggtctctggaagccatttgttaaaaaaaaaaaaaaaagttttaaaaataccttttaattttctggtaattccagttctttgaagcatcctctgctgggtcttggggtgtgtggatggattggctgtctgatgggattggtaacccctcgctactcaagatggggggatacaaacaccttcagggaaggggagcctggttcttctcgttttcctttttttttttttttttaaaaaaaaactatttaattttttaatttatttttggttgttttttgcacaatgaagtttcagcttctcaaccttctcccctacccagggctgtggacccagactggccttgagccacagtccctctttccctcctcaccctcttccccctgcgggctcccgggtctgtccatttgttactgtgctgtgctggggattggcgccgaggtggcgtgagattccacttgtgtagaactttgttgagtaaagatcagtttcttgtgaactccttagtctgtggcttcctgtgtccttggctttggtagtgaagaaatgtcgggggcaccggggatacttgagagtgggaagatagacgaatgtgaaagatggaagattaaatttgtaacatatatgaaatgtgcagctcattctctgggacttcagctcactaagggtgagccattagtgtcacagcccaggttcaagatgcccctctgccgtactctaaactgagtggtaaggggtgaggccttgccgcactcttatcatcagctgaccctgggtcaaggttttcatagaaggttcagcccagccccaggccgagggtaatttaattaatattagttacaattactcaggcaaatgagaagtagtttcagctgtggggggaaaccacaatcttcagaataaaatctttcttttttttgagaccgggtcttgctccgtcacccaggctggagtgcagtggcgcaatcatggctcagtgcaacctcaacctccctggctcaaccagtcctcccacctcagccacccaagtagctgggactac

SEQ ID NO: 11353 - DNA, 1799 bp, Homo sapiens
aagtgatctgcctgcctcggcctgccaaagtgctggagattacaggcatgaaccactgcgcctggccctaacactgtgccactttatatcaaggacttgcacatccgtggatttttatatctgcagggacctggaaagaatcccccacggacactgagggatgaccgttggggcactgccatctcccatttgcagatgtgggctggaggctagggaggttaaggaacagctaggagctctagaactggaaagtggcagaggctggacatgcaccagggactgtgccccctgagctgtcctggttagaaggaggggagcctagccacactgatcttacttgaatccccaggactcgatgcctgaggtccggcagagctcctttgccctcctgggagacctcaccaaagcctgcttcatccatgtcaagccctgtatcggtacgacactcgccttgtccctaacccatgaccccagccccggcctcaagtgatggagagcaatacccggggatgactgtgaccacattgggatgtattcgtactgtctgatggggcctgctggactaggtcctgcagcttaccctggctggccctccttctcagcacccctgtttctccccaccagccgagttcatgcccattctgggcaccaacctgaacccagagttcatctccgtctgcaacaacgccacctgggccattggtgaaatctgcatgcagatgggtgagtgccctgcaagtggcaacacgcgccccccattagcctgttctcaacctgggggcgggagcctagctctgactgacagcttccttcaaggcaagtctcttgggggtcgtcaggggtggagccaagcagaaaggtcatttgtgattggcttctctaaagaggagggataggagggctgttctgattggaccgttttgtgtagttggctaaaagactcattcggattggttgggtgactttggctttttttttcctttgacttgggcagcgtgttgtcaccttagcgactccagagaagcctctgttgtttggagggtgtgggtctgtccctggttggccagggattctgggtggggattagccggagaaggtcttttgtttcctcactggtagtggttggccagtctctagttggaactggggcgagtagtgagtgaggtggggcggccccctggcccctgtgggtggcgggggctgtgcagggctctgactgggtgctcccccaggggcagagatgcagccttatgtgcagatggtcctcaacaacctggtggaaatcattaaccgacccaacacacccaagacactgctggaaaacacaggtgggcacctggcccggctgctgcctgcacccctgcctgccttctggaggtggggttctgggctgggaagggcatcagaaagagccttgtcaaggaaccaaggagggtgtctggaagtacctggaaggggtcactgggagaagccccaagaaagatgcagcctcaggctgggtgcagtggctcatgcctgtaatctcagcactttgggaggcagatcacctgaagtcaggagttcgagaccagcctggccaacatggtgaaaccccatctctactaaaaaatacaaaaattagccgggggtaatggcacgtgcctgcaatcccagctactcgggaggctgaggcaggttgcaatgagccaagatcatgccactgcactccagcctgggcaacagagcaagactccatctcaaaaacaaaacaaaacaaaaaaaaacaaaaaggaaagggaaaggaaagaaagaaagataga

SEQ ID NO: 11354 - DNA, 1307 bp, Homo sapiens
acccggggctttgggatgagaggcttctgttgtttcccctcctgtgcctgcctttacctggctctgtgaaatgagtctgggccagtgatttaaactctaagcctcagtttccctatatgttgtgtgcggctgactcttctctccatacggtgggtgtggctgggcccaatcaaactgccccctcttggttccctttccttgtaggctgcatgcagggcatggtgccctacctgcctgagctgatcccgcacctgatccagtgcctgtcggataagaaggccttggtccgctccatcgcctgctggacgctgagccgctatgcccactgggtggtcagccagccacccgacatgcacctcaagcccctgatgacagagctgctcaaacgcatcctggatggcaacaagagggtacaggaggcggcctgcaggtgaccctggacccctgatcccacagcccccactctcccccggccaccctctgggaagtgatgacacctgtgactgttgatgtggaactgatttatcgcgtattcgtactggctgatcctgagttgccctccccaactgcccatggcccagtgtcacctgccatggtccactgagcccccgcttcatcctccctcccaccagtgcttttgccaccctggaggaagaggcctgcacggagctggtgccctacctcagctacatcctggacacccttgtctttgcctttgggaaataccagcacaagaacctgctcatcctctatgacgccattggcaccctggccgactctgtaggccaccacctcaaccagccggtgagaccccagagcggctcccgcctcccgatccccgtgcccctgggcatccagtgacctggtggcaaccccgtgttgcacgccagggacgtggccgtgacctcgacaggcagacagacagacccggccccgccctcgccctgctcccagtctagtgggggagaaagacagttatgagacagcgtggtaagtgctgtgcttcgggaaccaggaggtggtaacccaggctcccggggggtggggtggggcgggcggtgcttggacaggtgagaagaatgaaggcctcgaggtctggccagatggcaggcctttcagggtcccatgagccacggtgaggcgctcaggcctcatcactcgggcaacaggtacctgagtcacagtctgccaccccgacccagggagcgcccatttcgtgctccctctccaggaatacatccagaagctgatgcccccactgatccagaagtggaatgagctcaaggacgaagacaaggacctcttcc

SEQ ID NO: 11355 - DNA, 1307 bp, Homo sapiens; identical to SEQ ID NO: 11354

SEQ ID NO: 11356 - DNA, 1101 bp, Homo sapiens
ctcggtgcctgggtggcttgccgcccacagggttagaccctgcttcttaagaaaaaaaaaaaaaaacctttctctggaggcaggagtggtatcatttatatcctaatcatagcggcagagactagattccgataattccccagagggaaatggatcaatttgcacctagcagtaccatcatgctctgcagggtctgctctgtggctgattggggggctggtcactctgttggcacctgtttgcctcctccccaagctgtgcctccccccaacttttgccacggcccctgcatccccataaacagtccctctctgtgcaggttgatccccatcttggtgaatgggatgaagtactcggaaattgacatcatcctgctcaaggtcaggcagggcccacccagcatgggtgggcatgggcgtgggtgtcgcggctgtggtccccaaagtacttaacagtctgcctgtcccccagggggatgtggaggaggatgaggctgtccccgacagtgagcaggacatcaagccacgcttccacaagtcacgcacggtcacactgccccacgaggctgagcggcctgatggctccgaggacgcggaggatgacgatgatgatgatgctctgtccgactggaatttgagtgtgtgcccctgcctgggggtggtggtggggtggcaagccctggactccctcttgggaggtgactagaagctgaggcagaagctgattagaagctgatcgtggccgggcgcagtggcttacgcctgtaatcccagcactttggaaggctgaggcgggcggatcacgaggtcaggagatcaacaccatcctggctaacacagtgaaaccccgtctctactaaaaatacaaaaaattagtcgggcgtggtgtcgggcgcctgtagtcccagctactcgggaggctgaggcaggaaaacggcatgaacccaggaggcggagcttgcagtgagccgagatagcgccactgcactccggcctgggcggaaaaagtgagactccgtctcaaaaaaacaaaacaaaaaaaaagaagctgatcgtgaagattctgagcatgatctctgatcctgggagtgcagtcaaggag

SEQ ID NO: 11357 - DNA, 1203 bp, Homo sapiens
gcttttggaggccaaggcaggaggattgcttgaggccaggagttttaggccagcctgggcaacatagtgagatcccatctctacaaacaattttaaaaattagttgggcgtggtggcatgtgcctgcagtcccagctacttaggaggctgaggcaggaagatggcttgaggccaggagtttgaggctgctgtggactattgattgtgccacagcagtccagcctgggcaacagagctaattctatctcttacaaagaaaaaaaaaaggaggggggatgtagagggcgtacatgggctagggaacagaaaggcagcactgggggtgtccagtgggagggggaggtgctaggcagcccctgcccagcctcaggcagcgtcctttcccggccgccccaggcattctcatcaccaccatcgcttccaagggtgagctgcagatgtggcccgagctgctgccccagctctgcaacctgcttaactcggaggattacaacacttgtgaggtaggcaagaagccatggatggccagagcgagtactggggggctgggaccaccacccaccacccacgtttgtctctctgcccctctgcactcagggagcctttggagccctgcagaagatctgtgaagactcatcagagcttctggacagtgacgccctcaacaggcccctcaacatcatgatccccaagttcctgcagttcttcaagcactgcagtcccaagatccggtgggtgcagctccctgggggcttccagggagcctggagtgggcagggtcagggtgacccacgtgtctgctccccgccaggtcccacgccatcgcctgcgtgaaccagttcatcatggaccgggcccaggcgctgatggacaatattgacaccttcatcgaggtgggccgctgggctgggggtgggcagggcgaggactgagggcccctacaactgaccctgttcctccctgcagcacctatttgccctggctgtggatgatgaccccgaggtgcggaagaatgtgtgccgtgccctggtgatgcttctggaagtgcggattgacaggctcatcccccacatgcacagcatcatccaggtgtgcatggtcaaggccagcccaggcgggcaggcagggggccggtggcaggggtcagggagccacccccagccaggccaggcctcagcttctcccccctaccacagtacatgc

SEQ ID NO: 11358 - DNA, 1202 bp, Homo sapiens
cagcagtttgggaggccgaggcgggcggatcacctgaggtcgggagattaccagcctgaccaacatggagaaatcccgtctctactaaaaatacaaaattagctgggcgtggtggcgcatgtctgtaatcccagctactcgggaggctgaggcaggagaatcgcttgaacctgggaggtggaggttgtggtgagccgagatcgcgccactgcactccagcctgggaaacaagagggaaactccgtctgaaaaaaaaagaaaaaaaaaaaacgaaacaaaaaaacccgcgagacgggggctcctccccctagccccgccccttcgggttggttccctcattcgccccgcccccgctgcgggcgctggagggcctgaccgctcttcccggcatgcattgttcgggacgaggcgagtcgggcgccaagcgcggggccggagcggccttcccggagtcctttgcgcggcacctggcgacaaaatggctgcccgagggagacgggcggagcctcagggccgggaggctccgggccccgcgggcggtggcggtggcgggagccgttgggctgagtcgggatcggggacgtcgcccgagagcggggacgaggaggtgtcgggcgcgggttcgagcccggtgtcgggcggcgtgaacttgttcgccaacgacggcagcttcctggagctgttcaagcggaagatggaggaggagcagcggcagcggcaggaggagccgcccccgggtccgcagcgacccgaccagtcggccgccgccgctggccccggggatccgaagaggaagggcggtccgggctccacacttagcttcgtaaggagccgtgggggtgggggcgggcgccacggcctgtcttggcagcgggagtcggggcccgtgaagggggatcgggaccgaagtccactttccgttctgaatgaggggcccgtccgggtcacccgctgagggtgtggaacttggattcccgacaactggggtctaggggcgggagtggggactccaggagcttgcccgtgggaactgggagctgaggaattgcctaggaatcagcactgtggagaatgaggaaacgtggatatcaggattcctgtttgagtggtacccggaccttgggtcatgggaccaccactaattgtgaggaaagggagtaaatttaagtctggactctgagctatatgtgttagactcagac

SEQ ID NO: 11359 - DNA, 1204 bp, Homo sapiens
ccagctactcaagaggctgaggcaggagaatcgcttgaacccaggaggcggcggttgcagtgagccaaaatcacgccattgtactccagcctgggcaacagagtgagactccatttcaaaaaaaaaaaaaaaagaaagaaagaaatggaaaagctagtatttgaccaaccccaggaatctgcttatgggcctgagcctttaaccactgggaggtatcaggagtcatccctcgggtgtttagtgaacccccaacccaggaggtcgccgcaggtaagctatgagccctcccacatcccccctgcagatgtgcaacatgctgggcctgggggacatgaacgcagaccagctggcctccaagctggaggagacgctgcccgtcatccgctcagtcagcgaacagttcaaggaccctgtgagtggtggtctggctggcggtgagaggcccgggggctgaggacaggggcagaccccgcccctcactgtcctctctcgtgccctgtaggagcagacaactttcatctgcgtatgcattgctgagttcctgtccctgtatgagacagagaggctgatccaggagctggccaagtgcaagattgacacacacaatataattgtcaaccagctcgtcttccccgaccccgagaagccctgcaagatgtgtgaggcccgtcacaagatccaggccaagtatctggaccaggtgtgcccacccacccagcactggctcagcagaggcacctctgcccctttattctctgatcttttgctccaccatctggccctctgccctctagcctcctgccctttgcccccacatttcagatccttcacccttattccggccatagaggactgtggctggcctggcctaggtccctgtgaccctggagagcagggggtctagcccagtgatctctgaccatagtgatgcagctcccacttatgacaccttaagctcctgccctatattctctccctgactctggaagctttctagctttaccgcttctattgatccacactctgtctctgccttcctgccccctgaccactgccttctaccctctgccctggctgcagatggaggacctgtatgaagacttccacatcgtgaagctgccgctgttaccccatgaggtgcggggggcagacaaggtcaacaccttctcggccctcctcctggagccctacaagccccccagtg

SEQ ID NO: 11360 - DNA, 1151 bp, Homo sapiens
accccagtatgtcccagggggtttcaaggccaaagtcacctggctatgacttcctcaacctgtaggtcatgcagaccatggaacccaagcagcggccagctgcgggggcacctccagaactccattccctgaggacacagctccgagaacgggatgtccgcatccgacacctggaggtgggtgtcctcgtccctttacgctgcctccaacgtatctaggcccctgacacttgcctccttgacagatggactttgagaaaagccgaagtcagcgggagcaggaagaaaagctgctcatcagtgcctggtataatatggtaagtgtggggtctgggctctaagatctcatgggtagaatattggtgggggggtcctgtgagctcacctgaccccaaccacacctcctcctgaagggcatggccttgcagcagcgagctggggaggagcgggcgcctgcccatgcccagtcattcctggcacagcagcggctggcaaccaattctcgccgtggacccttgggacgcctggcatctctgaaccttcgccccactgacaagcactgacagacctcacaatcaagccagcctgggctccacccaccctggcttcctccagctcacatggcgcccagcactgggcttcagccaggtgctcgagagctttgaggccatgatctctgctcttccctctcccagattggtggggagggagggcgggaggtagatataggcctgttctttttagcaatgtgattcttgttgttgattctctctctggagttcatgtgctgcctcaggagactctgattttatatttgagaaaaataaaggcgttcaatctgccctggctgtgctctgggcaccaaggtgagggagagaaagtgggccagaggcttagcccattgcttttaagaaaagcttagcggccaggtacggtggctcacgcctgtaaccccagcactttgggaggctgaggcgggtggatcacctgaggtcaggagtttgagaccagcctggccaacatggcaaaacccctcctctactaaaaatacaaaaattagcagggcatggtggtacatgcctgtaatcccagctactcgggaggctgaggtgggagaatcgcttgaacctgggaaacagaggttgtagtgag

SEQ ID NO: 11361 - DNA, 1190 bp, Homo sapiens
tcaatatatccaagagtaaaccgagccttagagaaaagtaaccagcccaaggggacgcctccagtgcggagctgggtggagatttgcagcccgccgaggaaggtccctttgcagccagcaggagaagtagggcaacggggagcctttgggcatcgtcatccccgccgcctgaggttaccctttagatgctgcagcctcagctgctcccagctgtcaccttcgccctgctgccctaagtactgatagtcctggtagaccagggcaggggtcgccagctgcaggagtagcagaggcgccagcagcagcgcccccggggtccgcgccatgctggactccaacggcccccaacgcgctcccaggcggagtcgtgcgcggagtctgcggcgggcgcattacccacgcgggcaggtgcagtggtcccggccgaaggcaacgcgtctccccccgccgcccgcaggcgcatggacccggccgcacgctcccccgcacctgcgggcgcagtggacccgaccgctccgctcgtccgctccctcccccgcgccgtgcacgtcttggttcgggccgggcataaaaggcttcgcggcccagggctcacttggcgctgagaacgcgggtccacgcgtgtgatcgtccgtgcgtctagcctttgcccacgcaggtatgaacacccggagtgcacctggcgggaggacccccttcaggctgctttggcccgatcctgactttagtgctggccgcctttgctttccatccgctatagtggcctcctttgtccttgcgggggaaaccgaggccacagccttgcagcgcaggcctgatcgcccgacttcccgccccctgctcgtgcgggcctcactgtctccttctgggctgggggcttgcgacaccgccctccggccgactcgctcgtggggtgctggtggcagtggctgggtcactcgtgctctggtcaggagagcgggtctccggcagcctccgggcctcgtagaccgggtacccgggagggtgagggttagtgctgtcgcctccgccgtgctgactcagtcatagggcccagcacgcagcgcgaccttgggttgggaggacaaagtgtcttcccgggcgcactgaccgggcgggggtctcagctttcagtcatggcctccggtaacgcgcgcatcggaaagccagcccctgacttcaaggccaca

SEQ ID NO: 11362 - DNA, 2415 bp, Homo sapiens
agatggagtttcgctctgtcacccagcctggattactggattacagtggtgcgatcctggctcactgcagtttcctcctcctaggttcaagcaattctgccacctcagccttctgagtagctgggattacaggggtgcaccaccacgcccagctaatttttgtattttttagtagaaatgggatttcaccatgttggccaggctggtcttgaactcctgacctcaggtgatccacccacctcggcctcccaaagtgctgggattataaacgtgagccaccgtgcctggcccctttgtttctttttttagagacagggtctcactgtgttgcccaggctgttctcaagtgatcctcttgccttactgaaagcccccttctttccctaagccacaatttcccagtctgtaaagtggggctgttgtcccaccctctgaaagtggctgtggagatgaaatgaataaacctcagctagggccagcttggtgcctgcctccttgtgtgtccttattcagccctgtctcttgggtcttagctgggcagggccctgttctctattgtcctgctttcccctcctactaccaccaggatatggctgtgctggggtttcgtctgtggcctatgggctcctggcccgagagctggagcgggtggacagtggctacaggtcggcgatgagtgtccagtcctccctcgtcatgcaccctatctatgcctatggcagcgaggaacagcggcagaagtacctgccccagctgggtgagtggctgcccatggggcctggtggaaggaagacagtctctgaggtctggaactcaagggtggggctgtcccctgagcctattctgtccctatctcaaagatagcataagtggccacctggacccccgccagaccctgggcttcacctggagatctgatccctggccagcctgactgtccccctctgtgaccaccgtcatctccctatgctttctgtgttccccagtccagcccaaagtttaaagtccaccaggttcctgctggccatttgcagtggctcacacctataatcccagcactttgggagggtgaagtgagaagatcccttgagcccaagagttcgaaaccagcctgggcaacgtaaggagaccccatgtctattagaaaaacaaaaaaaggaaagagcctatgtgacctgcgctaagtggacgttggccctcttccgtggtgtctcggaggtgttcagctgcttcaagatgaagctgaacatctccttcccagccactggctgccagaaactcattgaagtggacgatgaacgcaaactttgtactttttatgagaagcgtatggccacagaagttgctgttgacgctctgggtgaagaatggaagggttacgtggtcggaatcagtggtgggaacaataaacaaggtttccccttgaaacagggtgtcttgacccatggccgtgtccacttgctactgagtaaggggcattcctattacagaccaaggagaactggagaaagaaagagaagatcagttcatggttgcatcgtggatgccaatctgagtgttctcaacttggttattgtaaaaaaaaggagagaagggtattcctggactgactgagactatgatgcctcgtcacctggggcccagtacagctagcagaatccgtaaacttttcagtctctctaaagaaaatgatgtctgccagtatgttgtaaaaaagcccttaaacaaagaaggtaagaaacctaggaccaaagcacccaagattcagcgccttgtcactccacatgtcctgcagcacaaacagcggcgtattgctctgaagcagccgcatattaagaaaaataaagaagaggctgcagaatatgctaaacttttggccaagagaatgaaggaggctaagaagcaccagggacaaatcgtgaagagacgcagactgtcctctctgcgagcttccacttctaagtctgaatccagtcagaaataagattttttgagtaacaaataagatcagattcgcaaaaaaaaaaaaaaacccacaaggccctgtgtgaccaggcctctgctgacctttccacctcatctctggccactcatgtgatcctcccagccagacttagctacttgaaattctccagaagtaccaccagttctttacacatctgttccctctcccagcactgctcttccccacagcctcctcctgcttaactcctcacacccttccagtttggccaactccttcctgattccctgggtccccctccccatcttggcattgtgatcatgactttggggtaacctgtctcttgaaagcagggccagatctaacttagttatgaggtctgactcaggggcgagggtaattttttttttctttttttgagacaaagtcccgctccgtcccccaggctgaag

SEQ ID NO: 11363 - DNA, 1203 bp, Homo sapiens
ctcagttctgggctaagtactaccacatacgaggtagtccacacaggttaggtgccaccttgacttactaggtgaattccttttccctctataaaaagggacggtacctacccagccttcctttgaaattttaaaagtagctgacatcgccaaaatgaccatctctggagcccaccacccaccgcctctcctagggcaagagagaataccagaagggcagagggttctgtaacccagagacggggaagtccaaggtcacacagcccgctcgaagtgaggctagataaaactcaaaacagggcggtgcttctgaccttgagataatcaattttacccctctggtcaaccagacgccattgatggagccagggtggaggtgggaactgagtcccatgcaccttttgcggctccgtcgccacactcaagatgacgacacattgagccctgttctacagttagacacattcaagatggcggtacacactccggttccggttccggtggctcagctccccccgcccacccgggcccggacacgctgagcacactggaaggagtcatggcggatggtcaggtggcggaactgctgctccggcggctggaggcgtctgatggcggcctggacagcgccgagttggcggctgagctgggcatggagcaccaggcggtggtgggcgccgtgaagagccttcaggcgctgggcgaggtgagccgggcccgtgatgccggaccgccttgcccttgcacctacagtccccttgccacgggcgctctacgtccaagccaaattccctcaggcctagtttggggtagctgtatatgtgtccactccgggatgtgcgggcgggaagtgggacgagtgagggcccagacgcacggatgttcctcatgcaataaacgtttattgaggcacggtcagcgtgggtagagggtacgatgatggacgaggaagtcgcggttgctgccctcacgcaggttgcgacgtaataggaaggtgcttcaagaaccagagtgatgggggaaaacaggggacccagctgtgacagctgacccagccttgggggtcagggagagcggcctggtgcaggtgacggctgagtctgttctctgttgaggaaagtgatagcactttagagatcagtggccgggatcttgggggatggcaggcggcaagggagaccagcatagctgtaattgcaaagc

SEQ ID NO: 11364 - DNA, 2885 bp, Homo sapiens
tgagctctctcccatcccaggcaggggtgggggagcagcagtggggtgctggttctcaaatgcaagataagagctggctaagaaagccttgcccagcccctccacctagagggaatgggagggagagaagctgagggcagggtcccggtcccgcgtggagacagctgcgctcccgcggtttctttaaacgcccagatgggcaacgacgcgcgcggacgagggcggggttgggttcaggtctggtcacatgacctggcctgaggtgctcgcggcccccaccccaccagtgggcgtcccccccacgcgtggtcgaccatcattggtcggtggtgaggccaatagaaatcggccatctgggaacccagcgttccgaggcgcagcctaacatagtgaaccgacgaaggtccaatggaaaaagacggccatgggcatagaccaatgacaaagtggcaggggcgggcccaagggctgggtcaggttggtttgagaggcgggtgggtataaaagtgcaaggcgggcggcggcgtccgtccgtactgcagagccgctgccggagggtcgttttaaagggcccgcgcgttgccgccccctcggcccgccatgctgctatccgtgccgctgctgctcggcctcctcggcctggccgtcgccgagcctgccgtctacttcaaggagcagtttctggacggaggtaacgcctggtcccgcctcgaggccgccccgacgacgcggccggcccccgatcctggatctgcgttgtcgcccgtaattaccgtttagaggtccaacacggtggcctcccgggactagagccgcgggcgatttctcttctgcgtccctggggagcgcggagggcgtagcggcctcccgcggcgggagttagggttagcccgaggatctctgaaggcacccgacgtgtcaaactagaggttggaatggggagtgtcggggatctcctttcctgtccccagcagcttgtggctctcggcagatgtttggtgtggggggggattagcacagccgctctgacctacccctctaatcccccacttagacgggtggacttcccgctggatcgaatccaaacacaagtcagattttggcaaattcgttctcagttccggcaagttctacggtgacgaggagaaagataaaggtaagagcctaggagtgggtgctcagatccgggaggacttcctggcagaagtccttgtctgtacacacacagccgggacagtccccttggaggaggacaggtggaggaagtgggggagtcttctctattctctaagtcgagggtcctcgcgagtcaaggcccaacggtgacctcactaccgtcccgtctcaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtgagggcctgcttcctggtgctgatctctgtcccattagttagagggagacccagaccccattgactttcttaataatgattttttttggaaggggagctaaaagaataagtcccagcaacaatttattgcattatgatcgcagatctaggctgttaatttaatttgcgtgtttgtatatagttatttcccaatcttactaatgaggattttgagttctagagcactgattttttttttttctcctttaaacttaaggctccacccacagcccattcaggacagaatcagggtctgagtttctcttctcagccttgacagacccgagttgaagaaccaggtcttccttttataaagaggggtgagagcctcgagatgatgggtagtctctgactcttaactggatctgcttcacacctaggtcccgacatctgtggccctggcaccaagaaggttcatgtcatcttcaactacaagggcaagaacgtgctgatcaacaaggacatccgttgcaaggtgtgcctgggggtggtggcaaatggctgtcatggggagattcagaggtcagcctcattggggggtggcccccgctcaccttcttccttcttcaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggttggtgtttgggcaggggctctgctctccacattggagggtgtggaagacatctgggccaactctgatctcttcatctaccccccaggactgggacaagcccgagcatatccctgaccctgatgctaagaagcccgaggactgggatgaagagatggacggagagtgggaacccccagtgattcagaaccctgagtacaaggtgagtttggggctctgagcagggctggggctcacagtggggagtgcaccaaccttactcacccttcggtttccttctcccttctgcagggtgagtggaagccccggcagatcgacaacccagattacaagggcacttggatccacccagaaattgacaaccccgagtattctcccgatcccagtatctatgcctatgataactttggcgtgctgggcctggacctctggcaggtgagacttggaggaaaaaggaggatccctggggtacctcaagtgcataagatcacccaagaggaaagggacagggt

SEQ ID NO: 11365 - DNA, 1763 bp, Homo sapiens
tcattctcctgtctcagcctcccaaatagctgggactacaggcacttgccaccacgcctggctgattttttgtatttttagtagagacggggtttcaccgtgttagccagggtggtctcgatctcctgacctcgtgatccgcccaccttggcctctgggcgaggattacaggcgtgatccacctcacctggcctctccatctttttaactgcagtgtcagcggtgttccttgtcttctctgcagatgcaggcagcagaatatagtggttataggaacacaggtggaaaccctgtccaaagcaagggctatcgggtatcacctctgaccatccttcccattcatcctccaggtcaagtctggcaccatctttgacaacttcctcatcaccaacgatgaggcatacgctgaggagtttggcaacgagacgtggggcgtaacaaaggtgaggcctggtcctggtcctgatgtcgggggcgggcagggctggcagggggcaaggccctgaggtgtgtgctctgcctgcaggcagcagagaaacaaatgaaggacaaacaggacgaggagcagaggcttaaggaggaggaagaagacaagaaacgcaaagaggaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctccctcctgtgtctccttctggggaaagacagacttaaggaaacccagcagtggtctttttggggggggggggggtttccagtatatctcctttttcagctattgctagagaggttgctgagtgttccacaagattccagggacccttatttaccccataaccctcaaaaccaacgggggaatggctgttgctgctgtaaatactccacatactaacttactgaatccttgaacctaactggtaagttttggttctgcttatttatttatttttaagatagactctcgctctgttgtccaggctggcgtacagtggctcaatctggttcaccctgccccttaaactggcctttttcatgcttctattcctttggggtcctgtggctcagcccaacccctctgggatgcctccaggactggtagatccaagggagaattctgtatttaatgtagtgaggcttt

SEQ ID NO: 11366 - DNA, 1789 bp, Homo sapiens
gtgtcacagcccactctccctcccctgcagggagcagcacatcgcagagtgcatggccaagatgccacagatgattgtgaactggcagcagcagcagcgggagaactgggagaaggcccaggctgacaaggagaggagggcccgactgcaggctgaggcccaggagctcctgggctaccaggtggacccaaggagtgcccgcttccaggagctgctccaggacctagagaagaaggagcgcaagcgcctcaaggaggaaaaacagaaacggaagaaggaggcgcgagctgctgcattggctgcagctgtggctcaagacccagcagcctctggggcacccagctcctgaggctttgtcccttcccaataaagcctgctacctggcagtacccctgaagagatctgcgtcctctcaaggtgtgcctctctgggtcccctggttcctcccccaatacttaagagctggggaatcccccacttggctgtactcaaaaggggacagggactctaggccctgctgactaactggggcttcagtgggaggaaaaggggggtgtacaatgggcaaataatggagaagcagatggcagaagagaagaaggcttctgtttaccaacattcatctccagtaattagccaattacaaggctggtggggggggaagtatagccaaaacagactgtggtgatgatggtgggggccggggagaagcagtccttgtaacgttgggctggggtccactgcctggaaatgacacactgggggaggagacaccggaagcctcaatctgcagggactcacagactcctctcccccttccaggcacccgtcaccatgcctgcctgtgcccagccagccccccaagacccagacaggtgggcgcggggagccccagcaggcacagaccatagggctagtttttaaaactttattcacttcaaaacctttatcagagacacggttctgttctggggtgggggtggccttgacaatgagctgatgttagcccttctccaggctggaggccaaggccagactggggagggggccttgggcctttcaggacttgccctagatggaaagatttgggccactccaatggaggatcaaagttggggctccagcttcccctcatcctagaagaggatgggggggggtcctcaggggtttttcggaggatggagaggcaagcagccgcctttccgtctggctgcagagagctgggacagaggccaagaggggcccatctgtcgcctcccagtcctgccagcttctctgagcaggctgggctggggaggaggacggggggacagctgtctggcccgggagatgggaacaggggccactttaggaggacaggaagctggactgtttgcttgtttttttaagatttttgatttttttttccatttcttaaataaacatgaatatatatatattttttcttttataaaactttcatggaataagggtagggtgggggcttcggtggcctggcttcctggcatcactcgtcatcaaagttctgactcaggaggaagttggcagccaagttctcatttttttcacacgcgaaataggcctggatgaccaggctctctgggaagcccagggccttcaactgtgggaagataggttaagtgtgagcaggagagggtaggggtcctgcccacctgcagtcacccctcagccaggcctcttaccctctctatagcttctttctcctgcggcgtcacctggatgtagttcatctgcggggcctcctctcctatggcgcccacctccccct

SEQ ID NO: 11367 - DNA, 1142 bp, Homo sapiens
aatgagaacttggctgccaacttcctcctgagtcagaactttgatgacgagtgatgccaggaagccaggccaccgaagcccccaccctacccttattccatgaaagttttataaaagaaaaaatatatatatattcatgtttatttaagaaatggaaaaaaaaatcaaaaatcttaaaaaaacaagcaaacagtccagcttcctgtcctcctaaagtggcccctgttcccatctcccgggccagacagctgtccccccgtcctcctccccagcccagcctgctcagagaagctggcaggactgggaggcgacagatgggcccctcttggcctctgtcccagctctctgcagccagacggaaaggcggctgcttgcctctccatcctccgaaaaacccctgaggacccccccccatcctcttctaggatgaggggaagctggagccccaactttgatcctccattggagtggcccaaatctttccatctagggcaagtcctgaaaggcccaaggccccctccccagtctggccttggcctccagcctggagaagggctaacatcagctcattgtcaaggccacccccaccccagaacagaaccgtgtctctgataaaggttttgaagtgaataaagttttaaaaactagccctatggtctgtgcctgctggggctccccgcgcccacctgtctgggtcttggggggctggctgggcacaggcaggcatggtgacgggtgcctggaagggggagaggagtctgtgagtccctgcagattgaggcttccggtgtctcctcccccagtgtgtcatttccaggcagtggaccccagcccaacgttacaaggactgcttctccccggcccccaccatcatcaccacagtctgttttggctatacttccccccccaccagccttgtaattggctaattactggagatgaatgttggtaaacagaagccttcttctcttctgccatctgcttctccattatttgcccattgtacaccccccttttcctcccactgaagccccagttagtcagcagggcctagagtccctgtccccttttgagtacagccaagtgggggattccccagctcttaagtattgggggaggaaccaggggacccagagaggcac

SEQ ID NO: 11368 - DNA, 1216 bp, Homo sapiens
aggcaaacatgccgacatttgctgacacacacaaagacatacatggccgcacacacggatacacccgctctcagacacgcagcgacctacgcccattttcctggccatacaagcagccgaacgttcctgtacttctgtatctgcatagctcccccaacactccttccatgggagggggatggctggggcttccctgatgcccccttcccccagctttctctctgggtcactctggccacccctctgtccctgcgaagctatagctctctgtccctgctccggcctggtgccctgttttcatggcacttggcattttctctccggctctggccctgcctgattcatgcccactgctggggtgggaggtgtgcccaggtgtgggccgggatggggtagctcatgagatgagctggggctccgtgagatgttttgatgctgggccgagctcagagccgagggctctgccgggaacagggtgctccagtctctctagggcctggaatgtcttgtgtagcctcaagagctcccagacggaggctgcgggagcggagtcaagggctaggctttgccgtcagacagaaatgggttcgagctccagctctacatgttctaatcttgcgacctgaagcacaggattttcctggcctgtaaaatgggcaaaaaccagtgtctatctcttgggctgtacttaggttcaatgtggtgcctggcacatagtgtgtgctccataaatggtaattgttgccaattgttggttgtcaacctcccagaccctcccagctgagagagggatgcctctgaggggtagaagacaggatcgagcacctcccaaccatagatatccaagtggactgcctggaggaggaggaggcaagaggagagtttggaaggatgagagtttgcacatggcccagctcttttacctttggatgggggcctgtaggccaagcagagggtggcacaacttcaagataggggagagatggtgggggagagtggggggcaggaggggagagacgaggcctccactgttccatgaggaccagataccctggttgggggccctgagtcctggtataagagtatgtgtgcacgcattcatccaaatgtatgtgggacaaagagacccggtgcatctagatgatgacttcagggacgtccccaagctccagaactttctgtgtctgcacctgggcgttgtcacctggacccgcca

SEQ ID NO: 11369 - DNA, 1185 bp, Homo sapiens
cctcactcgcttgctcgtggatgtcattttctgtcttcttgggggcggccaaaaatcgaccggtgtcggggaccagaggcggccccgcacgcccccgcgtgtgcgtccacgggcgtctgtgcagacggacactgtgccggggcgagctgacaggagttcacggctgcgatagaacatggagatgtcatgggcgcgacagagcctggcggggataccagcagcgtgtgtgtgtggacggcaacgttgtctgtgcgcgtgtgtgtgagtgagtgagggagagagagagagaataggtgtgtgtagaggctcccggtgcctctgtctggctgctgaggctgagatgggagcaagtggctggcgaagctggtggtggcttcaaaccacactttcgtagaacaatcgcaagagaaaattgttggggggagggaggaggaggagaaggcggttttccttgtgcccccccttctaacgctgcttttctccttctctctttccccctcatcccgtcttcccctcctcccgtcctccctcgccccgcatgctcccggcttgccgcctgcaggatgagttccacccgttcatcgaggcactgctgcctcacgtccgcgctttctcctacacctggttcaacctgcaggcgcggaagcgcaagtacttcaagaagcatgaaaagcggatgtcgaaggacgaggagcgggcggtgaaggacgagctgctgggcgagaagcccgagatcaagcagaagtgggcatcccggctgctggccaagctgcgcaaggacatccggcccgagttccgcgaggacttcgtgctgaccatcacgggcaagaagcccccctgctgcgtgctctccaaccccgaccagaagggcaagatccggcggattgactgcctgcgccaggctgacaaggtgtggcggctggacctggtcatggtgattttgtttaaggggatccccctggaaagtactgatggggagcggctctacaagtcgcctcagtgctcgaaccccggcctgtgcgtccagccacatcacattggagtcacaatcaaagaactggatctttatctggcttactttgtccacactccgggtaggtcgttctcaaccatttttccctctcattttattttccttgctggcatttgttctgtttattgttcctctaatttccaagcgataac

SEQ ID NO: 11370 - DNA, 1176 bp, Homo sapiens
gttacatgctgtcttccagagtcctctctaggtctgtctgcaccctcagtcaagaatggaggtgaaggggggtgggttcaacaagaagaagatccctagaggagactgggaaggtctgagctggcttcctctgtactctctccccttcgctagcttccctacctggtctcaaaaggactctgctcattcttcactagactctgagcctctctctgtgaagctgggcccttgagaccagtggttctcatcctgggaggattccatcccactagggaacgtctgacaatgtctggaggcgtttttggtcatcaaaactgggggtgggggttttgctgctggcatcttgtaggtggaggccagggatgctgctaaacatcctgccatgcacagaacaatcccctacacagaatgatgagcccccagggtgagaaactgctttcaaccatgaggccacggggtggggcaacctctagagaaataccaggaggggctgcggccatcccactgtggggcaccagaggcttggcaccccctctgcttcccaccgccataccacgggctctgctgctgactctcacagcacccctcctcaccctcacctccactcccttccttcagcctgctctgccctccctggaagatcaggaggcaagaaaacagatgggtaatgccccccgacagggggacaactggtgggaggctcaccaggtgaactgagaaggggacaaaaagactctgggctgcccttgctctgggtcaggatcccccgcacccatacctgcatccacatcgttgggccacccgctggactggctgctgccagctgctggggaacggcctgtcccgggatagaacacgtcatcaacagggctctccatctcactgtcatcgatggacttggggcgcttggtggtgctggggaagaaagaaagggtcacatgggccaaggatgggctgaggctccagggagtgaccaagagtccaggctaaagaactgtgcatagatggccctctgggtggggagtggtgccggccgacagcagcatttctgggcactcactgcgtgcccaaccccaagatcagccctagggcccctcaagccatcagcttcaacctgctcctcttcctcaagccccttcccaatctgtgatgccacggtcctccaagctgcccaca

SEQ ID NO: 11371 - DNA, 1195 bp, Homo sapiens
agtggtgttgtgaggggcaatgagggcaacaggagatgtggggacgtgttaggagagaaaaaaaaaaaaacaaaaatatatatgggggaaattaacttttttttttcattgaaccaagtgcaatgcatcagagagttttcctatctttgtatgttaagagattaagaaaaaaaaattctatttttgttgtaatgtcctcgcggctctggggacgctaaaagaaccgggcctgccccgccctgcgcggggataacgaaagctgagtgtttttcccttttttttgttcgtttttagtttttttttttttaagtcgttttcctgcgttgacgaggatgatctggggtttttatttgtttcgtcgttcgttctgtttcggtgggagggctgaaggaaacgttcacattttagagtttaaaaaaaacacctcgacatttaaaaaatcaaccaacacaagatcaaaaaggaaaaggacgagagaaaaattatttttaagataattaaacataaaaccctggtgcttcttacattataaagtacgttttaaagaacccacaaactattatacataagtttatgaatcaattaaatatcctgcacttgttaggaatacgcatatcccttctttgttgagtttaacggaacgggacagcggcgtgcccccggcggctggactgctccggccgcgggtctccccgggcgcccctccctggggcccagcacccctcctcgccccatccccgtccgggtacgggggcgcggcaggggtccccggcccctcccccgcagaggtcaatgccaacgaacaaacgtcccctccctccctccctctccgccccgagcgcccttctttgagccagacgccaacttgaccctcaccagcattatcaggagcgcgctcagcaagttggtagtttcctcccccctttcccggcgcccctcccgcccccattcaacatctctcatcctatccccgaccccctccggggaacaccgggaaggctcgacgctccaggacaggaccagccacgcagacaggtcgatttgcccaggcccgcgcccgcacgcacgcacgcacacggccccgcacacagccccgccccaccccgcaaccagccctgtcgactgccttatacacccgcccccgcgctggccggccgacctagtgccttgttctcacccccgtgctggcggagcg

SEQ ID NO: 11372 - DNA, 1535 bp, Homo sapiens
agggctgccgaatacagcagcgatggagaacggcaccgggccctacggagaagaacgtccacgtgaagtccaggagacgacagtcaccgagggggctgccaaaatcgcctttcccagtgccaacgaggtcttttataacccggtgcaggaattcaatcgggacctgacgtgagcaggggtcagacgttagcctggcatcggctagtgggtcagtgtggatggcgggggcggggtatgagctagtcctctgtctcccaccagatgtgctgtgatcaccgagtttgctcgcattcagcttggggccaaaggaatccagagtgagtggaggtccaggcttctggtgggcgggggtcacacaagtttatctccctgcctgggctcttctgccgcccaaatccagaggggcttcagccacatagcaggccctgggttctgctccttcagcctttccgcagggatttcagggacgatattttggagattaaggggaggtttctcagaggggaccttgttattctctgacttgtgcctctgggtggctgcagtcaaggttccaggagagaaggacacgcaaaaagtggtcgtggacttgtcagagcaagaggaggaaaaggttgaactgaaagagagtgaaaacctggcctcaggagaccaacctcgcacagcggccgtgggggagatctgtgaggtggggcctgagcataggagctggcagccctggaatttagcgggagacagagggctcctggagggggagagctataggaggtgggtggtgggggctccttggggcccagaagaggatggaggtggagatgtgagggaggttttctgcttactccaacaggaaggcctgcatgtgctggaaggcctggcagcttcaggcctacgttccattcgatttgccctagaggtgcctgggctcagatctgtggttgcaaacgatgcctccacccgggctgtggatctcatacgccggaatgtccagctcaatgacgtggcccacctggtacagccgagccaagcagatgcccggtaggttctgggcatcacagcctagctctgggacaagcctgcctggggtcaaattctggctctgtcacattctcactctgtgaccttgagtgagtgacttagcctctttgagccccagtttccttgtctgtcaactgagaaaattagttttacaggggttgctgtgatgagtaatagataattatggtatgatccatactctgtgccagaaataagtagcatcctggtctctgttttaacttcttacactccttttattcattcaaatgagccatagtatatccagtgtctgctatgtgtcaggcaccgttttcaagaactggaaatgcatcaggaaacaaaacatgcaaaattggtgaccttcgcaagagttggcaaactatagcctgtggggctcacagcctttttttgtttgtttgcttgtttgtttgttttttgagatgtagtctcgcccttgttgcccaggctggagtgcagtggcacgatctcagctcattgca

SEQ ID NO: 11373 - DNA, 1154 bp, Homo sapiens
catatgaataagtatgcctttgccccctcctctttgcaagggatagcgtgtggccaccctggtctgcagctagcttagcagatttgaccacatattgtaaaagtgagtctgtaccaggacagatagggtagagggctctgtgtggtttagcaccatggtagattccatcgtgcggatgtccctccagcaggggaggtctttggggccagggctaggccagcacccacatttgccgcctgaccccgtccctccgtctctgtctctccattcctccctgcccctcgtgcagccgctgccatggcccagacactgcagatggagatcccgaacttcggcaacagcatcctggagtgcctcaatgaacagcggctgcagggcctgtactgtgacgtgtcagtggtggtcaagggccatgccttcaaggcccaccgggccgtgcttgctgccagcagctcctacttccgggacctgttcaacaacagccgcagcgccgtggtggagctgccggcggctgtgcagccccagtctttccagcagatcctcagcttctgctacacgggccggctgagcatgaacgtgggcgaccagttcctgctcatgtacacggctggcttcctgcagatccaggagatcatggagaagggcaccgagttcttcctcaaggtgagctccccgagctgcgactcccagggcctgcatgcggaggaggccccatcgtcggagccccagagccccgtggcgcagacatcgggctggccagcctgtagcaccccgctgcccctcgtgtcgcgggtgaagacggagcagcaggagtcggactccgtgcagtgcatgcccgtggccaagcggctgtgggacagtggccagaaggaggctgggggcggcggcaatggcagccgcaagatggccaagttctccacgccggacctggctgccaaccggcctcaccagcccccgccaccccaacaggctccggtggtggcagcagcccagcccgccgtggctgcgggagcagggcagccagccggtggggtggcagcagcagggggtgtggtgagtgggcccagcacgtcggagcggaccagcccaggcacctcaagcgcctacaccagcgacagccctggctcctaccacaatgaggaggacgaggagga

SEQ ID NO: 11374 - DNA, 2430 bp, Homo sapiens
cctaacccctagccgtcatctccacactcaccaggcccaccaggggagggggctggcctgggggtcttgggaaggcccctccccaggccctaggccacctcgcggaagccttcagcctccgcccctcactgcagccccttgggacttgaggggggccccaggggttctcaggacccctcccaccacctcccagtgcttccacgtctccaaaagcgccttcctgtcaccctcgtctatccctgcgcctgggggctggggtaggcgaggccgtggggactacccattttatagctggggaaacaggctccgagaaattgcacaaccgacctcaggtggccggcagtggcgtgcctggtgccctttctcctcttccgcctctgttgctccctttggtcctctggggcctcagagaggcaggtcctaaaggagggggggtctcctgggggcagaccgagggtctcggaggatagaatgagaggtttccagggctggcagagtgtgtgcgtgtgtgtgtgcagaagttttgctttcaaacaaatgaagatacaagaggcagtaggacctgggttggaacccaggggagcagactggggggctgttgcccctccctccatctccccacacccaccccaccccacagcagggctcctggcccccacccccctgtacataatttttaaaacctttttttagcgaatgaaatattgaagtataagattccttttatttttcaaaccaatggggctgtgtctattgtccccctcggtccccaggggtggggggccttggaaggcagggcggtgttggggggctggggggcaggctgaatgtgtgtgtgtgggtgtgtatgtgtggagtgtgtgtgtgtgtttccatggtaggactccagtcccagctgctgcctaggctcctgtgggtcctgtgggtccccctcccctgttcaccttccccaacagggctatagtttaagggtgtcccaggccttggctggttggctgggcccagctcctgggggctgggcagggcagggcagggccgggtccacttccattgttagcagttgtttgcagaattttctcttttaccattcctctctttttgttctcgcccagagtgggtggttttttgttgttgttttagattttcatgtgaaggcagttttttttcttttttaactccccatccccctatgcagggtgtcatttcaccatccacatccacatccttgtttgtgtttctggccctcgtcctccctgcctctcatctgcctccccaacccccacctacccactgctcccaggggtctctccaggggcagggggattttaggagatggggtgggggccagcccctactggacccttgtaatctgatttggagaccatccccccgatgggaccagcagccccgccggcccactgggggtccctcttaacatctgcttgttgcgggggtcagtcatgagtgccagggtctggctggggtcttggcactgtcttcctggccggggcctgaaaccttagcccccagccggcctgagtgggggatattgacacccccagctaaagcacaagcaccttagtcacccctcctctccccccgcctcctggcctgccaccccaccccagcgtttaccccaaagcacaatgccctggtcacttggcaagcggctgggcctgacggaggccgaggggcagaccggggctccagccagacccctgaaaggaaggtgctcccccacttccaggccttagttggggtgggggggccagctcctgggcctggggtcttctcacccccacccccttgtcctgggtaggcccctgcctgcccctctctgccttttcctcgggtgtccctcctcgagcccctgtggcattggcttgggtggcagagcccacttgtttcagggaccccaggaggtgccccctggctcccaggactgtgtgtgggtccggggggtgggggggtggggagaagggtcgggcagggggtgcaggggaggaaactcctcaccaggagagccaaagacagggttgtgccttaccccaggagccacccctgtaccccccttgccctgccattcaccctccacccctacccctgggcggcctgctgctttttccttctcttcctcccctgccctgagctgcatggttcccccaccctgggcagccaggaaggaatctgaatggagaatcaccaaccaccagagaaaaaagactgtggggccctcccctgccaactccccttccctggccgcccactcaacccacacctctttcacgcaggacaggctgcccaccctgtccacgtgaagtgccaacgccctccccaccctgggccgagcccccacccctccctgggcccccaagtgagattgcacatttaactactgtaaggagaggagcggcgttggcaaatgtgaac

SEQ ID NO: 11375 - DNA, 1560 bp, Homo sapiens
tccgacggcgccgcccgcgtgcgaggcaaagcccgcttgccgcccggcggacagcatgctcaacgtgctcgtgcgggccgtggtggccttctgaggaccccgagcggcgctgccggagcccagagcgcgcgtcgaaccgtcggcccgagggcgcagacctgaggcgaggccacccccctccatcctgggggaagcgcccgcgaaaaccgtggagagaagccgccgcccgggctgctgagaggcccggagagggactctgtccccggggagccatcgccttcagtgtgcagggacggcaccgaggagtctgagccgggggcgcgggcgccttccgcagagacctgcgcccacaggtgctgtcttagtggactgggacgtgaacctttcgctctccttctggactgggagaagggaggcttgggtgttgtgttttttgttttgtttgtttgtttgtttttaaagatctcctcagggtcggacttcattttgtactgtgggctgtgctggccctttcaaggtttttcaagagttggttttgcgtttccaacctcggagaattccaggcactccccttccccctccgctgacatacttgtataagcggtcatcgttgcgtcatggggcaggcgtggggagcttcctgtcgccttgcgtgggtgtggggcctgggaggaggtcctggggcgtgcacccgccctgggcagtggggaggagagtggcctgagttacttcacccccgcgtgctgctggttaatgtcccgcgtctctgcaccttcgggtgggagcggggactgatctactttcacattctcaagtttttctcatctgcattagaggtgcccagtaggttcccaggttccagcgtgcccctccctcagacacacggacacaatcagccgagaagttcctggtctgaatcacgagaatgtggaggggtggggggtgtcagtggaaaggcataaggctgagctgagaccagttgctggtgaaactgggccaatctggggaggggaacatccttgccagggagtttctgagggtctgctttgtttacctttcgtgcggtggattctttttaactccgtctacctggcgttttgttagaaatgtcagataggaaaataaaaaccatttgagtaaaaaagccggtgctgtctggttttctgctgtggtgggggaggggcggggttaaagcgtcaggggctggcagccgctcgctggggccccaagaaccggtctgaccggttaccacgtgggcgagagagggttgggcccccttttccttgcccgggcattccctaactggtggagccccgcctcccccagatttgggggttcccttgaaattgtcctacaactccgggacagggagatcggggctttctgagttgagacaatagtgctaaacacactgccccaagcggagctggggatcgattgcacgcactttgaagccttgaaaggtggtagatctcgcccccaccccctagaccaaactgaatcagctgtggccggggccctacagtatcaggtggagctgagcgggtgagctttgaaggg

SEQ ID NO: 11376 - DNA, 1191 bp, Homo sapiens
gggcacctgtagtcccagctacttgggaggctgaggcaggggaatggcatgaacccaggaggtggagcttgcagtgagccgagatcgcgccactgcactccagcccgggtgacagagtgagactcctcaaaaaaaaaaaaaaaaaaaaagtataattcagccaagcacaatggcgtatgcctatagtcccgactatcaggaggctaaggtaggattgtgagttcaagcccagcctgggcaaaataggaagaccccgtctaccaaaaaaaaaaaaaaaaggttgggggaggtttttgtttttttggatgtgaaaagaagagcctagtccggcggagagcggggctttcctgaactgtgcctcctaccagtgaggttgctcagaccttgcctggggctggagtgttgcctggagaacagccatgaagctgcctccccacttcccacttcccacccctgctcgctgacccctgctactcctgcttctttcccctagttctatggggcttctgttgcttatgaaaatgccctgcgggtgttcaacatcgtcttcacctccctcttctctctggaatgtgtgctgaaagtcatggcttttgggattctggtaagtaccaccttggggctacagctatgggcttgggagaagcccaagggggaacaatgggtcctggatgatggtctcccaacgtggccccaagaaccccaacctcaagggtggcttcagtatcctgccagtggccacagatcctacttaggcattcttgtgtttgccaaggagtcccagggagacccaacctgtgagtgttaccatatggctgcttatgtatccagttcctcaaaatgatgggagtcatcatggctgggagtctttagcatccattttagagataagaaaactgaaatcaggctgggcgaggtgtctcatggctgtaattccagcactttgggaggccaaggtgggcggatcacctgaggtcgggagttcgagaccagcctgaccaacatggagaaactctgtctctactaaaaatacaaaattagccgggtgtggtggcgcatgcctgtaatcccagctactcgggaggctgaggcaggagaatcgcttgaacctgggaggcagaggttgtggtgagccgagatcacatcactgcactccagcctgggcaacaagagtgaaactctgtctcaaaa

SEQ ID NO: 11377 - DNA, 1218 bp, Homo sapiens
gcctcaaataccttgaacgctgcatgtgacaagtaaattctctaaaccaatgctttccattagaactttctgcagtcacagaaatgatctccatctgccctgtccaataggattgtcacttgaaatgtagccagtgtgactgcagaactgtgttttttattttattgcatttaaattaattttaattgaaatagccacatgtggcctgtgactgtcgtattgaataagacaggtgcaaacaaataattctgtttagctgagtgatatgtgaggttggcccaaaaggaatgaaggaggaaggtgccttctctaggcattggctttgctcgcaaaaggctttggacaagagaactctgcaagaggcagtgaggggtggtgagtgcaggagggtcaggggaagtgagagggtgataggtactgatttctaggtgggctggttccctgatcttgtcaacatctgcccagcccaagacgctgaccttgccttctctcccttccaggatgacacagaaccatacttcattggaattttttgtttcgaggctggaattaaaatcattgcccttgggtttgccttccacaaaggctcctacttgaggaatggctggaatgtcatggactttgtggtggtgctaacggggtaagtggcgcgtgctatacgctttggatttaactagctgaaggattacgaggcttttggttggtgtggtccgggccaggctcaggaaggctgagcccttgtgttctccctccccttgttatgcgcctgcctcctttctgccaacaccccacctccatgtctcagctgtatattacagcagatgctttctgttacaattaaaataatagctcattattgttggctgcttccagagtgctttatgcccattctctaatttaatccttgcaacaacccactgaattaggaaatattaatattcccatctgaccactgaggaatcagaaactcagagtgtaacttgcttaaggccacccagcaagtaagtgatggaactgggagatgaacagaagattatgcattccagaactcaaggttttaagtgttgtacgtgcatgggtctcttgatttgcttgaggatatcttgcttttatttcaacttggtgaatgttttttgagaatgtctgggtgcaagggattgtgattatgacaaaggagaaaagcaagctaaataaggtacagttactgtcttcaaggag

SEQ ID NO: 11378 - DNA, 1149 bp, Homo sapiens
tctaaatatttctgccattaaaaaaaaatgtttcagcatatcctgagagtgaaaaaaaaagtgtgtaggtacttaaataaagtctaatatatgtacaggcaagtacatatattcagatgcatagatttttacaaaatgaacacacccacgtatccagcacccaggtcccgatcagtgccctggaagtccccctccccataccgcctcctagttgctcccccaacaagggtaccgctcacctgacttctaaggttcattttgcctcttttaaacatgtaaatggagtcacacagtacgttcttttgccactggcttcttttgctcacatctgtgtatgtgactctactacaatctatccattctactgttgatgggcatttgtgtcatttctgtttgtgccactgggaacattcttgtgtcttctattatttttttcccacagttctcttagataggagtggaatcgcccctgctactttttgatgcatgtgttgtgggatgtgtatttggaaatggtgttgactaagggttgcaggtcgatatggaaagcaggttcctccctgtcttgtttaagagaagtgagtgaatgatccatgaacttgtcggtatgctcacagggcctaagagtgctacttccaaatgtaaattctggcatggtacactggtgaaggatgcagtcttgctttctccacactcggggcaatttgtcactatgatttcttcctctttcatccctcagtgggtcaaacttgaagccatcaatgacaattaagaatcctcatttatttcattttttcccctcttcctaagtgaggaaacccaaatggaagtctttgatgttcaaatttacattgccgtgtttttctcatgccaggcagcaagccgtcttgaccacacaccttggtttcatgttttcattgactggaattgtgattcaaatagggccatgagggtctctgatgattgccgaagagctcagatctgtcagctcaaaaaggagcatctgtcagccttcctagagttccctccccacttaatgccactcactccttctaccaagtgccaaggtgaatgtcatctttccagccctccctgtgccaccaggtctcccactgaacatgatgtagaaactcaggccatcggaggaac

SEQ ID NO: 11379 - DNA, 1307 bp, Homo sapiens
aatgctgccacttttgtggttccgaggaggcggctcactccgttcgggcttggcaggagtcgtggagtgggttcggccacgtggaatccgcgtcctgggaacccgtggaatccgcgtcctgggaacccgtggaatccgcctcctgggaacccgtggaatccgcctcctgggaacccgtggaatccgcctcctgggaacccgtggaatccgcctcctgggaacccgtggaatccgcctcctgggaacccgtggaatcgggttggatgcgcatgtgcgtgtctctttttccgggggaggctccgcccacggccccgccccgctcccaagtgcgcgcggacccctagctccctctgagttgcgctgggcttggctgctgcaccatgaccctggaggcgatccgctactcgcggggctccctgcagatcctagaccagctgctgctgcccaagcagagccgctacgaggcggtgggctcggtgcaccaggcctgggaggccatccgcgccatgaaggtgcagcggggcggcggggcggcggggcggcggggcggcggggcggcggggcggcggggcggcggggcggcggggcggcggggcggccgggttggaggtgggagtgcgcccgcgcctgcagcttccgacgcccaaatccctgccccgcaggtgcggggcgccccggccatagccctggtgggctgtctcagcctcgccgtggagctgcaggcgggcgccgggggaccgggactcgccgcgctcgtggccttcgtgcgcgacaagctgagcttcctcgtcaccgcccggcccaccgctgtcaacatggcccgcgccgcccgcgacctggctgatgttgcagcccgggaggccgaacgggagggcgctacggaagaggcggtccgggagaggtacggggatctggtaccaggcacggcgctgagcaggaattatattgactctttttaagtacagtgacccactatacagatggggaaactgaggcacggcgaccttaagtcccttgtccagggccccacagatggggagactgaggcacggcgaccttaagtcccttgtccagggccccacagatggggcccagagtctagcctgggcagcctggccctgaaacctaactccttaatcgtgcctcccctgaatacacgcagccccttatccgcccttggaggccctttttagtatctccgtgttctcttggtttctgcttttgaggaactttttttcctgtcctggtccccttcctgccatctttttccccccacttcctttctgctccagccctccctgcaatgt

SEQ ID NO: 11380 - DNA, 1402 bp, Homo sapiens
cttcagagactcttctccgattccagcctgtgctcagggcttggccgggagggaatggctggccagcatggagctggacaaaggcctagaggctggccaggctaatgtggctgcagggggttgagggggttgcagaaagaggctccaaagcttagccttctacacacgtgattcccacctagtccaggtgcgccctgatgatttggaaaggaagtttctgttcagcatggtgtggaggtggaagtggaggtggcagtgtcatggttaacccacgcatacatgtacgtgtgtctgcccccgctcctgacggatttccctccctcacctcccaccaggcccgcaagccctgatgaatatcatgcagaactggtattccttattcacaccagtggaggcggctaccatcgtggcagtgacgggcaccacacacgccactctgctgcgactgcagctggacacatcgcggagggaggagctctgggcctgcgcccgcaccctggccttgcagtgcgcgatgaaggaccctcagaactgcgccttgcctgccctgaccctgtgcgagaagaaccactcggccttcgaggcggcctaccagatcgtgctggacgcggcggccggcggcctgggccacgcccacctcttcactgtggcccgctatatggagcaccgcgggctgccgctccgggcctacaagctggcgacgctggccctggcgcagctcagcatcgccttcaaccaggacagccaccctgccgtcaacgacgtgctttgggcctgctctctcagccactccctgggccggcacgagctctctgccatcgtccccctcatcattcgcagcatccactgtgccccaatgctgtccgatattctgcgccgctggactctctcggcgcccggtctgggccccttaggggcacgccgggccgccaagccactgggtgccgaccgggcgccgctctgccagctcctggacgcggcagtcaccgcctacatcaccaccagccactcgcgcctcacgcacatcagcccgcggcactatggggatttcatcgaattcctgggcaaggcccgggagaccttcctgctggcgcccgacgggcacctccagttctcacagttcttggagaacctcaaacagacctacaagggcaagaagaaactcatgcttttggtgcgggagcgttttggttgagggacagtggggtgcgtgggagtggggatccccctcgcccctgcgtcccccacccttgctctccaattaggcccacgtggcatttcagtattattaagtcagggaaggagcccggctggagatgggggcagggggagcagcatcctgccacgtgtgtgcctgggagtctgtgagcaagtgtgcaagactccagaagcagaagccata

SEQ ID NO: 11381 - DNA, 1085 bp, Homo sapiens
aggatgatgaccccgatggcttcttaggctgagcgcccagcctcacccctgccccagcccattccggcccccatctcacccaagatcccccagagtccaggagctggacggggacaccctcagccctcataacagattccaaggagagggcaccctcttgtccttatctttgccccttgtgtctgtctcacacacatctgctcctcagcacgtcggtgtggggaggggattgctccttaaaccccaggtggctgaccctccccacccagtccaggacattttaggaaaaaaaaaatgaaatgtggggggcttctcatctccccaagatcctcttccgttcagccagatgtttcctgtataaatgtttggatctgcctgtttattttggtgggtggtctttcctccctcccctaccacccatgccccccttctcagtctgcccctggcctccagcccctaggggactagctgggttggggttcctcgggccttttctctcctccctcttttctttctgttgattgtcgctccagctggctgtattgctttttaatattgcaccgaaggttttttaaataaaattttaaaaaaagaaaaagggaaaaaaaagccacggagtccattttatgaatggggtggggagagggcactaaagagcctcctaagagagcctcaggttaggacagaattgtttggggagggagaaaaacagaaacaatgaattatagctgcctcacagccatgtataacaataattgctccaggaaggtgggaatatttgcttttttttcttctgtaatctcaccgtgtccgtgtccagaacagagctaggcacacagcaggtgctcaatttttgtttttcgtttagacaggtttcattctttcacccaggctggagtgcagtggtgctatcatagctcattgtagcctcaaactcctgggctgaagtgatcctcccacctcagcctcctgagtagctgggactacaggtgcactctgccatgccgggctaacttttaaaaatttttgtccgggcacagtggctcatgcctgtaatcccagcactttgggaggccgaggtgggt

SEQ ID NO: 11382 - DNA, 1177 bp, Homo sapiens
tgcccagctaatttttgtatttttgcagagacggggtctcactatgttgcccaggctggtctcaaactcctaggctcaagtgatccacccaccttggcctcccaaagtactgggattatacaggcatgagccaccacacccgaccctctgtaataattttttaaccaggggccatcttttttattctgggccccactaattctgcagcctatcatgatcccattttacagatgacaaaactgtggcctcagagccttactcaagctcccagagcaaggtactacagagttctctctccagccaaggcaggctaaccaggtcctgacatacctctgagccagccctcactttcacccattaacagcaggataagggtcgcccctgtagaacatgattcctacagggagccaggatcgctgttgtcatttaatgtttgaacaccagccggggaggcccccaaggccttcagatcgggtccaagtctcaggggtgggcccttgaccagccactgcttcccacaggacaactcaaacttatacatggtcatggagtacgtgcccggcggggagatgttctcacacctacggcggatcggaaggttcaggtaagcgggccaccccccatcacatcaggctgtcagggtgtccacaggtggcagtgcacgaccaagccccctgggaatgcagaggagtccagcatacttcaacatgcaggtggtctcccagaccctgtgggtttctgtttcccctctgctgaggaatatgtgatatttcaaccaccacaaaacaaaacagagcaaacagggcaacttaggtgtccaaactgaagttgctgccaggcacggtggttctcaccagtaatcccagcactttgggaggccaaggtgggcagatcacctgaggtcaggagtttgagaccagcctggccaacatggcaaaaccctgtctccactaaaaatacaaaactgagctgggcatggtggtgggcacctgtaatcccagctacttgggaggctgaggcaggagaatcacttgaacccaggagacagaggttgcagtgagccaagatcacaccactgtactccagcctgggtgagagagtgacatgccgtctcaaaaaaaaaaattgaagttgttgattttgtgcattttttgagccccaaaaggtggcatgcatc

SEQ ID NO: 11383 - DNA, 2930 bp, Homo sapiens
cctgctccctggagactgggaaaaggccgcagggcagggggactgggcggtggtggctggtggtttaaaggttgaactttctctgaagctcctttccccttgctcttggtccctgccccgcaagcaaacctgccccctctgcctcccagtgcacccaatgaccccctcccttggggcgactcctgatgaagcacaactccccgcagggcccccagcccacaggggtggccatatttgggcagttcccagtcctgtgggctcggctatctggggagcagattttgggtctggatctccctggggagtgggtcctgggcttggatctttccctagggggccctcttactccttcctctctcctcctccttccccattgctgtaaatatttcaacgaaatggaaaagaaaaaaaaaagacaaaaaaaaaaaaaaagaaaagaaaaaaaatctcatcacttgaagccaccgggagcctgcggcccgggccagcccgggctttctccggagcagagcagcgctgctggcctggcagccaggacttctccgtgtacgtgcatccccagtccccgccggggcgggcgggccgccagagcagctttttacaatccagagacagaaaacaaaatctagatgcaacagcgaaacaaagaacccatttccttcctggcaccctcctttcctgctccgcctgcccggcatcatcagcccttctggggcgtgtacctctcactgcctgccccaggaccagaggcctgtctcccccttccctccccaccggcccgggggagacctcttcacacccaaagatgctttgtcaagatggctgcgctgtccctttgagttcctgcttcttgtatattgctctggggactctcgccggggaagatggggctgatttcccacctagagaggttgatggcagaaggaaaatggggaggcactggggttgtggagggcatgggtatggctgaggagggtgctgggaacggcaaggcggtctgggggatggggaggggcaaaggtgagagatcaccttccctatcctccaccttcccgcagggaagacgaagccaggtgccagggctggggtcgggacacccatgttctgggcggcttgaccccaaatcccagaccccggaagctccaggctcgggatgtgtcctgagcacctgtcccggccccctcctctccagcctgtcaggccagcctccccagcccccttccctcaactctaggggcagcatagccccaggccaccctagcccagcccctgcattgccgtttccccagaggtggcccctccacctctgctctgacctctccccatctctctgcccctccttttctcacaagtgccatgagttttcaaacatcttcgggtctcagcctgctgctgccatgaactttgttgggttaagggggaggggctctaggaaggaactggggggaaggggacaggtaggtggctggagggaccctttttgctgctagaaagcccctcccttctcccggggagctggggctggcttgtccccatcaattaggggagaaggggtcagaccaaagatggtggtttgtcccgtgtaagggaacaggtgtggggaagaggtggggttgggttccaactctggctttttctggtagaaaggcctaacccattacaccagaagaccatgggtgaagtctagatggggaggagaagtgaggccagggacagtcttgccagacgactctgaggagggcaagggacagttccatggcccttcccggactgcactaggctgggagctctgttgtgtggaggggtggtcagaggtctgtgaagagcgggcaggaggcatgagcaggcgaggagctggcctgtcccgggaagcagcccagcctgtggctgcccccgacaccaggaggagggccaggagagttccagggggctgaggcacacagagaggccaacttcctccctgcccagccttccttgtatctctccagactcggacaatcaaagggagagagggtgtatcgggtcctgttccagccggcatcgccgggtggcttccaggcctcagagctgtgtggcagggccccctgctggggctggacatcactgcagtccagtgcaaagccgcccccagagcccaggtgtccccccaacctaaccagacctggtgccttgacgcccccaccccagctgggacggtacagagaagggtcttggtttcctctcctactcccttccttaggctcctgaactcgtttgctcctaaatcttgttaattctttttctctggattttggtttcttttggctttcccttgccttcccctttctctgtctccaacactctttccccatgtctttctggctgtctctatgttcctcttctcttatcctcaactttctgtccattcgggcctcctccccacctcccacgccccagcccctccctccttggtctccttttcgatatgccaaaccaattttgggtcgagtgcatttaacgagaacaaaacaaaaggctcataacaacaagaacgtttcagaaaaaaacaaaaagttttaaaaaaattgttgagtcaaaaagtcaaacaataaagaaattaagatttcttggaatgacaagagtggtgtgacttcttgagtgggggagtaagaaatgggtgaatagctgggcgcggtggctcaggcctgtaatcccagcattttgggaggccgaggtgggtggatcacttgaggccaggagtttgagactagcctagtcaacatggtgaaaccccatctctactaaaaagacaaaattagctgggcgtggtggcaagcacctgtggtcccagctacttgggaggctaaggcaggagaattgcttgaacccggctgggaggcagaggttgcagtaagccaagatcgtaccactgcactccagcctgggctata

SEQ ID NO: 11384 - DNA, 1105 bp, Homo sapiens
gtgccagtgagggagaaagggaatgtgagatcagagatccagggggcagggggaagcctacggaaaaccagcaggaatcaagcccacttctccacatggaccgcaccccctcactgtcccctagtgcatccagggcccctcttcaacctgaccagcccctttctgccctgcagagcaccccttgggaggccgggaagcctgtggcatggacaccctgcccctgaacggcaacttcaataacagttactccttgcgaagtggggatttccctcccggggatgggggccctgagccgccccgaggccggaacctagccgatgcggcggcctttgagaagatgatcatctcagagctggtgcacaacaacctgcgggggagcagcagcgcggccaagggccctccaccgcctgagccccctgtgccacctgtgccagggggcgggggcgaggaagaggcgggcgggcccgggggtgctgaccgggccgagattgaacttctctataaggccctggaggagcctctgctgctgccccgggcccagtcggtgctgtaccagagcgatctggacgagtcggagagctgcacggccgaggacggcgccaccagccggcccctctcctcccctcctggccgggactccctctatgccagcggggccaacctgcgggactcaccctcctacccggacagcagccctgaggggcccagtgaggccctgcccccaccccctcccgcaccccccggcccccccgaaatctactacacctcgcgcccgccagccctggtggcccggaatcccctgcagggctactaccaggtgcggcgtcctagccacgagggctacctggcagccccaggccttgaggggccagggcccgatggggacgggcagatgcagctggtcaccagtctctgagggcacctcatggaccaggggctggtggcccaggccagggagggaaccctgggcagggctctggtgggagagggagacagatggaggcagtggctggtgggccactctctccaggtgcccctcagccatgggccctacagtcccctcaggggactctaacctgggggcctgaggtgccagggttcacag

SEQ ID NO: 11385 - DNA, 1068 bp, Homo sapiens
cccgattgctggcctggctttgcatggcatcctagagagatcacgggcagtaccaggggaggctagccccatgggtgtggggggcccctggtcttgcctggggcatgaggccatgcgtctggtcctctatggccatgatcccaccgtctcccaaggcactctggagaagcaagttggtgttacgttggtcatctctccacaagccttccagagcatgaggaagtgagcgcattgctgcgtgcagaggggtgagggctgccaggttggcggcaccagaggtcctcacggcccatggccttgcccagggccctgtctgtggctggcacctggctgagcccagcgtgcaaaaccaaaggccctgagcgtgccccctgttcctgtccccagtaccagggccgcatcaacgagctgctgctgtcggtcatcacctgggtgggcattgtgatctccctggtctgcttggccatctgcatctccaccttctgcttcctgcgggggctgcagaccgaccgcaacaccatccacaagaacctgtgcatcaacctcttcctggctgagctgctcttcctggtcgggatcgacaagactcagtatgaggtgggctgggactctagggcaggtgacggccagcgcctgggggccgggagaagaagggggacacctgtccaggcagcagcccctcaccctcagtgctccccgcagattgcctgccccatcttcgccggcctgctgcactatttcttcctggctgccttctcctggctgtgcctggagggcgtgcacctctacctgctactagtggaggtgtttgagagcgagtattcccgcaccaagtactactacctgggtggctactgcttcccggccctggtggtgggcatcgcggctgccattgactaccgcagctacggcaccgagaaggcgtgagtttccacctcccagccctgcaccctcccacctggttccctgctgggcggcaccccttggaccaggaccctcagggcggtagtcccttcctcctcctgatcccagaggctgcagcctgcagagtcctaggccttcatgagt

SEQ ID NO: 11386 - DNA, 1823 bp, Homo sapiens
tcccatccttctcttcttccctttggctcccttgtctgttcctgtctgtctgtccctgcaggaattgcctccttccagtgtctaccagccttggggctctggaacccccggggccctgacctcagcaactgcacctccccctgggtcaaccaggtggcccagaaggtaccagccaccacccctcgcaggcaggcacatgtgctcgggcccagggcccagggcccagcgggggtcgtggagcagctggggagacatgggctggcaggtctggaaggcaggactgtggggtcacctccctggcctacaaagggagcagggacagatggggtgggaaggggcagatggcgatggggaagtggagagagagataggagaggctgcacaggccagggaagccggggagggcaggatggtccctgacagtcctgggattcccccttcccgcccccacctcatgcagatcaagagtggggagaacgcggccaacatcgccagcgagctggcccgacacacccggggctccatctacgcgggggacgtctcctcctctgtgaagctgatggagcagctgctggacatcctggatgcccagctgcaggccctgcggcccatcgagcgcgagtcagccggcaagaactacaacaaggtggggcctggcggtggcgctgacctggtatggggagggcgcctgcccccaggggcttgggaagtacctgacctggtacctcccagccaggctgccacctccactcctttcctcagagaggaaggacccccccctctccgccaaggactgccgggtctcactcctgtgctgccccggatggtcctgggggttggggatccctgaggaatgtcttgctgatagcccagccctgggtcagtggtaaccgcagacgagagagctatccagatgtgacagtattagggtgagggaaccggcacccagaggcctggcctgacatcacctccatctctttctagatgcacaagcgagagagaacttgtaaggattatatcaaggtgagacccagggggtcccagtgtaaggaccgtgggctccagctgatggggggattaggggtggaggttgagaagagggcatgcagagcccacccccaggaattagagggtgttggggggctcacagcaccatgccctctgcctgtgcaggccgtggtggagacagtggacaatctgctccggccagaagctctggagtcctggaaggacatgaatgccacggagcaggtgcacacggccaccatgctcctcgacgtcctggaggagggcgccttcctgctggccgacaatgtcagggagcctgcccgcttcctggctgccaaggagaacgtgggtgagtgccacagtcacccagggcaaactcagatacgaaccttaaaccacggggttctggcctggaggccacaggggggctatccgacccttgggcatcttgccagagtctcgttctgcagcctgagcccctggactgggaacagaccccaactgtgtatgccttgccttcccctgtccccacagtcctggaggtcacagtcctgaacacagagggccaggtgcaggagctggtgttcccccaggaggagtacccgagaaagaactccatccagctgtctgccaaaaccatcaagcagaacagccgcaatggtcagtgtccccggcggggcctcgggtggggaagcagccccacccccaccccccagctctgtgccagcgtctctgtgccatttgtagagggcagcggtgctgaccttttctcatgctagtgtaaaatttgaggggattcatgggccctgaagtgc

SEQ ID NO: 11387 - DNA, 2201 bp, Homo sapiens
aaatcggggtccgggccaggggaggtggggggcctggctggggcgggctgggtctttatcctagcgcctggttccctcccctgccccctccgagctggacctgggactgcccccctgagggaccctcagtcgggcctgggccttggagtgaattctctgctcacccctctctcctccgccagcactaaccctttcttcccaggtggtttgcagcgcagcctcccacggagccaggacctcgccaagccccatacgcccttgtctctcttccctctgcacagctctcctctccctccccaactctcccgggagccctgtccctctccatgtccccacccccacccctgtgcacagtgccactgtctgctgctgagccagaccccatgagagaccctgccggctgggggcagggctgggcgccctccaggaggggccagactctttcattccccgtcctagcctgggagctgcctctgggaatcccttcctcggctactgacttcgtgggtactgggtggggggtggggagcaggctgcatcaggaacctggggagagagttgaaacccctatcctggaatagggagacactcctgacacccacagtgggtatggaaacaccactctaccttgcaatttttgcaggaggaagaaagaggagttaaaaaaaaaaacactgtccgggtgtggttggtgaaggatgggatcctggaccctagctcttccctaagtggcagagaagagggagaaggggccgggtgctgagtccctggaccgtcaaagtcaggagtgactgtagcggggagattctgcccccacttaaatcacacaggaccacctctgggagggctcttgccaaactcctccccagcctgtggggtctctagcagccagggaagggaagaggggcaccacttcccctcactaaccccgctcttaatggccttcagggttcacatttccagggagaggggcagctgggcagggcgtggggagggggtcgggtcccagcccggaaacccccttcccatcaccagccataccaagcaaccgtgactgcagcagcaggaggggacaacctggctccccaccagcagcgtgaccaacttgcctctctcccccctctctctctctctctctctctctctctctctcctccctctcgcctctgccccttctctcctacctcctcccctcccgcccactctgcccagtcttcgtgtgcccagggaccctgcagaaggtgctggagcccacctcgacacacgagtcagagcaccagtctggcgcatggtgcaaggacccgctgcaggcgggtgaccgcatctacgtgatgccctggatcccctaccgcacggacacactgactgagtatgcctcgtgggaggactacgtggccgcccgccacaccaccacctaccgcctgcccaaccgcgtggatggcacaggctttgtggtctacgatggtgccgtcttctacaacaaggagcgcacgcgcaacatcgtcaagtatgacctacggacgcgcatcaagagcggggagacggtcatcaataccgccaactaccatgacacctcgccctaccgctggggcggaaagaccgacattgacctggcggtggacgagaacgggctgtgggtcatctacgccactgagggcaacaacgggcggctggtggtgagccagctgaacccctacacactgcgctttgagggcacgtgggagacgggttacgacaagcgctcggcatccaacgccttcatggtgtgtggggtcctgtacgtcctgcgttccgtgtacgtggatgatgacagcgaggcggctggcaaccgcgtggactatgccttcaacaccaatgccaaccgcgaggagcctgtcagcctcaccttccccaacccctaccagttcatctcctccgttgactacaaccctcgcgacaaccagctgtacgtctggaacaactatttcgtggtgcgctacagcctggagttcgggccgcccgaccccagtgctggtgaggacgactcacttccaggcatggagcctgcttgcctttgtcccctccacccccacccacccctgggtcccagagtggggagccccatcctgtgagctcttggggatcgggaggtaaaggaaattcacagcatgtgacagacgctgttctaagcacttcacagtcattaactcgtctcctcacgg

SEQ ID NO: 11388 - DNA, 1163 bp, Homo sapiens
acctgatccccatctctgaccagctgggggcccagccctggggaggggtgtcagctgtccccagccctgggagggggcagcctgccaaaaaatgaaaaaatgagggcgagggggcgggggcgggcctcgtggttgggggagcgaagggtgggggagcgtgttctctgtttctttcacacttgcaaagctgcagtcagggtttcttctgggctgttgtggttagaggaccagggagatgggcggcgggcggcgggggcacagtctggggacttccacagactccgtaatttctagcagagaactccctagtggatggggctggccattactggctgttattggggggagcggaggtgctgctgctgaggggcttctagggtgagatgttagggatgaccatttcctctccagaaagttttgggaaatttacccatctgaggccggcagcagcaggcagggctggaggacatggcctttagggatcccttttgccttgaaattacagtggtctgtggagcatcccttccgaaggaggtggggcagggtccctctgagctgctcccctccccgtcttcccctctcccccatctcagagaggcctgggctgctggccccaggtccgccccctcaccacacccctccagtctcctctctttctcctggagtctctctccctcccagcaccagccactcttcttgcaggcccactggtttggatgcggcaccactggagattttctcttcgagggccagggcagggcgggtggggtgacggggcaagggagggaagaggagggattgggagtttggtgctggtgaagggtccttgctgtccaaggccccagacagacccttcctcatcttctcccccttcccctgggttgacctctaaccacatttttcccccctgacaccctctgagcaggttaggctctgaggcctcccaccgtccccttcacacaaacacgtcccctcagatgccacacacctggtgggggtggggaccggcttgggcagaggccagtgtgctggacagagtgggcaggccgacccctcagggcatcagggacagggggatggccagtccccagggcccaagccagggtcgttttggctcctgcccagctctatgtcccaggctcctctccctctacaaaaactac

SEQ ID NO: 11389 - DNA, 1541 bp, Homo sapiens
ctagaggacagggaggccaggcactcacttgtccccaaaatgttcactgagcatctcctgagtgccaggccctgggtgaggcgctgggaagggaggcagaggctgcccctgcggagctccctgctggaaccttcagagaggggccaggagagccagtccctccagtcagaagttcctgaggggccagggatgcagagggggagcggcctgggcagccacctggcccagggcttcagaggctgggggtgaccccagtgctggtgagggtgggtcaggggtgggtggcagggggcacgtgatgtgtgggaaccctcccacacagtggacaagcccgactaatgctggatttgctttgcagctgagcacagtctaaccgcgccccttcctcccctaggtgccgcccgtccgcagggcagcgggcagggcggagctcccagctcctgggcccccgggccctgggtgggttgagcagagaagccgagcctcagacttgcccctggggagcctgggagcgtgtctgtgcccccacttgctgtcccacccagtctgtgtcccccacccccgccacctctctgcctccgtctccccaaccctggctctctctggggcccgggtgcaactgcccgtctgcctgtcgttctgtgtctggctctgccaccttctctctgtgtttgcttcttctgggttgtgagggcttgggggaagtcagctggacctgggtgaggccagcataaaggggaaggagttcagcctgtttcttggctgagggtgggcccaggccctgggagacactgaaatccttcccctggggcccctggttctagcaggagggcagcaggcagggtgggaagggagccgagtggcttatccaccccaccactccctggtgccccctctgaccggagcccacctcccagctggggctccctactccctgcccccgccttgcaccaagggtgccccctcccacctgagggctctgtctgcctgcctgtacccccctaccacccctgtgtctttctgtgtcttctccctcctgtgtgtgtccccctcgtccctctgactgtctccccagcaccctctcaccccacctgaccacccccagaggaagggacctgggggcgggggcccgagctgatgctacggaaggggttggggaagcaggagcgaggaaggaaaggaaaagggggcgtgttgccagaaaagaaacgaaagcaatttaatctctttttttttctctttttttcttgcacattttttttttcaatttgttttctctctctcttccgatgcttaaagtagaagtggagcagaaaggtaaacgcactgttaccaatgctaacccctaactcacactttgttctacctgtaccatacttatgtgacctgccctcccccggccccttcttctctccccaacccacacttggtccggtcggtatcccccaccctgggttgtcctcccagtgggaccagccctggtgcggccacgggcatctccaccctccagatacccacggaagctcctctctgagcttggg

SEQ ID NO: 11390 - DNA, 1263 bp, Homo sapiens
tcgggcgtccctggttcccgatctgtggcgccagctggattctaattagccaccagagcttgagagacaggaagcagggggctgggggcgggggcttggatttctgcccaagacggggaggctgcaagttgggttgcaatgagtccctcacttgggaggacactcattacctccttgctcatggtgaggatgcgagtaggggagatgagtgggcagggtcaggacaggggcatggggaagaggcttccagagggtccaaggcctgcctgggatctccccgtgagctgtcccaggaggttccagtggggaagagttggcagtctctttgcccagaggtgcccagatagctgggtctggctgctgggtgtaagggtggggggtgtggtgtgagctgcagaccccggagggggccctacagatagggctggctcgagggacgtgctggacctcagcctctcagagctactcagccaccagcaggaggagaggggagcggcctggaggccctatccccacctcagtctccctgtcctcccccaggctggtggtccaggccgtggtgcctgccaggtgatgtggggcaaagccccccgcacaggccactgagagctccggacacgcacccggctgccaccatggcccgcctagccgcagtgctctggaatctgtgtgtcaccgccgtcctggtcacctcggccacccaaggtaggtgctgctggggccggggaggggccgcggctcccaaacccttctggggggggcagataaaatgttgaaaaccctcctgatcactcagtaaagaattacagccccctgccccgccccagacctcagctggagcaggccagtggaagactcaggggtaacacacaccccagtgccaccaagaggcccctggaccatcctcttacctccaacaagtcggctgggccaggttggtaggggccatcccgctgtggcccctgggaccaggacaggccttcttggtgagccgatgctcctctctctgtctctctctcgctctctctctctctctctctctctgtgattacatcttcgaggctctcactgggaagaaggcttaattaaagcatgcccgctgacgtttatttaaaaacaactaattacccggctcggccctatgccggccctaggatcctgcacacgccactattagtgccccaagcctgcccgcccaccctcaccgattactcgattactggccccgtgaccagcccaggccgggggcaagggcgggataag

SEQ ID NO: 11391 - DNA, 1214 bp, Homo sapiens
cccagaggagccgtgtcgggggctggcaccacaggatgctgggcgagggggttgtttttctctgggaggcagtggcgcgggggatggggaggggtccgtctgggtgtccagccggccgcagtccggggggcgccgctgtcaggaggagggggtgcagccgggcagcaccttctctccgtggtgccgggttaaagcacgggaggccggcaggtttgatccactcggattattcgtgctttgaggacagctccccacccccaccccaggtgcgcattggattgagctgcgagggtttggttgtcatcctcccatctgacggtcctgggacccgagtccaggcctgaagtggtggggtggggggatgctgtgtttgctccagccgtgtccagaaaatgccctcccaggtatctctccagtgcacccctggcccccatctgaagacagccgctggctacacacacccctgtctctacacttccagtccgggtcctcacactgccccatccctggccaacacctcactgtacctgcctggaccctttcttcctgttccaacccccatccacccccagccatgccagctgcgtgggtgtttctgtatcccagttccaggcagggcccccccttccgcctggcttccaccggactcagagctggggtctgtcttcccacatcccacttcccaacatgtgtgcctgggggcaggagggggaggggttcaaaatggctgccaagatggctggctcgcgcgctctctctctctctgtctgtctctctctctctctctctctctctctcactctctctgtctttctctatctctctctgtctttctctcttcccctctctgcttgcccggctcccttatcctggtagggagtcactgcttagaggaggtcggatccagtggggcacacctgagggtgaatgtctattccgggccgttgacctccatgctgtttggggacagaccattggtttctgcttctctctccaacaccccaagggctggcatgagtctaacctgaccccagaccccactccttcaccctggctcacagcctgaaagctccgtgccctccacctgctctccagggcctggccccctgaattgatcaaccccacggagggtccacacccctcattctcttctcctgtctgcccccggcaggggactctgcgtgggtccctgtcaggccccagctttggggggc

SEQ ID NO: 11392 - DNA, 1320 bp, Homo sapiens
gagtgaaactccatctcaaaacaaaacaaaaaaaaaattacaaaaattagccgggtgtggtggcacgcttctgtagtcccagctactcagaaagctgaggtgggaggatcgcttgagtctgggaggtggaggttgcagtgagctgattatgccactgcactcaagcctgggcaacagactgagaccctgtctcaaaaaaagaaagaaaaaagaacaggaaatcaaaacagagcctggcaggcagcccgtgcccaaccagtgttaagcgctgtgattcatacgtgcatgcaggcaaatactcaatccgtcgcttgttttctggttactgcatcatctcagtgattcccttgtgcctgtgggtctccagtgtgtcccctggtagggggtgacatccaggtccttcaggcaacccctgtggtctgatgctccagcgattctgtcacccgccaccccctagaatgtcatcaaattggtggatgaactgatggaagctcctggagacgtagaggccctggcgccacctgtccggcacctcatagccacccagctgctctcaaaccttgaagatatcatgaggatcctggccaagagcctgcctaaaggccccttcacctacatttccccttcgaacacaggtgaggccttggcctggcctgccctgccccaaccctgggccccacctggtacctggggtccctaatcacaactgcccctctcccctcagagctgaccctgatgatccaggagcggggggacaagaacgtcactatgggtcagagcagcgcacgcatgaagctgaattgggctgtggcagctggagccgaggatccaggtagcagcggtggtctggagggggagcccgtgggagagagatggaggtgctgggatggggccagggtgaggttcagaatagaacaactgactgggcgcggtggctcacgcctgcaatcccagcattttgggaggcccaggtgggtagatcgcttgagctcagaagttcaagaccagcctgggcaacatggtgaaacccggtctctacaaaaaatacaaaaattagccaggtgtggtggcacgtgcctgtagtcccagttactcaggaggctgaagcgagaggatcaattgagcccgggaggtcaaggctgctgtgagctatgatcacgccaaagcactccagcctggacgacatagtgagaccctgtcttaaaaaaaaaaaaaagtccaggcacagtggctcatgcctgtagtcctagcaccctagcactttggcaggctgaggtagatggatcacccgaggtcaggagttcaaaactagcctggcca

SEQ ID NO: 11393 - DNA, 1478 bp, Homo sapiens
aaaaaaaaaaaaaaagccgggtgtgctgaatacccatctcagcttctcaggaggctggggcaagaggatcacttgggcccaggagttcaaggttgcagtaagctatgatggtgccactacactccagcctgggtgacagggggacccgatctcaaaaaaaagacaaacacaaaaacaccaagaaggtggggctgagggcagagcatggggaggagcgtgcatggtcccagggcctgctcctgccctgacttggtgtctgggccggcaggttcgggaagaataccggaagtgggcctgcctagttgctggggggagcaagtactcagaattcacctccaccacgtctggcactggccacaatcagacccgggtaaggggctgcgcctggggcgggtgtgggcaggaaggcaccagggctagcggggctcaggcctctgggctctcctctccaggccctcagggcatcagagtccggcatatgaaggcgcatggttctggacggcccagcagctcctgtggccacagcagctttgtacacgaagaccatccatcctcccttcgtccaccactctactccctccaccctccctccctgatcccgtgtgccaccaggagggagtggcagctatagtctggcaccaaagtccaggacacccagtggggtggagtcggagccactggtcctgctgctggctgcctctctgctccaccttgtgacccagggtggggacaggggctggcccagggctgcaatgcagcatgttgccctggcacctgtggccagtactcgggacagactaagggcgcttgtcccatcctggacttttcctctcatgtctttgctgcagaactgaagagactaggcgctggggctcagcttccctcttaagctaagactgatgtcagaggccccatggcgaggccccttggggccactgcctgaggctcacggtacagaggcctgccctgcctggccgggcaggaggttctcactgttgtgaaggttgtagacgttgtgtaatgtgtttttatctgttaaaatttttcagtgttgacacttaaaattaaacacatgcatacagaagatggccttgcctgctggtggtgattcagaggccgggcccagggtgtccgtgaaaggccaagatgaccaagaaatagatggggtgggagccaggcttccataataacaagtttattctcatacaatctctagcttctcaacagtggcgcctggaaaggggaggtgaagctgcatgcgggcggctccgggtgggcggctctggcacgtggtggttaccggctctgctcgactgtaagacatgagatgcagtgaactgaagggccgggggaggaaccctctgccccagacccctggccctgcccaaggcacttactgtatgtggagatgtcgatttcctctggaagttctgccacattaacttcaaaccggtcctggacgtcattgaggattttgg

SEQ ID NO: 11394 - DNA, 1138 bp, Homo sapiens
tggtctggggtgggggtcctgcatggcagacgctcatgcccacccatgtcttgccctccccacctagacatgcggcgggatgtgcaggagatcttccgcctgacaccacacgagaagcagtgcatgatgttcagcgccaccctgagcaaggacatccggcctgtgtgcaggaagttcatgcaggatgtgagtagggcgagagtggcagctttggccttccccaggggcctggagcctggggccccaggacacccgcacggcccacatggcacggaggatgctgggatgctgggagccggcggagcctcctttcctcccctcggtcttgtcaaactgggagtcaagcttggtccacacctgagtcgggccagagcttacatccagcttttgagcgatgtttactgaggtctggtgcagcaggtcctctgggaagtgtcgcacaaaggagtcgcccactggaaggttctgggcaggcgagatgcccagaggtgatccctgcccgcccctcccacctcccttcccacacagcccatggaggtgtttgtggacgacgagaccaagctcacgctgcacggcctgcagcagtactacgtcaaactcaaagacagtgagaagaaccgcaagctctttgatctcttggatgtgctggagtttaaccaggtgatacttccatcagcctgtcctggggctcaggaccttcgggaggtcactgggccacagggactgtgtggccctgactgccactccttccctcaggtgataatcttcgtcaagtcagtgcagcgctgcatggccctggcccagctcctcgtggagcagaacttcccggccatcgccatccaccggggcatggcccaggaggagcggtgagtgcgagccgcccgccaaggctgcagggagcaccaccaggagcccagtgtctgacggcctccacttgtttctcctgcaccccagcctgtcacgctatcagcagttcaaggatttccagcggcggatcctggtggccaccaatctgtttggccgggggatggacatcgagcgagtcaacatcgtctttaactacgacatgcctgaggactcggacacctacctgcaccgggtgagcagcctcacgggcatgttgctttcccctggcggt

SEQ ID NO: 11395 - DNA, 1117 bp, Homo sapiens
aggtgacggtcctggtcatgtgccacacgagggagctggccttccagatcagcaaggaatatgagcgcttttccaagtacatgcccagcgtcaaggtgagtccctcgggccagactggaccaggcgccacttggtttctgcagctttgttagcctcggctctggcccagccagcatttaccaagcttggcaggggcagctgcctttgaggtttgcggtggtttttgctccttaaaagcctgatgaattatgcatggctcccaggggcctgcgcaggtcccagcctggggctgcctttgagtggagccccgggaggctctcaggcctgccttggtcccctgaggcctcctgttcgcaggtgctgggccgtgcaggttggggccttgggccgtgtatcagcatggagcggtttcctcctcatccccataggtgtctgtgttcttcggtggtctctccatcaagaaggatgaagaagtgttgaagaagaactgtccccatgtcgtggtggggaccccgggccgcatcctggcgctcgtgcggaataggagcttcagcctaaagaatgtgaagcactttgtgctggacgagtgtgacaagatgctggagcagctgggtgagtcctctgcccttgcagccccagctgagagtcagtgactaggcgggccccatagcaggcggaaggctcttgagtgggttacatgggcggccggcaggcggggctcctgtggtgatcttggggaaagctctgctgctggcagagggatgtgctgtttctgagcccgagccgaatgggaccacggggcccaagcaagcccccgtccctcctggacgtaaaggcatgcacacatacctctgggagtatgaggcttctgccacctgttgggttggttccaggccccgcctgccctcagtgagccccgacagggccggtgggagatgggcttgtgtcctgggaggcagctgcagctctcaccccagcggctgtctctgcctcaggctcccctccctgaagcgtggctcgaggcgcacgggcacggctgctccgcgccagcgtgtaagtggattgcagctcctcccgcgcctgcgctcgctggccaccccccagcccctcaggcacc

SEQ ID NO: 11396 - DNA, 1274 bp, Homo sapiens
ggggcttctctgggctgagtagtctgaggaggttcactggagctgaggcttgcgtgtggagaaggaggcatttgtgcagagacctgggggcagagcattcctggcggtgacagccaggttcaaaggcttggggcaggggctccaggggtctgagcagctgaacaaggctgggggtggtgtgggatgaggtgagcaggggtcaaaccaaggggattgcctggcctgtggtgagagttgggattttaactctgtgagccatgggaagcccttggaggtggagggtgttctgtctgtgggtgtggccagaggggcatgggggagagatggggtagcttgggggtggggaggtggagacagggcgaagctgcgaggtgcagcccaggtagagctgatgggctcactcatggaaggaggcggcagagaatgccatttgaatgaagcttcatcatccttctgtgcccactcgcgggaccctgcctctctctcttctcagcatcatggcagaacaggatgtggaaaacgatcttttggattacgatgaagaggaagagccccaggctcctcaagagagcacaccagctccccctaagaaagacatcaagggatcctacgtttccatccacagctctggcttccgggactttctgctgaagccggagctcctgcgggccatcgtggactgtggctttgagcatccttctgagggtacgccttctgggtgttatcctcttgcccaggtcctcaccaagacaagaccagccctgcccgcccagagcggtgccgcctccagtttgccgtgggtgagggaggggcccgtctgtcccgcggatcagttgtgcccagcggggcctgtggctgccctcggcagtggggcgttctgctttgaccaggcggataccccagccctgcaggtgtctgtggccttgtccggactcggcctcttctgattgccctcactgtgggcccccggtcaactggtgaggatcctgcacgggggtgcatccaggttctcgtccctcacgctctgcttctcctgcagtccagcatgagtgcattccccaggccatcctgggcatggacgtcctgtgccaggccaagtccgggatgggcaagacagcggtcttcgtgctggccaccctacagcagattgagcctgtcaacggacaggtgggtgggctcctcccttcctggccccaccctgcctgtggcggcggaagtagagtaggctggatggggtggctcacacctgttagcccagtgctttgggaagctga

SEQ ID NO: 11397 - DNA, 1168 bp, Homo sapiens
cacgatcttggctcactacaacctctgcctcctgggttcaagtgattctccttcctcagcctcccgagtagctggcattacaggcgcgtgccaccacgcccagctaattttttgtatttttagtagagacggggtttcgctatgatggccaggctggtcttgaactcctggcctcaagtgatcgcctgcctcaacctcctaaagtgccgggattacaggcatgagcaaccttgtctggctactgccagcattttctgactgggccctctctcccatttcaggtgaagtcagcactgtgcttaagctggataacacagtggtggggcagacgtcttggaagccatgtggccccaatgcctgggaccagagcttcactctggagctggaaagggtgagctgcgttggaggacagcagggcctagaggaggaggggttccatgcctctggcaccctgagtgatggccctcttcctctccctccaggcacgggaactggagttggctgtgttctggcgggaccagcggggcctgtgtgccctcaaattcctgaagttggaggatttcttggacaatgagaggcatgaggtgcagctggacatggaaccccagggctgcctggtggctgaggtatagcccacacctgaccctgagaaaatgcttcttctccctcactgccccattcccagtttcctagaaggggaaaatatgttttaggtctggctcttccagaaggggaagataagttttaagtcaggcttttctagaagaggaaaatagattttagatccagctcttctagaaacggaagatatgttttaactctgccttttctagaaggagaagatacgttttaggtcaggctcttccagaaggggaagagacgttttaggtctgcttttttctagaagggaaagatatgttttagatcaggctcttctagaaagggaagataggcttttgatctgcctgttctaggctgggcgtggtggctcatgcctgtaatcccagcacttcggaaggctgaggcaggaggatcacctgaggtcagggagaccagcctgggcaacatggtaaaaccgcgtctcaactaaaagtacaaaattagctgggcgtcgtggcacatgcctttagtcccagctacttgggaggctgagacaggagaatcgctt

SEQ ID NO: 11398 - DNA, 1240 bp, Homo sapiens
ttgcctcaagggcctcgttgcgcctcaagggcctcgttgcacctccagggcaacatcgtcacctcctttgacacccccatttccctcctccacttttgttccccccaaggaccctcctaatcccacatctccacttttcccttttttttttttttttagccagggtctcgctctgtcgcccaggctggagtgcagtggctcaatctcggctcactgcaacctccgcctcccaggttcatgcagttctcctgcctcagcctcccgagtacctgggattacaggcgtgcaccactccaccacaccaggctaatttttgtatttttagtagagacggggtttcgccatgttggccaggctggtcctgaactcctggcctcaagtgatcctcccgcctcggcctcccgaagtgctgggattacaggcctgagccaccacgccgggcctccacttttcctaatccggcttctccaccaggctctcgcaggtgatccctcctgagccccagtccccccaccccacttgtcctctgtatgctcactcctctccgtggtccccgagccccaggactggtccccactgcagcacgccccctcctcagcctccaggctgaccctcccctccgcttccctcccctgcagactctgggctgggaagccctgttggcccggcgcctgccaccgccctttgtgcccacgctgtccggccgcaccgacgtcagcaacttcgacgaggagttcaccggggaggcccccacactgagcccgccccgcgacgcgcggcccctcacagccgcggagcaggcagccttcctggacttcgacttcgtggccgggggctgctagccccctcccctgcccctgcccctgcccctgcccgagagctcttagtttttaaaaaggcctttgggatttgccggatccttgcatcctccgtgtcttcttgtgtgcagtcattgggggtgggggcgtgcttggaggtgtggacgtttgcggggcaggtggctgggtggtcgtgggagtctcgactgatgggggtgtcatctgaagaggatcaaggggcggcgtggactcggggctgttcttatggtggggagcgtgggtgagccgagatgggagggggcgtcgggattgtgttggggggcgcccaggggcgtggggcaaaatggtttggggatagggttttggggctgtattggaagagctcaaagccgcagtgagcagaatggtttcggaagtccgtt

SEQ ID NO: 11399 - DNA, 1210 bp, Homo sapiens
caggagttggtctcgaactcctgacatcaggtgatccagcctccttggcctcccaaagtgctgggattataggcatgagccaccgcgcccagccctcccttccttttcataaccggcagcattacctgttagctgaggggactctgggcagacagcctggattctagtccacttctgccacttcccagctcccagggaccttccttgggcacatgggccgcagtttgcccatcagtaaaatggggatgagctgaacaccgataccaccttctcagggttgtcctgaggtctaaatacgaatatatgtaaagtggtgacaatggcagtccgtccaattactatgtatattcacattgttatgatgtcgctgtcacccctccctggcccccagccctctgcctttgaagagaaggccattgagaaggtggatgacctgctggagagttacatgggtatcagggacacggagctgggtgagtgagggctgcctgggggagggggcatctaggtctgctgggggccgaatccaccctgagccccttggtccctggtgtcatttgtgcctccgttctgacccctcccccaatagcggccaccatggtggagctgggaaaggacaaaaggaacccggatgagctggccgaggccctggacgaacggctgggtgactttgccttccctgacgagttcgtctttgacgtctggggcgccattggggacgccaaggtcggccgctactaggactgcccccggaccctgcgatgatgacccgggcgcaacctggtgggggcccccagcagggacactgacgtcaggacccgagcctccagcctgagcctagctcagcagcccaaggacgatggtgaggggaggtggggccaggccccctgccccgctccaatcggtaccatcccctccctggttcccagtctggccggggtccccggcccccctgtgccctgttccccacctacctcagctgggtcaggcacagggaggggagggatcagccaaattgggcggccacccccgcctccaccactttccaccatcagctgccaaactggtccctctgtctccctggggccttgggttctgtttgggggtcatgaccttcctagtttcctgacgcagggaatacaggggagagggttgtccttccccccagcaaatgcaataatgccctcacccctcctgagaggagccccct

SEQ ID NO: 11400 - DNA, 1178 bp, Homo sapiens
ataatgaggctcccatctctaaaaaaaattattttaactatgtgggtgtggtggcacgtgtctgtggtcccagctactcgggagactgagacaggaggatcacttgagcccaggagttggagaccagcctgtgcaacatagtgagaccccatatctccacaaaaaatacaaaaattagccaggcatggtggcgagcacctgtagttccagctacttgggaggctgaggtgggaggattgccggaatctgggaggttgtggctgcagtgactatgatggcaccactgcactccagcctgggtgacagagcaagaccctgtctcaaaaagagaaaggaaaactaaatcctagtcctagcagagctgacacgctaatgtgggccctgctgtggccctggctcaggctcagtgggtgatgagttactgggatggaatccccctagtcctctcccagctctctcccttcgccctccagtggtgattagaaaagggggagggagggggaagaggtttcagcgtctcccacccctgcaggtgatgttctgcaccctgaacacccacaaagtggacatggacaagctcctggggggccagatcgggctggaggacttcatcttcgcccacgtgaaggggcagcgcaaggaggtggaggtgttcaagtcggaggatgcactcgggctcaccatcacggacaacggggctggctacgccttcatcaaggtgcctggggagacggggcaccccggaggcctgggagtgagggtgggccatgggaccccggaaaccagggcagagccccaagggctgatgactccccgcccccgcagcgcatcaaggagggcagcgtgatcgaccacatccacctcatcagcgtgggcgacatgatcgaggccattaacgggcagagcctgctgggctgccggcactacgaggtggcccggctgctcaaggagctgccccgaggccgtaccttcacgctgaagctcacggagcctcgcaaggccttcggtgaggagccgccccctggacctccccagtggcgctgctcgcatgggcgcaggcggtggtgccgggagcggccagcaggtggcgcccaagcctggcctgccgaaagggaaggggttgcagaaagggaaggggttgcagctcctcccgaccccagacggggtgctggcccttg

SEQ ID NO: 11401 - DNA, 2335 bp, Homo sapiens
cgaagacaaaatattgaccatcgaagtgaagaaggggtggaaagaaggaaccaaaatcactttccccaaggaaggagaccagacctccaacaacattccagctgatatcgtctttgttttaaaggacaagccccacaatatctttaagagagatggctctgatgtcatttatcctgccaggatcagcctccgggaggtaaggtgccaggtggggcggtgtctgtagagggcgatggctgctttttgaagcagtttagtatttgctgaaccaatgtgttggggtgtgtggtgcgtgccaggcttggggcacaacagtgaacaggactgaccagggcgctgttgtggagctttcgtggtggggacgtgtagatttgggggccaggtcttagctgcagaggcctgatgggtcttatctatggcagacggcctctgggcaagagctgagcctcttgagccagcttccatctaatgctgtccttttgcttttcaaggctctgtgtggctgcacagtgaacgtccccactctggacggcaggacgatacccgtcgtattcaaagatgttatcaggcctggcatgcggcgaaaagttcctggagaaggcctccccctccccaaaacacccgagaaacgtggggacctcattattgagtttgaagtgatcttccccgaaaggattccccagacatcaagaaccgtacttgagcaggttcttccaatatagctatctgagctccccaaggactgaccagggacctttccagagctcaaggatttctggacctttctaccagttgtggaccatgagagggtgggagggcccagggagggctttcgtactgctgaatgttttccagagcatatattacaatctttcaaagtcgcacactagacttcagtggtttttcgagctatagggcatcaggtggtgggaacagcaggaaaaggcattccagtctgccccactgggtctggcagccctcccgggatgggcccacatccacctccagtccctggccaggggtgagaggcagaccagcagatggacttgatccctctgtgtctttttgcttctggctggtagataatgtcaacctgcagtcttgattcccagaccctgtacactcctccttttctgttgtgtgatcagtttgtgctttattctgtatttgtctcccatgtcttgctcttctcctggagaattctgtcttctctttggccatctcaaattgagaacctaaactattcctgcagaactgcctggttggcgtccacaagcaatacctctcgttccagcaggaccaagggagccagcctccagtgagtgactccagcaagtgcagccacctctcccttgatggtctgggagcctggcctcagcaaggggccttcctgacctctggctccagtgaagctgaatgtcctcactttgtgggtcacactctttacatttctgtaaggcaatcttggcacacgtggggcttaccagtggcccaggtaattttttgtttcatggactatggactctttcaaagggatctgatccttttgaattttgcacagccctagatacaatcccttttgataaaagggtctttgcttctgattacaggagcactgtggaacgtctgtaaatatgtttttataattccatgtatagttggtgtacactcaaaacctgtccccggcagccagtgctctctgtatagggccataatggaattctgaagaaatcttggggagggaaggggagttggaacaaatgtctgttccctggaggccagtccagtgctcagacctttagactcattgtaagttgccactgccaacatgagaccaaagtgtgtgactagtcaatgaagtgcgacagcattaaagactgatgctaaacctcaggggagcggtcctgtgactctgtttgagggttctgctggttttgggggtggagtggggagctgggcatccttccaaattcaatcaaggtgagagggtgggatgggcaggaggcaagtgccctgcaagggaaacgtaagtctcccttcctcagccataagtgggttggagaacttctacccagactcggggtccaaaaaaccagagacccaagcacagtggccttggggatcattttttgatgaaggttggagtcaaagtagcggtggggagaggcagggtctggctcctaattctgcctttcttcagggtccctggctttttcagcagaccttggctctggggccaaggggccaacccagggtctggcctcttaattccttatcactccttccctgctagaacgggctgggcgtcctgaaggctggccaaaccggagctcaa

SEQ ID NO: 11402 - DNA, 1072 bp, Homo sapiens
caaggcagggctggttacggttcccgagtgcaggccaccaagcccccttgtctcccgctgtcgttgggaatgtgcaggaggggtacccagcttctctggcttgaccgtggtgccctcatcttcaggatgggccctagctgccgtggcccggtctccctgggctctgggtgggtgggcctgccctgggatggccccagcccagaggtttgtttctgagcattgtgtcctgctccttttcctcaggcagcctctgggggcccccgctgggtttctgtgggtaggaagggtcccccaagaattgctggctggtggctgacttgggatcaggcctgcctgcttgccacgacccctgtataataggattgcactgacccctgcatagggtgggtcagatccccgggggctgcctccctccagccctgcccctctgcacccccatcgttcatcactggcctgggggctcagggagggctgggccagactcctacctcaggggctggcacaggcctggctcttggacgcaggaagcgccgggctttagtggggcgcaggtcctgggtgagggtgcagtgtttgggctgactcagtggaaagcctgccccacaggtggctataaggtgagaagtgggtggggaggaaggttggggagacctcatcagcccaagctggaggcggttgcctaaaacttccacacaccccgatcctttccacacttcgagagaggctctctgcacccataactccagaatctgtcacctccctggtaacacaaatgcacaaggaaaataatccaaagtgtctcttacagctcagaaggggaaatggatgatctgtctcgcggattctcaaaatagctgggatttctccaagcccagtgaactccctaggcctgagctgcgggctggggcctgcacggcccgctggcctctcactctcctctagccactggctctgtgcagggcgggggctgggaggtgttgtcatgcctgcccctggggctttccctgtgctggtgccgttgagggttttgaggtgaccactcaaaagctgctttcagggcagcctggctccc

SEQ ID NO: 11403 - DNA, 1122 bp, Homo sapiens
gtgtcctgccccaactacacctacgaggtgaggggctgccttacccctctctgccctgggacttggggtcccatgtggagggaccagcccctaggatggggcgcctggctgggcagctgcttttgccgcctgcactgcgagcattgggaggtggagaccgcggcctctctgctgtggtggcggggaggcgtgtgccgctgggcttccgccgtatacagccccgcctccgctggaattgggttcccatccctgactcagaaagcaggggcggcgggaggtggctggctgagtccaggacagccacatacacgggttgcgaggctgcccacgctcactctccgcccctgcccacaggtggggtcctggatcggtttcgccatcatgacgcagtgtctcccaggtgagcctgccgccctccctcggcggggccctgcccctccgggccggcagcccctccctgacgcccgttctttcctgcagtggccctgttctccctggtgggcttcacccagatgaccatctgggccaagggcaagcaccgcagctacctgaaggagttccgggactacccgcccctgcgcatgcccatcatccccttcctgctctgagcgctcacccctgctgaggctcagcccctcaacccggtggcattctgggggaggagtggggcccacagctctccagcacccggaataaagcccgcctgccccagtcggactcgggctctgtgtgtttctttccggggttggggaccaccacactgcccttcactctctccccactctcgcgtcggagcagtaagaggggactctggttgaggggcctgaaggcttttatttgactggtccatagggtggggggtgcaccccctacagggccaccttggggtccacttccccgggtccctggcctttggccaactctgccgccttcttctcccgccgcttcttccgctggagcagcctccgctcccgctcaaactccttcatgcgcatcacatagctgggggaaaagcacgagaggggctgtcagggtccctggccaggacacgccccccaagccctgggaagcggaggggccgtcccagagcactgtgggggaggcctctgaagaagacatgtc

SEQ ID NO: 11404 - DNA, 1273 bp, Homo sapiens
aatgaattattattatttttatttttctttttttttttacattttgtatagaaacaaattcatttaaacaaacttattattattattttttacaaaatatatatatggagatgctccctccccctgtgaaccccccagtgcccccgtggggctgagtctgtgggcccattcggccaagctggattctgtgtacctagtacacaggcatgactgggatcccgtgtaccgagtacacgacccaggtatgtaccaagtaggcacccttgggcgcacccactggggccaggggtcgggggagtgttgggagcctcctccccaccccacctccctcacttcactgcattccagatgggacatgttccatagccttgctggggaagggcccactgccaactccctctgccccagccccacccttggccatctccctttgggaactagggggctgctggtgggaaatgggagccagggcagatgtatgcattcctttgtgtccctgtaaatgtgggactacaagaagaggagctgcctgagtggtactttctcttcctggtaatcctctggcccagcctcatggcagaatagaggtatttttaggctatttttgtaatatggcttctggtcaaaatccctgtgtagctgaattcccaagccctgcattgtacagccccccactcccctcaccacctaataaaggaatagttaacactcagtgttgttggtctgtgtctaggtaaggtggggagtggtggcagtgggacttctatctcccccacccagggctaacttgagctcccatcttggggtaaatacatttgacttgccagtctacttatgcttcctcttttggcagatgactaccgattggattagtggttgtcacctgacttaagctgagccaatcagattcttttgctcgagaactttctttaatggagaggctaagaaagttgtcagttggtggagctcttaaggtcacaatcagatttagaaatatcagtggccaattcgaggtggtgggcaaagagacaagcaaacagggcagaagaatgaagctaatattcagggagaatcagaaatgagagctcaaatggctccttgagggctgggggggttatctcggctcccagtgcagttatcaattccagttaattgagtgttcattccattgagatcaacaggtatttattaattgctttctaagtatctgatcatggttctgcatgaatttcacttttacttcatgctcctatgggttttggagataaccttg

SEQ ID NO: 11405 - DNA, 1194 bp, Homo sapiens
ggaggctgaggcgggagaatcgctggaaccggggaggtggaggctgcagtgagctgagagatcatgctactgcattccggcctgggcgacagagcaagactccgtctcaaaaaaaaaaaaaaaaaattatccagtgaatggcaagatttgcagaaagcctggcatgggtccgtatattccagtcccctgtgcaagccttgtctggagtctctgtactctacggtgtgaatgcatggaaggggattgtctcctctgacccctgactccgcccctctctgcctcacccttccccaccagcccggtgtacgagaagtactgcgccgaccactttgccgacggccgctgcgaccagggctgcaacacggaggagtgcggctgggatgggctggattgtgccagcgaggtgccggccctgctggcccgcggcgtgctggtgctcacagtgctgctgccgccagaggagctactgcgttccagcgccgactttctgcagcggctcagcgccatcctgcgcacctcgctgcgcttccgcctggacgcgcacggccaggccatggtcttcccttaccaccggcctagtcctggctccgaaccccgggcccgtcgggagctggcccccgaggtgatcgggtgagtgaccccacctggaaaagccgtggtggctggggagaggagagatgctgttgatccaggtcttgtgtgtttcatttcacttaatgcctttacccaccagatgtcaggagcaccgcctcctggctgtgacaagcaaaaaatgcctccagatggagctagtgcttctggggtagaattgcccaggtctagtgctggcttgtggggaggcaggttgctaagtggcttggcagagtggttaaatacatgtgtagggtttttttcttcttcttcttcttcttctccttctccttctccttctccttctccttctccttcttcttttctttttttttttttttttgagacggagtctctgtcgcccaggctggagtgcagtggcgtgatctcagctcactgcaacctctgcctcctgggttcaagcaattctctgcctcagcctccagagtagctgggattacaggcatccaccaccacaccgggctaattttcttcttcttaaagacatagaagataaagccgggcacaatatattcttgtagtcccagctacttggaggatcac

SEQ ID NO: 11406 - DNA, 1203 bp, Homo sapiens
cctgggatggcagggcttatctgccaggtggggtctccagtgtggaaaggggagcggttgggtgggacatggggaggttgagggggtctcaaccttccttagtcttgacctcttctcttccccctctctccccttgactcttcttttccccactcctccatttcttctcctccttccctccactccccaccctcatttttatccctccctccccaaacccgacccccagccgttctggggtccgcgttgcgagcgggtggcgcgctcctgccgggagctgcagtgcccggtgggcgtcccatgccagcagacgccccgcgggccgcgctgcgcctgccccccagggttgtcgggaccctcctgccgcagcttcccggggtcgccgccgggggccagcaacgccagctgcgcggccgccccctgtctccacgggggctcctgccgccccgcgccgctcgcgcccttcttccgctgcgcttgcgcgcagggctggaccgggccgcgctgcgaggcgcccgccgcggcacccgaggtctcggaggagccgcggtgcccgcgcgccgcctgccaggccaagcgcggggaccagcgctgcgaccgcgagtgcaacagcccaggctgcggctgggacggcggcgactgctcgctgagcgtgggcgacccctggcggcaatgcgaggcgctgcagtgctggcgcctcttcaacaacagccgctgcgaccccgcctgcagctcgcccgcctgcctctacgacaacttcgactgccacgccggtggccgcgagcgcacttgcaagtgagcccatccacccgatcgatccgtctgtctatgcatccatcccagtctgtttgtccgtgggccctgcctctctttccacctgcccatccacttgccccgtctgtttctctgtgcactctatctgcccatcggtgtgtcccacgtgtctgtccgtgtgtctgttcatccatgtgctctgtctatcttgttcttgtttctatctgcctatgcacttctctgccccgtttgtctgcccttttctccatccaataattacttttttttttttttcccgagatggagtcttgctctgtggcccaggctagagtgcagtggcgcgatctcggctcactgcaacctctgcctcccgggtttaagcagtactcctgcctcagcctctggagtagctgggattacaggtgtgag

SEQ ID NO: 11407 - DNA, 2333 bp, Homo sapiens
tggaccagcagagggagttggcccggaagcgggagcaggagcgaagacgccgggaagccgtgagtctggaggcctggtggggaccctggtctaaggattagctcctgagggagctgggaaagggggactggagcctggacagggaggggcagcgggggagccccgtccctgctggtcggcatgtggtcctctggactcagctgtagggccctgagtgctgtgtggacggggtgagcgctatgaggggtcagccacggggagggctacggggctgactgctggtagcgggtatgagggcttgtagctgcagggtggctaggtcatcctcctgactccctccttcctttctcctccagatggcagctaccattgacatgaatttccagagtgatctattgtcaatatttgaagaaaatcttttctgagcgcacctaggtggcttctgactttgattttctggcaaaacattgactttccatagtgttaggggcggtggtggaggtgggatcagcggccaggggatgcctcagggcctggccctcctgcatgctatgcccggggcaggcctgacgggcagctgaggattgcagagcctgtctgccttacggccagtcggacagacgtcccgccacccaccacccctcacaggacgtccgctcagcacacgccttgttacgagcaagtgccggctggacccaagccctgcatccccacatgcggggcagaggcccttctctccgccaaatgtctacacagtatacacaggacatcgttgctgccgccgtgactggttttctgtccccaagaacgtgacgttcgtgatgtcctgcccgccgggagtctttccccacaccccagccatcgccgcccgctcccaggaggccagggcaggcctgcgtgggctggaggcgggcgaggccggcccaccccctcgctggcactgactttgccttgaacagaccccccgaccctcccccacaagcctttaattgagagccgctctctgtaagtgtttgcttgtgcaaaagggaatagtgccgtggaggtgtgtgtgtccatggcatccggagcgaggcgactgtcctgcgtgggtagccctcggccggggagtgaggccaccaaccaaagtcagttccttcccacctgtgtttctgtttcgtttttttttttcttttttttctatatatattttttgttgaattctattttatttttaattctctcttctcctccagacacaatggcactgcttatctccgaaatggtgtgatcgtctcctcattgagcagcggctgccaccgcgctgtgggtagtgtgtgaccgtggctgtactgtatagtgaacatagttggcatatctttgtttgaagtttgttggtgactccaccaaactggtgtgaaaaaagaaaaaagctcaaaaaaatccacaaaaagacaaaacacacaaaaaaaatcctgcctatattttactcagtttcaaactttattagtctatttttaattataaaaccagaaagctacaatttcttttctttcccctccaccccccccccccccacccatttgttggcttttttgttttttaatgtcagatctgttgagttggtttttttggttttggtttttgtttttgtttttgttttttactgagaaaggaagggccaagggatgaggtgggaaccgggccctgggggcgccacagactaaggcagagactcccctacctggcgcccagccccaaccagctggccgctcctgcccatgcttttttttttttttttttttaatttttataattggagcccctggtgaggttacgcgtgccatgagaacccactctacaccacgacgctggtgcctcagtgttggccaaactctggagtcactgactggtttgactttcatacggtgaatatgcatttggtctgtactgatcatggaataaacacatctctctttttttaatgctggcgtctccctgacatttctttgtgaaccaactgttgcctaggctaggcccaggggaccccctggaccccagaccacctctgtacaggaactactgccagggattacctagcccctctcctgtgacctgtccctgtctgccctgggcgggagccacgcagactcatagcaaccaccccaagctgaagctgtgacgcagagcccggtacccatccttgtggaccctggctgaggtggagggtgtgctctagcagaaccctggccagactccagacagtattcttcccctccaccctactccatcctgtcccccctactccatcctgtccccccactcaccaaaggacttgggccacttctcccacc

SEQ ID NO: 11408 - DNA, 1101 bp, Homo sapiens
ggggagctgctggcattgtctttctgggaagattctgctttcttggaccaaatggcagcctgattaccagtgtcgggcctgcatgctgcccccgacacacgcacgcacgcgcacacacgtgtgcacatgggccatagccacaagccagctctcctccagggtcctttcaacctcgctgtccagggaccctgtccttcttgcccgtggggcttccatctggcagagaacgttcagggcttgttgaacttgaaagctcattagacttaagctgtcacctgtgcttggtgccccaggaacagccagagaggacagtgcccactcacttcttgttggcagcctcctgtgcaggaagtgccagccgggcctcgacgcaccagctggctgtgggtcctgaggaggggcgggaggcggccgctcagtgcagatggggactcctctcctctgccctgaccttaccctccattacctccttcactggagtggggctggggggtgggtggaatcagtgttttaatcggatttttaaaaaacattttatttctttgtacaattaccatcctatgtaaagatgaaatttgtgttgagttgaagattgtcatggaataaagatcacaccgtacttgaggccatcttcatgtaaccctttctagagagttttgtgtgggggtgtcttggggctggtgtgttgtgaagctgtgcacttcctgtcttgtcttttactggtaactctgacacaaggctcagaccacatgggccagaagggggtacctctaccaccagcccctttaggcatctggtcctgggggtctgccgtgcacatgccgccttctctcccccactttttaggcctgccttgcctgggggccccagcacttgcaaggggccctggagacaagtcctcaggatattccctgtggcctttccaaggcagctgagacatgccccctggaaccccccacaggccctgctgcgctttgtccctacatcttctcctatgggcctctgctcacagcctgcaggctgtgaggggttagagtgaccatccctcttttacaaccaaaaaaacaaggtttcttccaaggccacgagacaacaggcgag

SEQ ID NO: 11409 - DNA, 1243 bp, Homo sapiens
gctgtaacatgtctcttgacagtagtgcacttggaataataaaggttgggtgattatatcttgatgatacattacttgttcaatacagccactgatggaatgcttccttttttatttttttccttaatttttttttttatttggttgggaacagctgaatactaggaatatatcttgctctatagaggatttttttttgtatgtttcaagcttcagcctttaacctatacctttgtagtgcaccatatggtgtgtgactttcacaggacttcgcagcacctggttcacatgtggcactgaccgcgtcacatccacgcactcccaaaggccagaagtatctgaccgacctacgccactggaaacacacccaccgcaacctcaagaaccagactgtgcagagggcattgcgtcccaatctttagtccttgctgaatcagttctctaatattttacctcatttgtgttccacctctagattacttcaggtttttttcctttaaaattagttactaccactcaaatgtatttacaaagagaatttggccaggcacggtgatgcatacctataatcccagcacttcgggaggccgtggtgagaggatagcttaagcccaggagttcaagaccaacctggacaacatagcaagaccccatctcttaaaaaaaaaggaaagaaaacttgatgtgattgccataggtggaataatccaacataaattgccatagatagaaggtatctgtaatatatatatatatatataaaatgaaatatatgtttcattttagagaaataactattactttagatctttccaaatctgagaaagggaggctagcatgtgttcaaggttagcacgcaacagaatttcctaaaatcagaagaattggaagatcctccccttttgaaatggccctgctgtgtcagtttccctgtggccttttgaactgtacatctcacatgttgggaaacgctggccactgggaaatcattagaaaggaggctgtagaatatttgccgagcctctactgtataccaggggctaactcaccaagcacattctaggaattgggccctgctcatgaggagccttagtggagattccaggtgaatatttatgaaaaagtcaacattagaactgaaaatggaaataaactgcttgaaaagacgatggtgcctctgggtcatttctgctcagcatccgtttgtgttgtgtagatgcgtcttaatcgcagggtgagcatg

SEQ ID NO: 11410 - DNA, 1217 bp, Homo sapiens
tacaggttgcacccacctttggctcttagtttcttaattgttcactgcttatagcttttttgtaagcaaatcagatttctgtaatacagccgtaaagttagagatatatagatctgtatttttatttacctacagtaagtgtggtgtggaaggagagggaatttgaacaaagatcagataggttgtggttccatgcttgtggagtggccctccgttggtggggctggaagtgcgtgggtgcaggggcggggtggggtccctctaagctggcagggtcggggcagcaacttgtagggcactcagagcagcctctccagctccttctgccctgcccgcagctcatgatggagcagtccaagaagtcctccctcatggtggcccgcagtattctcaacaacaagctcatcagcaagaagctggagcgctacctgaaggtgaggcactggtccgggcctgccctgtccccagcttagtccccgcctgtgctccctcccttcagtgtccgcgcccctccccacagggcgagaaccctttcaccgacagccccgaggaggagaaggagcaggaggaggctgagggcggtgccctggacgagggggcgcagggcgaagcggcagggatctcggagggcgcagagggcgtgccggcgcagcctcccgtgcccccagagccagcccccggggccgtgtcgccgccaccgccgccgcccccagaggaggaggaggagggcgccgtgcccttgctgggaggggcgctgcaacgccagatccgcggcatcccgggcctcgacgtggaggacgacgaggagggcggcgggggcgccccgtgacccgagctcggggcgggcggagcccgcgtggccgaagctggaaaccaaacctaataaagttttcccatcccacctccgggtttctctgttactgtgccgcgcgggcggggcggggtgggcagaggggcggggtgcgcatgcgcgcgggccgggccgtcgggcaccgcggtgggaccacaactcccattaggccacggagctggatcgtagcagcccgaaaggccagctgggacggcgagggcgggccctcgtgaagaccagccaatgggggcgcgcggaagtagtgacgtgtgcgcctggtcttccagtagtcgatggcggaggtgcgctgaacgcatgcgtgctgtggtcgcctagtaaacggggctgctggtgggccgcgtcgaag

SEQ ID NO: 11411 - DNA, 1217 bp, Homo sapiens; identical to SEQ ID NO: 11410

SEQ ID NO: 11412 - DNA, 1369 bp, Homo sapiens
cggcgccccttgggggccgggcacactacagccagggcgccgggagccagctagctgcccttcccccagcccgaggactctggggccacagggtgtcttccttcagcccatgcccacctggtccagcaggggcagcagccaggtctctgatggcagccggtctggtcacaggggaggacagcactcccccgtctagcagccaggcagggcgatgtctgccatccgtggccatttgcaaagaccccaaagacccctgttctggttccctctctcccccatgaatatcctctcacacacatgtacatgcgaacacacacaacacgcacctcgtgagacccgggacctgccccggacccccagttcctgggttgaacgaccacatcatgccacggtgcttgctcaggggaagccacgctccctctgtggggcctgctggggcctgggagccccccactgagcccacaatgccacggaaatccttgttggctgcccccgagaggggccttcccagctgggaagagctcagagctgacagctgcctcctgccatgtcaaggccccccaaagagcctcaggggctctggggccctggagggtggggttggggggtgggactctcctcccccactcctgctccctctcccttttcactgttgctttctatgtatagctccctagacctttcacttttttaaaaacgcgttttgtgtagagaataaggaacgtggatctttttattttgcaatcctgggccagctagaagccaggagctgattgaccttttaacttttttcagtggccacattttggttatcgatgtacctagaagtatgtaaattagattaaatttctcttctggaaacaccctggggcaggcggccagcgtgtgtttttctgtcaagtggacaggctggcattggctggcagccggggctgggatcggggcctcctctgtccagagcgccatggaggccctgggttttccagttggccgccaagccgaccagacgcagctggggatgagcccaagttcccagctgttggctctttaggccatggctgggagggggtctctggctggctggcaaagcggctccagtgagcagatgaaccagggttctgggcagcctgtctgggaagggagccaggatcaagaagcagttgaggctagaggagcttatcaaaggcaggagctaccagcgagggtgtcagggacccgttgggagcatttgggtgggggccagtggggttgtagagagctggaactcacctgcttttaatacatgtgacttctagtgagacacatgcacccctgacccaaggaacatgcggggaaaagaggagccactggctcctttgcgatgttattt

SEQ ID NO: 11413 - DNA, 1175 bp, Homo sapiens
gtctgggagagggaggggcactgcccaaggctggggtggctccagggagctggtcctggtggggctgatgggttcctggtaactgaaaccaagccactgacaacctgcagtgattcaggctgggcctttcaggactctaatcagccttcctctctctctttctctcttccctctctcttctttactctcttctctctccgcctcttctcctggctgtacctgggtttccctctctgctttcagcccttgttttctcatctctgagctctccctgcctccagcacctcccatccctgcccctgtccaatgtccccgaagctccccgggctctttttctgggcctcaggacctcaccctccatcccgtgtgccctgcaggatgtcgctgctgagcctgtcctggctgggcctcgggccggtggcagcatccccatggctgctcctgctgctggtcggggcctcctggctcctggcccgtgtcctggcctggacgtacgccttctatgacaactgccaccgcctccagtgtttccagcagcctccaaaacggaactgcttttgaggtcacctgagcctggtgagtatggcagcacgacgggtctggggtctcagggtgggtggacttctagaggggtgggaatggggctcagggagctggatattgagggtgggttggggtctgggacatcagaggagtgagggaggccgaggggagcccctatttcctcactgccccaaccggattcattcctcctctctgtccactccatggccccaggcctttttctttctctctcttccccaccctaagcctgctttggctcaagttcctacttgtcttccccacattaatgcatcgttgtatccttgttctactgggggcttctagggtggactgcacagagcaggtactccctggctgcccatgttttttttttttttttgagacagggtctcgctctatcacccaggctggagtgcagtggtgcaatcatagctcaccgcagccttgacctcctgggctcaaccaatcctcccatctcagcctccccagtagctgggactacaggcgtgcaccaccagacctgctagtttttttttttgtagagacagggtctcactatgttgcccagagtggtctcaaactcctggcctcaagcaatcctcccatctctg

SEQ ID NO: 11414 - DNA, 1153 bp, Homo sapiens
ctatctgcttgtatatctaccgactgaccaacctacctacccatttatccatccatccatccagcgatccatccatccatcctatctgtgtgtccatctgtccatttaatctatctatctatctatctatctatctatctatctatctatctatctaatctatctatctatcatctccctccctccctccccacctacctaccaatccatccatgcatccacccatcctatctacgggtccatccaaccatctatcttattatctatctgtctgtctatctatctatctatctatctatctatccatccatccatccatcatctacatatctatctagagaaagacacagagagaggaagagagtgagggaacagagaagcacatagacacagacacagaaagagacaggcagagaccaatatttcaggtgaaagggctgagaagtttgggggtgtgtggtgggtaggggggtgcaatgggcagtggtagcatctgaggccccctgccagcctggtgtcagccttgtctatccccagatgcggggcaatgaggaggacatgaggctgatggaggatctgggccactacttccgtgatgtccaactctggtggcttgggtctttctaccctgtcctgcatctcgtccaccctacgttcactgcccctgtgctccaggcttcaggtatctttctcaggaggctatgctgcagcatcttccctgcctctgctccctgccttcccaacctttggacaggccatgctgagcagaaaaatggacatatccaatagagaccatggctctgccactaacctgctgggtgactctgggcaggtccctggtgctctctggctcctgaggcctcttttagttctgaatgaagaaaactcaaccctgtgtggtctaagcaaagaaacagaatgcattgactgtaaagtaaaagtcaggaagtaaaagtgaagtccaggaagggtggtcttcaggcatggctggatccaggccatcataatgccagtcttcatctcttagctttgtatccctctgtgatggtttcactctcatgctgctaaagataaatcccagaaactcaacccccatggaaaattccctgtagttccaggaaaatttccaggattcccctaaatttgcctggcc

SEQ ID NO: 11415 - DNA, 1160 bp, Homo sapiens
ccaggacagatcacttgaggtcaggagttcgagaccagcccagccaacatggcgaaaccatgtctctactaaaaatacaaaaattatggtgacgcctgcctgtagtcccagctactcgggaggctgaggcaggaggatcgcttgaacccaggaagtggagactgcagtgagccgatatcgcaccacagcgctccagcctggtcgacagagtgagactccatctcaagaaaaaataaaaataaagttgttctctgaagagcaaatgtctcattccagtaatgacccactcagcaggaatatggtggagttcagtccaattcaggtcagccatatccaaaagaccacaagtcattactaagttgagcaaaagagtttttatctattagcagaaagggcctctctggcagcagagattaaaaactggcccaacttcatttccatacttcagggaacagcaaattgaggatttacttatctaggacttgaattccttctttgggaccaagttaataaaagaccaagaaactcctgattaaactggataatgaaggattctgtagacagggctgcacgtatcggctttgtttgacttctcttttctcagttaacatctcagagctagaacattccacattccccagcagcgtgtgggggctgactaaagtttacaattccaactaaaaatcaccctgcttctggcttatctgaatcccttacccaccccaccccaccaccctactcctatttattcagcaccacactacccaggaaatacactagcaaattgtgcaatggaataaaatccacactttagattcttgcaactgtatcatatgtaatagtatcactttttctacattttggtcaaataaatttttacataaactacaatttgcgtgaattttagaatgtgtgggggtacacagagcattttggttcaacaaatgttaaagggatggaaagggaaaataaccagagccaagaatgtagacaaggttatctatttgctttatactgtgacttcatgatacaaggatattacagtctcattgcaggcgagagcactcagcctcggtcactcgaaaactcctggccttccttatcccctacgctgcctaagccaggctgtgaagaatgagtaggattttaagagataaaag

SEQ ID NO: 11416 - DNA, 1831 bp, Homo sapiens
tggttggatggctcgttggttagttggttggtttggctggtttgattggtttggttgtttggttggttggttggttggttggttggatggttggatggatggttaggtggatggttaggtggatggctggttgattgtgagacgtagtgctgattctcagtgataacctcagaaaacctcttgtgatttcaggaaggcaacagcccccaggggagcaaccagggagtcaaaatcacaccggaccagcagaagaggagcagctttttccgatgtgttcttctgtgaggaacaccgccttactctgagcctcgctcagcccagctgactgtgcctgttctgagtgagcccctcactcagccggggccctcccacctccaacgccccgcccacgccgcggccaccgggcccacggccaccagaatgcaattgagaaatcgtttattttagtaactgtctgatctttttcaactttggagatggaataagttaaaaatttgctatttttcctgtaacatctgctgaacgggcccacccacacgttgtatattcagagagagagagggagtcaaggtgtgaccgtcgaccacagccagtgtcaggcctctgcctctgggcctttgctttgtggcctcactgcaacacaaagctccaccaggaggctggttcacgtcccctaccacggaagcgaggtcccagaaggccagcggtggttccaggagcaacagctcccaaaccctgagcaaggcaaccgatcgccaggaccaggaagcatcacccaggagatttggcgcccacttccacctcttctctcagttttggacaagtgacaaaccattttgccccctcactcttcttttttaactgttaaaccaaaggaaagcacaaatgaaggaaatcctgtgtaaagcattgagaaggaaagaagcctggagcagcctctcctgtccacagccaggggttaggtctgcaggcccgtctgcggtccccatcgagcatcaaggggacgctgtgtgtgctgcaagtgaccccgaaaacaaccacagccgtcacatggtcctcctgaagttggggcaccctcctctcagcaccaaaatggcccccactccttcgtgtcctcccgctatctccaaatcggacgttctttctagctgagatttttatttttccacatctgtagtgccatgaagcgattctgtctttgacttccaatggcaaacctgggtgatcgggaacaagcacgttgtacccttggctggacatggccaagacacaaggcattccacggcggcaagctgaccgcacagcagtctggcttgattttcagccgtcatcattgggttctgttttgacagctctgctgtcccatagggactgcgactgggaccaggtcaaccacgccaggggggtgtcaccagccttttctttttttctttctttttttttttttcctccttaagctgctgtcaatccaaaccattggcatcatcgtttcttttgaattaaaaccaacatatcagcaatagtctgctctccccgggaatctctaacatgctctgtttacatcgataaatgcacttaaggaaaacaaacaaattaaagctcatcttaaagtccaaggatttttatgtccacattttccctgtaggccacacggacatggccaggtgctgggggtgggtctggacaagatggtagagcccatggattaccccatcgagcggccacctcagaggagatgccacccatcatcaaaagactaaattgggaaaagaagcctcctggcttggtgcagtggctcacacctgtaatcccagcactctgggaggccaag

SEQ ID NO: 11417 - DNA, 1617 bp, Homo sapiens
gcatgtaacgctctgaggccagccagctgtcttctcctggatgagacagactccagagggtaaggagctagcgccatggtggcctgcagtatgcagagccccgcaggacccagcgtgggcgcccttccaagcttcctctagctttgggcctatgctgtcccctgcaggccctagggaagccacttgcaactatgcggccttcagacttcctcctcagccacctggccactgagacagcatagcctgggtaacggaacagccacctaaggcaagaatggaacggacacaccttgctcctttctgagcccgtttcccaaaaccccccttccaggtgcttctaatgggtgttgccatagcagacgctgctaatgcatcacagcattctttgaaatggaaccagacacagcctgcctctcaatcctcagctgggggctcctagcagcctcttgtatttactcagagttgacacatcacacagatcctgtttggcattcctaccttacggacgtctcaggggtgacaggaccagggcagagccccggtacaaacagacaaggctgcagtcaaatgggagggtccaggtgtccgtgttggagggctgggatcttgtagggcctgtgcgtcctggctgaggatcaaaccacatatgttattgggagaaacgatttctgttgacgtagatattgaaagaataatgaaggcagaagagaaaaacgaagtgtggaatttggggttgtcctgtgtaaattacacaataaagcaaaagtcagttattgtaagtctgagtgtcttctttttttttttcccagacagagtttcactctcttgcccaggctggagtgcagtggcataatcttggctcactgcaacctccacttcccaggttcaagtgattctcctgcctcagcctcccaagtagctgggactacaggcaaccgcgactacgcctggctaatttttgtatttttagttagaaacgggatttttccatattggccaggctgatctcgaactcctgacctcaagtgatctgccgcctcagcctcccaaagtgctgagtgtcctcttataggctgtttgtcaccaaaatgtcttttggatttgtggcacagaaaaatattcatactggaaaacggcaactcaggtggaaaaatttcgatggcacatctgttcccgcctatggttcacacctaagagagatgacacacactctcattagcagtggcttttgccagtgattctcccatggcctggtggaaagacagtttcagaccttttccttccacaagctagcagcaggagtctgcattatgtactactgtggaaaccctttattagtatagtggaaaggtagttatttcagctctttccctgcataacaaacgtctccaaaaggcagtggcttaaaacaacaaaaatgtatttttattttattttattttattttattttatttttttgagatggagtcttgctctgttgcccaggctgcagtgcaatgacgcgatctcggctccctgcaacctccacctcccgggttcaagcaattctcctgcctcagcctcccaagtagctgggattataggtgcgtgccaccacgcccagctaatttttgta

SEQ ID NO: 11418 - DNA, 1624 bp, Homo sapiens
ggaagttggggagggcgctcaggcttgggactcctctggggacaaggctcaggaccttggggagggagtgttcgctgggaaaccttgagagattccgtgtcttagaatgctggagagagggtgcatgcttaggacccgtcggggagcgtggctgacaacagtggggagtggaccttgcgctcctccgaccccctgggggtgaggatccggattgtggggggagttggggatgtagggcaaggatccctcaggggcgcaacactaccgcggggagcgcgtcaaggccctggttagggataggttgcgctcgccggggtagccatacgtgccctgtcctgggaggggaactgacgcttactctcgccccctccctgcaggtgagaagccctaccactgcaactgggacggctgcggctggaagtttgcgcgctcagacgagctcacgcgccactaccgaaagcacacgggccaccggccattccagtgccatctgtgcgatcgtgccttctcgcgctccgatcacctggcgctgcacatgaaacggcacatgtagccgggacgcccccgcccacctgcgcgcggccgtggcgggtcccacgcgccgggcgcggccccctcccaaactgtgactggtatttattggacccagagaaccgggccgggcacagcgtggctacagagggtctccctcgatgacgacgacgacgacgccaccaccccagcccccgtctgtgactgaaggcccggtgggaaaagaccacgatcctccttgacgagttttgtttttcaaaatggtgcaataatttaagtggcatcttctctcccaccgggtctacactagaggatcgaggcttgtgatgccttgtgagaaataagggccttaatttgtactgtctgcggcattttttataatattgtatatagtgactgacaaatattgtattactgtacatagagagacaggtgggcatttttgggctacctggttcgtttttataagattttgctgggttggttttttttttaattaaaaagttttgcatcttttaaaaaaaatcacagcactggtctggttgcttggaactggggccttggggcacttgggaggaggggggagcggagagtttgatggagggcagccccactaaagcatcgtgtgcagtgggtcctgcgtctgccagcaccgggactgccagctgctgtgcctgcctgccaggaacctgtgggtttttctgtaaatttagacactgcattttaggactgagggagggttattttaaggttgttctttgagccataaattgcctctttgccccacagctggggaaagtgctggtcccactgacgtggcctcctctacgttgaaaaaaataaaactacttacctcttcctggaagcctctgaggttttagccaaatttctggagtgccagctctatatttttatttttatttttaaagggggttaacctgctgagtttctggcatgttctgccctttactcgtctcgacatttagcaagtcttttcttaaggggtgagttccccattctgctagcggaaaacagtgaaacctgcattcgagggccatgcatgaagctcttttccagatgaggaaacggaggc

SEQ ID NO: 11419 - DNA, 1284 bp, Homo sapiens
tcccagatgctggggctttgcgcgagatgcgtgggtcccagcgtggctgagtgaggaggaaggtgaaatgcgaccccctgtgagcctggcggtcgagccttgagctggtggagatagacagactgacaaaaagtctgaaggacccataggctgtccagtgggcagtcttaaacatgcacacagcgttgacacctgcactcatggaaatcacaatgaaggaacaagcttttctgtcatctctccgcctggcacatggaacatgtctgatgtcccatgctcccatccagggtttgtccatcccagggcacccagaggtttctagaaccctgctaggcctctgtgccaggaaatggctgatgtgtgaggccaggacaggagaactgaggccgcttccttctgtcctctgggcagccaattctgctagaatccaggggactgcttgatcaggctggtttctggacattggaggaaagggaggccccgggtgggtcacttaacctccctgagcctcagttttcctgcctgaccatgggacccactcaggcctagcaggtgggtgtgtgggtgaagcgccttgcacggtgacgtgctgtatgtggtctgtagcccccatccccaccctgcggcacagggaccgggacgcaggcttctgccatatgggcaccttttccaggaaagacaggctgggcagctgaggtggctgcacacattctgggagtcattaattgggcccttttctccctgtgaggtcacagtttagtggaaatcttttccgttaaaaaaagcgtgcagggagttgaacttcaaagagggctccagcgtcctctgtgggtcatcgctcatacaggaccaaatgtgagtttgggtctgagtcacgtgtggctttggtgccatctcttgtgttctagaggctgcagttttcaaattccgtgggagctgcttgtcttattttgtttaaaggtcaattgaggtgaaattgacatttggtgtggctggcatgcagtgtgggtgcacgggcagacaggtgttgacctggacagtcacaggtggacccctccacctgggaacctgcagaggttcctcgagggagagttccggtcacagcgtacagctgagtagcccacagttggccatctgccctcaaggccacatactcagttctgtctccatctaagccagaaagtgcactctggggaccaccaagggccatctcctggggcatgcatggagctttggtgtgggcactaagttcttcttgcctggaggtcttttcaagaaaggtgt

SEQ ID NO: 11420 - DNA, 1633 bp, Homo sapiens
tcagagggcttctcaaacttaaccaaaattggatcagtttctgctcattgtggaaaccccacattctactaatcagggggcaggggacatctgaggggcatgtgtctatgtgtatgtgtgtttccacaaggaacaccttgaaaagcaaatgtgttgctaaagatgaggaagtaatggcaagcagcgccccagggtgttgctctttcaagtaagaattggcctctcctgaaattttggttatgtttaaaaacctctgcactttactctgacctcatgaccctggagttgtgatcaggcctggggcaggggactgtcggccccttacatttttgagagctcttgagcccctgataccaagacaggtgtgaccttttccttaggtggtcacatcccccctgttcacaccagagtctgcccctgcagcctcgaacctggggacatgtagtttcccatttcgtcttggtgctgttccgggagcggatgggccgggccgcgcatgtctggatgtttccttggtgctctgctgcctccagcagctctctccgtgctgccaccctctctcccagggctcctccctggagcccttctgctcctgggcctctgtacgtcatggattcctcttcctccctggaataagagtgagcgctcgtgctctctaaacaccacacttgcctctttatgttcaatgcttgatgtgtttcttttctcagcagccaagtcctcagtcccaaggatttatggggaagcacacgcgtcccctgggctgctgggaaggcactgctggcgagctcatctgtctcttgtgtctggcccccgctgggtgcaccgcctccctctttcctcccatactctcttttctcgtggactcgtaatgaggtggtttccatagccgcccccgggcccgtcatcatcagctttatcgtctaaatttaaacgatgagcattcatccttcatgagttacgagaagccagaactcctcgctttgctccctggctgttcttggcgtgtgtgtttccgtctcacaacccggctcctactttccccatctggcattgtcccctggcaccgcttttggcttgtcctgctcagtcttcgttcagggaacagcttcctcttaaatgtcccttttgcaggtttttagaaaccggttttcttggataaaagttggcagtgaagtggcagtttgcaagtggccagtgattcccccaactccaaagacagatttttacctttctggttatttttgttcatcttttgggcagggcaaaggttacctgagacacaattactttgggaatgtagattaagatacgttacatggaaacttgcaactggcatccgaaagaaaaactgtttttatcctgttgtacaaatacagtttttaaagcatttttctggcttgtttctatttcttaataaatacttggaagagagatttttgtttactcctgaacacttcaagactgcttcagagccgagagagaggtgtcttagttctcccttgtgggtcgaagttgggggttttaggtccctgagaatagtgtatccacagtggtacatctggaacttcctatgtttggacagttctactcaggttactaaattccatgtgaagctcacgcagtgtgactt

SEQ ID NO: 11421 - DNA, 1479 bp, Homo sapiens
cccatcaagggcggggacgtccgggataagtgggaccagtataaaggcgtgggcgtggctctggatgacccctatgagaactaccgcaggaacaagagctactccttcatcgcccgcatgaaggccagggacgagtgtaagtaggcgcccatgccgggagccgcgccggtggccagcggtgccggctgtgggaccttcctggctgactggcagaggaagattgcagtgacagctcagttcttacaccgtctccacttgtggagagccacaggaagagaaggaagaccagcgcatgcccagtgggaacgccgtgctccatggcgtggagggcacgggtgccacccacaaaccacaccaggaggcgctgcagccaccagggccccaggctcgttttcctttatagcgaagcaaaaaacacaagaccctccgcccgagtaaattcttcagccacgaagggatggatgtgcatctgccctaagtcagattgaagcctcctcctaggctccaggaggagcatgtgcaggaagggttggcctgagccagagccggcaccccagctccttcctccagctccccgcacccaccggccctgacctggcttcccctcggctgtgtagggacaaagccgaagcccagtgccatgactgcccgcggattgaaaaacagaaacacaaaactttgacttgacttgcgaagtgaagcagggttttcatttttactctccttggtttaggtctagaaagaagaatactgacctgagaggaggcccagtgagattctgaaacctaattcttcgaaggcgtactggcccttagttcagttattttagttgtataagttgatattttttttctggaatgtagccatttgctgttatctgggaaacaagattctaacaggaaaccagcctaagacacttcaggttgagcgctgcctcggagtctgtgcccgtcgcgtcccctgcttgagttttgcacttggaagaaccctgcaccggctggcgtgtgcgacggcccagtcccatccagagcatggagcccgaccccagccagcgccttccactccatcatttcatttcacacccccgaagggaggggaggccaggaggggagctgctcctgccagaagctggtgggtgaccgttgggaatcggccacacctggtgtccatgggcagcctggtgcaattccattcatttgtacagaaacatttttgaaaaattcttttcaataagatgcaaaatcttccaacttttcaacccaacgtgatgaatatttgattttgttctagatttcctgtagctgtgaattgttaaaatgtatgattcaggataaaacgtaaacacgtgctgttagtaatttcttgtggatttcattgttttgccttcaaataaagcctttttttaaagacctttctcccgcacatgtgtaagtcagaagtgtgcacgggctgagtgaggagacacatgtcctggtttga

SEQ ID NO: 11422 - DNA, 2317 bp, Homo sapiens
acttcacggagccatgggcagcagggagagctgcgggcgggggcccaggcaagccaggcagggcagggcctcaacaggaggacagagacggagcagaagaaggatacaggccagggggctccagggccggggctgaggctgttctgagcgggggcccagggtaggcattgcaagcaaagggtgacgtgaggggcccgctgcatgtctgaataaaccagagggtgttcaggtcacctgagtttggagaccatgtcccctgtgggtgattttctgaagagagaaccctgtgactgtcatcagcctcagagcagctatgacccaccatggttggtgtggctgaggtcctacaagagagtgggatccccaagagggaagcatgaggagctctggtgcccagggtacccttgacactgaacctgggccctgccctgaccccactccttgcagaccctgggtgggcctgagagggctctgcccaggcatggtgacagctggggttctctgctgcagctggaagatcacgagtacaagcctttggaccctaaagacatccgcctcccaccccccatgccgcccagcgagaggctgctggctgcagtggaggccttctacagccccccgtcccacgacaggcccaggaacaggtaaggggcccaggtcagtggggtgggcgggaggcctctgtcccctctcccggctccctgcaaccacaccttctgtccaggctagaaaatgtggctgtccctcaggagaaactgccctccccccgcctgagtgacaagtgtgtgtcacaggcacagcacacacgtggccctcaatgaagggcgttttaatggagacacatcagaagaagttagggaaggtgtggcacggcggcacgtctcaagcagccggctgccacagggccctcagcccacccttcccagtggtcacccctccttcctgtgctgggctgcaggcctgtccacccatgagtcagtgttcctgtttcccagttccacagaccatgggtccccaccacctcagcggaacagcagggtggcaagggcgtgggcaccagaggagccactgggctgcaggaggacagccctgtgggaacactgaaccaagctctactgcgcccatgctcggagcccacagccacagggccatgtactctccaaggttctgtggattaactcctgatgactttttcacgacttccttgtgggtgggtgtcacgtggtcacacacggaatgccgtgtcttacagtgaaggctgggagcagaacggcctctatgagttcttccgagcaaaaatgcgggcccggcggaggaaaggccaggagaagaggaacaggtaaaagcgcagatgtctgcagtggccggggggccagggtccacagcttgtgatgggtgggagcagaccccagatacactcatcacgtccaccctcacacagcctgtgcctatggggcggtgttttccacaaggcctgaattcacacagcagcaggctcggccacactatttaggaacttggtaccgttgctgtggctatggcgccacatccacagccagagcccctgcatctggggtggtctaggaacctgagggccagggtgggctgggtgcagcccatccactggggcacctgatcatcaggcctctccccacagcggaccctcgaggtctcggagcagatccaagagtcgagggcgttcttcctcccgctccaactcaagatcctccaagtcttcaggctcgtactcaaggtcaaggtcgcgctcctgctcccgttcctactcccgctccagatctaggtaggcagaggctgcctcagggcagtgcctgaggcctcttcctgtggcctccccacgacgcctggctgctgctgacccttgggcacccttccctgcagaagtcggagcaggtcgcgctcctccagaagccgctcccggtcccagtcgcggtcccggtccaagtcgtactccccaggaagaagacgccggtcacggtccaggagccccaccccgccgtaagatcctgtcttaagtgctgcgctggtaactctgggaagctgcggtgctttgctgtgaatgtggaaacattggtggttaggagactgtgttaggaggccgccagcattagcccggggacagtggcacccctcacccttcaccacagtagccacttggcgaagcctgaggcagtaactggggtctgctttctaaccaccatctgggttggaggtgtcctgctctcaatgctgagcgtggggtgggggccagcgtctggagcccccttatctagctgagacaggataaacgggtagagac

SEQ ID NO: 11423 - DNA, 1159 bp, Homo sapiens
gaacacaggcacacactaccatgctcaactaatttgtattttattttttgtagagatgaggtttcgctacgttgcccaggtggtctggagctcctgggctcaagcgatcctcccgcctcagcctcccaaagtgctgggattacaggcatgagccaccgcgccccgcctttgttttttgttgagttggtttgcagaggttgtttgttcctctgggctgcagtgttttccttggttacctggagggcaggtgttgtctcctggtatgtcctgtcagtgccctgcccactccaggagggactgtcacagattcacggcaggcatgagagacagaatctcctcctgctggggacaagcaagggagctgatggccagagcagcccagagtccgggcatcgccaccatgtccccaccccgcccctgctgagccaggccggagggctcaggctgcgggtccctcctcatgtgttctcgaccccaccgacccccgcccgcaggagcaagtgacagcggccgtggcccacgcggtggagcagcagatgcagaagcttctggaggagacccagctagacatgaacgagtttgacaacctcctgcagcccatcatcgacacgtgcaccaaggacgccatctcggtgaggggccagcacttcccagagcccagctttcccttggtccctccctgaggcagggcctgtcgtagccaatctgggctaagggctgttacaatgggtgcccttccctcccgcctggagctcctgaggctgtgggaccctgtgccccccacgctcatggtgtgtccttccctgagctgatggtgacgcgctctcagggatgcagtgggtgcctgggggagccgcggccctgctcactcgtcattggctcggttgttgcaggccgggaagaactggatgttcagcaatgccaagtccccgccgcactgtgagctgatggccggccacctccggaaccgcatcacggctgatggggcacacttcgagctgcggctgcacctcatctacctgatcaatgacgtgctgcaccactggtgagcgccgccaccccgtgcccagagcgccacttcctcgcgctcctcctcaaccctcctgggtggccgcttgctccggtcggtagcttggcttggcctgtcccgagactaggg

SEQ ID NO: 11424 - DNA, 1266 bp, Homo sapiens
gttcaggtgattctcgtgcctcagcctcccgagtagctgggattacaggcatgcaccaccacggctggctaattttttgtgtttttagtagagacagggtttcaccatgttggccaggctggtctcgaactcctggcctcaaatgatccgcccaccttggcctcccaaagtgctaggatgacaggcatgagccaccgtgcccagcctgattgacaatggcctcttgaaggctgggttttcccagccggacagtgcccgccccacatgctccactcccacgctttcatctgcaggcctgccttcctctcagccacctcactgctgagctctgtggtagagaatttcctttacccatcagggtatggtctggctggtaatactgactccaacccagctccttcattttatagaaggaggcatttctgaatcatgtttgttcaccatggcgagactcactgcagaatttttaaccaccttattttaagtcattcattctaggaacagtcaagcccctaccacaaaggggccagatccgttcaagtgaggaagcacttgcagtttctgaattttgctgtatatttgtcctatgtcacccaacaggccctttgctatagctgggacattaccagaccccaataccttagggtctcacagcctgaaggacacagagcattgaattattaaaagacctgaaaatattataatgtttttcaattgtcacctgttttcaagacttaaatgctatagacttttctgcaggaatgacgtgtatattcctcactggcatttaccaaaaataaatgatggtttccagggaatcaaaattggtcccgatttgtcagcgagggtctctttttgagtggccctgtcttcagtgtgcccagcaacaaaatgtggaaggaggagaaagagcaagccaacttggctgtcacgtctggatttactgcaacctttgttttttcttctgagccaaaaataaggacgtgcaatttgtgaattgattagatgatacaatgaaaataggatcacagctaaattaatgacgtgactttattgaacggaataacatgggaagtccaggaacattgtggcagctgtgcttatgaaacttttttttttttttttggtatgtttcatgttttttgagacaggatctcattctgtcgcccaggctggagtacagtggcgcaatcccggctctcagcagccacaacctcccagactcaagggatccttccgcctcagcctcccaagtagctgggatac

SEQ ID NO: 11425 - DNA, 1225 bp, Homo sapiens
agcgtgcgcccccagtttgcagagcgagtttagcccaagagcttttcacaaatggtttctttccctaaaaggccttttacctttggtgtcagccgccgccagccatcaggaatcaggaatctagttagcggttgcccttgtatccctggtcgaggccctgatgtttggcccacgcacagacgccgacgctgcgaagccctccgcgcttctgttcgcccgtcccgttcgagctccggctcccggtcactgggaccgcccacgtctcaggtggcacagcttggacgcaggtctgtgtccccttcttccgcttccggcctcggctccgccggaagcgcatctacagtggactgggcctgcactcgagacgtggtggctggcgcgtcggccggcgcggagggatgacgcgaggaggcagcgaccaatgggaaacggcgtagaccggggcgcctgcccccccgcccagccccgcccccgcccggcgtcgggccgtcggacgggctggaaggggcggccgctcgggcaggatggcggcggccgcggtgggcgcgggccacggcgcggggggcccgggcgcagcgagcagcagtggtggggcgcgcgagggcgcgcgggtggcggcgctgtgcctgctgtggtacgcgctgagcgcgggcggcaacgtggtcaacaaggtgatcctgagcgccttcccgttcccggtgaccgtgtcgctgtgccacatcctggctctgtgcgctgggctcccgccgctgctgcgcgcctggcgcgtgccccccgcgccgcccgtctcgggccccggacccagtccgcatccgtcgtccggcccgctgctgccgccgcgcttctacccgcgctacgtgctaccgctcgccttcggcaagtacttcgcgtccgtgtcagcgcacgtcagcatctggaaggtgcccgtgtcctatgcacacaccggtaggttccgcgcccggcctcgggggcggcggccgggcccgccgcttcgggtttgggcgcatggataggagtgcgccgcccggggcgcgtcccgccggactgagaagtcagcagaggggctgccaagggtttggtaggggagggacacgcacggggttctcagggagaagaggagctgagaagagagctgagaggtaagcaggacagaccacaacagccgtggcaggaggaagccctaccgaaagagaaggggcgaagaggtgtgaggggctgccaggcc

SEQ ID NO: 11426 - DNA, 1160 bp, Homo sapiens
gcagaagccgggtgggcgggcaggcaggtgggcaggtggccggggcccagctgcctcctgcgctgggaactcggggagtccggcccaggcgggagggagggggcgggagtcacgcggtctctctgcgctcttccctcaaaactctttttgtgaaatgctgctaccagtttactaacaaaattgcgaagaaggaccgcgtggaaggaaggacggcaaagtgagttcagaactctatagcaaaccagctataaaaagcgttagtccctcacccccaaagaggtgcggacactttccagcacctgaaagctggggcctcagttgcaggcaggcacagaaaacctgtgggagaggtcacctttaacacagcaacagaagcacgcatctcatctctcttgcattttctgttctttaatttggccctgagtgtcttgagacagtgggccatgccactgcctctgtttgctccctacccagccactgtcaggccagtgttgtctgtcatgtgccagaagcttctcagctgtggtgagccactggcattgggcaggcgggccagctggccagccagtgtgacccacactccatgggcagccacctgtttatatctggtttcagttataacccagtttttaaagaaatgctgcaaaaatttaagttttctcatgtttattttaaacaattcctcttccatcagaccaccagacaaaaaaacctttcctttcttcctcccttttcttttttcccttcctgtacacatctagaaaacttcacctttctagagtccccccaaaacaacacaaaagttattgtgggtgctactggttttatgctgtactgtggggcgagggggaagacctgtctgtacgctggaaacactcataaccattcctttagattcgtttgccttatggttatttgtcataaacgcgatttgcaaaaacaaggagccttagtgaatgtacagtacctagacttctgtgttctcaggacgcagaagggagcaactttgctatttggtccagtaagtggacaccttgtgatataaatgtggaaataaaaaaaaaaaaaaaaccatttgcacaaaccagtctgagaatcttttctcatttggaccttcacaaccaaatcagccctttcctggattgtggattattagccag

SEQ ID NO: 11427 - DNA, 1413 bp, Homo sapiens
tctctgccaggaccccatagagtcacagcttttggaggggttcacagaatcctggcagcagctccagtcaagaatgtcactggttggcatgatattcttagttgtatttttccttctttaaaattgcatcttgaccaggcacagtggctcatgcctataatcctagcactttgggaggccgaggcgggcagatcacctgaggtcaggagttcaagaccagcttggccaacatggtgaaaccccatctctaccaaaaatacaaaaattagccagacgtggtggtgcacgcctttaatcccagctactcgggaggctgaggcaggagaatcacatgaatccaggaggtggaggttgcagtgagctgagatcttcccactgcactccagcctggccaataagacctgtctccagcaagaccctgtctcaaaaaaaaaaaaaaaaattgcatattgactcctgaagaacttcaagccatgttgagatccattcatttgatggacattttctaagtacctgtgagccaggtgctgccatttcaaagtctcttcttaccacgctcctcagtggctagacattttcacgtggccagaaagtcccgactcttgctgggcgtccctggacaagttgccttcctcctctgagcttggcgctccccatctgtatagtggagacccttggcccccctctgtacggaagggccgatgcgaagctgcagttaaaaaaggctcacatgctcctagcctcgtgcagtcaggaggggagaccaggacagttggaaattatgattgcaaatggctttgcattttagatcattcgtgtgtgtggatcagagaaacgcacaagttccctggcacaaaggaagccctcagtagacacgtctagggcaggcttgagagatcagatggcgtgaaaggcttgtgatctgttcgtctcaggctccccctaaaccaaagaaatggaaacagctggttggggttccacgatccagctctatcaaggggctctgagtgtgcacagttgggacctggatgtatcaggtctccctcaggctggagtccactgtcactcattcagccattgaacaaacatacagatgcttacctgctctgtggtcagccttgtgctgctgctgggcgggccaggagcctgcttcagtgtgagcgaggtggatgatattatagctgaagggtccctcctggtcaccctcatctcagcctaggtcaccaggatgtctgagaggggtgggtgcatgggacgggcgtggccagtctcaggtgaggtttgggcccagacctcgttggagtcccagacgttgccaggctgttggaaaattgccttgttcctgtgatgcctgggagttaggtgggtcctggggaggtttcatcctcttgcttgtccacctcagctcggtgt

SEQ ID NO: 11428 - DNA, 1230 bp, Homo sapiens
gcagctctgcatgctcaggtgcatgggtccagccacgtctccggtgctgaccacctcccacatgtgtccttagttcacaggaaacgggccgtgcgagatgcacagcgtgcagaagaacgagcacgacaagaccccggagcacagcaggaagcgctcccggccctcgctcctccgccccgtgtctgcacccgccaaggtacctgtgagccacatgcagccatgcctgcacgcggggcccccagcaaatcgggccttcccagcatgtgaccagggaacagaggccccagcaggggttcggggctggaccgggggctgtgtgaggttcaccggcagtgggaccgttggaagtcagctctcctctaaggtggctgttcttccgttctccctgtcctgtgagattgttttgaaaaggaggaggaggaaggagtgttaaccctgccctaggtcccaagaaacagggtgtaccacccagtctccttttcaccctcaggactctctcacaggcaaggccgccatgtacgtttgttcaggttggtcactgcacagctgagggcagagaggggctgggatccagctcctgtcacgcctttcacctgcaatggtggttttccgattccattattccttgtgcagttactacttggctttctactattggtgggaactttgtcgtcctcccatttatttagttatgtatattagatatggactctgggttataatccattctagtgttgatgtccatactgttccagattgggccagcggggtccctttggctcttgtgtcctttttttctttcctttgagacagagtctcgctctgtcacccaggctggagtgcagtggcgcgatctcggctcactgcaagctccgcctcccgggttcacgccattgtcctgcctcagccttcctgtgtccttttggcatgtcctcatcattctttctcctgtggggggatggggtttcactctgccacctaggctggagtgcagtggcacagtcagccttgacctctgggctctagctgtcctctcacctcagccttccaagtagctgggaccacaggtgtgcaccaccacacctttttgtagagatgaggtttcatcgtgttgcccaggctggtctcgaactcctgggctcaaacaatcctcccgcctcagcctcccaaagtgttgggattacaggcgtgagtccctgcacccagctcatcctcattcttcaggcactt

SEQ ID NO: 11429 - DNA, 1239 bp, Homo sapiens
gagccatcatgcccggccccctgttcttacccacagtggcgagtggtgtcccctagtcacccctgtgggctctgtgttctctagctgcctcccacctgtctgacttgcctttgtccccctagacgcctgtggcctctcagacccggcccacgttgagagcctgcaggagaaggcgcaggtggccctcaccgagtatgtgcgggcgcagtacccgtcccagccccagcgcttcgggcgcctgctgctgcggctccccgccctgcgcgcggtccctgcctccctcatctcccagctgttcttcatgcgcctggtggggaagacgcccattgagacactgatcagagacatgctgctgtcggggagtaccttcaactggccctacggctcgggccagtgaccatgacggggccacgtgtgctgtggccaggcctgcagacagacctcaagggacagggaatgctgaggcctcgaggggcctcccggggcccaggactctggcttctctcctcagacttctattttttaaagactgtgaaatgtttgtcttttctgttttttaaatgatcatgaaaccaaaaagagactgatcatccaggcctcagcctcatcctccccaggacccctgtccaggatggagggtccaatcctaggacagccttgttcctcagcacccctagcatgaacttgtgggatggtggggttggcttccctggcatgatggacaaaggcctggcgtcggccagaggggctgctccagtgggcaggggtagctagcgtgtgccaggcagatcctctggacacgtaacctatgtcagacactacatgatgactcaaggccaataataaagacatttcctacctgcacagcctccctggtctttatttttattttttatttttgagacggagtcctacttcgtcacccaggctggagtgcagtggcgtgatcttggctcactgtaacctctgcctcacaggttcaagcgattctcctgcctcagcctccccagtagctggaactacaggcacccaccacgatgcccagctaattttatttttggtagagatggggtttcaccatgttgaccaggttggtctcgaactcctgacctcaggtgatgcacctgaggcctccaaaagtggattacaagcgtgagccactgtgcctagcctcacttactttcttttggtcaaccttaatctttttttttttttttttttttttttttgagatggagt

SEQ ID NO: 11430 - DNA, 1448 bp, Homo sapiens
agttcttttctcaccgttcccgggcgagcatccgatctgtccgtttataagcccctactctgcaccccaggaacatgcagggtctctgtggagcccgtctagacggtctcagttcccagctgcccaaaacagaggcccaaaggcccagagagaggtcctggtgcctgctttgcgttggacatggagggacgctgcccgagttgggggcactgtgggggaactgtggggctagggtggggaccgctgagttcggatcggagtggccccagggagaacggctgatggaaggcttgttggctgaggccaccaaatagggccccaggtacccgagggtggagtttggccccaggtcccgggtcagggctggcctggtgtggccatgtgtggcagagctgccttgctccctcctccagcacaaagtgggccactagactttggcctcattcttgctgctggaaaaccgcctgctctctggtcatatctttagggagggtaagggaggggggctcaggcagttttggggtcccaggagcttcctgagggtggtgtcagggagcagcaattttgggtggggggggccttgcttggagctgacaggtttgtgctgtgtcagttgtgtgacctggtgaaatcaccattccattctgagcttcaaatggattgagcagggtctcgctggggcccagcctgggtagtttgatgccagcccctccagagagaccccagctccaagtctagctcctgagaagcccccagtctggaggagacacagtgagacagatgccccaagtctgtgggatctggggtcccagggagagagcagaggctctgcctggaggtcagagagggctgcctggaggaggctaggggacatgagccttgaagcatggagttggcaggtggaagaaaggccacagggacatgccagaatgtggtccagacaaaacacttagtggcagactgggggagctgtgctgtaagagggggactgtgcagccatgggagaagtcagagctaggtgggcctgaaatgctggctgagggtaatggggagccatagagggtgtgtgagcaggagagggctctgatcaaattggactggaggccagaagcccagggaggaagctgagttgggccatggggttgggcaaaaaagcttgcactctttaggtgggataacaggaagaacttaactgtttccctccttggagggatggatctgtcccaattccacagctggggaagttgagactgaaggttcagggcctcccctgaggtcaggggcccctgagctgggcctctgcctgcctgcagggccgccccaggccaggccgtttccacccggctgccctggaccctcccaccacccagccgctgggctttgttctggttctgcctgagctccctctgccctagtggggcctcttcccaggggctcagtggctggtg

SEQ ID NO: 11431 - DNA, 1631 bp, Homo sapiens
ctttagattagaaactctaattagcgagttcagattagaaagggtctggggatccttagcacttagaatagccctggatactagcccggcgaggtggttcacgccaataatcgctgcaacttgggaggctgagtggggcggatcgcttgaacccaggagttcaaggctgtggtgagccatgctcgcaccactgcactccagcctgggcgacagagcaagaccccgtttcttaaagaaaaaaaaaaaaaaacaaaaaccattaaagtataactggactggtggttcttaactaaggaggattctgcccccaaggaacacgtggaaatgcatggagacatttttaggtgtcacgactgagggggagggggtactactggcatctagtgggtggaggccagggatgctgctcaacaccctacaaatgcacaggatagcagcccccaccccagctacccgccccttccccgcccacccccgcccccccagcaaagaatgatccagctcctaatgttggtagagttgaagttgacaaaatcctcctccaggccgggcgcggtggctcactcctgtaatcccagcactttgggagaccgaggcgggcagatcgcctgaggtcaggagttggagatcagcctgacaaacatggcgaaaccccgtctctactaaaaatacaaaaaattagccgggtgtagtggcgcgtgcctgtaatcccagctacttgggaggctgaggcaagagaatcgcttgaagccgggaggcagaggttggagtgagccgagattacgccactgcactccagcctgggtgacagagcaagactctgtctcaaaaaaaaaaaaaaagaaagaaaagaaaaaaagaagaaaatccttctcctggcatactgtagacacttaataaatgctggatgcctgaatactagttgggttccagcagggctacaggccatcctccagctcccccttgagtggaagtggagagatgcagggtagatgggaggagggacttttggatgctgtgggccatgtgtgtatggcggagtcccagggaagcctggcctctctccaccctcttgcccccgcctaccttgagccctgcgtcttctgcagatcctgctcctggcattcctgaagctcatcgacgagggcagccacatggtgatgctggaatgccctgagacggtcaacacgctgctccacgaattcctgctctgggagcccgagccctcgcccaaggctctaccggagccactgccggcgcctccagaagacaagaagtagccgctgggccggcggggcatcgcttggtgagcacagccgcagcaggaggaggcccgagcctgcgccaggtctgcagcgcagaccacctgggcgggccgttcgctccggtgggcggggccaggtcagggagacgcccccaggctgcctgggcggggcgtggcatccgagggagcccagcggacattccgctctccgcttccgtcccgcggggcccatcggcgttttggggccgcagccgggaccctcacggaagatgaccttgtacagaagctctccctcaccttccccccaacgccacggccaaggcaggccccccaccccgctgtcttccgtgtcagccgtgcttgatcc

SEQ ID NO: 11432 - DNA, 1194 bp, Homo sapiens
tggtcagtgaggagggggcggccccgggagggagaagaaagctggggaagcggggcggggaagcagaggctccgaagtctagagagagaggctgcaggggaagggactgggcgcagaggtgaggggccttggggaaggagggagaatccagtgagaaggatgccctggatcggggacgggctgatagctgtatggggcggggctatcaatgggggcgggtctatcgatggaggggaggggcttatggatgggtggggcgggtctagcgatgggggcggggcttggggccgggcttggagcggggccagtgtctgctgcctccagtctgccctgagtccctcttctggtcctttaggcacatcttggaaggtccgtcctgctcggcttttcgcttgaacattcccttgatctcatcagttctgagcgggtcatggggcaacacggttagcggggagagcacggggtagccggagaagggcctctggagcaggtctggaggggccatggggaagtcctgggtgtggggacacagtcgggttgacccagggctgtctccctccagagcctccctccggacaatgagtcccccctcttgtctcccaccctgagattgggcatggggtgcggtgtggggggcatgtgctgcctgttgttatgggttttttttgcggggggggttgcttttttctggggtctttgagctccaaaaaataaacacttcctttgagggagagcacacctgactctcgagttcctggagtatcatcgttttagtacccaagcgttggggccgcccctgcaggtgagagtggacaccccgttgacgatgacacctcccttccctgctccaggacgttttcaggagcccacggagttcggggaggcaccaccccagttcttcccagcccttgtctctgctgggatcaacataagaactatgcaccctcatcagggctcaccgtttcccaggtgttgtattctcatctcctccctagagcctctcctgattcctggggatccagtgaggaaactgaggctgtaactgagagtaaccttgtcttgcttcccttcccgcctgcagaaaatgctgggctgggatttaaactgggatctgtacacacacacaggccatgcattgtcagaatgtttccccctgcttcatcccccagattctctctctctctctcttttttt

SEQ ID NO: 11433 - DNA, 1681 bp, Homo sapiens
gctgaggcaagagaattgtttgaacctgggaggcggaggttggagtgagctgagattgcgccattgcactccagcctgggcgacagagtgagactctgtctcaaaaagaaaagaaaagaaaacagaccttgagccagatttggctcatgggtgctagttgtccaacctctataggattagagggctcatggaaagtaagttttgagggccacgatgggcacccagctctgtccgattccacagctagccaccccatgaatgcagcttcatatcaccaaagatcagcctactccagcggttcctaaaggctgcatggaatcccctccttcatctataccattcatgatttaaccactcctcccacccccatccccaatgttgtccatgtggctgccttaaacagcaccctggcgagcctcatcctagagtcatctttgggccttcccacccctgcctggcttccctctctcactcccctaccccccactcccagaggcctctgtgtccaagaagaaacgcatgtgtgtgaagctgttgcccctgggagccacggacacggctgtgtttgatgtccggctgagtgggaagaccaagacagtgcctggataccttcgaatagggtagggccaccccccagtgtctagccaccttccctgccctcccaactcatgatctcaccaatctgaccctcaaggacacccctgaggtctcctgttccttcttctaccttctgagcctcagattctgcatgttaaaaccgggacatatatatcatcttgtaggactgtcattaggagtcagtgacttggtgtctaaagtagacataacaggactgggcgcggtggctcacgcctgtaatcccagcactttgggaggctgaggcgggccgatcacaaggtcaggagatcgagaccatcctgactaacatgttgaaaccccatctctactgaaaatacaaaaaattagccgggtatggtggcacacgcctgtagtcccagctacttgggaggctgaggcaggaaaatcacttgaacctggaaggcggaggttgcagtgagttgagatcgcgccactgcactccagtctggggcgacagagcgagactccgtctcaaaaataaaataaaataaataaaaataaagtagacagaacggtgatttgaacccagcagtattagtttggtgtggtgcttcgggtgtgggtcaagatgctgaaacaaaaatcccccaaaagactgggcacggtggctcacgcctgtagtcccagcactttggaaggccaaggcgggcggatcacctgaggtcaggagttcgagaccagcctggccaacatggtgaaactccgtttctacttaaaaaaaaaaaaaaaaaaaaaaaattagctgggcatggttgcctgtaatcccagctaatccagaggctgaggcaggagaatcgtttgaacctgggaggtggagattgcagtgagtctagattgcgccattgcactccagcctgggcaacatgagcgaaactccgtccccaaaaaaaaaaaaaaaaaaaattcccccaaaagacagaggtcacctgcatgcccgggtcccccgccttctccaggggctatcctcaaccctggccccacaccgggccagcatccctcccaccttccctcctggtccagggacatgggcggctttgccatc

SEQ ID NO: 11434 - DNA, 1193 bp, Homo sapiens
gccagctgggcttcgcgccgggcgacgtggtggccatcttcctggagggccggccggagttcgtggggctgtggctgggcctggccaaggcgggcatggaggccgcgctgctcaacgtgaacctgcggcgcgagcccctggccttctgcctgggcacctcgggcgctaaggccctgatctttggaggagaaatggtggcgggtgaggccaggcgtgggcatcaggtgggcggggacccaggactggcccctgggcgggcggggagatgctgcgccccaggcctcggaaggcggccgccctggacgtgggcatgaggtgcacggtctgggtatgccccgggcagggagttggtgcatcccaggcctcgggagggggcctgtccggcggtgaccatgacccatgtgttggggaccacagcggtggccgaagtgagcgggcatctggggaaaagtttgatcaagttctgctctggagacttggggcccgagggcatcttgccggacacccacctcctggacccgctgctgaaggaggcctctactgcccccttggcacagatccccagcaagggcatggacggtgagtcaagggtgggacccctgctctatcaactggtttcctacccgcccaggccccgcccccaacttccaggccccaccccccaatgctcaggccccacccctaacacctgtatctcctgcagatcgtcttttctacatctacacgtcggggaccaccgggctgcccaaggctgccattgtcgtgcacagcaggtgaggggcccacaggcataatgccctcagccgctgagagtgacccaggctatcttgccagcctgacctgcccctcagctcctgtgggcatctccatgttaccctggggacagagagggcagctggtgtttcctgagcacttgctctgtgtccagaccagggccaagccctccacgtgtaaactcattgcaaccctcataactgcttggggctggacaaaggcatcacacccattttcacacccatcttgggacccggttgccctgtgcccactactctggggcccctctcatccccccacctgttcaccacatccatcccaccagcaaaacccgtcctctccatctgtctacttttttccatgccccccatctggacctgtgccagcccctcctcgggctcctcctgctccccccactc

SEQ ID NO: 11435 - DNA, 1200 bp, Homo sapiens
ccttaggagggagggtggggatggagaaggttacccttctccatggagggtggtgaggggctgagttttatcccaagggccgtgggaccctggaggctttgaaacaggacaatgggctggctagacaggtgcaggctatggccaggaaaccccccaaatacaacggaattgaaagactcctgttggaatgctggcccccgcaggaaccaccatgatcccgattcacccaggagggccaccctcccgtccagccccccaagagcagcagggctccctcttgcccttgaacctcctctgccctgacaggcggcgtcacccagggctcaggatcctggcttccagcattccagaggtgactcaccaaccaaagtgtcactcaccaaccgaaggaccttgcacaaatgcaccagcctccccatgcctcagtctccccatctgtaaatgagtgttatgacggtactgtcataaactccctggaggatccaggtggtcacgttactgttggtgacattgtccctctgttggctgcagacgcatcttctctccagactgccgatcccagaaagccaggtgatcaccattaaccccgagctgcctgtggaggaggcggctgaggactacgccaagaagctgagacaggtgagccccgaggagcggccgcaagggagtcacatccacgaagcggccacaccccgggcaacagagcggccttctgattgtcaccagcaggaactgccccagggatcactggcagatccctttgaggaatcccctcttcgaggccacagccctgccctggggagcctgaaggccactcggcctctgttgcccaggtaacaggcctgggtcctcacatcttggggaaatatgatgggtatggctatggctttgatcacaggctacattgagcactgtttcctgcgttacagctacttgtatttctttttttttttttttctttgagacggagtctcactctgtcgcccaggctggagtgcagtggcgtgatcatggctcactgcaagctccgcctcccgggttcacaccattctcctgcctcagcctcctgagtagctgggactacgggtgcccgccaccacgcctggttaatttttttgtatttttttagtagagacggggtttcaccatgttagccaggatggtctcgatctcctgacctcgtgatccgcccaccttggc

SEQ ID NO: 11436 - DNA, 2338 bp, Homo sapiens
tccgagtacaaggcccacttctccctccgcaacctgcatgccttctctgtggagccgctgctcatctaccccacacactacacaggagacgatggctatgtgagtgacaccgagacctcagtcgtatggaacaatgagcacgtcaagaccgactgggaccgcgccaagtcccagaagatgcgggagcagcaggcactgagccgtgaggccaagaactcggacgtgctccagtccccactggacagtgctgcccgggatgaactctgaggggtagcagccagaaagccaaagcagccatcggtggcccaggctccacgtgcttactgaggacatcaggtccacctctggaccccttggcaggccacagagggctctcgtgtggggtggtgtccagccagctcttgctaagcaatcacgtgcacacaggcagcattaatggagtgcctactgcatgccagcaacagggcttggccctggggaattgggaggaaccaagccctcttcatctgttcatgtgcccagcatttattaagcacctgctgtatgcaaggttcccatgttacggcagtgaatgaggcataattgttccctccatcagcgattgattcagtcatcaagcagttactgatcagattaagaatcaggcactagtgatacacattcatttttaaaattcattcaaggatttattgagtgcctactgtgtgttgggtgccattccaggctctgggatttttttttttttttttttaagagtagagtctgtctctgtcacccaggctggagtgcagtggtgtgacggctcactgcagcctgcgcctcccagcgtccagcaattcttgtttctcggcctcccaagtagctgggactataggtgcgtgccatcacatctggctagtttttgtatttttagtagagacggggtttcaccatgttggccaggctggtctcgaactcctgacctcaagtgatctgcccgccttggccacccaaagtgctagggttacaggcatgagccactgtgcccagcccaggctctgggaatattgagataaataagatgcttctatccatttattcaagcacatattggtcacctactgtgtgcctggcactcatgtcacaaagataagttcctgattcggtacacttactgagcacctgctgtgtgcagggagctgagctatgggatgggaatgggagtaaacaaggtactttttacttttttctttttttcctcactgctagacggtgtgggaacttctcactcattggcttctttcccacacacctgaagagcactgactgtgtgccgggcactagtgatacaaaagagtgtgacagttgttcagtctgcattttcgatcatgggctacatgccgagtgctggggcacagagatgaacaagatcggttccttcacttcttcatgccacaagtgtttattgagcacctgtgtgccaggcctcacagactcccagttgggttgaagaatggttgactgagtttgattcttcctgtaccctcggtcgtctgagctgtgtgcagacaacatccccccaccacccaagagggagggtagctcttccgccaccaggggcaagcacaggtcctggtggccccacgccacatgttagcccccctggagggggcgccagttggagacgggggctgggtgtccctggcccactcccggtcccctgtgctttacctccttgcccttgtgtctcaggtgtggtccctgcctgcttgatgaagttgctctgttcaagcctttggtgggatcatgtgtttgggggcttttaggggacccagctgcactggggcactgcccgtggcctgggtaggacatttcccagcaagggctggaggagttgccgtgccttcagcctgaatcgaatgtcagaaccagccagcggtgcttcaccctcttggggataacttgcttagttttttaataaatgttcctggttggttttcacagcagtttgtgggattttgctcggcaccaaaacactgcccacgttccccacccctggatggccgacaagatttgggaggaaaccagggcaggtgcagtagggaagctgcccagtggggcctggcatggtggctcatgcctgtaatcccggtgctttgggaggctaaggtgggcggatcacttgaggtcaggaattcaagaccagcctggccaacatggtgaaaccccctctctattaaaagtacaaaaattagcctagtgtagtggggcggggtggcggggggggggtacctgtaatcctcgctacttgggaggctgaggcaggagaatcgcttgaacctgggaggtggaggttgca

SEQ ID NO: 11437 - DNA, 1198 bp, Homo sapiens
ggattggtgggtgactggatcagttggtggatggatcttggtggactgcctgtctccttcaacccctatccatccaaccacaatctctttgctgttttccctttcaagtctgccctcctctgaccattcccctcctgttcctcttgggcatggccttctccctcatagtccctgatctccatccttcctgtttcggttcatcccccacactgttctttcaaacatgaaagtctggctgtgtctccctcttgaacactccatggctccccactacccccatcctgataaaacccaagccttcctcccagacattggggccccttcccatctggtccctgctgactagtccaaccaccactcactcttctcttcatgcatcagatatcatagccccatcaaaccacccaggggtccctgtacaggctgtgggccctctttcctatctgtggaatgccttgcccacctgttaagggaaggtgatctgtgggtgggggcgagctgggccctctctcagacctgcccctcgtccccagcctgaccctctttgccaaaatctgtgagaagactgtgctgaagcgagtgctgaaggagctgtggaagctggttatgaacaccatggagaaaaccatcgtcctgccgcccctcactgaccagacggtgagacctgcagggggcccgaggggacatttaggccacctccctggcgagagcccagaaaacttggtgcctagaggctggggggtaagaacaaaggcatccggtctcagagaggtcatccaggctcaagggccattcaagggtcatggaagccaccagaggtcagtggggggccattcagaggtcagagagttcacacaggggttaaagatcatcgaagagttaaagaggtcattcagagtccattgtattttctctggggtcaaagacatcaggtagagtcaagagaccactaaagtcatagaggtcacatgtaggtcaaaatagctttcaaaggtcagaggtcatctagaaaacaggtcaattttgggatcaaggttatccttgagccacggaaggcatagacattggccaggcaccgtggctcacgcctgcaatcccagcactttgggaggctcgaggcgggcagattgcttgaggtcaggagttcgagaccagcctgggcaacatggtgaaatctcgtctctactaaaaatacaaa

SEQ ID NO: 11438 - DNA, 1399 bp, Homo sapiens
ccaaaatgctgtgattacaggcataagccaccgcacccggcctccagcactcctttccatgccctccctgctcagaagtccaatcccctctgaccaggactgaggggctttttctctctgtgccccaggcaagttgcactcatggcacctccaagtgaagagacgcccctgatccctcagcgttcatgcagcctcttgtccacggaggctggtgccctgcatgtgctgctgcccgctcggggccccgggcccccccagcgcctatctttctcctttggggaccacttggctgaggacctgtgcgtgcaggctgccaaggccagcggtgagtgcatccctagtggatcgggccagagggaaggatggggctgtgtggggccaagattggaagctggaatagttgcctgcagaagtcagcatcggagctggggctttgggggatgagtaggagttttgtaatggagaagggtgtgcagggttggcttctgaggcagagggaatggcctgtgcagacggagaggtgtgacggcacatgaagggaacagctggtcataccttgaggtatggaaggatctggacggttgggtatgatgctggcactcctgaagggcacagatggggtgactcaggagggagctgatgggaccatcccctgtaggcatcctgcctgtgtaccactccctctttgctctggccacggaggacctgtcctgctggttccccccgagccacatcttctccgtggaggatgccagcacccaagtcctgctgtacaggattcggtaggaagtgccccccagcccccagggattgtacaattttatcatctccttgcatttcgaggtgcccacacccctgccccagggaggtatggtcactacccatttctcagatgaggaaacagaccagagagggtgggtcacttgcccaaggtcacacagcaagttaaaggtacaagctgggctctgtgaggcctccgcagaatctgtccctcgcccccaccataatgtcactcctactgaggctgggttgcactttcatcccagggttctctcctctcctcacagcttttacttccccaattggtttgggctggagaagtgccaccgcttcgggctacgcaaggatttggccagtgctatccttgacctgccagtcctggagcacctctttgcccaggtggggttctgcctggggtttgacccagggggttgggggtccaaggggcaacatgaggactggcatgcaatcaggtggggcctcgtctgaccctccctgtggcagtccaggggtgggggtcagcccaggattgggggggtctgcaggttaacaacagggcttgaagttgggtggcctcagctgatgctccctgtggcggccccccagcaccgcagtgacc

SEQ ID NO: 11439 - DNA, 1154 bp, Homo sapiens
agggctggggagagacctgaggtcttgtcctagttctgcctggaatgggctgtgagatcccatgctggtcactgggcctcagggtgaaagaagatgttggctggatgttttgaggtgcagagtggctgtttgacggcgactgcaaagcaattcaggactgcagcatgaagaaaggaggctgtgggtctaagccacagctttcctggtctgaaacccttagcccaggcaaaggagaggcaggcaactcaattaatcctccctggagacctccctctcctcagttcattttgtgtataaagttgtggtcgggagtgtgacctacagtcaccaagaatccacatggaggccctagggtggccctgcctcctgcttcccgaatctgtggtcactagatgtaggaaagggagtgaggtggatctccacagttgcctctgggtgctggccttaccctcactcctgtttcctttcagctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtatggagaggccggggctacgtggggtctggagtggatttgcgcctcttgggacatcgtgcatctcaagaattaatcagacatcgaacgggtgcggtagctcaacgcctgtaatcccatcacatcagacatcagagccccgggttgtgtttctgcctgggtcacgggactggagcagagcttatgtgccatttccctgattagaaagccagggacccagggagcgggtgggtggcatggtgggacaccttggttggtgctgtcttccctgggccctgtctgttaagtgaggagaggtgatggctatctggtcagtgggtggtagctaggttggcccagacaggttccaggagacttgagttcaggaactgcatctggggctgggttggtgtccgtggcagaagcctggacttcaggctgttgccatgggaagttcccttacctcacgctccctgaggatgcctgaaggtaggtggggctgggaaactgaggcacaagagtctg

SEQ ID NO: 11440 - DNA, 1163 bp, Homo sapiens
gggccaggcgcagtggcttacacctgtactcccagcactttgggaggccaaggcgggtggatcacctgtcaggagttcgagaccagcctgaccaacatggtgaaaccccccctttactaaacaaacacacacacacacacacacaattagcgggatgtggtggtgcacgcttctagttccagctactcaggaggctgaggcaggagaatcgcttgaacctgggaagtggaggttgcagtcagctgagattgtgccactgcactccagcctgggcgacagagcgagactccatctcaaaaaaaaaaaaaaaaaaaaaaagaatcgtcctacctcctggagttgttgggggtcgaatgagctaatgtgtgggacatggttccctctgacatttgatgaataggaaacgagtagacctgaagtcagtgagctcagcagatggaatccactcacactgctggctcagagaatggggaggctgcaatctgggcaggcttcctggaggagggagtgacctcaagacaggacgctgatgtgccccctctgccctgcacacagggagctggctgtaccgcgctcgtggtggctgtggtggctcggaagctggagctcaccaaggctgagaagcacgtgcacaacttcatgatggacactcagctcaccaagcgggtgaggaccgcggttcccatggaggccgcctcctggccttgtcagcgagcgtagaacttccctgctttccctctgtacgtgccgggcatgctcatgtgcccatgggttaccatgcagccccgtgtcaagactgtgctggctttgggaggccaaggcaggtggatcacctaaggccaggagttcgagaccagcctggccaacatggcaaaatcccatctctactaaaaatacaaaaattagcctggcatggtgacggacgcctgtagtcccatccacttgggagtctgaggcaggagaatcgcttgagcctgggaagcagaggctgcaataagccaagatggcaccactgcactcgaacctgggtgacagagcaagactccgtttaaaaaaaaaaaaaaaaggactgtgcttggctctgccaccacgcacccatctgtgagtaatgcacagagagacatcgtggcatcaacccttgtgcccagtcacgtccagccatg

SEQ ID NO: 11441 - DNA, 2220 bp, Homo sapiens
aggcacattacttaacctttctgggcctctgccacctcatctgtaaaatgggcatgatggtgaagccaggttgccagataaaatataggctactcagctaaatgtgaagttcagatcaatattgaatttggttttactgtaagtatatcccatgcaacatttgggatatacttatactaaaaaaaaattattcattgatgctatggtttgaatggtcccccaaagttcatatgtttgaaacttaatcctcaaagcagtcctttcaaccttgtcaacctgtcggcgcggcctctggtgcagtggcggcggctcctgttcctgccgcagctctctccccttcttacctccccaccagatcccggagatcgcccgccatggctttacttactgcggccgcccggctcttgggaaccaagaatgcatcttgtcttgttcttgcagcccagcatgccagtgcttcctccatgaatttgaaagacatattggctgacctcatacctaaggagcaggccagaattaagaccttcaggcagcaacatggcaagaaggtggtgggccaaatcactgtggacatgatgtatggtggcatgagaggcatgaagggattggtctatgaaacatcagttcttgatcctgatgagggcatccgtttctgaggctttagtatccctgaatgccagaaactgctacccaaggctaagggtggggaagaacccctgcctgagggcttattttggctgctggtaactggatgtatcccaacagaggaacaggtatcttggctctcaaaagagtgggcaaagagggcagctctgccttcccatgtggtcaccatgctggacaactttcccaccaatctacaccccatgtctcagctcagtgcagctgttacagccctcaacagtgaaagtaactttgcccaagcatatgcacggggtatcagccgaacccaagtactgggagttgatttatgaagactctgtggatctaatcacaaagctaccttgtgtcgcagcaaagatctaccgaaatctctatggagaaggcagtggtattggggccattgactctaacctggactggtctcacagtttcaccaacatgttaggctatactgatcatcagttccctgagctcatgcacctgtacctcactatccacagtgaccatgagggcggcaatgtaagtgcccataccagccacttggtgggcagtggcctttcagacccttacctgtcctttgcagcagccatgaacgggctggcagggcctctccatggactggcaaatcaggaagtgcttgtctggctaacacagctgcagaaggaagttggcaaagatgtgtcagatgagaagttatgagactacatctggaacacactcaactcaggacgggctgttccaggctatggccatgcagtactaaggaagactgatccacgatatacctgtcagcgagagtttgctctgaaacacctgcctaatgaccccatgtttaagttggttgctcagctatgcaagattgtgcccaatgtcctcttagagcagggtaaggccaagaatccttggcccaatgtagatgctcacagtggggtgctgctccagtattatggcatgatggagatgaattactacacagtcctgtttggggtgtcacgagcattgggtgtactggcacagctcatctggagccgagccttaggcttccctctagaaaggcccaagtccatgagcacagagggtctgatgaagtttgtggactctaagtcagggtaaaactggagactgggggaaagtgactaccagaaagtgaggaagcctaaataaaaagtatacttttgtttcagggggcctttaaagacttaagattaaattatatctgaggcactgataatatgtttgaggttaaaatataaattaagactttaaaagatgaaaaatggtcccttcttccctaatcagctcctttcccctgcctggtatgagttgcccatcacaggcatggtcctggaggatgaccaggactaatgcatgtggtatgagtaggtttggccccctcactatctctagagtgagaatctggctcctgtttccatggctcaaagccggttgcagagaatctgcagtcacttcggagctttagcttcttctctgccaagccctcaataagccagcaaaccaggactctgccccttctgtttccataggaatcatgttgga

SEQ ID NO: 11442 - DNA, 1164 bp, Homo sapiens
caagcgattgtcctgcctcagcttcccaagtggctgggattacaggcgcccaccactatgcccagctaattttttgtatttttagtacagacggggtttcaccatgttggtcaggctggtctcgaactcctgacctcatgatttgcctgcctttgcctcccaaagtgctgggattacaggcgtgagccactgggcccagcctaatttattactttttataagcgatagccgtactgagccgccccctgaaggcggctgccaggtcttgccccaggcacctgggactctgtttgcaggccctgccctctgggctgagaaggatgcactttggacaagtcatctgtgtttgtgttttccagtttttctgtactttttaagtgttttgtgttacctggtctcattcccctccccacacctacccatttgaggggatggagttgaagtcacctggtcacctgtaccggcccagttcggctacaacctggagtgtccgtaaacaattcctctcacccacaaaacaatgtaatcccagcgatggactggattctgaaggccacttcccaccatcatagctgccatgcccaggcagtgcctgctctatatatagagtctgcctccaatcctgctggcttcagcctggagaagggatatgggagctggagctttgatggatgaataggtgttcaccggatctgggcagaggggtcatccgctccccaggtgggcactgataaaggaaggtacaggcctcacctggaactgccaaggcagcctccagaaatgctcggctgtctcggggcacgctccagtatgccagtcctgcgggattacgtccagctacttccagaaacactcagtgtcccctcccctcaggctctgccttggcctggccttgtccagtctaccctggacaagatgccgtgtgtttgaggcccagcagagtaagcccttggccgtgatgtgtctgaaacacctgttaggggttccctccatatgtcagagcctctctgggatgaagttcaagccagaaaacccagtcgaggctcaagtttgaatttcagcttcactgtgtggctctgggaaaatggctttcccactctgtgcctcagtttccttgtgtttacaagactaatcccattgactgtttattaagcacctactgtg

SEQ ID NO: 11443 - DNA, 1270 bp, Homo sapiens
gggagtcgggtgttgcagtgagccgagatcgtgccgcagcacaccagcctagcgacagtgagactccatctcaaaaaaaaaaaaaaaagtctcaaagtcaagattccacctggcaagttctggaaggcgtgcaagatgaattgcgtatcacagccccctttctacaagactaccaagtggggttgagagaagtggggaactgcccagggctacacctgcctcccacgccttcctaatccacagacaggcaatctatacctgcgggggcccctgaagaagtccaatgcaccgcttgtcaatgtgaccctctactatgaagcactgtgcggtggctgccgagccttcctgatccgggagctcttcccaacatggctgttggtcatggagatcctcaatgtcacgctggtgccctacggaaacgcacaggtgtgtgggcgctggggaaactgaggcacgtgggcaggggagcaggggacccagcctaccagcaggctctcaccctgctgccttgcaggaacaaaatgtcagtggcaggtgggagttcaagtgccagcatggagaagaggagtgcaaattcaacaaggtggaggtgagcggccccagggccccacactggggtgggggaaaactgtcccacgtacaggaggcaaatacgaggatgccagctctgtcttctgcctcgtgtgctcccatttaatcacatctttattccctatctcctgggtgggtactggtgattattacgagagggtgtcagggtaccctaggccctcttcatgccctctcctgccccctctccaaaccccaggcctgcgtgttggatgaacttgacatggagctagccttcctgaccattgtctgcatggaagagtttgaggacatggagagaagtctgccactagtgagtgacgcccctcactccacccaaggagggggacatgggtggtaaccttccctgcatccaggcagacccaaattcaagtcctagccctgaccactgctgtctgtgcagcccaggaaaacaactacccttctttattttatttatttttttattttttcttgagacagagtctcgctctgtcgcccaggctggaatgcagtggcgcaatcccagctcactgcaacctccacctccagggttcaagtgattctccagcctcagcctcctgagtagctgggattacagttgtgtgccaccatgcccagctaatttttgtgtttttagtagagacagggtttcaccatgttggtcaggcttgtcttgaac

SEQ ID NO: 11444 - DNA, 1127 bp, Homo sapiens
gagaccagcctgggcaatacagtgagaccctgtctctcaaaaaaataacaaaaattagtcaagggtggtggcacacacctgtaatcccaactactcaggaggctgagatgggaggatcacttgaggccaggaggttgaggctgcagggaaccgtgattgcaccactgcactccagcctgggtgacagcaagaccctgtctctaaaaaagaaaaagaaaaaaaaaaaacattactgagtactcactgtcactggccatagggggtccatgaggagccttcccagtcttgggtaggcagagccaaacacagacaaccctagccctgcagtcagggaagcgccagggacctggatggtttcttacaggagggcatgctagagttgggccttcaacgcatgggtaggagtttgctaaggatttccaaaagctgcttttgggtagagtgggtggggcgggtggatcttggggctctcagtcccataccctcacagactcagagctggcgcttatgtacaacgacgcctcggtgctggagaaccatcacctggctgtgggcttcaagctgctgcaggcagagaactgcgatatcttccagaacctcagcgccaagcagcgactgagtctgcgcaggatggtcattgacatggtgaggccagggcagtaagcggggcgggaggggcagaggggagcggggcatccttctcatctgcagacagcagggtggggtgatattggcatggccggcggttcatccagacccaggcatgtcctcactctgtctgagcttcctcatctgtgaaatggaacagtggggccaggggcggtggctcatgcctgtaatcctaacactttgggaagcagaggcgggcgaatcacctgaggtcaggagttcgagaccagcctgaccaacatggtgaaacctcgtctctactaaaaatacaaaaattagctgggtgtggtggtgtgcacctgtcatcccagctacttgggagactgaggcaggagaattgctagaacccaggaggcggaggctgtagtgagctagtgagctagtgagctgagatcgcaccactgcactccagtctcagcaacagagtgagactccatctcaaaaaaaaaaaaaaaggg

SEQ ID NO: 11445 - DNA, 1154 bp, Homo sapiens
gcgagcacctggcttgtggggccgcagggcctgcagctgctggggcttcccttgtacccacagaccatgtccatcgtgagttacaaccacctgggcaacaacgatggggagaacctatcggcgccattgcagttccgctctaaggaggtgtccaagagcaacgtggtggacgacatggtgcagagcaacccagtgctctatacgcccggcgaagagcctgaccactgcgtgcgtggggcgcgggcgcgggcgcggggttgcccggcgaggggtggcagggacccgggcaaactcctgctgcactccaggtggtcatcaagtatgtgccgtacgtgggtgacagcaagcgcgcgctggatgagtatacctcggagctgatgctgggcggaaccaacacactggtgctgcacaacacgtgtgaggtgcggcgcggcttcaggggctgctatgggaggcagggcttggccaccgcccccatctcctgacccacccgccccgcaggactcgctgctggccgcacccatcatgctggacctagcgctgctgaccgagctgtgccagcgcgtgagcttctgcactgacatggaccccgagccgcagaccttccaccccgtgctgtccctgctcagcttcctcttcaaggcgccactagtgccgcccggcagcccggtggtcaatgcgcttttccgccagcgcagctgcatcgagaacatcctcaggtgcaccccagcctccaggttcccgcccggggcccagatacccccctggctaagctatgcacagggcttggggggctgtaggtggcagggataccccccctttctccctgtgggtgtctggctctgctaagctgtgtgacctctccagggcctgcgtggggctcccgccacagaaccacatgctcctggaacacaaaatggagcgcccagggcccagcctcaagcgagttggacccgtggctgccacctaccctatgttgaacaagaaaggaccggtacccgctgccaccaatggctgcaccggtgatgccaatgggcatctgcaagaggagcccccaatgcccaccacctgaggccccggtcacacagtttctcggctcttcctccccgctgccccccacgaccctaccttgaaggcccccacaaataaaggcg

SEQ ID NO: 11446 - DNA, 1098 bp, Homo sapiens
gtgggggcgggaggggcgtggtgggtagggaggcttggtgggagtccttgcgggcgggggcgggagcctgcagggggcggggctctgcgggaccaggggggctgtagggggtggggttccgcggggcgaggggctgcaggggcgagggacctgcccgggtctggaggcctgtagtgggcgagggacctgcagggggcgaagctctgtggggcgggagggcttgcagggggcggggcctggctgcaggcggaccccgtggaagggtttcgcgaggtagcggggactcctcgggagtcttacaggggcggagcttaaggtgccggaggtctcaggggaggggcctgggggcagcggcttccgtcctggctgtgagcctggaactgaaaaatgcccgaaagtggggcggggcttgagagtctaggtggggcccaggccgggtcgcggccctttcaccactcccacccgtcacctcgccgtgtctgctgacccccaggaggccaactactacggctcgctgactcaggcgggcaccgtgagcctgggcctggacgccgagggccaggaggtgttcgtacccttcagcgcggtgctgcccatggtggcgcccaacgacctcgtgttcgatggtgggcggagccctgggccggggtggggcgggatgggagatggggtctggaggggcccaggatccgggcagggccgagtgtgagggtccccccaggctgggacatctcgtcgctgaacctggccgaggcgatgcggcgcgcgaaggtgctggactgggggctgcaggagcaactgtggccgcacatggaggccctgcggccccggccttctgtttacatccccgaattcatcgcggccaaccagagcgcgcgcgcggacaacctcatcccaggctcgcgtgcgcagcaggtgctgtcccatcccgcatcccttgcttcctgccacctgttcttcgccacttggttccctctttttgccccaccccgcgaatccaggcctcacttgacacccggggaactgagtagcccaggcctctgtgagtccgagagtatgtacaaccaacttccctacaccctctccatcctccccaca

SEQ ID NO: 11447 - DNA, 1958 bp, Homo sapiens
cctcctgtctcgccagaagactcctaggcccttggggtggcgcgcctgccttttctagttttatacaaagacagccacttttagctactgctaatgagacttgagtctatttttgtacaaaagagaagcaaaatcttttttctaaacctgtgcctccctctcctcggacacccagggtctagccgctgccctgggtcctgcctgcagtattacagaggtcgtcgaaaggtgcagctgcgttctgagggcgtggggaatgggcaggtggcctctgctggtctctggctctacgtttaggcacccctttccccagcctctcctccttgggcagggtctctgctccagcaagcaaacagggtggcccaggtggctattttgagaactccagctggtgcccccagacagctgctcagagccaagggggcagagggctttcagcgcccccaggcctgccctgctatttcaggccctcagctgtcgggggccactgtgtttctgtgctccaagttgagactcggccgcagcggcgtcagacttttctttgcgatgtcctcggtttcccatttgttgctgctgctgctcattccacactgttgagaccttgtggtctcgatgctgctggcctccctccgtccctctgtccacttgtgggtcctggggtcgtcttagcagagccaccgccaaggtttgcactcagggaggggctgatggagggctgggcgccatggggtcagggaggccccagggacccatgggcagagctggggagccaggaggatgggtctgcctgctctgggggtgcaggctctgcagacaccccaattgctgctctgttgctgtgcctagtctagtgtcccccaaagcatcggggggccacgcaagtgtgggtgtgtgagtgtgcgtatgtggggaccccccagggcatggtggggtctgaggcgtgtgttcccatttagggctgaatgaagccatgacttggaaaggtggtggggggtggatggcggctgtgactcagggcccagggatcacatgggggtcactgctgccatcagcagtcaggcagggagaacagaaatgcaaaaatacagatgtctatttttctaaactggggggtggaggggtgcctcctgacagcttccaaagagctgactgtggagggcccacagtgtatcccacccctgcccgagagtctctctcctttgggacccccgggttcccagagctccgaggaaactgatccttcatgtttcaatagctgttgttgtttttctctttgggccgggccgggccggggaagggccgagcaggctccaggaggcctccagagtcagctggaccttgctgtgtcgcccgcaggcagccctgcagacaccggtgaggtgggatgatttcaggaggtcccagcccgggactgcccgcccctctgccctgggaaccagtccaaggggctgtcagttgaatttgcctttttgttgttgttgttgtttttgttgtttatttgttctccttttaaggaattatgaagctaagaaaagttttgtgttttgggggttggtggacaaagttctagctgattaaatatggtctaacttattgatactatttttttttcttttaatgttgtactgtggagaaaaactattttgagccatggggttggtgtttacaagaactttccacttttgccaaaatgttacaattgaaaggcatctatctgcgtcttcagtttcctgatattttcttaaaagatctagtgtcctttttgtacactaaacaggtgaatgctgacttttttcattctccaataaatttcactgaactgaacctggcagcccaggctgcctggctggtgtgtgtggtgtgtgggtgttggtgtatctgtgtgtgtggtgtatggtgtgtatgtgtgtgtggtgtgtgttggggtgtgtgggtgtgtagtatatctgtgtcggtgt

SEQ ID NO: 11448 - DNA, 1431 bp, Homo sapiens
ttgtaccggaaaatgctgggcaaccccagccggctgcctgctaagtgccctggcaagggtgcctgggtgagctggggcacagaatgggcaggggctgtgtgcagggcacgcctagcagagggattttattttgcatacatggatgtcctcggagactgggccgtcctgggcgatgcaggggacgtggagagagcccagccctgtgtgatcatgagtggagtcgaaggtggaactcaagctggagggctgggggtggactgtggagcctcttccagggcacgaggggcggtgtcctggaggaggggccatttgatttgggttttgctgcatgagtaggagtttgccaggaagtgggaaatacatagtcaggcaatgatttgttgggaggtctgtttgggctgtgctggcagctgaggccccagaggccagtcttgacctccctccacccttctctcccctcctttttatccacagtccatcccatggaagtggctgtttggggcgactgctgttgccttggggggtgtggcactctctgtggtcatcgctgccaggaactgaccacctaggtggctgccaccccctctgcacaccatggaccctgccctgcgctccccaactcccccaggctccctgtccactgccctccctggtctggccccctcctccgggttaggggagcaaggattgggggtcgtgcagcccagccagcaggagggactgaggccctctaggaggaaagcccagagggagggggccctcattccttcagacccagttttcccccaccctccttaccccgctgggctaggtctccgccagggctggcctcagtttctcctcaacaggcctgggggcagcccttcccctgcctagtccccgcctgagtgccagccccccaccccgcctgccgccccctgtccaggttccctccccgccacagtgaaataaagcatcccaccctgcagtttccacggactcctgagctttcttctcccgctgtctggggctgggccagagacagcctgtgatgcatctggagtcacacagcatggtggatgtggttgagccagctggagctgggggtctcctctccgggcacaacatactcactttacagaggagaaactgaggcatagagaagtggggtgatgtagcaggggcaagtgggttgagaggtctgactcagctggactctgggggtgttactgcccagctccactcgttaccccagcgttcactgtttactcacctgaaatccaggaccccagtgggccctaccttgaggctgctgcatgggttctgtggcatcattgctttacctagtggatgtactgaattcaaaagagacagatggtaggaggatgacttgagcacaggaatttgaggctttagtgagctatgattgcaccactgcactccagcctaggc

SEQ ID NO: 11449 - DNA, 1420 bp, Homo sapiens
agccgttaggggtcacatggacaataagtcctacatcacagagcttggcaaggtgacaaaaccaactcttgggcctccttcccccagatatcccagaggcatccttcctggaggaagaggatgaagaccccatcccacccagcaccacgaccaccattgccacctcagaacagagcacgggctcatgtgacaccagccccgacaccgtctcgccctccctgagccccggcttcgaggacctgtcccatgtccagcctggctccccagccatcaacggccgcagccagacagatgacgaggagatgacgggcgaatagccctgctgcccggtgccttgagggggtctcagggcagcagcatacaaggtggcagcgggtaaccctgccttgttctgtcatccagggctcctttgctgccccgttctgtcacccagggctcctagggggacaaggctctctcccgaggggtgtggaattcctgggggggtctttaattctggctccttccttcctcagaacatctctattctgcaagacccctctgccatgccagggcacgcccattccagctggagtcgtggggctgggcacaggggaatttttccagagctgagcctgacgtctgctctgaagaatgcttagaaggttcccagacaccagagccagatgtcccccaccaccggtcaggacctccttgaggtgcacaagcacggtctcctctgagttcaccccagcccacccccgcacccactaattctgcttttcctgccccttgctccgtaaaagtatcaaatactttctccttggtatctcaaggaggtttctgagataggtagaagtcttgagacggaggctggccatccattcagccctgagcgtgctgagttctgtgtttctctgaatagaggtgtggaacctgaggggccagcaggcctctctgaaggcctccatggagcaaacggagccacctcgggaaagagtttaatggaatatttttgtacccgatgtttacagatgctgttgggaagttatcaataaaaagacaccattactaaaaagggaaaagtacacctagctgtggcttcttcagtccttaagccaagcaacccaaaaggagggcaagtgctggatgtggggctgggggccctgctggagggaggtgcagacaatcaggcactacagggctagaaagagatgtggcccttttttggaaccccccctggtgggagctataacaacccaagttcccgtcaccagctaggtcttccctcacgctgctgtcactgctcacaatactagtgttcccatcctcatttcataattccttctccagatctcagccttcctccagataggggagccacactagatccattccccatcagacacactcccagggttacctcatcttctgagtactt

SEQ ID NO: 11450 - DNA, 1183 bp, Homo sapiens
gccagacttgggggctcaaggggcacagggaacagctctcaaggcaggagttgaggaaggttatacctgaccacagagggcttagacacctggcagggcagtggggccaggaaggccgtgagcagggagcccacagtcagggctgtgagctgatgaggcctctcctacgcgctgcacggagggcagcccagccaaggcaatggggctaagggggtctgtgtgagacccggacgcatccaagggaggctccatctctgtaagacaggagtaaaattcgcctctgcgactcggtcacgcagagatcagccagagtccccccctcccccccaactcagccgccccttggtgctcagccagccgggccccacaacaccagagtctgagcggcctcaggttgctcccgggatcccccggctctccagaacagagaagcttgttctccggttctcatttccgtgggctgggggagcttgaccagctgggccccagactgagcccttgggccccaggagccaccccgtcagcccaggatggagagtccagaccagggtcagctgaactcagactccacagcgtccccacaggccctactttcacagcccagaaccccctcccttggaaggggtgcagcccgcacgtgtgctcacggagcagagtgctgagtgctaggtggacagggctgtacccctggagagcccctggaacgggggctgcttgtagccaggcaggaaaggccggcaggaaacgccccccgccctactggtcccagctgtttgcaggcctcaggccgaccccagccagccagccggggcttcctgccctgggctgagagtgtgttgttggaggcggggtctcagccagtggcactgcccccttaactcacctcacgccgacagctgcccctatggcaccatgtacctctcaccacccgcggacaccagctggagaaggtcagtggctggacaccccccccccgcccccttcttgttggaaacaaaaccaaactctcatcatggttacatgtggaaaagcaggacacagtcgcttaaacaatgaccaaactaagatgcatccagaagtttctagaaattagccttcaccctgaaacacaggagttccagctttgggaggtcttctaacatttcccttccccccacttatgacaaaaaaaaagacaaaaaca

SEQ ID NO: 11451 - DNA, 1222 bp, Homo sapiens
ggtccagcggtattcgggggtcctctgtcacctcgccctgaaaacagcagctcccatcaccttcactgggtcccgatggagccgtctcagaggccgaggggccctctgtgtgggggtgggacgcaggggctctcagagcaagggccacaaagccgatggcacagatgtgcccctgggcctggcccgtcacccacatgtggtgccctgggccagggcgtgcgggcgccagagccttccctacacagcctaagagcaggggcaagactcggcccctcactcaccctgggaggcctgcctgggctacatggacacctgggtctctttctacccccattcaccatggaccaggggcctccatttcctgggggctcttgcggcatgtgatttgggggtccctgggacattctcccgtcagctccacctgagccaagtgtcctgttccctgcggcccttggccttccagggtcctggccaggcaggggtcaggcaccccatactcttccgtgtggcacaggtgtccacccacccccactggccacagacaccattctccccctgggagcaggaggtggagtaagttgtacccccaggcctgggtgctggggagttcctgagggcatgggtggggcaggagtgagtgcctcgtgatcccagcctcagtttctctcttgtcactttctcaaacctgcaggtctcagggccccgggctcctcctgggcaggatggggggcaggggctgggccttggggtggtgctggctctgatgattccagagcctgtatccaccttctgggctcctggccagcaccccacccccaggagccagggacaggtggcatgtgttggggtcgggggatggcccccatctcgaagtgttctggaatttgggggcaacccttgcccagcccagccatcaagaacttctgatctcctgcccaccaggaggggacttagccatggacttggccagtaggcctggggagggagggctttggcagccaaagtccactggccctgccgtgcccctgagtaggaaactgtcccctaggggctgggtggccccactgatatatgcaaacccgccggtccgagccctgttcctgcctgtgctcctctgtgcccaggctggctctcccccaaccctagcatgtatactctgccacggacgtcccgtgggccatgattgtgggcggccgcagcgggcgggggcaggcggctcagg

SEQ ID NO: 11452 - DNA, 1106 bp, Homo sapiens
catgaccactgggtctgaggctggattcctgaatttcaggccaaagaacggggactagaatggccctggaggagtgaggcctccttccagcaggactctccttggaggtggctttgctccttatcccctcggagcttctgccacataccccttccctgcattcttggatttgagaagccctggttaactggtttgatttggttactgggattgttggggttgagtatgtgtttaatgaagaacttaaaaatgttgtcagaggaaagaatttcacatcttgccaaatgaaaaccagagagcaagcttccagctgtaactgtcgctgttttgattttttagttactgtggaatacacgatcctgcctgcgtggtttactgtaataccagcaagaagtggttctgcaacggacgtggaaatacttctggcaggtagataatcagaccatgcatgtgtgtttaatcagtgctgtgctcagatttgtgtgtaaattatggaaatgttgaagcaaagcgtaatataaaatcacgctaacaaacctgggttttttcctcctctgtgactggtttaacttgaaacagatggtggtgtgtgaatgccttaatgtatttacccttgatttattctctgtggctctttttattatgcaagtagggttggcttaattctccttcccagtttttatttcgatttttctgcaagatgagctcttggcacacccgctgatcttcattaacgggaggatgttcccaaggcagtaacgggcatccaggggcgctggttcctgagcaagcttgctctggcctgagctcatcggagctgtccggaggctaattcaggccagatcctgaatcatcggcttcaattaagttcacttgaccgtcggcgctgggcttgccttcctgatgttgatcagctgcagctggactgtgtcgcttgttctgtgtttgggacaggacagtgttctcccagtgcccaaattccaaggggggagttcgatggtcttgcccgagtggtgggactctcgtcctggtgggtcccgtgctagcggctccccttcccctccaggttgctgtgtacaggtcactccactgctggagaggatgga

SEQ ID NO: 11453 - DNA, 1265 bp, Homo sapiens
ggtccccagatgtctcctgggggtgacctttaagctccagccgtctcctcacaagccttggcccagcccagcccagccgtggctctaactccagggagttgtcctccaaagatggtttttgctgaagggtgaggcatgagagcgtttaggcgctgaggcttgttaaggagtcggcagtgccgtgtaactcttttggggcgttctggctaagtcataaaaacaattctgtaaaaacaaagtctgttctgagttttaagagttcagagctcaagtgcacagggagatgcgatttattactaacagtttgaaggtaatgtgatcacataataaaatgcagggcatgcccctttgggtgaaaggtcagcatgggagggggccctccctgctccggggcttcagggacgggagctggtcctcacggccccctcccgctctgcaggcagccctgtgccagccagagcagcctcaaggacatcaactgggacagctcgcagtggcagccgctgatccaggaccgctgcttcctgtcctggctggtcaagatcccctccgagcaggagcagctgcgggcacgccagatcacggcacagcagatcaacaagctggaggagctgtggaaggtggggctgcccagcgggccgacccgtgccttcgtgtggtttctggttgcggggaggggagtgtcttcagagacggcttgacccagtgagaccgctggagattctctgaaaggaattcaggcagacctctgccacctctacgtggaatgacctcagggcaccttggtcaccttccatccaggcagccttacctgaccgagaagatcctggccttggggaaaggaaagctctggctgctggaatttttcttgtcttgccggggtgaggatgggtggtgggaggggaagaatggggctggctgtgggcagacttgtcctgcagagcctgaacctgcccagacaggtgggctgcgagaatgtcctggggaaataggttggtgtcgaggtcggcacagtcagctgagacagaggggagaggagagggtgccgggtcaagtagtgggtgcctggccctccttccacagacagccctcacttttccccacggaagcctttctgtgcttccagctgtttaggattttgtgataaagtagttctaataactaggctagaagttttcatttgcctcccattcagtcagaaatctcacataggaaatgaagtgcaagttaaaatatttttttaagcattgttcagccgggtacct

SEQ ID NO: 11454 - DNA, 1180 bp, Homo sapiens
tgtccctccctcccctcctctctctcttcctccctcccacagcagctgctccctggccacggaggcctctggtgtgcggtgaagcctccagacgggattggcctgtgtgtgttccggggactcctaatggcttctctttcagatgtgcccttggtggcatttggggctgcaggtgccactcacggcgcctgctctcacggcagaggcttgctgtagggcccgcctcatggggcctcgggcatgtggaggccaggcccgggcctgtgctggaggctaaccggggctcttgtttttcatgtgctcagactcaagataacatcactgtcaggtgggacctgggccttaacaagaagagaatcgcctacttcactttgcccaagactgactctggtaatgaggatttagtcataatttggttaagaggtgattttaagttttaaaatatttgtgaccataagtagcataaattcctagttccacccttgtaaagtgccccttaatttgaactctccctggtggaagcgacggcgtgggttaaaatggccacctctctcacttttttacctcaagacatgcggctcatgcagggggatgagatatgcctgcggtacaaaggggaccttgcgcccctgtggaaagggatcggccacgtcatcaaggtccctgatagtatccttcatgtgaagagggtgtggccggctggtgggagaggaaagtgggggcatcaggtggaggccactgtggatttgatgctcactgctgggccagcatctcatgctctgtggtgggtgctggttggcatcgccctccactgctcttaggagaatcacagggccttcaccttcaggggacagctggttgtatggttgcttcccctctgcccgaatggtgatgttggtgatgccacttgtgtggcgcgtccctgggctgactctggaagttaatgtatgccgcttgtgtggcacgtccctggactgactctggaggttaatgtggctgcaggagcgccttacctggacgctgactctgcacacggaggttccagaagccagtggtcacatgcagaccctctgagcacacacttgctcccaggccatgtttgggaatgtgcagtgacctcatggtgatgcagcctgccggccagagtggggcagctgtaaggcacaggtgcagtcagagg

SEQ ID NO: 11455 - DNA, 1093 bp, Homo sapiens
cggctgcaccccacctctcctgtccccctgctcttcgaaagtcagactgaggaagtcaaaagacccgtttattaagcacctcctgtatgcggcacccctggggggtgaccttgggttggggtcacaacctcccggtcatgttctttcttcccctgcagcctgaatcttggccagggctcagggaagggaccagccagtggtttcggggcagaggagcagggcccgcacaacacgagcgcccacgggttctgctgtggggcactgggtaggcccccgggaagggctgctgcccccaaggaaggttcctccgaccctcagctccatggacgagtcaaggactgggcagatggccgtgtggggctcagaccaggccctgggaggggactgggcctgagtgggacccagacggtgtcctgggtggacgccccttgtggccagccctgccagccttctgtcgcttcagcgtctcctccaccttctccttgaagcgccggttcttctgcttgatcttggccagctcagccttgcgcttggcctccaggtcagggtcctggcacagggaggaccaggggatggctgagctggcggcccccgccagggaacctggccacccaccccctacctgcgggctcggccctcaccttcccctccaggatcagctgcttccgtttgttgatctccttcttttcgtcaaagtgggccgcctccagtttctggtggagggaagtggggtaaggagatgctggtcacgggggccccacctggaagggagcacccccggccctggagagcactttagttcctgcccgcctctgacactcacgatctcacactctcttcgcaccacgttgacctgtgtgaggatctgtagcacctcggcctcttccacggagaactcctccagcttcttctctgtggggacagcaaagccgggggtgggggtggggaggagacgtgacatggagagggagttcagccaagtagtgagttccccatgctgtggggtatgcaaggccatctggggccatatcaggtaagggtcagctgagcaagatcagggatttctgaggtaaggaaggtatggaccgctgtc

SEQ ID NO: 11456 - DNA, 1344 bp, Homo sapiens
tccctgaaggggagaagctggggttaactcgagtcaccacagcatagggctagtcccaggccccgaccctgctcctggaacagtgcagtcaccgccctcctggattccagacattgcaggtgctgaaaatcccaaaggcaggtagttgagatctagaacaacttttcctctgtttgctgttgagcctttccttgctgataagcagccaccttccactgctcctgttcagcaccctgctgcctctggcccccaacagggcagggtgtagtttggctccaccaatgttcagccacacagtggaggctggggacacccccctcctgcctagccttcctcaaggcagtgatgaaatgtcctggggatgcttttctgggccctgcgtttgttgtacattcttttgccatccttcccatagggaggaaaacactgaaagcaacactgaaaagtctccaagaaggtggcaccttcattgcacccagttaaaatgttgtgtcttctcctccctcccaagttcagaatgaccgaagaagcatgccgaacacggagtcagaaacgagcgcttgaacgggacccaacagaggacgatgtggagagcaagaaaataaaaatggagagaggattgttggcttcagatttaaacactgacggagacatgagggtgacacctgagccgggagcaggtccaacccaaggattgctgagggcaacagaggccacggccatggccatgggcagaggcgaagggctggtgggcgatgggcccgtggacatgcgcacctcacacaggtgagtgggaggagccagcgggaggggctggaacctggagacaagcccagtgtgcccaggttggggctggccacactccaggcctgttggtaacagcttggcggggttgtggagagggctgtaggctcagctcgggcatcacccaccactggcagctgtgctgttgtggccattccagggccccaggtcccaactgcaagtggcacagagtgtgggtctcacaggagaaggagtggcacattccatcagctcccctgccatcagtaggcctttgccacccacgcacctgctgtctgtccaactcggtgcttttggtttgtagggacacttgagttattcatttggttatgcttccctgcttttcagatctagaggtcagagggccaggaatgctacacctaccttggtcacttggctagggatagagttgggagcccagcccagggcaccctcctcggagcgggtacgggatgctcactcgactccatgttcacttggtgctggtctttggcttgctctgttggtttgtccttagtcaacactgattacttcaagagt

SEQ ID NO: 11457 - DNA, 1304 bp, Homo sapiens
tggtgccaccttgtgagcaagctggcagcctgtggatacacccctcggtcttctggggacaggttggctgccaggtgtgagggctttggcctgcctgagtggagagaagaaaatctggttcacgcagggagctgggctccccttcaaggggtttccaccatggccaggggctgcgggctggtggcgaggcacacacatgccatcagacccagcatgctcaagcccccacaatggctaacactgagcagggccccaggatcccgagccgagtgtttacctgatccgaggcacacggtagagggagcagccatgttttccaaagtcaccatgtcatgctcaggggcatacgcaccctcagccctggcgacatggcggcaggcatgaagtccctaccatcagggtgcccacctgggcactgggattgggtgccctatgacgtgtgggtaagaagaaggaggcagcctgggagccatggggcagggcaggggatgtggaggatgcagggcagacagggaacagacggggaggtctcagctccctgccatgtgtccacaggggtgggcactgggtccagctgtcaagggcgctctggtcactactgtctccaccccacagtgacatgaagtccgagaggagacccccctcacctgacgtgattgtgctctccgacaacgagcagccctcgagcccgagagtgaatgggctgaccacggtggccttgaaggagactagcaccgaggccctcatggtgagccacgtgttggcgctgccgccggagccccactgtgcccttcctactcatgacaccctcaggtggagctagtgatggcagggcctctgctcctcaccaaggacgctccctctcaaccctgttcctctcgcccctgcagaaaagcagtcctgaagaacgagaaaggatgatcaagcagctgaaggaagaattgaggttagaagaagcaaaactcgtgttgttgaaaaagttgcggcagagtcaaatacaaaaggaagccaccgcccagaaggtgcgtgcctgtctcccctccttcctgggccagcaggagcgcctggccttgccttgatcccctcatcaatgtcagcggccagaaaggtgaaagggcttccttgagggagtatagggcaaggtcccactcccgcatttgtggactccagtgtgcattttggattcagcttacaagatgttaaagtgaatttcagtctagagtattctggttctgagggtctaaagctcacttttttttttttttttttgagatggaatctcactctgtcgccaggctggagtg

SEQ ID NO: 11458 - DNA, 2075 bp, Homo sapiens
agtgcgagccaggccccgtggaagacgggctccctcctcccccacctggcccctggtctagaaggacccactgcaccaccctccgctggctcgggaagacaccgtgcccgccccaagagcaagcaccggccatgctgcagaggcaagacctcaattcttggctgcaaagtttcatcagggctagggggctggtgccgcctcataggcagacgaggatcatcgctgggggacctttcccgtgggctttcttcctttctctctttgcctttagtttgcccgacaccagcagaaaagtggaccttgggggctggttctgctcctggcccccttgttcagcccctgccggcacacgggcggctcaccctggacactgtgatgcgcatgggcaaggccagcgcccggggcttctgaaccgagcggggtgtttcatttttttgcttttccctgtcttaggctcccagtctttgactgccttcccatggcgatctataagttgaaagattttttttttttttaatcacctcatgatgatggagttaaaagtaaaccgtgcagaccctggggtccctgttgtacgctgcatcatcccgctggccctgtgccctggagggtgggcggctcatggtgccacagcccctggcagggacggccggcccgcccccgtgactgactgacagatgcagggatggccgaggcagccctcgctccagctgaacgcctccattgctgcttgttctggagacccccgcccccgcaccttccagacttagcagaagaacaaactgaagaacagacccagccagagaagcagggattccagaagctgcccattaagggagaaggagaggatccggtcggcagcagccctgagcagaaagctggaggggggactgtcgcggggtttttctgttgtggtttattttattaaattttttccttttttctattcatttcgatggacgcaatcttaagccaccctggccttgctcctgggaggtgagcgtgcacaggtgtgtgcaggtcaggaggtgccgtccaggtgtgcggcgagccgctgcgcacagatgtcaggatttccgtttgggtctagtttagaacctgtccttaaacctaggggttgctgtcaggatttgctttcagactttttttttttttgtaattccctttagagtctacaaaaatgtttttaaaaggatcaggtctgcttttagtttcatttttgtttctttcccgtcccactctttaaaaactggttccgtgaggaaaggcagaagccgttccgtgtctcttgcaggctgggccggcttcatgccagtgcgagggcgtcccgtgcccacgtacatacgtatgtctccatgagttctgggctccactggttccaattgagctccagccctggttttcctacccatgcagttagggactttaatttaattttttttttgtagggccaccgccttcaaacacaactgctacaacattctaataaaggctcatttaacccccaggctcctgtcgtgtgaatatcctcagtctgtaggaaactttttttgacacagcatagaagacctagttttggaaaacattatctaattttttgttgtgcaaatccccaaatttctcactaatttttgtttttttgtgcataacttggatgggctgaaggaggtgaggacagattggggaagggtggctttcattccaagatccagggatttggggaaaaggaaggaatttgatgttttttggggtgggaggggagggtgtgttttttacaccaaaaaaaaaaaaaaaaatcaagagtatgcaagcatttctattcctcgcatttttctgtgtgcctggcaaataaatacctgtctcctacgaccctgagctgttagccctctctgttccatgacaggggccagatcttccagctcctcccagaaggagcacccaggctggcttcttcccactgaaagccctccccagcgaaccaacctcagttctatgcagtggctggggatcaggcatccagaccgaagtcacctctgcctgctccagcttgggtcagctgggtctgaccagggggc

SEQ ID NO: 11459 - DNA, 1183 bp, Homo sapiens
tcataatcatcctgaatggtcagtttccgatgagaggccactagcaagggatacccatcaccaccagggagcagaatccgttccagggattggggtgagtccgacttcgagcagcagctgccccccaacatcatgtacccagcccgtgactacgtggagccctgggcttcgcgtagagtccctagacggggcgaaaacgggaaaaggggccttaactggggcacctggctcctttgagagctcggagtttctgactggcctgcgcaacaccccagaggcaaggtgaacgcgagggcctataatgcaagaaccaaggcgagtcacgccctgtctgggcaaaagaggagtaaagacccctcagctgcagcccggcagcgcattcctacccagggtccgccgccagagctttcccgcgcggtcggatagttacactactgtccgggacttcctagccgtgccgcggaccatctcaagtgcttccgccacactcatcatggcggtggcagtaagtcacttccgcccgggaccggaagtgtgggatactgcgagtatggcggcgtcaaaggtgaagcaggacatgcctccgccggggggctatgggcccatcgactacaaacggaacttgccgcgtcgaggactgtcgggtcagtatcactctgcgccggggtctcagagtctgggcactcggggctcgggggcggggttccggggacacaggcgggcctcagttttcccggcggtgtgaccggaggcggagcccggggatccatcatagcttctgtaataacgctaagtgctgcagtttgttgaggtctttcccagctcctcttccttctcgtaacagcccaggaaatcggtccctctagttatttacgttttacagtgggttaaactgagtcatagcctgtgctctggccctcagccacccttggatttctaagatggggaaactgaggcccaaagaaggccgcggctccccaaggcaaagctgaggccgcaacccggaacctggagggaatttacaagatgttctatgcagtggttccctgctggcagcccccgcctgcatggtgtcacaggaatccatattctttaaattttcaattttttttttttgagacggagttttgctcttgttgcccaggctggagtgcaatggcgccatctcggctcaccgcaacct

SEQ ID NO: 11460 - DNA, 1109 bp, Homo sapiens
tgcttaaaatctttcagtgggttatttcatcttttctggcactttctttatcaggcttttcctatccagttttataacagcacccccaccccaacacacacacaccccacccaccagccacaacaggcctacagctgcacagtcctgggcccaggccagccacgctgccaatgccagcctgccacttgcctttatcagtatgcagcatcttgggtgccccctcttccccagcacttcttgagactcggttcaggggttcaggtgaccccagcaacaggcgcctgcctggccctgctgcgtgcacacagctgtgaccaaggtttgccctcacaggctatgccaaactgcgacctgtgtctccccgttcctccccagactgcgctctaaggatggcacttggacccatgtcttagcggggtgctcagtgtccatcatccaatttggtgataaagtggagtattcctttctcccgaagggttctatgcaaaaatcttcagacataacaccagtgctcacattttctcatggtttgttttctctccagaaaatgaattgtgacttgtcccggtctctcttatctagtggtaagcatccgtggcattcaagacgaagatccccctgacgcccagctcctgaggctggataacatgctgctggctgagggcgtgtgcaggcccgagaagagaggaagaggaggagcggtggccagggccggcacagcaacaccaggtggctgtccaaatgacaatagcattgagcactctgactacagggccaagctgtcccagatccgacagatttaccactctgagctagagaaatatgaacaggtgatctttctgcatggaagagtttctgtcatgtgaatgcgcatttgtcaaagcgaaacacggaacgctaaccacctttctttcgtggcgcagaacagggagtccatgcagttggtcgctgcagaggtggtccattgttactgaaagccctttccatttacttaacagtcacccgccggtgtgtgaactacagggggtggcaggcggctgctccgctgtggaacctgctgccctgtgccaccctgctgcctagtcacaggccggcgtgtctgtgctccc

SEQ ID NO: 11461 - DNA, 1113 bp, Homo sapiens
agtgtgggaaagcctttatatgttaccaatcttttcaaagacacaaaaggactcacactggagagaaaccctatgaatgtaagcaatgtggtaaggctttcagttgtcccacatactttcgaactcatgaaagaactcacactggagaaaaaccctacaaatgtaaagaatgtggtaaagccttcagttttctcagttcttttcgaaggcataaaaggactcatagtggagagaaaccctatgaatgtaaagaatgtggaaaagccttcttttattctgcaagctttcgagcacatgtaataatacacactggggctcgaccttataaatgtaaagaatgtgggaaagccttcaactcttctaattcctgtcgagtgcatgaaagaactcatattggagaaaaaccatatgaatgtaaacgatgtggcaaatcattcagttggtccatttctcttcgattgcatgaaagaactcatactggagagaaaccttatgagtgtaaacagtgtcataaaaccttcagtttttcaagttcccttcgagaacacgaaacaactcacactggagagaaaccctatgaatgtaaacaatgtggtaaaaccttcagtttttcaagttcccttcaaagacatgaaaggactcacaatgcagagaaaccctatgaatgtaaacagtgtgggaaagccttcaggtgttcaagttattttcgaattcatgaaaggtcacacactggagagaaaccctatgaatgtaaacagtgtggaaaagttttcattcgttccagttcctttcgactgcatgaaagaacacacactggagagaaaccctatgaatgtaaactatgcggtaaaaccttcagtttttcaagttcccttcgagaacatgaaaaaattcacactggaaataagccttttgagtgtaagcaatgtggtaaggccttccttcgttccagtcaaattcgattgcatgaaaggactcacactggagagaaaccgtatcaatgtaaacaatgtggaaaagccttcatttcttccagtaaatttcgaatgcatgagagaactcacacgggagagaaaccctatcgatgtaaacaatgtgggaaagccttcagat

SEQ ID NO: 11462 - DNA, 1416 bp, Homo sapiens
cagtgtttgacacgagtcgcaccgaaacaaatgctcttcacgatcattgttaaagtagcaatagcgccacgtgctttcctgggaactgctggcctgttttccactcatacaaagtggagaaggctttgaaatagcaaaggagggtgacataaattgaatacttatatgaaatttttaattaaaaatagcatttgatgttatacaactataagtgagactattagtgtgatgtcatattcttaattatattgacaaaataaccattcacagtattcctatttaaaataacatgttttgtcggctgtatatttgctagcttttggttaaatagtaccagagctcaatagcaatcaacaaaatgaatctttattttaccgcaagcattagtgatgcatatgcctgtttttcttaaagttcattagctttttgccttttccggttgcagcgccgcgcggtgaggttctctagtccacgctcgcagccatgccgtccaagggcccgctgcaatcggtgcaagtcttcggacgcaagaagacagccacagctgtggcgcactgcagacgcggcaatggtctcatcaaggtgaacgggcagcccctggagatgactgagccgcgcatgctacaatacgagctgctggagccagttctgcttcttggcaaggagcgatttgctggtgtggacatccgtgtccgtgtgaagggtggtgctcatgtggcccagatttatgctatccgtcagtccacctccaaagccctggtggcctattaccagaaatatgtggatgaggcttccaagaaggagatcaaagacatcctcatccagtatgaccggaccctgctggtagctgatccccgtcgctgcaagtccaaaaagtttggaggtcctggtgcccgtgcttgctaccagaaatcctaccgataagcccatcatgactatcaaaattcacctgtataataaacagtttttgagggattttaaagtttccaggaaaaaaaaagttcattagctttttatgaaggatttatccttttttttcagtgtgctgtttattgctgagaagtggctgccctgccagaaaactgctattctcagctgtaaccacattgactaatagtgagtggaagtgcagtggataaaaagcaaatgtgtcttctctgtatcttttttcatttattggctgaagaacaggaggatgcggaagatggaagaaaatataatctctgaaagataatgaagaagctctcctaaatagaagaaaacctcataggggatttttttttcatcattttactctctgcttctatgcgtttaaattttttttttttttttttgagacagtctcgctctgttgaccaggccagagtgcagcggcatgatcccgactaactgctccctccacctcctgggttcaag

SEQ ID NO: 11463 - DNA, 1185 bp, Homo sapiens
acataagagaattcatactggagagaaaccctacaaatgtgaagaatgtggcaaaagctttagtacgttctcaatccttactaaacataaggtaattcatactggagagaaaccctacaaatgtgaagaatgtggcaaagcctataagtggtcctcaacccttagttatcataagaaaattcatactgtagagaaaccctacaaatgtgaagaatgtggcaaaggctttgttatgttctcaatccttgcaaaacataaggtaattcatactggagagaaactctacaaatgtgaagaatgtggcaaagcctataagtggccctcaacccttagatatcacaagaaaattcatactggagagaaaccctacaaatgtgaagaatgtggcaaagcctttagtacgttctcaatcctcactaaacataaggtaattcatactggagagaaaccctacaaatgtgaagaatgtggcaaagccttcagctggttatcagtcttcagtaaacataagaaaattcatactggagagaaactctagaaatgtgaagaatgtggcaaagcctataagtggccctcaacccttagttatcataagaaaattcatactggagagaaaccctacaaatgtgaagaatgtggtgaggctttcaactggtcctcaaaccttatggaacataagagaattcatactggagagacaccctacaaatgtgaagaatgtggtaaaggctttagtatgttctcaatccttactaaacataaggtaattcatactggagagaaaccatacaaatgcaaagaatgtggcaaagcctataagtggtcctcaaccctcagttatcatagaaaattcatactggagagaaaccctacaaatgtgaagaaagtggcaaagccttcagctggttctcagtctttagtaaacataagaaaattcatgctggagagaaattctaaaaatgtgaagaatttggcaaagcttttaaacagttcccaaccctcctacacataagaaaattcatgctggagagaaactctacaaatgagaagaatgtggcaaaggcttcaaccagtcctcaaaccttatggaacataagagaattcatactggtgagaagccctacaaatgtgaagaatgtgataaagacttcaactggtcctcacaccttactactcataaaagaa

SEQ ID NO: 11464 - DNA, 1587 bp, Homo sapiens
aatgtgaagaatgtggcaaagctttcaactggtcctcaaaccttatggaacataagaaaattcacactggagagacaccctacaaatgtgaagaatgtggcaaaggctttagtatgttctcaatccttactaaacataaggtaattcataatggagagaaaccctacaaatgtgaagaatgtgataaggcaactcatgctggagagaaaccctacaaatgtgaagaatgtggcaaagctttcaactggtcctcaaaccttatggaacataagagaattcatactggagagaaaccctacaaatgtgaagaatgtggcaaaagcttcagtacattctcaatccttactaaacataaggtaattcatactggagagaaaccctacaaatgtgaagaatgtggcaaagcctataagtggtcctcaacccttagttatcataagaaaattcatactgtagagaaaccctacaaatgtgaagaatgtggcaaagcttttaaccaatctgcaattcttattaaacataagagaattcatactggtgagaaaccctacaaatgtgaagaatgtggcaaaacctttagtaaggtctcaacccttactacacataaggcaattcatgctggagagaagccctacaaatgtaaagaatgtggcaaaacctttattaaggtctcaacccttactacacataaggcaattcatgctggagagaagccctacaaatgtaaagaatgtggcaaagcctttagtaagttctcaatccttactaaacataaggtaattcatactggagagaaaccctacaaatgtgaagaatgtggcaaagctttcaactggtcctcaaaccttatggaacataagagaattcatactggagagaaaccctacaaatgtgaagaatgtggcaaaagctttagtacattctcagtccttactaaacataaggtaattcatactggagagaaaccctacaaatgtgaagaatgtggcaaagcctataagtggtcctcaacccttagttatcataagaaaattcatactgtagagaaaccctacaaatgtgaagaatgtggcaaagcttttaaccgatctgcaatccttattaaacataagagaattcatactgatgagaaaccctacaaatgtgaagaatgtggcaaaacctttagtaaggtctcaacccttactacacataaggcaattcatgctggagaaaagccctacaaatgtaaagaatgtggcaaagcctttagtaagttctcaatccttactaaacataaggtaattcatactggagagaaaccctacaaatgtgaagaatgtggcaaagcctataaatggccctcaacccttagttatcataagaaaattcatactggagagaaaccctacaaatgtgaagaatgtggcaaaggttttagtatgttctccatccttactaaacatgaggtaattcatactggagagaaaccctacaaatgtgaagaatgtggcaaagccttcagctggttgtcagtctttagtaaacataagaaaactcatgctggagagaaattctacaaatgtgaagcatgtggcaaagcctata

SEQ ID NO: 11465 - DNA, 1711 bp, Homo sapiens
agatgtgaagaatgtggcaaagcttttaaccagtcctcaaatcttactgaccataagagaattcatactggagagaaaacctacaaatgtgaagaatgtggcaaagcttttaaggggtcctcaaattttaatgcacataaggtaattcatactgcagagaaaccctacaaatgtgaagattgtggcaaaacttttaaccatttctcagcccttagaaaacataagataattcatactggaaagaaaccctacaagcgtgaagaatgtggcaaagcttttagccagtcctcaacccttagaaaacatgagataattcatactggagagaaaccctacaaatgtgaagaatgtggtaaagcttttaagtggtcttcaaaacttactgtacataaggtagttcatactggagagaaaccctacaaatgtgaagaatgtggcaaagcttttagccagttctcaacccttaaaaaacataagataattcatactggaaagaaaccctacaaatgtgaagaatgtggcaaagcttttaacagttcctcaacccttatgaaacataagataattcatactggggagaaaccatacaaatgtgaagaatgtggcaaagcttttaggcaatcctcacaccttactagacataaagcaattcatactggagagaaaccctacaaatgtgaagaatgtggcaaagcttttaaccatttctcagaccttagaagacataagataattcatactggaaagaaaccctacaaatgtgaagaatgtgggaaagcttttagccagtcctcaacccttagaaaccatcagataattcatactggagagaaaccctacaaatgtgaagaatgtggtaaagcttttaagtggtcatcaaaacttactgtacataaggtaattcatactggagagaaaccctgcaaatgtgaagaatgtggcaaagcttttaagcatttctcagccctcagaaaacataaggtaattcatactagggagaaattgtacaaatgtgaagaatgtggcaaagcttttaacaattcctcaatccttgctaaacataagataattcatactgggaagaaaccgtacaaatgtgaagaatgtggcaaagcttttaggcaatcctcacaccttactagacataaagcaattcatactggagagaaaccttacaaatgtgaagaatgtggcaaagcttttagccatttctcagcccttagaagacataagataattcatactggaaagaaaccgtacaaatgtgaagaatgtggcaaagcttttagccatttctcagcccttagaagacataagataattcatactggagagaaaccctacaaatgtgaagaatgtggtaaagcttttaagtggtcatcaaaacttactgtacataaggtaattcatactgcagagaaaccctgcaaatgtgaagaatgtggcaaatcttttaagcatttctcagcccttagaaaacataaggtaattcatactagggagaaattgtacaaatgtgaagaatgtgtcaaagcttttaacagtttctcagcccttatgaaacataaggtaattcatactggagagaaaccctacaagtgtgaagaatgtggtaaagcttttaagtggtcctcaaagcttactgtacataaggtaattcatactggagagaaaccctgcaaatgtgaagaatgtggcaaagcttttaagc

SEQ ID NO: 11466 - DNA, 2336 bp, Homo sapiens
aatgtgaagaatgtggcaaagcttttaacaattcctcaacccttatgaaacataagataattcatactgggaagaaaccatacaaatgtgaagaatgtggcaaagcttttaagcaatcttcacatcttactagacataaagcaattcatactggggagaaaccctacaaatgtgaagaatgtggcaaagcttttaaccacttctcagcccttagaaaacatcagataattcatactggaaagaaaccctacaaatgtgaagaatgtggcaaagcttttagccagtcctcaacccttagaaaacatgagataattcatactggagagaaaccctacaaatgtgaagaatgtggtaaagcttttaagtggtcctcacaccttactagacataaagtaattcatactgaagagaaaccctacaaatgtgaagaatgtggcaaggcttttaaccatttctcagcccttaggaaacataagataattcatactggaaagaaaccctacaaatgtgaagaatgtggcaaagcttttagccagtcctcaactcttagaaaacatgagataattcatactggagagaaaccctacaaatgtgaagaatgtggtaaagcttttaagtggtcctcaaaacttactgtacataaggtaattcatactgcagagaaaccctgcaaatgtgaagaatgtggcaaagcttttaagcatttctcagcccttagaaaacataagataattcatactggaaagaaaccctataaatgtgaagaatgtggcaaagcttttaacaattcctcaacccttagaaaacatgagataattcatactggagagaaatcctacaaatgtgaagaatgtggtaaagcttttcagtggtcctcaaaacttactttacataaggtaattcatatggagagaaaccctgcaaatgtgaagaatgtggcaaagcttttaaacatttctcagcccttagaaaacatgagataattcatactggaaagaaaccctacaaatgtgaagaatgtggcaaagcttttaacaattcctcaacccttaggaaacataagataatttatactgggaagaaaccatacaaatgtgaagaatgtggcaaagcttttaagcagtcctcacaccttactagacataaagcagttcatactggggagaagccctacaaatgtggagaatgtggaaaagcttttaacaattcctcaacccttaagaaacataagctaattcatactagggagaaatcgtacaaatgtgaagaatgtggcaaagcttttagcaatttctcagcccttaggaaacataagataattcatactggggagaaaccatacaaatgtgaagaatgtggtaaagcttttaagtggtctcaaaacttatggaacataaggtaattcatactgtagagaaaccctacaaatgtgaagaatgtggcaaagcttttaagcatttctcagcccttagaaaacatgagataattatactggaaagaaaccctacaaatgtgaagaatgtggcaaagcttttaacaattcctcaacccttatgaaacataagataattcatactggggagaaaccgtacaaatgtgaagaatgtggcaaaggttttaacaatttctcgacccttatgaaacataagataattcatactggggagaaaccgtacaaatgtgaagaatgtggcaaagcttttaagcaatcctcacaccttactaaacataaatcaattcatactggagagaaaccctacaaatgtgaagaacgtggcaaagcttttagccatttctcacgccttactaaacataggataattcatactggaaagaaaccctacaaatgtgaagagtgtggtaaagcatttagtcctcaaaccttactaaacataagataattcattctggagagaaaccctacaaatgtgaagaatgtggcaaagcctttaaccagtcctcacaccttactcaacataaaacaattcatactggagggaaaacctacaaatgtgaagaatgtggcaaagcttttaaccatctttcagcccttactaaacataagataattcatactggggagaagccctaaaaatgtgaagaatgtgtcaaagctttcaaccattttacaaaccttaatacacataagataatttatactagagacagaccctccatatgtgaagaatgtggcaaagcttttaaccagtcctcaagccttaataggcagaaaacaattcatgctggagagaaaccccacaaatgtaaagaatgtggcaaagcctttaaccagtcctcacaccttaaatacacataaaataattgatactggagga

SEQ ID NO: 11467 - DNA, 1172 bp, Homo sapiens
atttcagtgtaacaaatatgtgaaagtctttcataaatattcaaattcaaatagatataagattagacacactaaaaagaaaactttcaaatgtatgaaatgtagcaaatcatttttcatgctttcacacttaattcaacataagagaattcatactagagagaatatctacaaatgtgaagaacgtggcaaagcctttaaatggttctcaacccttattaaacataagataattcatactgaagacaaaccctacaaatataagaaatgtggcaaagcttttaacatctcttcaatgttcactaaatgtaagataattcatactggaaagaaaccctgcaaatgtgaagaatgtggcaaagtttttaacaattcctcaacccttatgaaacataagataattcatactgggaagaaaccatataaatgtgaagaatgtggcaaagcttttaagcaatcctcacaccttactagacataaagcaattcatactggagagaaaccctacaaatgcgaagaatgtggcaaagcttttaaccatttctcagcccttagaaaacatcagataattcatactggaaagaaaccctacaaatgtgaagaatgtggcaaagcttttagccagtcctcaacccttagaaaacatgagataattcatactgaagagaaaccctacaaatatgaagaatgcggcaaagcttttagcaatttgtcagcccttagaaaacatgagataattcatactggacagaaaccctacaaatgtgaagaatgtggtaaagcttttaagtggtcctcaaaacttactgtacataaggtaattcatactgcagagaaaccctgcaaatgtgaagaatgtggcaaagcttttaagcgtttctcagcccttagaaaacataagataattcatactggaaagcaaccctacaaatgtgaagaatgcagcaaagcttttagcaatttttcagcccttagaaaacatgagataattcatactggagagaaaccctacaaatgtgaagaatgtggtaaagcttttaagtggtcctcaaaacttactgtacataaggtaattcatatggaagagaaaccttgcaaatgtgaagaatgtggcaaagcttttaagcatttctcagcccttagaaaacataagataattcatactggaaaga

SEQ ID NO: 11468 - DNA, 1889 bp, Homo sapiens
tattttatgaattaacagttttttccgagaacatagattggactataaggggcagacatttgccttaataaggtgatcacacgtcaacttactgtgtggactagatgagttttagggtgtccttctaatccagagagtatgggaggtatttagcatgatttatatagtaagtcttggcagttgaattttcggaaactttgagttattactgtttattttgctgtttaacgtttttagcatgatgcactgaggtgttgtgaatcctgaatcagcaatgttcaaccaactagggggagctcaatttacaaatagtatcttgtgatttcataccagtatgataggtggtggttcacttcatttcatttttaagattttatatgctagcaccgccaatttgactatttctgagacccagtgagtgccatatttcacatttttagaatttgattttttacctgtgaatccataaagggctatttcctgatatatactcccttcgggatactcatctaattgtgttttttaaccttctgtttgtcttgcagtccctgcttctgtttgttattcccacacagacatcaaggtgcctgacttctctgaataccgccgccttgaagttttagatagtacgaagtcttcaagagaaagcagcgaggctaggaaaggtttctcctatttggtaactggagtaactactgtgggtgtcgcatatgctgccaagaatgccgtcacccagttcgtttccagcatgagtgcttctgctgatgtgttggccctggcgaaaatcgaaatcaagttatccgatattccagaaggcaagaacatggctttcaaatggagaggcaaacccctgtttgtgcgtcatagaacccagaaggaaattgagcaggaagctgcagttgaattatcacagttgagggacccacagcatgatctagatcgagtaaagaaacctgaatgggttatcctgataggtgtttgcactcatcttggctgtgtacccattgcaaatgcaggagattttggtggttattactgcccttgccatgggtcacactatgatgcatctggcaggatcagattgggtcctgctcctctcaaccttgaagtccccacgtatgagttcaccagtgacgatatggtgattgttggttaagagacttggactcaagtcataggcttctttcagtctttatgtcacctcaggagacttatttgagaggaagccttctgtacttgaagttgatttgaaatatgtaagaattgatgatgtatttgcaaacattaatgtgaaataaattgaatttaatgttgaatactttcaggcattcacttaataaagacactgttaagcactgttatgctcagtcatacacgcgaaaggtacaatgtcttttagctaattctaattaaaaattacagactggtgtacaagatacttgtgaaatctgtaactgactttattttcttgcccaaatatttgcttcctgctttgcgtcagggacgcagattctgcacggtcattgttgggatgaagtaaaattaacgggtcatctaagtgtctatggcattgacagaaacagtagtatctaggtattccttatttaccggacttggtaagagtcctggctatgcatttcctccctactgtgtaagccgtgtgataatctcaacactaatctgtgggaaagagtcctgaatgaggcattagtagctctgagggtttatcttcacgtctggtctgctggtttttctccttaagtgacaggccaggaaattttattagtcccttatgagtgtaaattagtacttaatcctttagtcttaataggcagtgatgggatattacctgagagaaactttccaaaatgagagtgctctgccatttc

SEQ ID NO: 11469 - DNA, 1208 bp, Homo sapiens
attttggatgcattataaattgagactgttagagattggctttggtgctagtgccatcttttatttcctttcaggaaatctatcctccaaagttgcaccagtttgcgtatgtgacagatggagcttgttcaggagatgaaattctcaccatggaattaatgattatgaaggtgggttccagtgaattttccggccattttttaaatgcgtacggcagatcttttccacctgaagtgtgagtgcctctgggaggtgttctccagctggacacattgtggcatggaacatggctgcattttgaacttcttttctcaatcatcggtctcttttctctctgttttcctttaggcccttaagtggcgtttaagtcccctgactattgtgtcctggctgaatgtatacatgcaggttgcatatctaaatgacttacatgaagtgctactgccgcagtatccccagcaaatctttatacagattgcagaggtaagtggctccatcacgtccgtggggccaccttccctgcagctggagtgaggaactctagaataggcgtgtggtggcatccatctcagcgttcttttcttctccgtagctgttggatctctgtgtcctggatgttgactgccttgaatttccttatggtatacttgctgcttcggccttgtatcatttctcgtcatctgaattgatgcaaaaggtttcaggtaagttggctttccagtgcatgcacaaacaaggtgtactaagcttacatccagttgtcagcctcagattaagcccacgatgtcttcactgcagggtatcagtggtgcgacatagagaactgtgtcaagtggatggttccatttgccatggttataagggagacggggagctcaaaactgaagcacttcaggggcgtcgctgatgaagatgcacacaacatacagacccacagagacagcttggatttgctggtcagtgctgctccttctttcagtccttcttggccaaattcttaaaactgcctaaataggccagccgcggtggttcaggcctgtaaacccagcactttgggaggccgaggtgggccgatcacttgaggccaggagttcaagaccagcctggccaacatggtgaaaccttgtctctactaaaaataaaaaaattagccggctatggtggtgggcacctgtagtcccagctactcgagaggctaaggcaggaga

SEQ ID NO: 11470 - DNA, 1310 bp, Homo sapiens
ctacttgggaggctgaggcgggagaatcggttgaaccctggaagtggaagttgcagtaagccgagatcccaccactgtactacagtctggatgagaaagcaagtctccatcttgagaaaaaaaaaaaatttaaaaattaaaaaagaaaaagcctatggtaattgaagcccaaggatatgttctactctaatgtgttgtcccttttattcttaccaacaggacaaagcccgagcaaagaaagccatgttgtctgaacaaaatagggcttctcctctccccagtgggctcctcaccccgccacagagcggtaagaagcagagcagcgggccggaaatggcgtgaccaccccatccttctccaccaaagacagttgcgcgcctgctccacgttctcttctgtctgttgcagcggaggcgtgcgtttgcttttacagatatctgaatggaagagtgtttcttccacaacagaagtatttctgtggatggcatcaaacagggcaaagtgttttttattgaatgcttataggttttttttaaataagtgggtcaagtacaccagccacctccagacaccagtgcgtgctcccgatgctgctatggaaggtgctacttgacctaagggactcccacaacaacaaaagcttgaagctgtggagggccacggtggcgtggctctcctcgcaggtgttctgggctccgttgtaccaagtggagcaggtggttgcgggcaagcgttgtgcagagcccatagccagctgggcagggggctgccctctccacattatcagttgacagtgtacaatgcctttgatgaactgttttgtaagtgctgctatatctatccattttttaataaagataatactgtttttgagacagctggttttatgagctatgtctggtaacttaaggtagcagtcagctttaattgtggttatatcaacttctgttttttgacttcatacttcttgaggctcaagtctttcttttttttttttttttttttttttttttttgagacagggacagggtctcgctctgtcaccaaggctggagtgcaggggcacaatcttggctcactgcagcctctgcctcccgggtttaagcgattctcctgcctcagcctcctaagtagctgggactacaggcgtgtgccaccacacccagctaatttttgtatttttagtggagatggggttttgccatgttggccaggctggtctcaaactcctgacctcaggtgatctgcccatctcagccttccaaagtgctgggattacaggtgtgagccaccacacccagccttgagtc

SEQ ID NO: 11471 - DNA, 1258 bp, Homo sapiens
cctggagtttaaagtatcctgtcacaaggcttttgcacgttactgtagtaactagatttccttgagtaaggatggtaaatggaaatttatcatttatgtgttgcatttcgccttataaccagggtgcattgtggccatttcttatgcatttttgaagctcttctcacaaccttgaatgtgtatgcaggttctctggggctcttgttgaaatacagattctgattcagtgggtctagggtgtccttagagcttacacttctgaagtgttccccaaggacgccagtgctgttgatccatggaccacactttgagtagcaaggctgtaagagacattcatccttggagttctgtttggcttaaaaattgtgacccctctgtttcaatatttcccttgccccaaaagaaagtctcattaagtctgggtttgtgccttttttatgttggctattaacagccacgtcttttcctttttctaaatagcaaaacaccgaattgctcataaaccgcattccaaaccaaaaacttcagatatttttgaagcagatattgcaaatgatgtgaaatccaaggatttgctagctgataaagaactgtgggctcgacttgaagaactagagagacaggaagaattgctgggtgaacttgataggtacttgatgacaaattatctttccaagataatttgtttctatacacatttcctcattaatctttttcttcattaataaaataatatgtgttcattgaagaaaatgcagggaagcataatatattatcaataatcctttcacctcaagatgaacattaattctctggaatattttcttataggattgtgtgtttgtgcatattcccatgcatgtacatgtacttaaatacttaagatcaacatcttcattttttattatggcctattttatataattaattataccagatagttgacttttaataatcatggatttaatatatataatgttaaattttaaatgaagtatttttatgccacacccaggatagtgctctatctttgaatgtgttgtgaaaaacaaaaatacactttgaatttaaatttgatacagtaaaatgtttattcttgctttccttttataaactttggagcaggtaatttgtaatctggtcagatagctatatgtatgagaaactttacgaaattgctgtttgaaatacacattagcacacacttagaattgttaaaatgctaaatgaaatctgctactcgagaagttctatatta

SEQ ID NO: 11472 - DNA, 3225 bp, Homo sapiens
tttgtttcagtggtggggcaaggtagaagaaggtggctttttaaattatttaggtgttacgttgttttaactaattttgagcacttggtagacagaggagaacaaaatgtacattaaagttcacctgtcaaattttcatttgtagagggaaggatggaggttctaaataccagcaatcttaaaaaaaaaaaaaaaattaactccttgtgtcttacctatttttgtataaaacgacatgtacagatatttccagcaatttatgcacattctttaattctgttccagttgaacatatagttgaccagattaaatgcagcaaacatccaggtgaaattgagtcatttctttttttgtggaacttctgatttctgtcattgagttaattatattaaaattttgaaacctgtacttattcctactagtatcagcacttttatttttcaacttccactgatcttttaaaattgaggcaatatgcagtaaaatatttaaataattgcataaacaccaccaaagagatatcagttagaaatgtcagtactggtgaaactaagctattggctagcaggcagcaaggccatcataggatagctcattcatcaactgatgtacaaaagtcagagtttgacaccctaatagcatttttattttaatacattatttttcacagcatgggctggacatgaatggaatgtatgaaagtttgaagaccttttatttatccatttcttttttttcccagataaaatttacattttacattttgttttcttgcatgtatactgtaaaaattacttctgtttggtggtgaaattaaaacttaatggtgttggtttctctgaacaattagtattttggtgtagtagtgttgtctagccaaaaatctcgtgaatttacttttaatgaaaagaattgccaaatgagtgaatgggaagattttgtgggtgtcttatttgcattttattaccataacctgacttttgttttctaggctttttctggaactgttatagaaaaagaatttgtatcaccttccttaacaccacccccagccattgctcatcccgcactacccactattccagaacgaaaggaagttctgttggaagcatctgaagaaactggaaagagggtttcaaagtttaaagctgccagattgcaacagaaagactaggccctgtctaggaaatgggaatttacatcctaaaacctagttgttcatttgtttagagtatctatagcaaaataggttacatgtagtttgaaataaggtatcctgagttactttggcaacaagttcttttacccttacccgtggtatttgaaaaaaatcaaggtaactgtctgaatactttaatatcagcttgttttgtgaattctctgaatactgtcaacactcttatctaagtttgcctttatgatgcagtggcagcattttgaattacttttcaaagaatactgttcatatgcattgtttttgtgtttcaaactaaatacaggcagttttgtgccagctgtgatattgtgcataccatatggaccattttaaagaaaattttaaaatttcaaatagattcaacaattacattacttgctttcacattttaaaggcactttaaaaaaatctacttctcttgtaggttttgcggctagttggctattcaagaaacctcgcccctctgaatgtcatactgtaatctttaaggaagaaagctacatgaattaattgtactctatgggaaaatttctttggaaagatattttgtaaaacttttttttccaagtaaaaactttatgaaacttggtctcaaaaatgttgtgaactttatgattcaaaattgagtacagatatgtccttgattcatatgtatgctacatgtatcacacaacagatctggaattctttcagttcctcagatacttctcccttagtttttgcagtttcactgggattatgttttgggaaacaaggaaaggtctagatgcttaaacattttaaataaaaattccttacagtttcatcttcccaacattttcattctttaaggctactttcctactaactgaaataacacatttacttttaccacaattcctcaaaataaatttattctaacattgaaaataacattacaagttaatcattagcttgatgcatgctaaaatgtagcttttaaaaagcattctgcattagtactaaaataagccatcaatgccagtccaccctctctattcatggctaaatatttaaaggttatttatagcttctttaatgaattcttcttaaacaaagtgaaattatgtcctagaaaagtagaagctattcgtaactagagcagtgcaactttaaagttttatgaatatgtattttaatgacaagggggcgagcttgcatccccactagttaatggataattcaaaccgaggactgattttgaaagatcacctaaaaatgtagatttgttctttagtaaatttagatcaactatgcatatattttgtaggtaaatctttcagtccatgccccaaccctcaccaaaaccaaagcagaaattacacacacaaagatgctcccgttaggaattgctattcacatgaggctttctgtgctagatttttttctcagaaacaaactttactgtaggactattgtggtgttcttaacagatttgtaatttcaagatgcgtgtcattaaataatttttcatgttcacagacttgattttgagcctgtctatgttacatctttcagataggttttccctcatagaacaagatggtagtagaagcagataaagtgtttgataacacatttttgcgtgttctgctctggagaccatgaaatagtgttgccccatttcatagcttcagtcttataacagagtattaaattgtaatttaaaattatagcttttttatattaaagtttgggacaaaatgaagctgtcttacctgttctgttttaaaccattataaaacagaacagcagaccaagagattctcttttaaactttctattttgaaatataataactttagtctttcagaaaattgcactaaatagtaccaagagttcccatataccctcatttcattcagcctccctcaatattgtaatatagaaccgtaatataattatccaaatcaggaaatttatgttggtgcaatagcgttagacctaaattacagatcttacttgaatttcaccaacttttccaccaaatt

SEQ ID NO: 11473 - DNA, 1218 bp, Homo sapiens
gactctacaaggaagaaatgatcagttttggataattttctttcctgtcccaaaatagccatatgtctgcatgtcttagggactcagctgacacacattttttttaatttgttgcttgctataatgcaaatatgatttcagtcccatagtgaactctacagtgagtccatattataaattaatcagattcaacaaacaccaacatttttaaacttttgaaaaaaatatttaataggaactaagcaaaagaagaaatcaaaccagctgctgacacagctgtttcttttcttgtttaattcagttcaatataaaggtaccatatgctgcttaaaatggtgataggaaagatgaaataatttaagagaataacaagaaaatacatgaattgtcagcattctgtcagatttaaagaatgaaatagacaggtgtagtattgacatgtttaactttgtgtggtgttagcagttttggtgcgaacaactcctgacatgtgctgaagtgatgtgagaacgtttctccttcgctgcagacattggcgaggaggctgggagatctgccggcgtccagcaaccagcgctgcttcgcgacagaagcctgggctcggccatgaaggactgcccgtactgtgggaaaactttccggacatcccatcaccttaaggtgcacctgaggatacacacaggtgagaagtctgagtgcatccaggggcacagcccagagaaggaggaggtccccgtcctgcctgctttctggcccaggtccacagctgtgtgggtcactaactctggaaggttctccctgggcctgtctagccaccattgtatggctcagaagcggccctcatttcctgattcgtcacttaactaacattcacctcgcaaatgactcagggactcgtaaatgtagacttggatggtcctggcctgggataactgggtcgcgtctgagcctctagggcgttttgctaatggtttccttctgctgtattgaaggagtccctccccaggcgcctgtatgaaccaggagtctcccaggtgtcagtgatggggtctcagctcaaaccttcctaagtgcagaagggaatgaagccacttccccaagcatccaggtagaataggctttagcccagcctgtgttacatgcccagacctgggacagggcagctggagtccatcctcgtcactccatgtggcgtggtggaaaagtgactcttccctg

SEQ ID NO: 11474 - DNA, 1149 bp, Homo sapiens
ttcacaatttcaaagatttggggagaaaaaaaacaaatttgtgattttagtaataaaactgcagctatatttggtataagaaatactctcaagaattgtatcagtcattggctttacagagtgatgtttcacagtaactggaggggtttcacatgccttgagaatggctgtgctcctttaatcaaggaataggagtctttttttttttttcttggcattgtgcaaaagggagggagtacttttggtcctgctggatgctgaaggcaaagaaagtgaagaaaaatggagaaaaagatcatcatttccgaagaaataagtgatagaggggagtatcttcatcattagtcttgatagaagattgcattgtaaagagaaattctaaccaatttaaatctatactggggatcgccgggtgtgtggacatggagcttccagcttagaaaatacttagatgagattacagacactaacattctcttatattttccaaattacatgcctgtaattatcctgtaacctggtatttttctgttttacattatcctttttagatatggaagaaagtagcagtgttgccatgttggtgccagatattggggaacaggaagctatactgactgctgaaagtatcatcagtccttcattggaaattgatgaacaaagaaaaactaaaccagatccattaatccatgttatccagaagttaagcaagatagtggaaaatgaaaagtcacaaaaatgtcttttaattgggaagaaacgcccacgttcaagtgctgcaacacactctcttgaaacccaagaactttgtgagattccggctaaagtaatccagtcacctgctgctgatactagaagggctgagatgtcacaaacaaattttacccctgacactcttgcccagaatgaagggaaggctatgtcttatcagtgtagcctttgtaagtttctatcatcatccttttccgtgttaaaagatcatattaagcaacatggtcagcaaaatgaagtgatactgatgtgctcagagtgccatattacatctagaagccaggaggaacttgaagcccacgtggtgaatgaccatgacaatgatgccaatatccacacccaatccaaagcccaacagtgcgtaagcccctccagctc

SEQ ID NO: 11475 - DNA, 1677 bp, Homo sapiens
cttcccattatcattttgtggcaagccttaagttaacaatgtgtctaccaagaacaattgagttttctaaaagtaataatgaagattatgcaattctaactgtagaagagatagctattaaaataatcagtagcctgggcatagtggctcacacctgtaatcccaatactttagaaggccaaggctggaggactgcttgagtccagaagtttaagaccagcctgggcaacacggggagaccctgtctctacaagaaattaaaaattagccaggcatagttggcacgtgcctgtagcaccagctacttgggaggttaaggtgggaggatcacttgagcctgggagatagaggcttgcagtgagccgtgatggcaccattgcactccaaccggggtgacagatgaggtcctctgtttacctccccccccaaaaaaaaaattcagtaggaattccttcatagaataacatgttatttattggtattgacttcttattagacagagctcatagtatttgttttctgctccgaacacttaaaaaatactaagacgtgatagtgaaaatagctttgaaaagaaactacatatggcaaaggtggggaggggggaagatgatgcattctgatcattataaagaatacttttcagggctctatcattttctccctttctctaatcatccagaatatggcgggtgtcccagtgttcaacagtatcatgctaatattccatttgatcggtagtccaagttctttggccagatagtgcaatgttgtgacaccgaccgaagcctttgttctggatctttcttcctattgaaggtggctgctggtggcttcataattttctgttttttttctcacaaagtaaatggtgggcatccatgtttacattgcaccttcccgtgctgtaattggcttgacaaagacaagcaggcttctctgttgagacttattgtgtttttagttttcatagacacttatttaatctttttaaattgtacagcaaggtgctctaagtaatattcgataaaatatatttaatagaaatttgcgtttgatattcatgaacatgaatacatgtatttttttaagaaataagtattgtgtaacactatggcattgcttctatagccaaagtataaaaatttctggaatactgacatgtaaagactacagttaattctgacactgtatcttattaaaataggatgatttgcattttgtaaaattatcctgcacatcaagctgcatgccttaaagcggaaactctaggactgtgttcatgggagagcagttcatctgttcagaacagtgaggcaaggtctgtagtgcttctttaactacctttggaaatactgtacaatgttagaataatttattttgctttacaggagtttgtcatgtattgactttaatattgtattttggtaataaattttttgttaaaaaaaacttggctccaagttctattaaccacaggttgtgttcattcttttcctggaaatgatgactttattgcttagaaagttgtaaataattaaaagcttcccaagagttaaatgaaggttatgatgactcttgataacttgttaatctgttgctgactagcattagactgttacacgaagataaactgaataagcatttagctttttaaatcattttaaaaattaagtc

SEQ ID NO: 11476 - DNA, 1127 bp, Homo sapiens
gctgagattacaggcgtgagccatcgcgcctggccttttattatttttaaatagagacagggccttgctatgttgcccaggctagtcttgaacacctgggctcaagcaatcctcccacctcagtctcccaaagtggtgggattgcacgcgtgagccaccgtgcccagttaattaatgtgtttcaatgagtacttactatatgggggccctcaacagcctcatgataagcatatgatagtagatcttattatggttgagctggttgcatggagtggttgaatccccagcgtggagtccacagagagggcagagcttttacccagtggtaaaagcagagccgggctccccatgcaggcctgcttttaccactgggctttatggcctccaagctccatttgtaattatttctgagctttttctgcccagtcacactaatactgacatttagatcaaaaacaaataataacctattaaaaaagaataaaaacattactgttccttttccctttcaaattgcagaattcaaaaataatggaattgcttcaggtggtaccaagctgtgttgcttcattagatgatgtggctgaaactgaccgcaaggagtatgtcactgttaagatcaggaaaaaatgtaagagtttacgttctttctgtcacgctcaagttgggtatatttagacattcatgagtagttgctggtgttcatttaattgtatatgtaaagtgtaattataatcatgcctggaggagatacaggcaccaaagaaatgtatgttacctcccaatttatcagactatgggtaagctttttttgttactagttttctggttgatggtaatgatgtttcctgaggaaataggatagaaactgtcaacactaccttgaaggttcaggtgtctgcctatggagatggggaacagtctctgggatagtttctttcatgcctcatgttccaaagtcaggtgttctgggcatttcctggacatccagggtaaatgctacctttcaagattttttttttttttttttttttgagacagagtctcgctctgtcacccaggctggagtgcagtagtgtgatctcagctcactgccagctctgcctcctgggttcacgccattctcc

SEQ ID NO: 11477 - DNA, 1162 bp, Homo sapiens
acatttttggtttcccattatccttgtcaggctattttgctgggtgtggaggcctaaagggttggtgggggagagactccagggccaggtgcctctgttcctcatgctgggtgagcactgggacagtgccggagacacacatctcttgggtggcatcctgtgagccgccttctgtctgtggtacctgcctatctacctggtcagggagaggctttgctgtgccattcccctgtgtagttttctatctctttctgtattttaggaggttgaatgatccctcagttgtcactccattctccagagacgacagggggcacacccctctccatgtggctgctgtctgtggtatgtggtcctgggctggcccctaggggctgtcacagcaaagggatggtgcccaaggtgacccagcagagaggcctggctgatgggctgggtgggggttggcagttggggctgcatcgtgggtccaccctccaagggccggaaggagaagaggagcaaacgttccacaggcctcgacggccaccctgctgcctcctgcgctggctgagcccccctgcgtgggtcccacggcatggaaacactgcctaacgctcccgcaggctgggggcccagcaagggaaggcttgaatctgaactatgagaacggtctcagaatcgtcagctcgcagttcttgtggccctgcctttaaaaaaatattattattgtcttttaaagtatacatttggctgggcatggtggctcatgcctgtaatcccagcactttgggaggccgaggcaggcaaatcacttgaggtcagacatttgagaccaacctggccgacatggagaaactctgtctctacaaaacatacaaaaatgagcctgttgtggtggtcacgcctataatcccagcttcttgggaggctgagtcagaagaattgcttgaacctagaaggtggaggttgtagtgagctgagatagcaccaccgcactccagcctgggtggctgagtgagactctgtctcaaaaaataaataaataaataaataaataaataaataaataaataaataaataaaataaagtgcacattcaagatagaaaacataaggtcctccagagtccccggccatccctgtctcccagagatcgttgtgattgatgagtgtctggggt

SEQ ID NO: 11478 - DNA, 1523 bp, Homo sapiens
aggctggtcttgaactcctgaccttgtgatccacccgcctcgctcggcctcccaaagtgctgggattacaggtgtgagccaccgcgcccagcctgtgttttcttattagtaattataaagggaatcttatttgacagttctttgacaaataattcagtttgcagaggggatcctgccccagaggccctggcttggagtggaatgcagggccgtgtgcaggagagcctgctcaagtgccgcctggcttttccctccttaggtggagaccatccatggaaaagaacccccctgatgatacgggccccgtgcacgtgcctttggggcatattgtggccaatgagaaatggcgcgggtcacagctggcgcaggagatgcaaggtcggtggcctgccctctgccagccctttcctcccctgacatattaaaaaaaaaaaatctgcctattattgccatcttttcatccaaagcttatggaactcattttcttctctgtattttaagggaaaattaagctcattttcgaggatggcttgacaccagacttttatctgtcgaacagatgctgcattctttatgtcaccgaagctgatttggtggcaggaaatggctacagaaagaggcttgttcgggttagaaatgtaagtattaggctgggtgctgtggctcacgccagtaatcccagcactttgggaggccaaggcgggtggatcacctgaggtcagtagttggagaccagcctggccaacatggtgaaaccctgtctctgctaaaaatacaaaaattagctgagtatggtggcgcacgcctgtaatcccagctactagggaggctgagacgggagaattgcttgagcctgggaggcagaggctgtagtgagccgagatcacgccactgcactccagcctgggcgacagagtgagattccaactcaaaaaacaaaaaacaaaaacaaaaaagaaatgtaagcattggattaaagaaactcgaacattgatttgtctcaccccacccttccctccatcccttggtatcatttatttaaaatcattggccaggtcaggcacgaagtgatagcattcttaacctgaaaagcaatttggttgcaaaatgacttactgtcttttttcctttcaagtccaataatcttaaaggaattgtagtcgttgaaaaaacccggatgagtgaacaatacttcccagccctacagaagtttactgtgctggaccttggaatggtgctgcttccagtggccagccagatggaagcatcctgcctcgtcatccagttggtgagtaccgattcctacaccttcgtggtagtcctgtcctcatggacactcagctgctctccagaagcaaccatcaatccaatctatgtcattctctgacttggtttataaaatctcttcgaggaatttaaatgcggaagctgcctctgcagccagctcagcttgtcacacactccaggcaagtgtatcacaaagtatacaagttggagacctgattttagattctcagggtgtg

SEQ ID NO: 11479 - DNA, 1180 bp, Homo sapiens
taatattaaagcactgcctagccaaaatagttttttccttttttttgagacggagtctctctctgtcgcccaggctagagtgcagtggtgtgatctcggctcactgcagcctccgcttcctgggttcaagcgattctcctgcctcagccttccaagtagctgggattacaggcgctcgccacaacagccatctaatttttgtatttttagtagagatggggtttcaccatattggccaggctggtcttgaactcctgacctcaggtgatccacccgcctcggcctctcaaagtactaggattacaggcatgagccaccatgcccggccgagccaaatatttttaatcccttggtgagaagatcaaaatatacatgtataggagaataggaaaccattttatgccttagtttccaatgtactggagcataaatgttatagcacaaacttttttcacagttctagaagattgcttgaaaattttaaatgggagagcagtcaggtcagtggtgcggccacttgatggaacagaatgcatgtctttttccagaatgatgtcggggataagcagtcggctgtgaagatgaagatgtttgggaagctcacccgagacacgtttgagtggcaccctgacaagcttctatgtaagagatttaatgtccctgacccttatccagagtaagttggataaacctttacatcagtacaaaatgtattcttgatattaaagctaattttccccttacatactcatataaattcttattttttctacatgaacttatttgcatatcactggatatacaaatctacacattttatagatttgctttgataaattacttctataatttgttactaaaacaaaatctggatagcaaactttattccatattgaagctatgaaactcagatatgtcaagttacaaaagcattatgcctctctcatttgccaccttcttgttgctgctcatgtggtttacatttataatgttacttatgtttttaaattatcattataaaagttaaacactttcttatttgattaataacacttcaagaggtggggtgtggtggtgcacacttgtaatcctagcttgggaggccaaggcaggaggatcgcttgagcccaggagttcgaggccagcccgggtaacatagtaagaccccatctctaaaaaa

SEQ ID NO: 11480 - DNA, 2287 bp, Homo sapiens
aaagcataggaattatgtttttgagatacctttgggcttagattggcattgttttattctaaaaacccaactcagtggtgtagagaaacttgtgtaccaaaattttagtttctgcagatgctagtgtttttttggatacaattttgacaaccaagttagtaaacaaaatatcttaacagtttgatgacacaagctactgatgagggtttggaatattaattcagaaggtagtttctcttgtgttcaaaatagctgccatggggctgttacttttaaagtcaaaattttcttctgaaggctcattttggtatttgatcttaaccaagtgattattagagaaatgtatcaactccatgccatctcccaaaataattgtctaagaaaacttgaaagtgtaaggttttaacctttaatttatttctcttaaatacatcttttgatattgttgttgtgacatttctttttctggttagtgggctttccagactttgtaccactgcttctgtttattcatttatatgcttttgtgtcccataaattatttcagaaaatgctgataaaactcaggatattgacatttttgttgagactaaaaaatggcagtcgctaaagtagggactctagagtctggcttacgtcagtgttggtagtttagattgtctttgtcaacgttttttcttctctcttttgctttcttttctttctctttttttcttagcacagttctagctcaaatttgtgtattttttgtgtgcctgggctggagatgagagactgagtcataactgatttaaaagtttgtgttatcaggtatcttatttgaacatggtcatttttggccacattgctgtttcatactaggacttgggatgatgtagccagaataaaactcaagttgcaccctccggttggtggaagattgctgaccgtgccgtttctgggcaggagaagacatcatggtgtccagcaactcagcaaagccattcttaagagtcgtgaggtccttctgaatgtaaaactggagcccaggagaagctgtcccaggagggctgttaactccctatagagccaggagacaggataggggtttctagggtccaacaccagcttaccttggagtatgaatctacccatgaaggatgagagatgttttgaaaaactagccaggacacacccacaggatcctactggctccttagcagctgattggtgttacataattaacttaattggagatgcattaggtcacttgaatgtataagcaagcacctatggtaggcgctacagacatttaaatctcttgggaattcgatgctcccatggaatttataccagttatatgaattgacttaagtatcttgaaaaagaaactttagagaaagcatcaggggtgtgtactcagtatttcaaatcagaacacaagattggaacttttggaaaaatgggttcaagctttcctattagccatggaaatgcaaagtttagcagaagcaagcaattaggcagagaacaaaaatgttaagcatggtgttgtctatcttattgaagtggttggaaatgaaagcttttaatttgatagatttatcagtataaaattagggaaaccacgtgtggggaatgaatcaatttagagcttcgggaattgtgaggtgacttttgtaacttttgttctgtgtgtgacctgtgaaccactaggatgtgatctgcccttgtgggcaggtccagcatagttaggagttaggctttagcataaatttctagctgcatctgagtctcctgggatgggtgctctttggctggttttggctgcggatggtgagatcagagcagctcttcctgctgctggcccctgcaatcagttgttgggatgccagtgcagatcactaagtagtaagattttaatcaaacacgaccaggtccgaaatgcaggtcatgagtgtgaaattctcaaatttacataaaaagtagaagtatagacagtttaacatttggtattaaaggagaggaaattgtagcagcttttcacgtttcccagtccccattagagggcttgagaccttgtacctgaacaacccattttgcactcagtgctttctgatgccttaggagaattgttttgtttcacaaaagctgggaaggaagaagtccattctgcagctgttagatctgcctctcaggaaaaagtactaacttgttctttttgttcctggctttcatcagtttgtgagatttctctattttttttaaatataattttatttctttcaacaaatataaaataaaaaac

SEQ ID NO: 11481 - DNA, 2062 bp, Homo sapiens
aggaagtatgcctgtattttggggtggggttcaccactgcattaacctctactgactggaagatgcagtcaacaatgaggtactactgagtatggaagttatagaaggagtttcgtggaaatgagtgagacaggtttttctatgaaagtaaaagtgggggagtatatttaaagataatttaaaataaacttgagcaaagtaaaaagaaaataatacaccaataatttggaacatgagctaaatttttttttcttttttagaaagacaacaaagttgctgcatagtctacaaacaagtctctgaaaataggtgaatttctagctcttcatggtcctgaacattgatttcagtctttgcaaagaatgaagaagtgaattcgctgtacatttgtcaccagcactgggtttttgttttttgtttgtttttccgcttaatttcaaagataaaatgcagttacttttgggggtggaaggctcatcttaaaacatgagcattaaatatatttggaatagcagaaggttaagtaatttcttatgtatagttaaactaaagcagtacttcagtgggacttaacaagtattttttcatcactgaaaggttttttttttttatcactaaattgtatttggcaattgcaagttgcctgcagatagggccgtgatactgtgttttgagccacagaaggttgtgtgtgtgtgtgtgtgtgtgtgtgtgtgtgtgtgtgtatgtgtgtgtctttttcctcctttcttttggggaatcctgtaatatgaggtagcttatttcgtcaattaattagggtgctggatggtagagaattttgtcagtcaactatgtacacacagtaaatactgtttcttaggcaaaggtaacttttttatatagttgtaaaattccattatattccattgccaaagaaacattaagaactttgtatagctgtataaaaagcaactaattttttaaagaataaacattttaaagtcagcaaacatactgtgtccttgcagaagttgatgtgctgagcagcagccttatgggtgggtctttttttcttagttttccaggcttaacatttttgattttgttttttaatgtttggaacataaatgaagatttgatacattatttcattatctaaaaaggattaattattcatgctcattgtaagaacttcattttgtagcaaatggcatatcacaggatctgtccagataatcgatattttcagtatacaaatgtaaataatcacagatgagaatgtacttagctgtattttcaaataagtaatcttccccccttttgtaggactttaaaactaggcatcaatgaacctgtttttcctattatgcctggaatttagtcatgataccttgactcattccatcatatttcaagaggattcagagtgctagaaattattttggtagcctgtaacacacggcaacactggtccttgggcctatgatgacccacagatgactcagtatagagttcattgctaattataaattactagtgaatctttttgatattttaagctctagtgggaaaaatctggccacttttgtgtttttatgaaggccatggaataaaaggatccaaagatttaaatatttttatctaatattttgattgttttcttaactttctccttaaaacattcagtagtgataaagatatagaaactgcactgtaggagaattggaatatttaaggctggttgacattttttattttcattttatatcttttgtatagctctacaaggcagtgttttgtaatttggtttcattatgaagatccagtacttggcagccatagtttagacaatattgttcagtgctgtttgcttgcatgttaacaacaaaaccttttagaggacccacaaatcatgatattgaacacagttccgaggcattcagagcatcagagcaagtaccatggcaatacatgtgtagactgttggagatgtcccgggccaatttcaagaaagaaaactgtaaatactagttctacttgctctgaaattatgagtttatgcgttttcccagccctccga

SEQ ID NO: 11482 - DNA, 1623 bp, Homo sapiens
cccagcactttgggaggccgaggcaggtggatcacctaaggtcaggagttcgagaccagcctggccaatatggtgaaaccccatctctactaaaaatacaaaaattagccgggtgtggtggcgtgcgcctgtagtcccagctactcgggaggctgaagcagaagaatcgcttgaacccgggaggcggaggttacagtgagctgagattgtgccactgcactccagcctgggtgacagagtgagattccgtctcaacaagaaaaaaaaaaaagaatatatatatatgtatgtatgtatgtatgtaaacacacacactaatttgagaggacccgtagggtgtctgagcccagccacctgagtttttagtactgtgttgtcaggctcttcccaggcctcaggtgttgtcttttgtgctgtgtggggatgcattgctgcctgtatttatgatcttttgccgtggttctgagcattcacctcaccatgtttacaaagaactgttttgtatatagacattttcaggcacgtgctttgcaccaaccctgcgtggctcttgtctgtgttagctgtcacggtgtgcacactaatctctgttaaagttgtctatggctgttctacttgtaagatagttttctatttccttcagtaatgtgtccacagtaccctgtatttcgagttccattatactgaagtactcatgttttaatagtgcctctccaaaggcctcaccttggacagaggtcaatccttgatgctccagcacaggtgacgtcactaattgtcactttccagtttgtttttctctattaaggaagacattttctaattgcatctccatgggctgtgagactgtgtgaagccgtttgtgtggtctccatgtaggtgctgtgttcccggcaccgccttgctctgaacactggtaattccaggtgctgcgcttggcagaggggtctcgccaaagcgcatgtgtgtgcatgtgtgaacgtgtgtgtcctttgcatggttgggcgtgggtgccttgctagggcatcagcaggacattgtgtgtatagttacaatgcttccaaactggaactctacattttgtatcttttaaagctcctataagtaaaataactattggctttattaaaaatatacatttaataatactttgtatccttgtttaaaatgaactgcagaggacattatgtcaaaagccctgcctgactcattgctttgaaaagctgcatactgagttggtttttaggtcagcctgtcctctgattctagcaaggggaagaccacttgggatattacggtgagctgaagtggatgggcaggagggagaacaagcagctacgcctcccctattggcttccctaaggcccaagctggtttaggcccctgtgcagggggagccagtgcagtagtgaaggagacgtcctctgcaagggtgcaagctctctgggttggggtctaccaacacccatgttccaccaaatgtggatgctgtgacttgcccagccagcttgtccaatgacgagacccaagaatgagggcttgttttaccctcttcccaaaccagggacccaatctatggcagagatactgtgccttacagggataagaaggacctgtctctgc

SEQ ID NO: 11483 - DNA, 2459 bp, Homo sapiens
tatagagttttgtcgaatgaatgaatgaagccgactagtgcacagggagtgcagcggcgcgatggtagctctctgcagcctccaacacctgggctccagtgatccccgggctctgcccaccctccccactgccacttccgggcagaggccagcaaagcggcggcgcaagaggtagggagagaggagctgaggccccagatcagcggccgcgggcaaggtcgctcagcgggcacccggcctgggtatcggggcgcgggtcgggggcggggccggggctcaggggtggggccgggccgggccgggccgggcgcctgcgccataaaggccgccgcgcgcccacgcgcctcgcttgctgcgcgctgccggcgctccttcctcctcggctcgcgtctcactcagtgtaccttctagtcccgccatggccgctctcacccgggacccccagttccagaagctgcagcaatggtaccgcgagcaccgctccgagctgaacctgcgccgcctcttcgatgccaacaaggaccgcttcaaccacttcaggtgcgggcgggccggaggcgggggctgccacgcgcggcgcccggaaccgggcacgcgggcctggggtctggaggcgggggcagcggtgcccggggaccccagtccccgacctccaggccacggactggggcccaggccgagtccgcacttcgtccttggagtctccttggagtgcgttcctgggggcttgcagcctcgccgggagtctcggccccgggtctgcttcgttacgaggaaaaacgggcccctccgtggggacatttcccctcctcctccccgtgcagctctggccatttgagcaggggctcctttcgcagttgtgaagagaggccttggctgacgcagcaagcgggaaagggctgtccctttccatccgctcctggccacatgagcttgggagcgtctgcagggcgggcagcccgggcgggggtgtttgagggagctgggtggaaggatggagacgtcgggcgtgattcctgcagaagacacctgtgcacgaccgggaagtgggaaggagtgtttgagcaaatcatgggcgggagtgcggccaagggagctctgatcactgatactggtggaggcgggggaggggagcgactgtggctccgggctagacgtcccgatggccatccctgtcatctggatgggtgcctgagtaacttacggcagaaagtggaagccctgggaaggggtggtcccccacttcagtccgggctcctcatccagggtctgcctgcatctacggtctgtgaggatggcttctttctctgggctgctgttgcagatcatcctggtgggccagcaggtgacagacaccaccactgtgctgggtggccgcggcccttgtggggcgtgggtcagggaggatgtttcttctgggaacagctcctgcttagggcatggctccccgctagggagaccagggtgtggtcagcagcatctccatctttctgcagcttgaccctcaacaccaaccatgggcatatcctggtggattactccaagaacctggtgacggaggacgtgatgcggatgctggtggacttggtaatgttctgcttggggaggcataactggtaaccgacagagtggtgggtgagctgggctcctgggagtccccaggaccttgagtatcttgagttcttcctctcattagacctcagtcacctcctctgtgctggtgaggcacctgtccctggcttaggttctaagcagcatcccagggaccccagtgtctgatgtctgagtagacccttcccagacagcaggggagggaaccagacagcagccgtctgtctgtctcattggggacagcaccaagccttgtgtttgggggctgacacttggggtggccagtgtgggtgggaccaggcctcagtatcgtctcttcctaggccaagtccaggggcgtggaggccgcccgggagcggatgttcaatggtgagaagatcaactacaccgaggtgagcaggccccacataccctctggggcctccttccttccctttggggtttatctgactgttagccgcatcaccctgtgtcttcaccccttctcttgggcaatgcttttgcttaatgaggggcctgaaggcctttttcctcctgcttgtagcagggctttggggtgtgccttccacaagattggtttggtgagctccttggaatggttcccagtgtctgcctgggaggagcatatctcatacccacagggagagtttctcaaggctgacattttcttggagaagttaactctaatatatcctcaatgcaagttttagtagcgacaagaagaatcttagatcaccaaagacttcagcctactcaagcagtaggagtcaataggaagcagtggtgaggccaggcctgggggcccctgttcctgactcagtatgggagcccagcctggaggtataatg

SEQ ID NO: 11484 - DNA, 1289 bp, Homo sapiens
agaacccagaaagtggagactctgtctcaaaaaaaaaattaaaaataaatagctgggtgcggtggctcaagccagtaatcccagcactttgggaggctgaggcgggcagatcacagggtcaggagatcgagaccatcctggctaacacggtgaaaccctgtctctactaaaaatacaaaaaactagctgggtgtggtggcgggcgcctgtagtcccagctactcaggaggctgaggcaggagaatgacgtgaacctgggaggcagagattgcagggagccgagatcatgccactgcactccagcctgggcaacagagcaaggcttcatctcaaaaaaaaaaaaaaaaaaaaaaaaaaaaaaaaaaaatatatatatatatatatatatggtaaattaaaaacaaaaaaatagaggcacctgcgagggcctgaaagctgggactgaggtaccaggacacggcagtaatgatgtttttgagcagcggattatgcctgggggtttgggctgatggcatcttcgcccctgtgccagcgtgtccggagcggtgactggaaggggtacacaggcaagaccatcacggacgtcatcaacattggcattggcggctccgacctggtgaggagaaaactgccttggggtagggtgggagtctgggcactgttggtcccactcaggtctttactttctccagggatgggacctggctgtctccacttttcgtgggccctgaattcttattctctgatgctatgtctccccgcagggacccctcatggtgactgaagcccttaagccatactcttcaggaggtccccgcgtctggtatgtctccaacattgatggaactcacattgccaaaaccctggcccagctgaaccccgagtcctccctgttcatcattgcctccaaggtatgagtgccgaaaactgcccggcccctggccctgtgtgtgttggggtggggagggacagctgtcttgccatccccctggccattggtcccttttggtgggttccgagtgaaccatggtttgtggatcaggtcagtacagctgccctagactgtttccatgcctagcagcaaataaggttgactgatgaaatcctgaacacatcagtttgaacctttgtgtcctgaccacacccgctcgccttgcggcatctctgctcagcctgggactgctcgccactttcttacaaacctgtcctttatgcctgctccttttcttgttgttgtttttgagacagagtctggctctgtcacccaggctggagtgtagtggcgtgat

SEQ ID NO: 11485 - DNA, 1176 bp, Homo sapiens
catcatgctgtcctcacaggctgctggcctctctgcagctggctgggatatttatttcatgtccagaaggaaggtctgggtttttttgcgtgtgcaagttggcccccgtctttgcccctcacaactgcagtcctgtttctctcctatcctaggcagagtcagatccctgcactcagggccacctctcactggaggggctttgtctaggtccgagtcctcccatgtcgtatcttctggctctccatgcagccttccttcgttgcagaaggagctgtgcccactgcccacaggacgcagggtgtggccacttctgttgactctgcttttgtgtcacaggttttgacaacttcgagcagctgctctcgggggctcactggatggtgagtgctgaggctggttctctgccaagtgctggccagaggcgcgtgtgttggtcctggtcccccgctttctcccccactgtcctgtccctcccctccccgtgcagctgctcagctcccactcatcctgctcctgtttcaggaccagcacttccgcacgacgcccctggagaagaacgcccccgtcttgctggccctgctgggtatctggtacatcaactgctttgggtgtgagacacacgccatgctgccctatgaccagtacctgcaccgctttgctgcgtacttccagcaggtaccagctgccaagccaggccttggagtcagcaagatttgtggggggtctgggaggtctaggaacctgggtttcagctcctccaggagctctttgccccattgcccttgggcctggccaaggtccatctgtgctccttgtctcaggatgaatctttgtaactgaggttggttccatttgagtgtcatctgagtttgatcaccatgggaggggcatgactggtgatcatggtgccctggctagggaggtcctggcttgactcaggggatgtttctcagctggggtcacttctttcttgcacatcactatgcatgcctaccatagtgtctgaggacgtaggatctagccctggtatgaggccctaggtctgttagtatctggggaggaaggatctggtacaggtatgaggacctgggtctgtccatgtctgaggaggtgggatttggccatagggtggggctgcaagctggaatcccttatagcctgcactgcctttatccc

SEQ ID NO: 11486 - DNA, 4641 bp, Homo sapiens
atgcgccatcacacctggctaattttgtatttttagtagagacagggtttctccatgttaatcaggctggtctcaaacttccaacctcaggtgatccgcctgccttggcctcccaaagtgctggaattacaggcttgagccactgcgctcagcctctttctttctttttaaatgttctttcattttgccaagaactgggtttctgttccttttccagggcgacatggagtccaatgggaaatacatcaccaaatctggaacccgtgtggaccaccagacaggccccattgtgtggggggagccagggaccaatggccagcatgctttttaccagctcatccaccaaggtaggcccctgtggcctgggaagggtgatgttgggggagggaaaggatcttccagaagagatatctcacttaggtcagtgccctcctctaggccatatggctagctcccatgggctggggtcatgtgggtgaccacagtgcccttcacaggcaccaagatgataccctgtgacttcctcatcccggtccagacccagcaccccatacggaagggtctgcatcacaaggtaagagcccccatctggccccatctggggggtctggctcacattgcacccagacctctgaaaacctggtgcattggttggcaatcacgttagttttctattcctgccgtaacaaatgataacaaacatggaggcttaaaacaacactcttcttttgtggggtggggaggggggacagagtcttgctctgtcgcccaggctggagtgcagtggcacgatcttggctcactgcaaccttcccctcccggcctcaagtgattcttatgcctcagcctcccaagtagctgggactactggcactcaccaccatggccagctaatttttgtagttttggtaaagggggggtttcactatgttggccaggctggtcttgaactcatgacctcaagtaatctacctgcctcggcctccctaagtgctgggattataggcatgagccaccttcctgggctatctgaagagtttctgaagctcaaatatccagcaggccctgatgtgtctctgcttagagtcttgcaggctgaaatcaaggtgtcatcaggactgtgtttctttctggagaccttaggggaaaagcctttgacctgcttgtcaggtggttggcagaattcatttctctatggttgtggaactgaagtccagcttccttgctgtgggctgaaggtcgttctcagattctcagaggtcacctgcatcctctagcttgtgggcctcttcactgcagaaccagcaatggcaggttaaatccttctctgaagctttgattctgtcttgccacttctgttgcatctctctgacttgtttaccttcctcttctacattttgcttttgttccctaagtgacagtgtcatgctgtgttgtctaggctggacttacagtggcatgatcacagttcactgtattctcaacgtcccaggctcaagcagtcttcctgcctcggcccctcaaatagctgagacttacaggcactaacaggcacttacaggcacttacaggcactaacagcctggctaactgttaaactttttgtagaggccagatttcactatgttgcctaggctggtctccaactcctgggctcaagtgattctcctgcctcggcctcccaaagttttgggattacaggcatgagctaccgtgcctggccctcttttacttttaagggccagtgtgattagattggggctactagataatccaggaaaatctccccttttgtttattttatttatttattttattttagagatagcatgtcactctgttgctgaggctggagtgcactggcccaatcatagctcactacagccttgaactcctgggctcaagcaatccttttatctcagcctcctgagtagctgggaccacagatgtacaacatgcctggctaagtttttttttttttttaaagagacagagtcttgctctgttgcccaggctggggtgcagtggcacaatcaggctctctgcagcctcaccctcctgggctcaagcaatcctcctacctcagcctcctgagtagctgggaacaggcacacgccaccacacccagctgatttttttatttttattttttgtagagatggagtctcagtatgttgcccaagctgccctcgaactccttcagagaatttactgtgctttgtctcaggtgtgcagagcagcacagggttacggtagcacaatcttgggagtcagtgagctggattgaattctgattgttcctgtctatagttctgtgatccagcactgtggacttgtggaacccaaggctctactagaacagggcgatgatgcctttcctccttaggatcttagtattatttttttttcgagacaccgtttcactttgttgccccggctggagtgcagtagtgtgaccttgactcactgcaacctcagcctcctgggttcaagtgattctcgtgcttaagcctccggagtagctggaattacagttgcacaccaccacgcccagctaccttcttaggatcttaaaagatagatgttggtaaaattgtgagcaggacccctagcaagtggtgtgtagttctttttttttttttgagatggagtctaggtctgtcgcccaggctggagtgcagtggcgtgatcttggctcactgcaccctctgcctcccaggttcaggtgattctcctgcctcagcctcctgcctgatgacaggcatgcgccaccatgcccagctaaatttttttttggtatttttagtagagacgggtttcaccatgttggtcaggctggtctcgagctcctgacctcgtggtccatccgcctcggcctcccaaagtgtcgggattacaggcgtgagccaccgcgcctggccactggtgtgtagttcttaaagagcagttatcactgttccctgccttgtggtgtcatcggatgtgtccccctcgctccaactgagctgtacagcgagtgacccaggctgggactgacccctgctgagaagtaccaggcggtcttgtccctctgcctgaagcccagacagtgctctcaagcataactgatgtctcgctcatcagatcctcctggccaacttcttggcccagacagaggccctgatgaggggaaaatcgacggaggaggcccgaaaggagctccaggctgcgggcaagagtccagaggaccttgagaggctgctgccacataaggtcagcacttctgcatttggctttggggtgcatgctggagttggaggtgtgaagctatggcaccaggcaggggcttggggcgtgcctggcttgtcctacagaatgggagggcctgtcctcacagacctgcacgtctcagcctctggggcagggtgtgcttcccttcaaggggtttagggatcaggactctcttggagacattccttggtgttttctgcaggtctttgaaggaaatcgcccaaccaactctattgtgttcaccaagctcacaccattcatgcttggagccttggtcggtgagtgagtaggggaaaggtcctggcttggggtaggttggaatgggcttgtggagccctgatgtgccctgtctgtcacttctgcagccatgtatgagcacaagatcttcgttcagggcatcatctgggacatcaacagctttgaccagtgggggtgagttgctcacttaggggagggccgggaatacctttgtgtcggctcagggatttcagtagcaacgttagagccttcctcataccactcttcccttcccttcccttcttggcagagtggagctgggaaagcagctggctaagaaaatagagcctgagcttgatggcagtgctcaagtgacctctcacgacgcttctaccaatgggctcatcaacttcatcaagcagcagcgcgaggccagagtccaataaactcgtgctcatctgcagcctcctctgtgactcccctttctcttctcgtccctcctccccggagccggcactgcatgttcctggacaccacccagagcaccctctggttgtgggcttggaccacgagcccttagcagggaaggctggtctcccccagcctaacccccagcccctccatgtctatgctccctctgtgttagaattggctgaagtgtttttgtgcagctgacttttctgacccatgttcacgttgttcacatcccatgtagaaaaataaagatgccacggaggaggttgtaggctcagcctctgattttttttttcctgtgatggtgctttatgtagcagagggcaggagcgctcagcaggacgcaggctgtgcctctgcggacacttaacactaagtggtgagcgggtctagagtggagcaaggtgccctgagaagacaatagtggggtgggggcacaatcagtcaggacggcaacttggcctgtgtcaccaaatcccaagactgttttccactcctcacctctgtgactgcagaaattggatactctgttcactcgatggttctaaaaactgcattgagattatgtttgtttcgggtgaattcctggacaagaccgaggatgactgccatctcctggcaagacgctcaggtagttcttttgctttaaaaggcagatat

SEQ ID NO: 11487 - DNA, 1182 bp, Homo sapiens
tcctggcttcaagcagtcctcccacctcagcctcccagaatgctgagattatgggcatgagccagtgctcctggcgtgaaattactctcttaacctgactcatcttttttccctagccttaaactactttaatagttccaagttgatattccacattctgccttcatttctatcatgtattatctgctagttatattagaatagtggtgagtttaggaacaccttgaaacagtgttttgtgtaaggtacagcaatagaagagaaatatggcacgttggatttttaagattatgtgtttctgtgggtacttctcctggagtaaatttgtgatataaattctatttgatattttgctaagtgaatgtctcttaaatgtctgtaattaacagttgtattattctggccatagctataagaaaattgtacaaaaaatgaagccagtaagatagttttgagtctgtgtcatcctaattaaagataactaattttttttttcccaaaaactcatactgtttgttttacttccagctgcccgaaaccatgttaatagaatgtgcctggcagctgatgttcctcttattgaaagtggaacagctgggtatcttggacaagtaactactatcaaaaaggtaaagaaaagttttatttttttaacttcccaaatatttatttgagaccttggagcaggaggaaataaactttgtatttatataaaatgaacaggtgaacatccaaaatgtaaggacttttatgcttatataaaacttaaaatgcggggccaggtgcagtggctcatacctgtaatcccagcacttcgggaggccgaggtgggcggatcacctgaggtcaggagtttgagaccagcctggcaagcatggtgaaaccccatctctactaaaaatacaaaaattagctggacatggtggccggcgcctgtaatcccagctacttgggaggctgagccaggcgaatcacttgaacctgagaggcagaggttgcagtaagctgagattgcaccactgccctccagcctgggctacagatcaagcctctgtctcaaaaaacaaacttaaaatgctataaacgtgctcaaaagactatgggcaaggaaatctttcagctctgccattttgtttcatttgacttttgtattaaaatccttagagtggtaagcatgatata

SEQ ID NO: 11488 - DNA, 1249 bp, Homo sapiens
gccaaaaagaaacgtatatcaataaaatgaagagtatttggtttagtaacacctaagatttttctgtgtagggagatatatcttgaaattaatcttgtagtttacttaatttcaggagattataaggatatggctgtattccccagacccacttagttttgctcaaaaaaaaaaaaaaaacacatataagaaaatggctgcgaataatatttagataacatttacaactttgagaaataatttcttggaaagctgctgtttgtctttccagtagtttttctgtttagtgtgatcaaggtaaactcatatttgacactcaggtgtagtaatttttatttgggcttgtaagtcatgttcactgaaccaggagtcggcgtcctggcacagccttagctatgactggtagattcagttagcttttgtgttagtttatcataaagtaagcattttggagtcactaatattttaaaatttccttgacaacgtaaaacgtagttggaatatagatgaatgaagtgtttatattaccttataatgttgagaaactgccatcatggagtaaatttttctcatatcctgacttcatagggtgtgaccgagtgttatgagtgtcatcctaagccgacccagagaacctttcctggctgtacaattcgtaacacaccttcagaacctatacattgcatcgtttgggcaaagtacttgttcaagtaagagtgtatatttcttggcatgcttttcggtactgatgatggaaaatggagtcatttttatttaattaccttgaagagattgaactcaggatgtttaaatatggtgaagggatgctttagtagctttcttgcagtatttcttaggttaaatgtagctggccgggtgcggtggctcacacctgtaatcccggcactttgggaaactgaggtggtcggatcacctgagcgcaggagtttgagaccagcgtggccagcatggtgaaacacatctctactaaaaatacaaaaattagttggccgtgatggcgagtgcctgtaatcccagctactcgggaggctgaggcaagagaattgcttgaacccaggaggtggaggttggagtgagccgagatcgcgccactgcactccagcttggcaacagagtgagaatttgtctcaaaaaaaaaaaaaaaaaatgtggccatgactgttcaggaaacttagtcttatattggagacagccatgtaactaagcgataaaaatctttatatttgga

SEQ ID NO: 11489 - DNA, 1182 bp, Homo sapiens
tgttcatgtttctgtgggttatttttggaggggagggcacattttaaagatatcgcagttcagaagttctgttgtgaagcactttagtttaaaaatctgtatactttgtgtgcatgtccccatgagcttggaggcattgctgactggcatccctaggctcagtgattgtctgtagttgtacatttatttacaactacataatgtacatttatttgtatgattgtgcttcagactgatctttggagctaaatttagggaagcttttggagaggtgacttaggaaggcaggggcagtcggcagttcagggctcctttactctgcattcctcagagcacttctgcatttcgctgttttcaatgtagagattctgttagaacttccttttacaaatgtttttccttttgaaaattgttatgctgctggtatatgacatgtatctttaaatcagatttcatagtgtaatatagatcagcaatgacgttttcttgtatcttatcaattagggattatggggttcatgggatctgtctttcttttgtaagctttttaaagatgacatcaggtatctgttgacaatggacaaactatggcggaaaaggaaacctccagttccgttggactgggctgaagtacaaagtcaaggtaaagaatacattttagtcttggaacacctaagctggaaatatcctcgcgtaaagtctttgtatagccctgttgttgcttgaaaatgatatgtcttcatatattcaaacagtgcaaaaaaatatgaagaacaaaagtcactgaagtcccacacttcagaaatagccactaataacattttcaggagtgttctggtggtccgccctatgtacacagatgcaggcattcgttatacactgcgtaaatggaatcatactattgataaactctcacttgcttttgtcagtcagtatagttaactagtctcttattaacatgtagtgtttttgtattttccctgaaataaagttttgaaattgctatatatttatgtatatcttttttttttttttttttttttttgagaccgtgtctcgctctgttgccaaggctggagcgcagtggcacgatctcagctcaccgcaacctgggttcaagcgattctcccgcctcagcctcccgagtagctgggataacaggtgtgagccactgcgcctagc

SEQ ID NO: 11490 - DNA, 1112 bp, Homo sapiens
agaggatgtagaaatctttttttggcattgtagctaaagaaataatgtccaagagttgctttaggccaccaagctttggacccagttttatgcttcagcaataaaagttatttactgttttaaagaaacaaaaaaccaaaaccttgccctgatttgaaagtgcatgtagagtttttgattatcacagaaatttgttgtgtaccgtcttttttattataagttcagtgctttgaaaattagaatccaaggtgggtatggttggctcacgcctgtaatcccagcactttaggagaccaaggtgggaggatggcttgagcccaagatttcaagaccagcctgggcaacattatgagaccctatctctcatttttttttaaataaaaattaaaaaaaaaattagaatccacatatttggtgtatacatagtgtatgctttgaggaacaacaggatttctctggtgctcctttgctttctaaatagtcatagcagtgacctgtgtgattctcctacagtgaagacctaggaaaggacgttgaatttgaagttgttggtgatgccccggaaaaagtggggcccaaacaagctgaagatgctgccaaaagcataaccaatggcagtgatgatggagctcagccctccacctccacaggtgagtatggccccagccagcaggttgttaaatacccacaaagcagaagtaaaaacaaactgattattaggaacattgaccataaatccataaaactactagaggtgtgtattggtttggtattgattgttgtaatggagctttgaatttatgaaccatgaagacatttaaggctgggtgtggtggcttacacctgtaatcccagcactttgagaggccaagatgggagtattacttgaggccaggagttggagaacagcctgggcaacacaatgagagacccccatctctacaaagaaaaaaaaaaattaaccacgcatggtagcgtgtacctgtagtctccgctactcaggaggctgaagtggttcacttgaacccaggagttcgacactgcagtgagccatgattgcaccactgcactgcagcctgggcaacagcaagaccatgtctcaaaaaaaaaaa

SEQ ID NO: 11491 - DNA, 1480 bp, Homo sapiens
cctctgcttttctattggagaatgtggaggtagaatcaaggatgtgtaatgagtactttgagttacataatgcttgtcacaattttttgttttgattagaaaataaataggttcttatataaaacatttaaaacagtatggaaatacgtaatgtgtaaagtgaaaatgcagccattcttaagtctggtgtgtattagaagagtcagctttcaattatagaaaatacaggtgagcacaggtaactcccacgcttttacccattttctttttcccttttttctgaaataagctcaagagcaagatgacgttctcatagttgattcagatgaagaagattcttcaaataatgccgacgtcagtgaagaagagagaagccgcaagaggaaattagatgagaaagagaatctcagtgcaaagaggtcacgtatagaacagaaggaagagcttgatgatgtcatagcattagattgaacagaaatgcctctaaacagaaccctcttactatttagtttatctgggcagaaccagattgttatgtcctttgttccaaagggaaaaaattgacagcagtgacttgaaaatgattctgctccctttgaaagcattcattttgctagaactgttagacacattgcagtatgctgtattgaaagtaggaatatagttttaaaaaccctttgaacaaagtgtgtgcataaccagtcatgagataaaacaacacaatgcatgttgcctttttaatgtaaatacccgtaggtatcattaatagtttcaaaatattgtggtttagtaaagttgatacctggttataaatattatgcctttatttttggctagaagaagaattatttttagcctagatctaaccattttcatactcttaactgattgaaacagattcaaagaagtatcgagtgctatgcattgaaacttgtttttaaatgttagatggcactatgtatattaatgtaaaacaatgttaatttactcaagttttcagtttgtaccgcctggtatgtctgtgtaagaagccaatttttgtgtattgttacagtttcaggttatttatattcgatgttttgtaaaactcaaataacgactatacttatggaccaaataaatggcatctgcattcttgttacacatgcctgcacagttcctgtttctgctgccttatatctactgcaggaatgtcaaattcttttcattaaaaaaagaactcggtcgggcacggtggctcatgcctgtaatcccagcactttggaaggctgaggcaggtggatcacctgaggtcagtagttcaagaccaacctggtcaacatggtgaaaccccatctctactaaaaaaaaaaaaaaaaattagccgggcctggtggcaggcacctgtaattccagctactcaggaggctaaggcagcagaattgcttgaacccgggaggcagaggttgcagtgagccaagattgtgctattgctactcca

SEQ ID NO: 11492 - DNA, 1185 bp, Homo sapiens
agcgccgtgggttccaagctgagctgggtcggccctgcagcgccggagagcaaggcggcgcagggaagggagatggggcgggatgtggggaaagctgtcgactgcttggatctctccggcccggatggcgccagctgcctccagctcagcctgcggaaatccgagctcttcccagcggcccgacggcccgggcgccccgcagaccctgggctctccccgcggtgcctccgccgcccgcccctgcgtcctggcccggcctccacgcccctccgaggtcccggcgcagcgcggccgccgccactccccccacattccagaggccgcagcgccgtctccttcctcgcattcctgcccccgcaaaggagtccctccgccccgcgcgaggccgcggcgaggagggggcgcggcccggcgcctgggagcttacattcctccgccgcgcgcgccgccgagcagggcgccgcgtcccccggcccgcgcgtggccgccggaacgaccccggcccggcgccggccccgccccgccccgcgcccaggggtcccggggcgggctccgggcttcgggcggacgatgcggcggcccggccggagcggcggcgggaagcggaggcggaggtgacgcgccagggccggcgggccgggccatgcagcgctccagggcgggcgcggacgaggcggccctactcctggccgggctggccctgcgggagctggagcccgggtgcggctctcccggtcgggggcggcgggggccgcggcctgggcctggagacgaggcggcgcccgcgctgggccgcagagggaagggcagcggcggccccgaggccggggcggacggactgagccgcggggagcggggtccccggcgcgcggcggttccggagctcagcgcgcagcctgcgggcagcccacgggccagcctggcggggtccgacggcggcggcggtggcggcagcgcccgatccagcggcatcagcctgggctacgaccagcgccacggcagcccgcgctccggtcgctcggacccgcgtcccggtcccgggccgccttcggtgggcagcgcccgctccagcgtttccagcctcggctcccggggctcggccggcgcctacgctgacttcctcccgcccggcgcctgccccgcgcccgctcgctccccggagcctgcggggccggctcccttccc

SEQ ID NO: 11493 - DNA, 1580 bp, Homo sapiens
aaaaattagccaggcacctgtagtcccagctacttgggagggtgaggcaggagaatcgcttgaacccgggagtcagaggttgcagtgagccaagatcacgccactgcactccagcctgggcgacacagtgatactctgtatcaaaaaaaaaaaaaaaaaaagattcattcccgaaaatttgctgtgaattcaactgatcttcaagtgaatgtgtttattaaccaacacatgtatttacatgagcaaaatatttattcatatatttgttttggcaacctttttaaataactctgtcgacaatgtgttctgtttaatttttttctgaaattttgttattataacaataacaacataatattaaagggaaatttagaaaaccacccataacccagtgtctcatctgttggaggagggtgctgagagctggaagcacggctccatccctggtccccagcgttccagggacccctctcaaccctcacccttgcagggagacgactccgtgggaaggcgttctacaacgtgggtgagaaagtgtactgccaggaggacttcctggtgagtccaagctgtgccctggcagtgccaggggtgggaggtggggcagggaccctcattctgactcgagtggagacctgaggccaggaggcaggtgctagctgggccgcgagtgcccctttgtcacacaatgtcctggatcctgtgtcccctcccagtactccgggttccagcagacggccgacaaatgcagcgtgtgtggacatctcatcatggaaatggtgagcccctgccccagcctcctggagcccctctgacgtgggtggagtctgaggactctaccgtctcccctgctccagacctgccaggggttcagggccagagcctctcccagggcggtgctgagcctcctgcccgcgctgacccctcagtgtgccccgcccacagatcctgcaggccctgggcaagtcctaccacccaggctgcttccggtgctccgtgtgcaatgagtgcctggacggggttcccttcaccgtggacgtggagaacaacatctactgcgtgcgagactatcacacgtgagttgctggtgctgtggagcaggcgggactcgggccgtcctccctggctcctctggaagcatttttttcctgctggactgactgccctttgttcttggccttttgccttccgcctccccttgtacacctgggcttggggcaggcatgtgtctctgcctgcatcccctctcctggtggtccggccaccagctgtcttttgcctcttctctccctatcgtggcctgcatgcttctctactcctggcacaggggaccctcctggctgcagtacccaccatctttccccctcctcccctccatcccctgccaggccaggcctctttcagctggggcaggggcttgggatctctgcagcccccttctcctgcctgtctgatccctgatctgtttcctcctaccgtgactccaggtttattcctgggagctctggttctgagcagggccttccgtgggattggagtcctgggcagaggtccctggtactcagggtgaagccaggtct

SEQ ID NO: 11494 - DNA, 1163 bp, Homo sapiens
tgtctgagatcatgatgtatgtgctcattgtggtgttgaccatatggctcgtggcagagatgatttactgctacaagaagatcgctgccgccacggagactgctgcacaggagaatgcgtgagtagggtggctgggaggtgggagggcacccagggcaccgtcacacttgccagagaggaactccggagcccgggcagggaggaggcagcggagcggcccagggcgccatctctcagtactacccagaggggagtgctccctgtcagacacaggataggggtcgtcagacccagccccttcctccctccaactcaggagcccaggctcccagccagattcctcaaagaccctgaggagtccacccatagactccttctctctctaactaaggagccctgtgtacctggggtggagaccgctaccttcccccatcccccgggggttgggtcggtctgatgatggggtcactgtatacctggcctttcccccacagctcggaatacctggccatcacctctgaaagcaaagagaactgcacgggcgtccaggtggccgaatagccctggtaaggcggatgggctggcagaggggaaggggattgggaggggccgaagtcccccaggtccctaattccccctctcttgctccccttcaggccctgggccccgcctcaaggaagagccagccgtaatggggactctccaggcaccgcctgcccccagcgtgggggtggccactcctgggccccagaaagcctcagagtcctgccgacggagccactggggtgggagggggcagggggcttggctcgcacccccactttcgcctcctccagctcctgccccgccggccgcgcaccgccatgcatgatgggtaaagcaatactgccgctgcccccaccctgcttctgctgcctgtttggggaggggggcggtgaggtgggggcagcggccccgcacccctcctccttgctgatttgcacacattggccgcttcagacacgcacttctggggccagcccctccccgcctcctccctgcctggcggcaggggtcgcgatgatgggctggagcagtttggggcagggggttctgggacccactccgactccccctccccggcatcatttcccctcccgcttcctccggctggacctggggtc

SEQ ID NO: 11495 - DNA, 1100 bp, Homo sapiens
gaatgatgtgtcttaagaggaaagtttcttagagtgcgaaacggatttgctcagcaagtgatcgctgacctcccgccatgttccagggctgtttgaaacacaggacagaatgctacacgcagaaggagtccccactcctgttaattgcagagaatgcagtaaaccccaagcacagcaatgaggggacgggatggaggaacagagaaagctaagggtagcctctgccctcctactccccaggctgtgatccaaaatcccttcagcaatggtggcagtccggcggccgaggctgtcagcggggaggcacgatttgcctatttcccagcgtccagtgtgggagatactacggctgtgtccgtacagaccacagaccagagcttgcaggctggaggtgaggagtagaagtcagattggcaggtgggggaggcaacgggcccagcagggagggaagcccccccagccagttctgacttcaccctgccttgccactaaccccccactctccctgcaggccagttctacgtcatgatgacgccccaggatgtgcttcagacaggaacacagaggacgatcgccccccggacacacccttactctccgtatgtgcaggggacacctggagggcctggtgttgaaatggaaggaagaggggtttctggagtagaagctgggcagttagcatgaagtgggcacatggtgtaatgttttttttctttgcctgtttctgctgctctagtgcacataaagtatcatgtcttttgtttttgcagatggatttaccttgcaaagataattttcaaatctaatacttagcagatgcttgggcaaacagctctgcgataatacatgccccctttttttttcctcctcttgtagaaaaattgatggaaccagaacaccccgagatgagaggagaagagcccagcacaacgaaggtgaggacaaggtgtggctccgggtccccctgaccaccaccctcacaggctcagccagccctggagtgtggagtgacagagagagaagccactcctgggcaggccacaagtgctccagagggctttgctggacgctgtaaaggtagaaagtgagcaacgagggga

SEQ ID NO: 11496 - DNA, 1913 bp, Homo sapiens
cgagctcctgaggcagcaggtgggtgcggggcctggagcgggtcagggcccaggagccccagatgcaaggcgctggccctcagctcccttgacctccgtcgtgtccgccagatcgaggagctgaagaatgagaacgccctgcttcgagcccagctgcagcagcacaacctggagatggtgggcgagggcacccggcagtgacgcccgccaccaccacgcagccgccgccgcccacgccggcctctgctgcccccttccccagcccttagcacagagagggacacatgcccctcccccagctgcgtttttttatagtagatttttaacaaaaaacggggagaaataatgcatttctgtggatacagtgcccaccgccctcctccacttggaaacggtatcctccctgcccatccgtctgtctgtcgcccttctcccggccctcactaagccccggcacttctagtggtctcacctggaggcaagagggaggggacagaggccctgccacgtcccgctgcctcctgctctctggaggtactgagacagggtgctgatgggaaggaggggagcctttggggggccacccggggcctggacctatgcagggaggccacgtcccaccccacctcttgtttctgggtccctgctcccctttgggggtgtgtgtgtgtgttttaattttctttatggaaaaattgacaaaaaaaaaatagagagagaggtatttaactgcaataaactggccccatgtggcccccgccttgtctgcttgtgtgtttgtccatctcaggagtggggagggggcctggggtctgcagagctccacgaggcatggttctgctgttgtgcacatggctgtgcatggtccctgccagctgcaccacccattacccagtggttggttggatggatggaggaattaaggaatgaatgtcccctttgaggccctagacgtgcatgagggtgtggggagctggggtcaaggacatgtcccatgttggaggagaggcaggggtctccgtgtcaacagttcctgaaaacacaaccagcccctggccctgccctgctgggccaaagccctcccctctgcaccagccaatagtggggcctggccttgagcccctcacccccagggagggcagatggccagggcgccaagcttggcccgtcagcctgtcgccttgcaccaaggctctggcgcctgtgctgtgacccctgcccctgctgatgatgaaacctgtcctcagctgagatgcagcgatgcctggtagggctgggggctgctcctgtgtctccccaggtgagcacacccctattcactgggccctgcttcagcctgcagcacccttcaactcccaggagctgggcttgccactctgctcaccttgtggagctccatctgcctttcctccccaattcccccactccctgcactcgtctcttcccacaagagccctgtctccttttcctagctattcccatctgaggccatctttattcatttagtttttagagacagggtttcactctcacccaggctggggtgcagtggcacacaatcacggctcactgcagccttgaccaactacaggtgcgtagcaccacagccaagtttttgtatagatggggtctcgctttgttacccaggctgtgacaagaggagcctcccacgtggtgtggatgaggaggcagatggcagggcctgtgcatttctgtgcttgagtgggccttgaaagtggttcagcaaccaggaagaagtgttcattcctcgacaacaacatccccgggctctggtgacttggctgacactggatggccctggaatgaaaaaggcaaagaggcaaaatgtgcaagggcccatctggaaccaaggtttgttgatcccctgggccgtgtgcaccctgagctgggcc

SEQ ID NO: 11497 - DNA, 1220 bp, Homo sapiens
gacgctgtctgtcctatggagttgttcacccagcagctgtaactcccagcatcttctggggagatggagtcaaaattcagctggctttctttccccagaagcctgccatttttctcccagaagaactggacttctttggggtggctgcttgagaagtcacattggaggctgaccgagtttccagagtgaatctcggaaaggggcttgattttccggaccctcacgtctcggggggcatctggagggcaagggtcccaagctgacctctccgctccctgtcccttttgctgtccccaggcctcccctccccttggccctgacgccaggctcctgtccctcaattctgttgaagacactggcccaggctccggcctcgttgccttcatcccctcatcccagccgggccacctcccagatccccctgcctagcccagggactcacactggacattcagggcgacaggggaggcccacgagcaccaactattacaagctgcgcaggcgatggttgtgttgtcccagccaacgttttggatcttcagcaccccaagcgatggctcctcccaggcgccatggggtttccattcataccgggtaacactggggttactggaattgtagttacaggaaagggtcactgtgtctccttctcgaatcggcatggggttttgaatcactgtggtcaccttcttgggaggatctggaagaaaaccagagaggtgagtaaagaaaagccagctgtccacagtaccccttccctcctgcttcctcttctcccgctacctgtcccgggcatctgcacaggtcctaaattaatcaaaggggggcttgtgcgtccttcctgcatctgtgtgagaacagaaaccctgccctggctctctggcctggctgtggtttggtgcaggggttcagggcacagcgctgaagccagacggctgctgagaggcgcacgggcatgggctgcaggtctcagtttacacgtctgtcaaatggggtcctgaggccgggcatggtggctcacgcttgtaatttcagcactttgggaggctgaggtgggcagatcacctgaggtcaggagttcgagacctggccaacacagcaaaaccctgtctctactaaaaattttaaaaattagctatgcatgctggtgcatgtctgtagtcccagctactcaggtggtcgaggcaagagaatcgcttgaacccgggaggtggaggttg

SEQ ID NO: 11498 - DNA, 1189 bp, Homo sapiens
gagccaagattgcaccattgcactccagcctgggcgacaacaagaccctgtctcaaaaaaaaaaaaaaaaaaaaaaaaacaacttaatcttcatttctacctccatcccccagacaaccacgagtctactttctgactctataactttgcctattctggacatatcatataaataaatgaaatctgacaatatatgtacatggtcttttacgtctggcttgtttcactcaacataaggctgtagtgtgtatgggtagctcattccttttctttgccaaatagaattccagtatatggatgtgccacttttttattcactcaccagctgatgggctgccaggtaacatttccactgttggtgactatgaccaacactgctgtgaacatttaggactgagtctttaagtagacctgagtttccacttctcttaagtaaatacctacggtggaattgttggatcgcatggtgaatttatgtttaactttttaagcaactgccacctgctttccaaagcagggacaccacctcccattattctcaccagcagtgaatgaggcccctatctctctacattctcgccgaccataggcattgtctgactttttgcttgtggccattctagtggatgtgaaatcatatctcattgtgccctgtgattgtttgaatgaactaatagatcacctgtgaaactggacagcacttgggtttgaaccctagtggtgacatttcacaagctgtatcacctggagcaagtcacttccctacggtgaaggacaaggattttatgacataaaagcgttgccctagaagcagtgtctgctatggattatgtgcccatgaaaaggcagctgctgtcatcatcgccaccaccattattattgttattattattacattgtcaccccagagataatcctgcaccagtgacagggaaaatagcagctggcatccgctgcctgctcacgaccacacgccaggcttccgtcaaaccactcaacatgtattagtaatcttttaatcgacctacatattgttttaatttgcatgtgttaatgcgttgatctatgagatgggtattatgatgagctctgttctgcaggggagaaagcagaaacatggagaatttaagtcatttcccccaaatcacaaagtcaggaagaaacagacctcacggagctcgctctctgt

SEQ ID NO: 11499 - DNA, 1102 bp, Homo sapiens
cgagtcaccacacccagcctccatcattgtttatactgagcatcgcctgtggtcagtggtgggattgcactgtgtattgtttggcaccttttttgcacttgactatgtatcttgaagatccatccattcatgccagaacataaatcagcctcgttttttttcacagctgcctgctattccatctcccctgtttggacaaacagcatagtgttgacttgaggttttcaaagcagggcccacccttggagctctgtacagtgacacatctccccatcgacagctctgcagtgggcctggggttttcctgcccattactctcctcccagcatgtcagcttgttcagaacagtgatttctgtcttttggggtcactgctgattccccggcctctagaatagaggttggcacacagcaggtacctgtggatattggttgaacaaacaggtgggcaaagtgaggaagataagaagtccatccgttcagtttccccactgcggagggaataacactgtctttccacaggtcacagactgggatgagcaacgggctgaaggcacgtttcccgggaagatctgaactggctgcatctccctttcctctgtcctccatccttctcccaggatggtgaagggggacctggtacccagtgatccccaccccaggatcctaaatcatgacttacctgctaataaaaactcattggaaaagtgagactatgcgtgtgaacgggccaggcagtggcaagaagctgggctggaatcagtgccctgaccagggaggggcttgaatgagtattttctctgttttgtttttatttatttaatttaatttaattttttttttttttatgatggagtctcgttcttcacgcaggctggagtgcaatggcacgatctctgctcactgcaacctccacctccagtgttcaagcgattctcctgcctcagcctcccgactagctgggactacaggcacaccccaccacacctggctaatttttgtatttttagtagagatggggttttaccatgtcggccaggctggtctcaaactcctgacctcagatgatccacctgcctcggcctcccaaagtgctgggatta

SEQ ID NO: 11500 - DNA, 1232 bp, Homo sapiens
ctcctgtggtcccagctacgtgctccaggaagaggggccggcctcccctgactcccagccagcgggcggagcgggaagctgctcgggcagggccagagggcacctctcctcccactccaacccccagcaccgccacgggaggccctccggaagacagtcccaccgtggcccccaaaagcaccaccttcctgaagaatatccggcagtttattatgcctgtggtgagtgcccgctcctcccgtgtcatcaagacaccccggcgatttatggatgaagacccccccaaacccccaaaggtggaggtctcacctgtcctgcgacctcccattaccacctccccacctgttccccaggagccagcaccagtcccctctccaccacgtgccccaactcctccatctaccccagttccactccctgagaagagacggtccatcctaagggaacccacatttcgctggacctcactgacccgggagctgccccctcctcccccagcccctccacctcccccggccccctccccaccccctgctcctgccacctcctcccggaggcccctactccttcgggcccctcagtttaccccaagcgaagcccacctgaagatctacgaatcggtgcttactcctcctcctcttggggctcctgaagcccctgagccagagcctcctcctgccgatgactctccagctgagcctgagcctcgggcagtgggccgcaccaaccacctcagcctgcctcgattcgcccctgtggtcaccactcctgttaaggccgaggtgtcccctcacggggctccagctctgagcaacgggccacagacacaggctcagctactgcagcccctgcaggccttgcaaacccagctcctgccccaggcactaccgccaccacagccacagctgcagccaccgccgtcaccacagcagatgcctcccctggaaaaagcccggattgcgggcgtgggttccttgccgctgtctggggtagaggagaagatgttcagcctcctcaagagagccaaagtgcagctattcaagatcgatcagcagcagcagcagaaggtggcagcttccatgccggtgagtgtggtccctgggcccagcggcacacccagccatccagcctccattctttgcaaccccctaaccttccgcctccttggacactttccagcattgcggggaaccctcagaacctgcctttctgtgatcccccaccttcctttg

SEQ ID NO: 11501 - DNA, 1142 bp, Homo sapiens
aagagagagcggccctcagtatgcatcgggaggagggccctgaagaagactggcgggaggagtggggctgcgggagcgcaagctgcccacacacactccgatttctcccccagggtcccgagtcccctgtgcaaggtccccgcatcaaacatgtctgccgtcatgctgctgtggccctgggtcaggcccgggccatggtgcctgaagatgtccctcgcctcagtgccctccctctccgggatcggcaggacctcgccacagagggtaggtggggagactggacagccatgtcaggtttggggatgaccccacacttgggtgacatgcaccaagagcctaggagagagggagccaagtcaggtgctcaggggttaggtggcaagtgggctggagtgctaggtcctagagcaacttcatttgggggcaccaggaacctggcgctgtgagaaagcgagagccaggttgtgggaaagcagggaagtgaggtagaagcctggtggctttgtggctccatcccctcctccctgcctgctgcaatagatacatcatcggcgtccgagactgagagtgtcccgtcacggtcccggcggggaaaggtggaggcagcaggccctgggggagaatcagagcccacaggttctggagggaccctggcccacacaccccggcgctcactgccctcccatcacggcaagaagatgcgcatggctcgatgtggacactgtcggggctgcctacgtgtgcaggactgtgggtcctgtgtcaactgcctagacaagcccaagtttgggggccctaacaccaagaagcagtgctgtgtgtgagtagctggggcgtgacctcattcccgtggttgttggtcccctaggcttcctacctcactcctcttctgcctggccagagcagtggggttggcattcttgtggagagcttcctctcttcccccagaccaccagtcccctaccctggtgacgtgctgctcccctccccagataccggaagtgtgacaaaatagaggctcggaagatggaacgactggctaaaaaaggtgacgagctttaaggagcatttcttctcaaaaccgtgttagagtttgtgctgtggagggagctgtttttctttgctctcctcccttgcagctc

SEQ ID NO: 11502 - DNA, 1208 bp, Homo sapiens
gggggccacctgtgatgaggaagaggatgaggtgcagctcaggtcaaccaggtatggagtgtgagctggggggcgggtggtggtctggaagggtcttagagagtgagcaggggtgagagaggtcattctgagcaccagcctgggtgacactgctgtccctcaccagacgtgccaccagcctggagctgcccatggccatgcgttttcgtcaccttaagaagacgtccaaagaagctgtgggtgtctacaggtgagtggggttgggggggaggatgccccttgggtggacggacaggtgcactgggtagggggtactgtctggtttctgtccccctcccccctgagttccctgttcatcctgccctgcagatcagccatccacgggcgaggcctgttctgtaagcgcaacatcgacgcgggggagatggtcatcgagtactctggcattgtcatccgctcggtgttgactgacaagcgggagaagttctacgatgggaaggtgggctcccagtggctgtgggaagacagtgggtgaagcgagcctgtccgcggggacagagcacctgatctccccacctcatccctgcagggcatcgggtgctatatgttccgcatggatgactttgatgtagtggacgccacgatgcatggcaatgccgcccgcttcatcaaccactcctgtgagcccaactgcttctctcgggtcatccacgtggagggccagaaacacattgttatcttcgccctgcgccgcatcctgcgtggtgaggagctcacctacgactacaagttccccatcgaggatgccagcaacaagctgccctgcaactgtggcgccaagcgctgccgtcggttccttaactgaggccgtggctgcccaccacgacccctcacacctcctgctgccgtcgctgccatcttgcccctagcctgggggctccctagcccctcccagagcatctcacccccaccctcatgttcagggtggatgtgggcatgcaggtgacaagggccctgcctccacccctccagcccatccagcaatcgccccctttctgccctgggggcccaggatgtagatattgtacaaaggtttctaaatcccttcttttctatgcacttttttatttaagaggtggggtcccaggtgggaacccccccacaataaagtctgtcaatgtttggagaggtggtcttcccatttgtag

SEQ ID NO: 11503 - DNA, 1114 bp, Homo sapiens
agaagtgaggaaacctctgaaggacccagtggctatctccaaacggtcaggggtccctgagaggatcagggtgcttccagccactgtggaatccctaatgggggatctattgctataggggggccctcaggaccccattgccttccccaggtgggcttcctcatccccgagggatggttcctgagcggctgcccccatggctccagcgctacgtggacaaagtgtcaaacctcagcctctttggaggcctcccagctaaccatgtcctcgtgaaccagtatctgcctggggagggcatcatggtaaccacacaccctcggcccgtgtccccccactcagacttctgagctgtgctggggcaggggactctgtacccaccctcactcattaggcagccacatctcccaaacaggcattcacctccctgtccctggcttgggaagcccccctttgacccagagggtgggggttgtggactcctgccctgcccagccctggtgcccactccctagccccacgaggacggaccactgtactacccgactgtcagcaccatcagcctgggctcccacaccgtgctggacttctacgagccgcggcggccagaggacgatgaccctacagaacaggtgggcccccagacactgccccagctgcttgtaggcacttcaacctcgcacatcctccaagatgacctggtcccacatgccttcggggtactcctggcactctcccagataccttcccttgtcccctcatggggtgtacccacttcctcccagacacccaacccatctgcttacagggtgtctgtcccacatgccatgattttcacaggctccccgatgccccaacctgctgaatggatacccctgactccccagcagacactgatatccttagataccccaccgccattaactcggggggcctcacctcctcccagatgctctatctgcccctgctcagggtgccccagacgtcctgctactccaggaatgtgatttggggtgcaggacacccccagattctccttgaccccttgacacaatttctctgagtgatgcatttctagcaccccagtgttcacagaaacgcccctgaacacgccgac

SEQ ID NO: 11504 - DNA, 1203 bp, Homo sapiens
acctttattactcccctcattccctacccagtgctaccatcgtctcctctgtacctgtgacatacatgctgtttttggctgcacacaatagaaaaactcaaaacaagaggtaaaagttaggtttctgactcatgaaagtagtctgaaggtaaccagtttagaccgttctgcaggaagcccttagggatccaagggccttccagctctctactctgtcatttgagggagcaggctatgtcctcatgacccagtgtggctatgggggctcctgctatcatatctgagttccaggctgcaggatggagaaaagacagcagaagaatacgtgcttgctttatatttaatagttcagaatttattcacatattcttatctagctgcaggggaggcaaggaaataattattctgattggtgaaactcccagctcaaaattagagttgtattactaacgaagaagagactggctatggagggacacgatttcagaggtgcttctgagctgctcgtgctgacctcagccctgtccttcctgcagaccctgctgaaggtcgtgtacgtggagaatgacatccagcacctgcaggacatgtcacacttcccagaccgggggagcgagaatgggacacccatggacgtgaaagccggggtgcgggtcatgcaggtcagtcctgacggccagcatttggcttcaggcgaccgaagtggaaatctgaggcaagtgggccctggcagtgtccagtgtacacctcccagctccagctcaggttctcagggcagtgggcagaagccctggccttggcacctcctgctgcccattgggaatgaggggctgtgaatagtaatcccatgaacagctcccattgggaacttaagctcgtaagaggcttccagaagggctgagagcagagtaactaccaggacctcagcagctagggtgtgcagattttgcctatagagtgtacaggcaagctcacatgactctagggcagcgtgacactttcaccagccacatggtaccagtgctgaactgtcaccgaagatgccagctggaggagggtcctggtggctctgggagaggggctatgagggtgggatagctgagagttcaggctgcttatgtgccctgttgaggtttggcaggatgttaccaacccagtaggtgctagtgggacataggccctgttgctgggaccaggtttaag

SEQ ID NO: 11505 - DNA, 1100 bp, Homo sapiens
taggccgtggatgtttgctccgcgcccatgacctgccaaggacctctacattcaggctgggctctggatctcacattctagcgcccagacatgtcgggaacgccttacgccaacttggggtccccaccaagagaacccccaccagatctgcaccctccccttcacgcgtgcacccagtccaggctccctcaagccccacgggtgccttttagacctgaggaggttgcaaacctgatcccccatacctgccccacccatccgcggacaacccgccctcgcaaactcagacccccacccggaggcttcagattcctcccaggtccagctgccggaaatgcgtgtttgaagggagggtgtgggctcaggggcgaagcacccactggtccccttttttccccccagcagtgagtcgcagccatgttcctggttaactcgttcttgaagggcggcggcggcggcggcgggggaggcgggggcctgggtgggggcctgggaaatgtgcttggaggcctgatcagcggggccgggggcggcggcggcggcggcggcggcggcggcggtggtggaggcggcggtggcggtggaacggccatgcgcatcctaggcggagtcatcagcgccatcaggtaaggcggagactatcagaggggcggggcctgggaatgggaggagcctcagtgaggcgtggtctgggaggggcgtggtctaaaaatagaataggattaacctggaggctaacctgggtacatgaattaggccggggaggcctggtttgagagttctgctgtaagggggtggaccccagtgaggcggatatcagtcattgggggcggtgcttgatatgggagtagtctgattgtgtgggaccaggacaatgtggtcctgaggggactgatgtggagttttggcgggtggggcttatgggtctgggctcagcctgcattggctaacctggagatgaacgttaaaggtgcggagccaatgcgtctgagtgacattttacggaaggggcttgacttatgagtgtggtcagaggttttaggtgggttaatgaggaggtgagcccaggaggaagcaagacctaatggggtagggtaaat

SEQ ID NO: 11506 - DNA, 1729 bp, Homo sapiens
agcaattcaaaacttaaatactatgatgtttaataagtattatagtgtaaagaaaacccgtacccccaaaactcccacaacaagcattatcaatgctgtacttctaggagtatactcattaaagttaggatctagtcatggacactacttaatgtgttcctggaaggcctacagatgcattaagaaatagatatgagatgtatgaggatttgaaattaagagacaaaattatcatttttgtgatgttttgctacatatatgaattgtaaaactagaatcatcaaaattatttgttgttgaagcagtcataaaactgagactgagacagaatattgaattcagaaatgtgtgcatgaatatatggggaattggtaattgatagaggcggtatcccagattggtggggaaatcatggattacttaaaaattaattgactcttcatatggaaaaataatatctcccatcataatataaaatatttttcttatgaattcttaaagtactaaagactaaaatgcaaaaagcaatacttaataatataacagttttataagaagatgtttttaaaaccttagggcaggaaagaacttctaaaacattccagaatacccggtagttccactcttgagtatggtagtcccctattttctgcaagagatggactctaagacccccagtggatacctaaaacccagataggaccaaactctatgtctatgtttttttcttatatatacatacctatgataaaatttagtttacagattagacacagcaagagatttaaaacaataataaacataatatggaacaattataacaatatactgtaatcataaaagttatgtgaatatgatctttctctcagaataccttattgtactgttctcaactatttatgaactgtggtgactacaggtaactgaaaccatggaaagcaaagctgtggataagggggaactactatatatatgcatctacccaagaaacatgaacacagggagtcatgtactggtctatagctgtatagttcattgcaccatgagttatagtagccagaagttgggaaacaaatgctgtctcttgtgaaatagatgaataaaatgtgatagtaacatagtagagtactctctagcagttaagtgacaaattaagtctatatattaacagaaatatttttaaaaaattagagtgaagaaaaatgatgaacatattgtaatgatgcttctgtgaatttgaataaaatcaacactaaccagccctagtactaagaattggttatggataaattatgtaaaactaaagaatggattgaaaggatatgtatatactcagttcccaaaagtggagtggttacctctaggaagaaaggaggtggaagggaaatgttaccaagcatggtagttaaaggatacttcaattttgtatctatttcttattaaaaagaaacattctaagtaaacataacgaaatattaattctgggtggtggtaatatttgtgttcattctatcattcgtgctatttatttccttaaacttctgaaagttaaaaagtccagataggagtgaggaagctgtacatgaaacataatggacttacattcctagtcagatactaatattctgtagaagatatttctaaaatcttatctttaaaatatgaaataatttttaattggggtggcaacttaaattcaattaaaataactcatgtgtcacaagagtaa

SEQ ID NO: 11507 - DNA, 1179 bp, Homo sapiens
tacagaacggacagccccccaccagcaccccggcttcctcagggtccaaagccttccaccgactctccaggagaaggtccaaagacgtggagttccaggacgggtggccccggtcccccggcagggccttcctcccccttcggcaccgcagcagcagcgagatcaccctcagcgagtgtgacgcggaggacgcgggggagccgcggggggcccggcacacgggggcgctgcccctcttccgcgagtacgggagcacctcgtccatcgacgtgcagggcatgcccgagcagagcttcttcgacatcctgaacgagttccgcagcgagcagcccgacgcccgagggtgccaggccctcaccgagctcctccgggcagatcctggcccacacctcatggggggcggcggcggagccaagggggactcccacaacgggcagcccgccaaggacagcctcctgccactgcagcccacgaaggagaaggagaaggcccggaagaaacctgcgcggggcctcggcggcggggacacggtggactcgtccatctttcggaagctaaggagcagcaaacccgagggggaggctgggcgttccccgggggaggccgacgagggccggagccccccggaagccagcaggccgtgggtgtgtcagaagagcttcgcccacttcgacgtgcagagcatgctgttcgacctcaacgaggcggccgccaacagggtgtcggtgtcgcagcggcggaacaccaccacgggtgcttcggccgcttccgccgcctcggccatggcctccctcacggcctcgcgggcccacagcctcggaggcctggacccggccttcaccagcacagaggacctaaactgcaaggagaacttggagcaggacctcggcgatgacaacagcaacgacctgctgctcagctgcccgcacttccgcaatgagatcgggggcgagtgtgagcgcaacgtgagcttctcccgggcttccgtgggctccccgagcagcggcgagggccacctggcagagcccgccctgagcgcctaccgcaccaacgccagcatctcggtgttggaagttcccaaggagcagcagcggacgcagagtcggccccggcagtacagcatcgagcatgtggacctgggcgcccgctactaccaggattacttcgtgggcaaaggtg

SEQ ID NO: 11508 - DNA, 1999 bp, Homo sapiens
tttaaattattttcttgggggcctgaggatagagagaggcaaggctagcctccagagccgatttatttgagagagaaactctatttggatctccaggacggtttatacgatctttttctatcagctcctcttccgccagaggccactgcacctgggctaggggtccacaggcccctccaccttccagctaaccaggccaggccggggcggtggagccaccacacagccgactctctcctcctcctcccggcacgacctggccctgaccagcagcctcggcctcttctgggttccaggaggggctcccgaagccctcaggacagggctggaggagaacagccttcatctcctcctctggtttttttttcctttgcaagtctcccagcccatctctccgagcagcggccaccagaccccctcaccatgctccccggggagcactgcaccccgcgaaccccactggacgctggttctctaaaggcaataaggggcggccatgccggtgtggtaccacgctgttcctccaggaaaccgtttctttttttccttctttaaaagcaaacagaaaaagatatatatatatatatatatatatttattttttcatgtagagttggcgccagaacaagcctgtatggccacagtctgtggattcatccccccaacctcaagctgaggaccaaggcgtgtcccctgtgggctgggggtcagtgggaggaccagagggatgaagtcagggcaggccggtgccctttttgggaggcaccaggcggggaggagttggcggagcaggtctggctgtgagccagcaccaggcaacccggcccttgtccagggacctctgctgccttctctctggggtcaggaacctcagaggagggggctctggggactgcataggacgcaggcactcggaggtgccggtgtggatgggtgggggtgagagaagagggttcttatcgcgtctcctgtgatcagcctctggccccctggaggaggaaacctcagcgctgcccctgcccccaccctcacccccaacaccaagagtgaggtgggcgtgccccaggcagcgtcctcagccctggccagctactgtgatgccatcttctcccccatccccttctctggggggcccacccgtcccccacccccaccccttagaccctcatcgggtccctttttttttttttttttcagttgtctcctcccatcttcagatcattcgaatcattttggggacttaatcatgtacatggacaagtgtaaattatgatttttggttttgttttctgttattttttaaggatttctgcaaaaacagatctatttaatttgaggttgatgttctatccaatggccgaagatagcagcaggttttttttttcatatgttgatttgtttcatttggattttttttttattattctttattgtcttttttttttccccatccctgtcttgagattttctggcatgtttctggaggtttcaaaggaaataaaggtttcatagaaatggcttgtgtgttcacttttggggcagctgcctggagttgctgaccagagggtgtggtccagcatcggcccctcctcctgctcctgtccccaaatcccccacaccatgaccaccacacacatgtcctaagaaccaggggcacctgccttgctaacttcttttccttggaatccaaaggacagaaatccaacactcagaatgtgaaatgtccttaagttcaaaagagtgagattctgcctcagaggtcatatactggaggcctgaaggccagccccagcccagagggttgtgttgggtcttagaaatagtggccaacttttaatctggacattcagccaggtgcagtggctcatgcctgtaatcccagcactttttgagaggctgaggcaggaggattgcttgagcctaggaattcaaaaccagcctggacaacatagcaagatcctacctctaaaaaaacctttttttttttttttttaacttt

SEQ ID NO: 11509 - DNA, 1181 bp, Homo sapiens
ggggtagggcagtgactgagatgccctgggcctgccctcaatggagctcccaggccagtgggagagacagacctatctccagacaaggacagcccagtggggtcagggctgggcaggaggaaggccaggagagtggttgggctggggaggagggacatttggaggcgctgtaggagtctgggggggtgggggtgcagtagcattccaacttagcccgcaggtagcctcaggaagagagcggttggggtggatgtagagggaggcactgtcctctgtcctcttagccatggcatccccccggcccatcttcctctcccagggacagacgccccagctgtggtcaactgtcttcacatcctggcccgctccctggatgccaggtagggccataggcagtggcgcccactcccaccatcatcgggcccccaccccaacccctggtctcctagactctccgattccagagctgatgttcccccgctgcccttctaggacagtgatgaagtcaggccctgagatcgtgaaggctggcctccgctccttcttcgagagtgcctcggaggacatcgagaagatggtggagaacctgcggctgggcaaggtgtcgcaggcgcgcacccaggtgaaaggcgtgggccagaacctcacctacaccactgtggcactgctgccggtcctcaccaccctcttccagcacatcgcccagcaccagttcggagatgacgtcatccgtaagggcgcctgacccaagggcaggttgcggggagtcagtgtggccaacaccacccatccgggtgcctgtgagagtccctgggtgtttgaatgtgtggatttcttgctgtaagcaaagcatgcagtcagtaccttggcaggtggcaaatgagttaatgaggacgcgagctcagcagctctaacaaaagaccctaagtggactggcgcagtgactcacacctgtaattccagcactttgggaggctgaggcaggaggaccgcttgagctcaggagttcaagaccagcttgggcaacatagcgagaccctgtctctactaaaaaaaaaaagaaaaatttaaagattagccaggcatggaggcacatgcctgtaatcccagctactggggaggctgacaagggaggatcacttgagtccaagagttggaggctgcaatgagctatgatcata

SEQ ID NO: 11510 - DNA, 1151 bp, Homo sapiens
aggtactttgattgcaggtaaatgatgggatgaattctccagggaagaggctgatctgtgagcgctttctctctttttctcttctctctcagaactacctgtcccggaacttttacaccctgcggttccttgccctcttcttggcatttgccatcaacttcatcttgctgttttataaggtgctggtcctgaagggctgggagggtcaggcccttttccatgctgtgggatgggaggctcagcccctatcagaatttcagggttcctccactgaagggataaggtattgggctttgggtcgttaggagggttcaggctggacacctggatcctgggacccccctccatgggggtgagtaggggatatctggatccatctgggacagaagcctgagtgtctgtgggagttagagcaggagcaggagctgagttctctgctcagctcggccacatgccagtcctgtgcgcctgggtgcaggccctcagctcttggcaacacccactgattctgttaagcatctttggtttcacataagctaaacagaagtttgcagggaggaagaaatgggccactcacagaatggaaggaatgggttaagaaccaggcctcctgaaggacaaagggacccttggggtcttgccaggggtctagataacaggacagtaaggtagactagagagatcgaagcatggcttctgtgggacccagaagtcccacagtgggactgcccactggcgcatgacgataggcaaggtgcttaccatccctgtgcctcaactccctcatctgtaaaatggaatacctcttagagctgtggggattgaaagaggataaggcaccaggcacagtggctcacgcctgtaatcccagcactttgggaggccgaggtaggtggattacctgaagtccggaattcaagaccagcctggccacatggtgaaaccccgtctctactaaaaatacaaaaaaaaattagccaggcctggtggcgggcacctgtaatccaagctatgcaggaggctgaggcagtagaatcccttgaacccaggaggcaaaggttgcagtgagccgagattgcaccactacactccagcctaggtgacaagagtgaaactccgtccaccccaccaaaaaaaagaggatgagtgtg

SEQ ID NO: 11511 - DNA, 1189 bp, Homo sapiens
aatctgatctttcttttccccacacattactgataagaacgttgttgataggtaagattaccagtgtaggctgggagtggtggctcacccctgtaatcccaacgctttgagaggccagcgtgggcagatcacttgagcccaggagtttgagatcagcctgggcaatatagtgagacctcgtctatgtaacaacagcagcaacaaaatcttagcactttggggggctgaggcaggaagatcacttgagcccagaaattcaagaccagcctgggcaacgtagtgagaccccatctctataaataaataaaaataaaagcaaataatttaaaagaataaacattgtgaacatcaattcccatcacagcaagccctggatgaaaacatggacctcttggaaggtataactggctttgaagactctgtccgaaagtgtaagtccctctctgaggctgggctccccaaggggaaggggtagggagtggcagccaggtccggggggacagctgctcaccggttttgtctctgacctccacagttatctgccatgttgtgggtatcacttaccagcacattgaccgctggctgctggccgagatgctcggggatctgtcgggtaacgccctctgggtcctggtgcacatctgggaggttgggggtggctagggcagtggacctcagtcagctcctccaacaggcctgtctgggtctcatcaggtcagcatggaaggcccagcccaaggaggaaataagaacttggtataagacagtctctgccttgagggagatcctatgccatttgctcatttattttgcattaattgagtgcctaccgtgtgtcagtgtgctaaactgggcgtgcagcagtaaacaaagtgggatggctccaattcattctcatggaggtagcaaagcacatggcgacatggaggtgtccagtggtgattcctgtcatgaaggaaagcaagacagctcacagaccagcggcatctgagcccttacctccgtagagagaggcccgtggcctgaggtagtgcagaggaggatagtagagcagggccctgacttgtaacgttcatgggtagccagggtgtatgtggccagagcagagtaagcatgggcgaaagtagagagctgggggttggaggggcatttccaggtcatgtggggcctcgggaggaccttgtccttt

SEQ ID NO: 11512 - DNA, 1205 bp, Homo sapiens
catggagaaaccccatctctactaaaaatacaaaattagccaggcgtggtggcgcatgcctataatcccagctactcgggaggctgaggcaggagaattgcttgaacctgggaggtggaggttgcagtgagccgagattgcgccattgcactccagcctgagcaacaagagcaaaaactccgtctcaaaaaaaaaaaagtgtattgtttctggtaatggtcatgttataattttgcaaccgtttcatataggttgtgggaaaaggtagataaatacgctgctcttgttaggaaccaaaatttgcccagggagagaaaacagaggaatagaaattaaggcagaagccccacgatgaggctgaaagagctcacaggctccctctggcggccattcagagaatgacccgtggaagggcaggggcggaagcaaggagaccaggccagctgctgctgtccaggagatgtcagtgggcaaggggggctgccctggcttcctgagccatgactctgttgcctctcagtcccctggaactgtgggatcaggctgactgaagccccttgctgcccctgtcacctgcagacagccagctaaaggtgtggatgagcaaatacggctggagtgccgacgagtcggggcagatcttcatctgtagccaagaagagagcattaaacccaagaacattgtggagaagattgactttgacagtgagtggtgacccacggcctcgggctttggggctaagggggtgcccctcaagggaggccgaggcaggggcccagaggacctgggtagatctgctcgtgttctgggctgggaagtctgcacctgccagattccattcaccttgtgtcttggggctcccgcccaggaggaatagcggggagctgggtgatcttccctggaacttctaggccctgtgtcctgccccatagcactcagcaagacttcctggggcccagcggggcctcacagggggtctctgcacccttatttgtccctgaggcctgtctcgttggccatcttttattcttggggtgcccaagcctcatgtgcagacttggaatccggtgaacagtaggaatcttgattctctagtttgggtgattccacatttttgtgcctcagttttctcatctaaaaaatggggacgactgcaacagtaactatgataaacactgtgtaggtccttacacttacatcattt

SEQ ID NO: 11513 - DNA, 1195 bp, Homo sapiens
acccacccaaatggctttttgtttgtttgtttgtttgtttgagacggaatctcgctctttagccagggtggaaggcagtggcgtgatctcagctcactgcaacctctgcctcctgggttcaagcgattctcctgcctcagactcccaagtagctgtgattacaggcacatgccaccaagcccagctaatttttgtatttttagtagagatagggtttcaccatgttgaccgggatggtctcgaactcctgacctcgtgatccacccaccttggcctcccaaagtgctaggattacaggtgtgagccaccgtgcttggccaacccacccaaattgtgtaccctacaccatcctagtgcttgggagccaacacccactcacaggaggctaagggcaagtttaggtaactcttaacaccacgaattagttgcctgctggcaaacttcaaactccaagcctgaaatttctggttggagtcacctcccagatggactcagggattcattcaccccctcatccagtgctcacggagcctctgtgaggtgcaggcctggagaggagccctgtggcctcagcaaagggcaggcaggctggtgagcacccaacctctggatcgaggggactcaattatgcggataaaggcccctaatcctctcagtgctccaaactcactctgcttctgaaagggatcttcgtaccctgggttcagagagtaggaagcccgcagggaccgagtatgcatgaaacaagcccaagtctgtgggggctgtacatggtcaagatcacagatttccagaccaagccagctccaccctagctgggatgcccaccctgagacacccctctctgctttcactggaataggatggccctgacttggccgggtggactgttgaatcagagcctctcaaaacaggaaaaaggaaaaggatcaccaagcaggagtttcagttgtcaaagacaaaacccttaccacgattaaagattactccagggcctcgcatattcacccttccaccagcagggcccagtttacggatcatttgaatactagcaaaaaaacaagccatctgctggagagattgaacagagggagaaacaggagtgtttgccctgcttccagacacccctttcctgtggcagttcctgcacctggcaagatctactggggaattcccggggtcccactagctcagg

SEQ ID NO: 11514 - DNA, 1206 bp, Homo sapiens
gcgggaagggtacataggaggcagccgcattgagctctggagatgacagtggcttggtggagagtgtcggcagtaggattggaaggaagtggacagattcacaataaacaataatgtagtgcacatttgctgactgcgagatgaaaaagaccacctttgccctgagagtgggggcccggggtgcccccctgtagtcaggaggtacgcagattacggcagaaatgtacagagcactgagagttgagagaggtgtgaacagaggccacacgcctgggaccagcctcttggaggagcggttttttgagttgggtcaggagaaggagctggctgcggggccagggacccttgtggccagaagcctgcaggcgctcagcagcaggaggctctgggacagtgctgcctagagactgttccctgcattttctcctgagggaggtggaggaggacaggcctgggagatgcaaccagggggtggtttggagcctttctctagatggggctggaaggccaccttcaggttgggcggaggagcctcactctggttttaacgaccttctgccctctgcccccttccctgtgtgcagagattgtggacggcaacgcaaagatgaccctgggaatgatctggaccatcatccttaggttcgccatccaggacatctccgtggaaggtgacagccacctgtactgcccccgcttcccacctgagtcagggcgggttagaggagagctgaagtgtgatcttcatgcttcaagcctcttcctgtttccttggggtcactcacagggcctggcccttgcaggggtagtcagtgggtggcaggtgaagggaggctcctcccagctgcctgcctcttggctccagtgccttccgagtgcctttgctctcacagcctcatctcagtggaccctcacgccaccctcatgagatgggctaggatggctgggcccgttttacagtccaggaacccaagtcccagaacagactagtgagagagttgggcctgggcctggttctctgtctgcttgacatccccatccttgaaacttggcccccatggacccgttatgagctcaggccgtccaggaatggacaatttcgcttccctgcaagcacctgtgtgcacacaggatgggcagagccacctgggctagcgtgcaggggctcccaggtgccaggtcgcagtgatgactgggagagatgtg

SEQ ID NO: 11515 - DNA, 1099 bp, Homo sapiens
ctgagacccccttctctataaaaacttaaaataaaaatcagccaggctcggaggtaggcacctgtagtcccaactacttgggagactgaggtggaaggatggcttcagcccgggaggttgctatgatcatgccacttcactccagcctgggtgacaaagcgtgaacctgtctttaaaaagaaaagcacaggcaggaacaggaagtaacaagagaacagtacagtgatgcagggacagggagggagcccacgctcccagagttccaggttgggggttctagcaggaatcgtggagaagttgggctggggagcaggggtaaccccctaaggtggggccctcaaagatccagatcccatgtgcccataagctggggggcagcccgtcagcactctgagggtcccccacaaaggccacgctggcttctgtggcccacagctcctggagtggatccggcgcaccatcccctggctggaggaccgtgtgccccaaaagactatccaggagatgcagcagaagctggaggacttccgcgactaccggcgtgtgcacaagccgcccaaggtgcaggagaagtgccagctggagatcaacttcaacacgctgcagaccaagctgcgcctcagcaaccggcccgccttcatgccctccgagggcaagatggtctcggtgagcaccaggattcacatgggagcagctgtgaggggcagaggcagccctagaactgcctgtgggcagtttggccagcgtaatctttcctaagttgttgatgtcctgtgggacatggcatggcctttcggatgcagtggtcggggaggggtgcacttcactcggcattgtgctcccctttggccctcactcactgtattttacacccagggttttatacgcatcccaaatccttgccacgggttgtgtgggtgtggagtggtgtgaatttggagccgtggtctgccatgatggcatgaccgccatgtgcttgaggcccttcatcagcggaggggcagtgcgccctggacggtaccacctccccatctatggtattcatccattcattcatgcactcacccgttcacgcattcattttgttaatccagaattg

SEQ ID NO: 11516 - DNA, 1200 bp, Homo sapiens
gagctggggtgcagccaccttcccaggctggcattttccctgcggttccctaaagaccttcacttgcttgcagggcttccttgagctttggttctgggatgtgtaattagccaggatcagggactaataacagcgttcctcctttcctttaaagggcctgatggtgggcccgccccaatgcacacaggacaccttaggacagcgtggggcacttagacgtggagaggaccaccacctgtgcgggtgcagggtcagggtcctagaagaagctggctctgatgcttccccttccccaagcctgctgggacatgggctttgaccccgggtgcttctccggatcaaagccctccagaaacaggtgctacctttctaagccgtgctaccacggcccgatttgtatggtttcctactaacaaaagttgctaagtttaggacacacaggttgagatggaatctctctctcaggctgagcaaccctgaagtgtccatccaggtccatccaggttacagttgggcttagagatccctggagggtacggaagaagattctggaagtttccatgccactgtcattggcatggaaggatgtggggtccacagtctctctttccctccctctgcttggacagcccctccagactcctgccccacagctgccgtgctgtggtctaagcgtctctctgctcctaccagggaaggaagccatgctgaagcaccgggactacgagacggccacactatcggacatcaaagccctcattcgcaagcacgaggccttcgagagcgacctggctgcgcaccaggaccgcgtggagcagatcgccgccattgcccaggagctcaagtacgtgcgggctcaggacactatcatcacctggctctcaccacagcctgcccagactggtggcggcagcacgccgaggcccagcctgcctcaaggcctggaatagggtccccagtgccccaactgcacctccttccagaagccagggaagggccttatgggatgaggccttttgcccatcctgtctcagccccaggtgggacacctgaaggatttggattctctagcaggagggaggtgtctggccccttgtcttgattcttcaggctttaggggtccctgggggtgtcacctctcctggccaccccaagtaggccctggtcccctgatgggatgggccccagcctccgttgctc

SEQ ID NO: 11517 - DNA, 1997 bp, Homo sapiens
ctctccttgcagggtgaggccgagttcaaccgcatcatgagcctggtcgaccccaaccatagcggccttgtgaccttccaagccttcatcgacttcatgtcgcgggagaccaccgacacggacacggctgaccaggtcatcgcttccttcaaggtcttagcaggggacaaggtgagcgagacccctacgaggtgcatgggggctggcgagaggggtccctgcagtgggaggggctgagggggccagtgtgtgggtggggatggctcagagtcccatcctgcctgccccagaacttcatcacagctgaggagctgcggagagagctgccccccgaccaggccgagtactgcatcgcccgcatggcgccataccagggccctgacgccgtgcccggtgccctcgactacaagtccttctccacggccttgtatggcgagagcgacctgtgaggccccagagacctgacccaacacccccgacggcctccaggaggggcctgggcagccccacagtcccattcctccactctgtatctatgcaaagcactctctgcagtcctccggggtgggtgggtgggcagggaggggctggggcaggctctctcctctctctctttgtgggttggccaggaggttcccccgaccaggttggggagacttggggccagcgcttctggtctggtaaatatgtatgatgtgttgtgcttttttaaccaaggaggggccagtggattcccacagcacaaccggtcccttccatgccctgggatgcctcaccacacccaggtctcttcctttgctctgaggtcccttcaaggcctccccaatccaggccaaagccccatgtgccttgtccaggaactgcctgggccatgcgaggggccagcagagggcgccaccaccacctgacggctggggacccacccagcccctctcccctctctgctccagactcacttgccattgccaggagatggccccaacaagcaccccgcttttgcagcagaggagctgagttggcagaccgggcccccctgaaccgcaccccatcccaccagccccggccttgctttgtctggcctcacgtgtctcagattttctaagaaccaaaaaaaaaaaaggaaaaaaaacacaaaacaacaaaaaccaaaaaaaaaaaaaatcacaaaaacaaaaaaactataaaaaagaaagaattaaaaactttcagagaattactatttactttattaacttacggatttattatataaatatatattcacctagcaacatatctctgccgtctctcctgctctcataatgaagacatagccgattctctgcccgggccccttgctgatgctcctccgggtctgcgtcgggcgtgggtctctggggaccctccagaggtggaggtgggctgatggcctggctgcctggtggttgatggttttgctccccctaccttttttttttgagtttattctgattgattttttttcttggtttctggataaaccaccctctggggacaggataataaaacatgtaatatttttaagaaggattcctgcagcatcatctttttttatttctcctgtgtctgtcctccaccttctaggagagccagggcagagctagcactgtcttaagctgtcaacgtggactagctcgtgtcatctgctcgagaagggctgtcgctgttcttgtttctgagtgaggagtacgcaggccagagtggtcacccggccgtgagcagtgagggccagagactagccccagacaggtggatgccagagagagtggcacccatgccaggcaaggcctagggaggtggtcttgctcagcaaccctgccctgagcagcaggtgcgcccatccggagatcctaggagaaggtggccacctccatccactaaggaagagaaggaagacagtggcttgaggcagggagctcgcaggacagagcctgagccaccctgtccctcccacctggctcacctgtctgtgggtcagg

SEQ ID NO: 11518 - DNA, 2275 bp, Homo sapiens
tggtcccgattaactgtgaggacatgggaggccagagcaggggttattatcactaacttgggaggggcaggagaggggaccctggcagctggacagaggtgctgactgcagctactctccccaaggtgaaattcatgaaaagcaagccgggggccgccatggtggagatggctgatggctacgctgtagaccgggccattacccacctcaacaacaacttcatgtttgggcagaagctgaatgtctggtaggtgctcaggctcgggagggcagcagaggtacaggggagagaaaaggaggggaatggggcccagcagaggagcacagtgaggccgaggtgttgactcacacagaaatgggatgtggcaggtgtgttcccagacgtgtctctgacaccacaggagaaagtgagtcagccttgcctcaggtgtagagcaatgccccaaggcacacagggcaagctaagcctctggaggccacaggggaaagcttcagggacaactttgggtatgacaaaggctcccctttcttccttgctgcagtgtctccaagcagccagccatcatgcctggtcagtcatacgggttggaagacgggtcttgcagttacaaagacttcagtgaatcccggaacaatcggttctccaccccagagcaggcagccaagaaccgcatccagcaccccagcaacgtgctgcacttcttcaacgccccgctggaggtgaccgaggagaacttctttgaggtgtgtgccgtggagctgcgcaggcagtcgggtccttgccacggccgtctgagtaggccattcatttcagtcttttctgcaaatagctgttgaactcctgtcctgcctggccctgggttgagtgctagggacacagcagaggccaggacagataggaatctgtgctctcaaactggacagggtgagaatggcaccaagtttctagcaacaccatttgccgcgttccttccttttacatttttggcaagcagggcaactgctcgtttgctgggaaagctgcttcacaggcccagtgatgagggcccaatttcacaagaaccgcattggcgtaggcttcgggtgccatcaccctgataccatcagaaggtggggccctgtaaagctcagtcagggggaactgaggcagcggaagggaggaggaactcaagtggatctggctgtggtctgaaatgttgaccttgcattcagcaaacagtgttcagcaaacagccgggtgcagatatccacatagctgttgaagttgggaacgaaaaagcagcttcccagtctcaggcaacttaataattaaagagcattgttgctggcctttttatgacacagggatgccttagggtatgtgataaaatctacaagccttttctcctgaaaacttcaagtactgagtcatgcagggcctggtctgcttgaatcctgtgtggcggcccttttgtttcagagttcatttactacctgttttcttttgcagatctgcgatgagctgggagtgaagcggccatcttctgtgaaagtattctcaggcaaaagtgagtcgagtgtgcccacctccttgccctaattgcatggtggttggtgggcagctgcctagttcctattgggtgagtctaaaacctttacttttccccttggtttgcaatcaggtgagcgcagctcctctggactgctggagtgggaatccaagagcgatgccctggagactctgggcttcctgaaccattaccagatgaaaaacccaagtgagtatctgtgtgtcctgcaggcatcaacctggtgacctaatgggttggctggcttcaggccagggatgtccttcctgcccttgagataggaccccgggatcttcgcactgttggtgacacaggcaggtgggacctgctcatcaggagagcagcctgtgctcctcttgggagagccagcctgactgcctgctgccactcactctgccagcttgggagttgctcaggcttgtcctccagggaggtggcattctcttctttgcatcagagactggcttaggtaggaaagccactctgttacctaggaaagaggcaacactatccagcaggtaaaacttgcccacccagttgctgggagaggcccattgccttgggctggcgaaggagataggaatgggattctctatgggaatgaaggaagagaaggagaaacgccgtgcataattggtaattggctcatcttgaagcctcacgttgggcagtcactccttagacccctgccgttgacctgcagaaaa

SEQ ID NO: 11519 - DNA, 1621 bp, Homo sapiens
ggctggagtgcagtgacaatctcagctcactgcaagctttgtctcgtgggttcacgccattctcctgcctcagcctcccgagtagctgggaccacaggcgctggccaccccacccggctaattttttgtatttttagtagagatggggtttcgctgtgttagccaggatggtctcaatctcctgacctcgtgatctgcccgcctcggcctcccaaagtgctaggattacaggcgtgagccactgcgcccggcctaatttttatattgttctgtagaggtgaggttttgccatgttggccaggctggtctcaaactcctaggcccaagcagtctgcccacctagccctcccaagttttagggttacaggcatgagctactactgctcctggccagtgttctttcattcagcaagtagttactgaatatttggtgcatgctatatactgcaaatacagtagtgagctgtatctggatgcttctcttagaaagttgccctcctagagtgatttgcactgtcatagtgtaagctcaagaagccgtctgtgggtggcatctgacagtctggtgaggagaggtcaggaaggcttcccagagggacatgatggctcagctagacctctttggcttttggtactacttgtggcacagggtgttcaggtcggggaaccatgatagggttgcagaggagttcagaggccatggaggagtcagttctcaaaaaatcaaatgataccctcctcctgtctacattttcctgagaggattgaaacctgtgttctctctgccagctatgtggtggtaatgcctaaaaagagacaagcactggtggagtttgaagatgtgttgggggcttgcaacgcagtgaactacgcagccgacaaccaaatatacattgctggtcacccagcttttgtcaactactctaccagccagaagatctcccgccctggggactcggatgactcccggagcgtgaacagtgtgcttctctttaccatcctgaaccccatttattcgatcaccacggtacgtgccagcaggcatttcttgtgaggtctcccttccttttctccccttattccctcccccaagccagactgatctgccagtgccccttcatcttgcctgtgtttgcttttgcaggatgttctttacactatctgtaatccttgtggccctgtccagagaattgtcattttcaggaagaatggagttcaggcgatggtggaatatcctttgctggaaaacaggtgttccttagggtagggactcttgcagggcttgacagtggccattctttgagccagcatgtgtctgctgaccacgggagtggctgccatgtgccagatgccttcacagagcccagtgactgagtagggaggcagttaaaggaccaggcatatcgtgtggacgtgcagatcttaggggagagagcagtgtgttgggagatacaaaggaatttatttttctttttgttttctttctgttatttacttatttatttattgagatggagtttagcccttgttgcctgggctggagtgcagtggtgcgatctcagctcactgcaacctctgcctcctgggttcaagcaattctcctgcctcagccttcctagta

SEQ ID NO: 11520 - DNA, 1173 bp, Homo sapiens
cactgggggggatcacctgccccgagcagctcagcagccccagggccaacatgtacggctgtgtaggttgtttactgtacagcagtacagtgataatccagccccgggccttgacctggggttgcatccaccagagggagtgcctcttaatcttccaaaggcttcctctgggcactggcagccctggctcaccctgtggtctctcctcccaggctacttcatggaccacaccgtggccttcagggacctgccagtcaggtgacacctggtttccttagaccttgaccccacctgtgacaatcagtcttccctccttgacccgactttccctgctctctgccaggatggtttgctccagcacctgctaccgggcagagacaaacacgggacaggaaccccgggggctgtatcgagtacaccacttcaccaaggctggtgtcgctgggactaaacggggctggggtggggggccaccccaagagctcagagcctcctgactcctgtgccctctgtcccaggtggagatgtttggggtgacaggccctgggctggagcagagctcacagctgctggaggagttcctgtcccttcagatggagatcttgacagagctgggcttgcacttccggtgtggagaggggccagggatccagggatggcaggggtggggtaggggagggacaaggggctggccagctgctcttcgctctggaaccacctctccagccccctcgttgcccccattttcctgtacaaggattacaggagcatatacaggatcccaatctgtctgccgtgtgccggtcgtccctcacaggactgtaacagaagcacgaacagtgcacggtgtgccagagtggagacccgggcccctttcctcctgctgctccccctctctctgggccactgcctcatctgtgcaacccaagatactttttcacctcccagtggagagtgggggtgggaaaagggggagccagaggttgggaaccccacttcctctcaccctgtcagtcacacgcagctttcaagagaggctgagaaatgtggacttcttttctgggtgacccattgtaaaaaactgggagcgtaagccgggtgtggtggctcacgcctgtaattccagcactttgggaggccatggcaggaggattgcttgaggccaggagttca

SEQ ID NO: 11521 - DNA, 1192 bp, Homo sapiens
cctctccaggcccagctctggttccccggctctgggctacctgctccatggctaccctgaaccagatgcaccgcctggggccccccaagcggccgcctcggaagctgggccccacggaaggccggccgcagctgaagggtgtggtcctgtgcacgtttacccgcaagccgaagaagcccaactcagccaatcgcaagtgctgtcgagtgcggctcagcactggccgcgaggccgtctgcttcatccctggggagggccacaccctgcaggagcaccagattgtccttgtggagggcggccgcacccaggacctgccaggcgtcaagctcaccgttgtgcgtggcaagtacgactgtggccacgtgcagaagaagtgacggctgggggcacagtgggctgggcgcccctgcagaacatgaaccttccgctcctggctgccacagggtcctccgatgctggcctttgcgcctctagaggcagccactcatggattcaagtcctggctccgcctcttccatcaggaccactattaagccataggagtcctgggggtgcaaagggtgcccctctgtcaacacccttggctcctgtgtttagaggggtggcctgaaggaccttttctgctgggacaagacactgtactgccctctgctgggaaggggttttaataaacagaccctggcgcttgtgatgtaaatccccttgtggagtatttgccctctgtgtggctgtggcagtggacatctctgagcttcagtttcctccagaaaatagctccattggtggtatctcctttgtttggtttggtgaagattaaattcgatgctctatgtgcataacacgcacggagggctcttttttttttttttagacaaagtctcactctgttgcccaggctggagtgcagtggcctgatctcagctcactgcaacctctgccccccgggttcatatgattctcctgcctcagcctcccgagtagctgggattgtaggcacacaccaccaggcctggctaatttttgtatttttagtagagacagcgtttcaccatgttggccaggctggtctcaaactcctgagctcgggtgatctgcccaccttggcctcccaaagtgctgggattacaggcgtgagccaccacgcctggcagagggctactgtattttaagcttaggagtcaggtaggtggca

SEQ ID NO: 11522 - DNA, 1282 bp, Homo sapiens
gaggcaaaggctagagaggcatgaaccaagtggtgggttgtgggagaggaacaggggccaggtcctgcatggccttttaggcatgtggaagcatttgtattttgttcccactatgaaaggaagtcacagggatttgagcaggagtcaggctcggtcagatttgcatttttagaaggacctttatggctgttgtgaggggcgtggactgtaggaggcaagagtgaaggcaggaaaccaatgaggaggctgtggcagtaattcctgccaggggtgctggtggcttgagccagcggaactggagaaattcaggaaagtggctgacagcttgctgatgggttgggtgttggaggtaagagaatgaggtatatctggtaggcagttacccttggaccccaggtcccttcctcttggcaggttatggggccaaactgccatcctggcactgacggcagggggatggtctcctgtggttgggtccccaggtctaatattttgcttttctcccactctggccaggtctcccctgccaaatccaccctagcccactgaagcgctccatgtcactcatccctacaagcccccaggtccctggtgagtggccgagtccagaggagcttggggcccgggctgcttttaccacgcccgatcacgcacctctctcgccccagagcagcgtggcctcctctggcagtgagcagacagaggagcagggctccagccggaacaccttccaggaggatggcagtggcatgaaaggtacattggggacagcagcaccaggacccttttccaggggcttctgcagagcttagaggacagaaaggagcttgtagctgacacctgcttacccctctgaggaggggacatgtctgaggggagtagatagtccctgcttttagggctcaggactaagcagagagaccccacatctaccctaacaagttctagtctgactgggaaggagccccctgtcttcacacaccccagtctgacaaggaagccaggacacagctaagtgatggaacagaggttccagcaagagttttggagcaatcagtgaggtcatcctggtatacatccagcctagcagcttagaagggtcagatgtccttcccagggaaggctgcctgagggtctggctaggcagatgaagaaggagctgatggaaccttagctccccccaaccccctcccaattttttgcatcttttgaggcttcctgtgggtttatccccacaacttttcctttaccctggtaatctgggccaaactcctgacctttc

SEQ ID NO: 11523 - DNA, 2988 bp, Homo sapiens
cttaccacccccattctcctctctcccacccagactgcccggttcctgggcctgacctggagatcaatcccactctggagtctctgtgtctgagcatgacagaacacgccttgggtggtgagcatttcctctttccctgacccagctcccacctacccagcgtctctgcctctgaactgagcaactcagagtcatcctgaggggtccccaggggaggccagactccagggagggcctgactgggatgacaggctacctgagtgccttttcttgggcctccctccagctcctgatcttcctcccttcctccctttcttaccacagatgggacagacaaaacctccaccatctgacgggacccacagcccagcgcacccataggctccctgggcggcgggcgggggccaacccccaacgggcttctccgcgacagcgagagggtgggctggctcagctatatattctaatatttttctactctcttaccctcttaacttttgtttaacattggcacatgccttgctcactcccaggcccgtcgagggatctctgctgaggcccggggagttgggggcagccaggataaagggggcagggactggccagactgcctgcctctctcctttccttcctcatccccacctggtcccatcccacccctgcctcctccagaccgctgaccacctgcctctccccaagggagcagactccccagagacaaactgaccactaccttgtggagcctgctcagaaacatttgacatttggggtgacgcgcagggcagagaacctgccctccagaatgttattgagaggagctggggagaaggaaggggagcaaggagaggaagctctctctcctctccctgcttccccttcaccattccccacattctgcaaggacaggagccaccttcctctctctcacctcccctggccctgttcaccagaggttctctatgattaatttcttaggcctatttaagatacatatttatatagttcttaacggtttttctctgatcatttcctctcatttttagaatccccaggtctctctcagccaagacagtggcagggagagcctgaactttatgaggggagagggcagagccccctcctccagaccctcaagctctaacccattttcctccagccctggctacccggatgaagaggttggaggtgggcagccagggtagccagtgaggtcaggaagtctgttgccttaacgtccccttccccacgaacacacacccttctccgctcccaggtctggttggtgagacttgggagtcaggaataagggaaaggggattgtttggtttttgggtttttccctaagcccctcccttttctttcagcctttttccttcccccattatgtcatgacctcacttaagtggaacactatatcataacccagagattcgtcccagccccagagtccgacagactgtctggtccctattcctaatgaggggttgtgttggggcccaggtggagggaggggatttgggggttcagactgcggggaagccagggtctccctcttcaacgccctcctccccctcaacccaccttcccaactgggacattctcaagcttttcacaccgaaaaggaaaaaaaatgttatttttagatacattttatgaataacttttgttatgaatatggctggtaaccattgtgtatgttattaaagatacaaaatgttgggaaaaaaacaaaaaaaacaaaaaaaaaaaaaattttaaaaccaccaccctccctgcactatcaccccattccccagaccttcttgcccccgccctcctggtctgtggacttccctctgctctgagcccagggagggggaagaagccagggggtagggtggccctgggaacctggctctgggtccccacttcctctcccagtgccgggctgggtggggtgtcaggtttatttatgtacctcttgcacactcatcaacctatgcaagtcccccaccccggccctccatgtttctgtgcctttgctcatcccctcaatctcccagggcttctccagtccccctcccactagctgcaggaagtgggatggatgggccacctcgtttggaatcagcagggtgtccctctcatgggaccctcccctctccccagcctgtcctgtcttgttcactctccatcagggtgagctgactgtgcctggcactgggaggtggtgagggacaccgtctcacacacacagggaggcaagagctgccccccaccccacctgacagcagagtgtgcaggacgcaggcggccccactctgatgggcaggaccctgaccctctcccgctccagccccctccccaggccctcctccatgatttcaccctccctacccacttctgtccccggccccactggcagaatcagctttgagtaactgtacagtttttctcgctgttggagaagacttatttgttggagtttcacttgtttaatggtctgggcttattttggaaaaaaaaaaaacaaacaaaaaaaacgaattctgaccttcgttgtgctacattttgtgggaaaccattggccctgcctctggcctgtgtttctaagcctcaagccaagatccttgagcacctgggggttgcgggaggtatgtgctgggctgaatgacatcataggggctgggaggggaagtaaagagaagttgactttattaacagcaaaggtttgggggtggggaacaaacaagtgaaaggctcacaaacagaccactagaaaagtgctttgctgctcacaataatggtgtctgaaccagccctgaatgccctgggactcagtcactgtcactatcagcttcactggaatcagaagctgcagcttcactgccatcctcctgggccgagtgctcgctgccactggggaagggactggcgctgcggctgtggctccggctccgctggccacccccattgctgccgctgtctgaatcattgtcactgccacct

SEQ ID NO: 11524 - DNA, 1235 bp, Homo sapiens
aggttctattcctctttctgcttagcgctctctccgactaacctggccctcggcctgcccctctagactaccaaatccagtttgcttctcgctgcttaaggccaatcacctgtagactctccttcagctgcgggatgagcatcttataacgctgcacaggatcgaagtcctgttgctgttgctgcaggaggccgctctgggcagggcccaccagttgtgctggcggttgcggctgctgctggggacccgggccgccagccgaactaggacccgatacaccagcagctgaggaagccgctgaagcttgctgctgggatgcagccatcttcctcgcgtagaccgccggaagtgcgttacgactgcgtctctccccgttgcttttcagcatccctatttctagtccccgtttgctagttagtcccgccccctaggcaattaagccaatggaggggaaggaggtgccccaacgttacgtcactctcaaatctgcgtccagactgagatatctctccaccaatcacagaagcacctctctccctcgctccgcccttcacccagacgctcgccaatccgtgtgtggttccgagccggacttcatttccccgaaggcgtcgcggcctgaggagacccgttgggtcctcagcgtcttggcggcagttggtggaaccggagcttcgagtccgtccccggtgctgcctgcgcgttcacctgagtctcgctggagctcttctcgcccgcccacctcatctcaacccactttccgcggggagcggcgccaagctgggccttcctcggatcaggcgtcccctgaagtcggcacgcccctctgcgtcccccttcggtcccgctaggaccccgtccgggctgccgtcgcctcgtcgctatggcgcccaccatccagacccaggcccagcgggaggatggccacaggtaggcgccacgcttttctgttgcagcaaggcgggggatcgggagagggtttctgctgaacaacgtcaccagcccccaggtctgcccgtgacgtcatgaagcgctcacctttgacgaagggggcgggttccttctgagattcaggtgttcccctcctccccgccgtgcagttcagggattaggcttttggagactccctccagaagggatccctccagtcaaccgtttggagacccctcttccgaagacgattgagtacatggttctttattaaagcacttgaagccatctcctgcaaaagggat

SEQ ID NO: 11525 - DNA, 1171 bp, Homo sapiens
cttctccaactggggctccctagcgccgcgccctccagcctggggcccctgcctcccgctcagaccagcttggtgatttggaggtgaaaatggaacccgcgacacccggctcttcgctcaaacatgggtggggcggcccatgcaagtggaaagtcggagaacttttctcagaccgaggctgcctggaggcggaagtggcccccatacctggctcacccctagtcgttgctgagggcgtggttttgcgcggaggcgtctctggggctgaagtctcagggtggggggatccgacttctgtctctccagtccctgaccgtagagacagagaaccctaaaaccgaagcaatccggacttccaggtcaactttgcccggtttctccagttgtgaaactggagatcccgacgcgtgggtcatatccggggaggacaagagacccaaaattgggaaacagtggtgcgccctgacttcggggtccccctcttggtccagccggggaagccgggattcctgggtccctcgggataaggcctcggtggtgggtaaactcagaacctccaactctgggttcctggcatccggaacccaggggtttctgcgggcgggtggggctcaggcggggagcccacaaaccggcctggcaagctctagttccctgcagctggggtggggcgtcgccctgcattttcaggtgccttaaccgacccatttccgcagagcctcctgtcgctgagccctgacgtgcccgtgccatccgaccatggagggactgagtccagcccaggctggggctcctcgggaccctggagcctgagcccctccgactccagcccgtctggggtcacctcccgcctgcctggccgctccaccagcctagtggagggccgcagctgtggctgggtgcccccaccccctggcttcgcaccgctggctccccgcctgggccctgagctgtcaccctcacccacttcgcccactgcaacctccaccaccccctcgcgctacaagactgagctatgtcggaccttctcagagagtgggcgctgccgctacggggccaagtgccagtttgcccatggcctgggcgagctgcgccaggccaatcgccaccccaaatacaagacggaactctgtcacaagttctacctccagggccgctgcccctacggctc

SEQ ID NO: 11526 - DNA, 1351 bp, Homo sapiens
ttgtactgtaattctggaaacctgtgaggctcaaagaaagggcagagagctcaggtgggaaatagaaaaggcacctgaacagtccagggatggctttcgactacttgaaacagccttgggagtttcagaagctattggaatgctccttactgttcagccttctaagaaccagtcttagaggtagggtgtctgaggtccagtgagggacacaagtaggagggagcccagatcttgttccctttaccttgcctatatttcttaacaccacttcagcagtctcatatctggcttttttgactttcctcttctctgggtctgtagagggccttggagtgacaccctgacccccatccactagtacttgaaggccagtggtggcagaagccacagaaacaagaagcccagtgagatggctaagctgcccagcatgtaacttaaatccctgttcattccccattcctttagctgctggagccagttctgcttctcggcaaggagcgatttgctggtgtagacatccgtgtccgtgtaaagggtggtggtcacgtggcccagatttatggtgagtcccaggaactgggcgcatggaggaggtggctctgggagggaggccttcacagcgctcctgtaccctttaattgtgtgtctttctcacagctatccgtcagtccatctccaaagccctggtggcctattaccagaaatgtgagtgagcatgggtccttcccatgaggtagatgggtgtgtggggatcaagtcaaggactctgtgtgattatctaaatcctcgtccctgctcttcttgccagatgtggatgaggcttccaagaaggagatcaaagacatcctcatccagtatgaccggaccctgctggtagctgaccctcgtcgctgcgagtccaaaaagtttggaggccctggtgcccgcgctcgctaccagaaatcctaccgataagcccatcgtgactcaaaactcacttgtataataaacagtttttgagggattttaaagtttcaagaactgtgtgtggccttatgtgttggtattggatgtttaaccagacagaaatcagtaaacatcctggacctattgccagtctggattttgaccctccccagaagtggtcgcgctgggcttggtgtgggtgagtggaagcagaaggcagggggtctctgtctctacacctccagtagagtccagtgtgcaggcaaagctgagatggcagtcgtttggggccattagtggctgcagaccttggcggatatatggctcatccttgtggatgtctatttttttcaagcccagcctcccaaatagcttggattacaggtacccaccaccacgccatgct

SEQ ID NO: 11527 - DNA, 1172 bp, Homo sapiens
caatccccaaacacctggctacccagacccctcgtccccacaggtcaacccacaatacaacccgcagacgccagggacgccggccatgtgagtccactggggcctgccctcgtctacccctgcccaaaccctcctactgccaccacctcttttcccctccctcctccaacaaatgcccccttctctcctgtctctgcaggtacaacacagaccagttctctccctatgctgccccctccccacaaggttcctaccagcccagccccagcccccagagctaccaccaggtggcgccaagcccagcaggctaccagaatacccactccccagccagctaccaccctacaccgtcgcccatggcctatcaggtaatggtctgcctgcctgccctgaagggtggtgggctagggtgactttgggcatatagggtcggccaggccagatgactattcccaatgacacttcctctttcccctgcaggctagccccagcccgagccccgttggctacagtcctatgacacctggagctccctcccctggtggctacaacccacacacgccaggctcaggcatcgagcagaactccagcgactgggtaaccactgacattcaggtgaaggtgcgggacacctacctggatacacaggtggtgggacagacaggtgtcatccgcagtgtcacggtacgtggggcccagggtggtgggtgagcaggcatcctctccttggtaccccctaaactggagacagacctgtccccagatggtgacagcccagagtgggcagagctgggattgaggaagcctagagggcaaggggagctatgtgaacccaaaggaggcatcttacctgatttagcggggaatcagggagggctgcctggggaaggagaaatctgagccaagacctgacaaatgaataggagtaagctaaggaaagtgactggggtgagtgagttccaaatggagggaactgcatgtgcagaggcctggaggtgaggggaacctgggcacattccaggagctgaagggtttgttgtggctggaacataaagagccaaagggggccaagcagtgcttcacacctgtaatcccagcactctgggaggccgaggtgggcagatcacctgaggtcaggagttcaagaccagcctggtcaacgtggtgaaacc

SEQ ID NO: 11528 - DNA, 1189 bp, Homo sapiens
gaggtccagagctctggtggggcctgcagaccatggggcggtccctgagaccaggtccaggaagaggagcaggtgtggggaagacgctgaggccagtttgggacatgaagagtcaagaagcagtctcctttttgcctgttagcttcattctgatgcttcccttgctgattgggtcaccctgtccaccctgacatgcaccacaggccccaggccttggaaccaggcccagccttggcctttcctgcccccatttcaccttgagttctcagaatgagccctgagcctgtgtcccctggagtatgggcctcagtcccatgttgggagcaggacaggctgaccaggctgtccccatcctccaggggggcatgtgctctgtgtacctgaaggacagtgagaaggttgtcagcatttccagtgagcacctggagcctatcacccccaccaagaacaacaaggtaagggcagggggcaaggagataagatggggccgttgggtgctgacatggaccctgaccatattccccccacccccaggtgaaagtgatcctgggcgaggatcgggaagccacgggcgtcctactgagcattgatggtgaggatggcattgtccgtatggaccttgatgagcagctcaagatcctcaacctccgcttcctggggaagctcctggaagcctgaagcaggcagggccggtggacttcgtcggatgaagagtgatcctccttccttccctggcccttggctgtgacacaagatcctcctgcagggctaggcggattgttctggatttccttttgtttttccttttagttttccatcttttccctccctggtgctcattggaatctgagtagagtctgggggagggtccccaccttcctgtacctcctccccacagcttgcttttgttgtaccgtctttcaataaaaagaagctgtttggtctaaaagtgcgtgtgtgtgtgtgtgtgtgtgtgtgtgtgtgtgtgtgtgtgtgtatgccgtgggaatgagggtgttgtttttaagtggggtcatttgcagaccccacttccttgctttgtggttggggcaaataactggaccctacctaaatctgttttcccatctagataatagtgatagtgcctgccccagagagctcttgaggggagtgtgtatgagaagacgtcggaaggagatgatcagag

SEQ ID NO: 11529 - DNA, 1274 bp, Homo sapiens
gcgttgccctatctccgtctccgccacccacttagcgttttaggcatcaattaccagcagtttctccgccactatctggaaaattacccgattgctcccggcagaatacaagagcttgaagaacgccgcaggcgattcgtggaagcctgcagagcaagggaagcagcgtttgatgccgaatatcagcgaaatcctcacagggtggacctcgatattttaacctttacgatagctctgactgcctctgaagttatcaaccctctgatagaagaacttggttgcgataagtttatcaatagagaatagttatgtggtgacactacttcaagagaacctctgcattccagtcataccaatcctgcaacttgattttcagaagtcaagagtatatcgcgataagacagtgcacaggtggaggggaaaaaaagggggagggggaagcttatcttgaaaaagcatcacagaagtagaaaaaaatgtcgaaagcattataactgtaacgttctttgagtttgtgattgatccacatttttccccctgcattatggaaaatgtctctcagcattgctttattacaaagtaaaggatggttttataaaattgagactgatgaaacatcaatactagagcccatgaggatgaaagaaattatcaaatagtgctgaacagaataagatgttaacgctgagttattaggactggaaggctatgaaaagaacttgaaattgtcggaatatgtgctctcttcatgtcatattcaatagaagtttctagtttaagattgattttgtgttttcttaggcatttcaagtgacaagcaaagtaaatgtatatattatgtgataaatcatgttttcaagaacgtcaaatttctggacttttttctttcaatttttaatttttaaagtttttttggtattaaaaaatctattcacaagccaaaaaatatataaaatatacagcgaaaagccttccattcttgttttcctccatccagtaccaacgatgacctctaatagccacagtttcctttccgtccttctagtttccttacgtgtacacaggcacatataaatctgggtttacttgttttatttcttcacagaagtcggcatattatatttactggtttatacattgctttctcattaagaacatatgttgacccttccaaaccactgtatttcctcattattttttaaagtggcattttattccattctgaggttatgtccaaatttacttaaccagggatatattgacggacatttagg

SEQ ID NO: 11530 - DNA, 1202 bp, Homo sapiens
agtctgaggttgtctgacattttgctcgtggttagactgggattttaggctttgggaagaatgctcactgaggtgaggttaacctgatcacttcatgaaagtggtgtctgcagatttcccaacgataataccactattttccctttactcatttgttagaagcaagtcactaaatccagcccacactcagaggagagctaagcctgattcctggagggaaatagggagatacttggaggctgcacaaatatcccatttctccttcaagtttacccacacattttagcattcatcagtggacccggtctgtagcagttattaccgtgatattataatgatgactttctgtttccctcatttctttacatttactatttagaattccatatggaagatttgtcccttctatcatacttcacttattttatttatacaatcattagtttatttccgtgtggactcatgaatatttattagttgggcataccccaacattattgtaatcaattttttttttgctcaagttgttttagccttggccatcagcgtttatctttcaggttggctcctgtgttctttactcttttttttttctccaacaccttcttactttctggcactgcaagatattccaggctcatgtattctccctgcaccagccctagaattagctcttcctctagagtcactggttcttttcattggagaatggtgtgtaaaaataagcatgagttcatactgatactctgacactagtctagtaccagagggttcattctcaccatcccccccttgctttctttataactccttcctctgccagtgagaagcctggctcagtgggctctttttggtgctcatcttattggtcatcttggcaaaaatcggctgtggtgaccctgcctgccttctgtgagcacaccctccccttagtttctgtgagtctgctatcccctgacatttcctctacgttttgcttccttgcgggctcctctgttttcaccagtctgttaaatgtggtggggctatgttctctcttctcaccttggggccaccttaccctctttcatggtctgtttcctatctctgtgcagatgacacactctgtccttagccctgacctctactctgagccctagacctggaggatccggaggcctcatggacaatcccccaatcccaactgggcaatccttgggccc

SEQ ID NO: 11531 - DNA, 1273 bp, Homo sapiens
gctaatattagtgaacagagctgtagaagttgagggttggaagactagagagtgggaagaggtgctattttagatagaggggttaaagaagacctctttgagaaaaacgttaatggacctcacagaaagggaggacaccagctggctgtatgtatattctgggaagaaggacattccaggtagaaaaaaccagcaaattcaaaggccccgaggcatgcttggtgtgctggaggagcagaaaggagtgaactggacctgactggacacagtgggagggaaggagaccaaggcaaggtcaggtgggaccgggaggccatgggaaggacttgaatttgaagctgatgagatgtgtggcagggagagcatggtgagctgaggcgatgtgatctaccacggtaagagggttcctctggctcccatgtggctactagggtggaagcaggatgccagtgaggaggccactgtgcagtccagctgagatgatagtggcttggccagggtgctaacggggcggtggggagatgtggtcagattttgcatataatttgaagggagaatcaggtatgtagggtaagaaagaagagtcaaggaccacactatggcgtttagtctgcacagaggaaggagggagtgccattaactgtatggacaagactgagagagagtgtgggcgtgtttagcctctgactggacccactggccaaacaggagcttatacaagactggcattgaagggtgagatctgggctgggagtagttggcatatttatggtattaaagcccaggatgggatcactaagggagggtgtatagatggaagtgtgggctgagaatgagagcagggaggcccgtgaggaggttgctgcaataatctaggtgagatgacagtggcctgtaccagggcaggggcagaatgagtagtcattggagtctgggtgcattttgaaggcagaactcactgtgattggttgtgggtagtgatggaaagaacctgacaagggcttcatgagaacagaatagaagcagaagtgagacagtggtgtgacattcctcctttccactgggccctgtggtctctgcttctctttgcattggctgcttcctgttctcaggcagctgggttggtcctgggtggactcttgcccccactctatgtgatcttccagctcagttacccgcagcccctcagtcttcattccgaatttcccagataggaatgggatttccagggtcgggtatccaaccctgctcaactcactggagctggagggtt

SEQ ID NO: 11532 - DNA, 1060 bp, Homo sapiens
atttttagtggagactggatttcaccatgttggccaggatggtcttgatctcttgaccttgtgatctgcctgcctcggcctcccattatgtgtcacatttctatgtccatcccagaatctctcccctgagctcctgactggctgccttcctcataacctgttggtaatctagaggtatctccagagtaattttgatcaaattgagctcctgctcctttccccaaaattttttccctgcatgttcatctcagtaaatgctccccccatcctctccaggcccaaaccactggaattgtcctttactcctctttctgtcttatattcatgtctgtcagctaatatacctgaccacttctccccaccttcactcctgtccacccttatctccttcacagaccattatggcaggctcctcagtgatctctctgctctcacccctgcccccagagtgttccttacatgcagctggagggatgctgtgagcacctgtatcaggtcatatccctcccccgctcagaacacttccaaggctacatcttgctcggggtaaaacccagagtcctctgcaaggccctgcattgtctgccctcatcacctctctgacatcatctactcttcttactccctgtgctccagccacactggcccgagggcctttgtgcttgctcttttctttgcctaaagaactcatctatcaaatagcccagacttgttccttcctctttaggtctctcctgagatgtcactgccttcctgagatcttccctcaccacccttctaaatttgtgacttatagtcacatctatctttgcttctttaactttatccttagcattaatcatattactgtttaacactctgtagaatttatctgtgtttatggtctgtctcccctgacccttacctctaggagactgttgacttcatcagggaaggggcttttgtctacttcctccgttatctccaacacatagaaaagtgcttggcacacagttagggctcagtaactacttatcaaataaactattgaagagcacatatctggatcccagcatggcgg

SEQ ID NO: 11533 - DNA, 1178 bp, Homo sapiens
agggctttgctgatgggggtaatggggcgggtagttaagtattatctgtggcttgcctgagtgatatttaggtctaaggtgagttaggagactgtgacataagggatctttgaggggaaactggggaatgttgggactcgttgaaggcgcagtcactttaacagcctatctaggagagccatgtgacattaggaacctcttgaaggggattgggtggcatttgggtctgataaggagttgatgtgacgtttagatcctagttgggggttgtgtgacactggggacatgttatgagtggtatatgataacataagatctgtttgaggggcaagttgacataaagagcttgtttaggtggccaaaaggtttccaggatctatttagagggtcttaagatatcaggggtctgttaggggctaagtgacatcagggtgaagtggggaggggaacaaacattagtgaagttgggaagctttcatgagaggactgtcttcttccaatgtgagttatcccctttcgtctaggatgagatcccagcactgtccgtgtcccggccccagaccggcctgtccttcctgggccctgagcctgaggacctggaggacctgtacagccgctacaaggtacattcgacccccaacccagaccttgcacaggacctgacatctcatactcttccccactttccaccactctctggatcagcaagtctggagccatccccttctgtcccctctctgctcgcagaagctgcagcaagagctggagttcctggaggtgcaggaggaatacatcaaagatgagcaaaagaacctgaaaaaggaatttctccatgcccaggaggaggtgaagcgaatccaaagcatcccgctggtcatcggacaatttctggaggctgtggatcagaatacagccatcgtgggctctaccacaggtgtgctaaggacacctcattcattcatctgtccacttaacaactatttcctaccatgtgctaggcagcagcaaacaaggcagggcagtgcagtgcaatgttcttcagagtattttgactgatcgaaaggtagaaatacatacatatatatatatatacacatatatatatgtatatctatgttttttttgtttgtttgttttttgttttgagacagagttttgctcttgtccaggctggagtg

SEQ ID NO: 11534 - DNA, 1162 bp, Homo sapiens
ttcaacctcagagtattcatactggtgagaaaccctatgaatgtaaggagtgtgggaaggcttttagacttcacctacaactttctctgcatcaaaaacttgtacaggtgagaaaccctttgaatgtaagaaatgtgggacagccttcagacatcagtagcaacttactgaacatcagaaaattcatacttgggtgaaaacctttgaatgtaaggaatgtgggaaggcctttcaatatcattaccaatttcatggacattatagatttcatattcgtgagaacccttatgaatgtcaaggatgtgggaaatgctttaccagtggtagaaaccttagagtacatcagagaattcatactggtgagaaaccatatcaatgtgaagaatgtgggaaagcctttagtcatagttcaaacctgttaaacatgttaaaattcatactgatgagaaaccctatgaatgtaaggaatgtgaaaaggcctttagcagtaattatgatcttactgtacatctgagaatccgtactgctgagaaaccctgtgagtgtaaagaatgtggaaaacttttggatttagcttagtctttactgcacatcaaagaattcatactggtatgaaccgtatgaatgtaaagaatgtggaaagacctttacttgtagctcgagccttgttcaacatgttaaaattcatactggtgagcaaccctgtgaatgtaaaggatgtgggaagacctttagacttagttcagtcctttctgcacatcacagaattcatactggcatgaaaccctatgaatgtaaagaatgtgagcaaacccttactgtgaatgatctgcttacgcaacatcagaaaattcattatagttagaagttttatgaatataaggagtgtagacaagccttcactgtgtatgaaaaatttactcaacaccagagaattcatattgatgagaaatcctgtgaacataaaagaatgtgtgaagaactttcatcgtggcctgggatttgctcaacatcagagtattcatactgctgagaactcctttgagtgtaaagaatgtgggatattttatagccacactaaatgccttagagttcagagaagataattttggtgagaaagttactgatgtgaggaatgtagagtagctgccatgttcacagt

SEQ ID NO: 11535 - DNA, 1200 bp, Homo sapiens
cacaatgatgcccctgtgcccatcatccaccgggacctcaagtccatcaacagtaagtggtgtcctctccccaaaattccttccacagaacctctcaaggccaggcctaggtggtgggaaacagggtgagggacaccagatgacactgtgcctggagtgagaaggggcagcagtatgataccttcagggtgaaggtgaggtaggccttgcctgccttaagggagaaaaaggaggctcagaaaggttgaaggacttacctgcctcccaggctgcagagtcacaatcgctcagtaaacatgtatccatgaacacctgcgttccctgcatgaacaggacagatgcagtgcctgccttcaaggtgcttgccatccagccatgctgccagagtccaccaggcagagacaaaaagagcctaccccgtctggagtcagtgtctctcaaccccagcactattggcacttgaggccagatcattgttgtaggggctgtcctgtaaattgtgagttgcttagcggcatctttagcctcttcccactagatgtcattagcattccctgccccctctccccagctatgacaaccaaaagtgtctccaggcattgcaaatgtcccctggggggcagaatcacccccagttgagaaccatttcctggagtcttcataggccgagctggccaaggcaaactggaaaagatgagggaggaattaaattgatgtggcttatataaaagcttccaggctgcctgataggttctccaaagttgattggttggttgaataaataatggagccaggtagaagggaacattctgcaagactcatttctagatggaagagcttcatgtggtgtcaacaagtattaattgagcacctattaagcaggagcccagctgggagtaagacagccatggtttctgccctgacagtactcacaggctagcaatttcattcattcattccacagatatttccagagtgctgtgtgccagaccctgtcccagggatacagcaagaaaaaaaaaatcttacattcctggctctcccattcgtgctgtgccccatctcactccctttcatttcttcattcatttgttcattcttccatttggtatttaccaggccagatcatgtgctaagcaaaggcatcagcagtggagaaggccagcatgtccccggccctcacgtcactcacagttaagc

SEQ ID NO: 11536 - DNA, 1260 bp, Homo sapiens
ccctactcgaccccgtcctacctctcagtgccactgcctgccgagccctccccgggggcgcgggcgccgtgggagccgacgccgtccgcgccccccgctcggtggggacacggcgcccggcggcgctgcgacctggcgctgctaggctgcgccacgctgctgggggctgtgggcctgggcgccgacgtggccgaggcgcgcgcggccgacggtgaggagcagcggcgctggctcgacggcctcttctttccccgcgccggccgcttcccgcggggcctcagcccacccgcgcgtccccacggccgccgcgaagacgtgggccccggcctgggcctggcgccctcggccaccctcgtgtcgctgtcgtccgtgtccgactgcaactccacgcgttcactgctgcgctctgacagtgacgaggccgcaccggccgcgccctccccaccaccctccccgcccgcgcccacacccacgccctcgcccagcaccaaccccctggtggacctggagctggagagcttcaagaaggacccccgccagtcgctcacgcccacccacgtcacggctgcatgcgctgtgagccgcgggcaccggcggacgccatcggacggggcgctggggcagcgggggccgcccgagcccgcgggccatggccctggtgagtgaggcgccctgcacccaggtcacagaaaaccccttctttcctcctctgccagggtcgcaagtccagcccagccacgacccctcaggcagccacctcctgcttcttgtggaggagggagggtctgtgtccctttaccgctcactcctggaggcatcgggggtctccaggggactgagacacaggcggcaaactgatgcctataaggccaggcaggtgcctatagcggttgtgaccagcatgaccatcgccaattcttacacagcctagacactgttctcctccatctgttaactgggtgggagatgcggccatagcagtgttattaagtacccacgtcaggcactgtgctgcttgttttaagttatggttattctatttgctcctcacctgcgtggtgaggcaccatttttatcccccttcagagctaagccatgcctgagcttagcccagtgcaggagagtcgggaagaccagggctttggcccccgaggctgccgctaagcagcagttccagaaggttgaggaacatgccagggtccacccagaggagcaagcagctgggagtggtcccagtctaggtcaaggtcccagcactgc

SEQ ID NO: 11537 - DNA, 1152 bp, Homo sapiens
gacgcaggcacacgtgggtgtgtgtgcatgtgtgtttgtgtgagggcagcgtgtcctccagtgtgcatggtgtgtgggcttgggccccatccctggcccgagcatttcatcctgtgggggaggggtgctgacctagtgggaggagccccactgtgatccatgagctgccctgcccacgcctcccctccctgtagcaacacctctgggtgtttggagtttagcttttgtgggtttgctctccctatcccatctcctgtactacacagttcatggcagggtggggaggggtggggttggttcgggtgggtgagggtctttttcctctgtgtgcgatgttgttatctgacagttctccgtccctactggcctttctcctcgtcttcatatttgtacggtacaagcaataaagacactcatttcagaccagggcccagcctgcactcacgccagcccaaccactctgggctttgccttggtgatggagtcagacccctgggccccagctcctcctgtactagccgttcccttcagcaaggagggcactgagctcagggtgagggcagctggggtgtgtgcaggagctcaggctggagagggtgggtggagctggtgctgtggggctgaggggtatgggaaggctccccgcatgtgggggtggggtggacagagaccactccaggccctcagtgctgcttaggctaagagaggtggggtggagggacagggctggaagatctgggtagcccagaatgaggagggtgcctgtgctgtcactgaatgagagggagtggttcattccacccggctgccgagcctcagaggggggcattcctatcctgccccacctccctgtttatgctgccacctggaagccttgaggcccccaaattccagtacagacccagtggtgtgttcatggtggcgtggttgctgtcacctgggagctcctgagcgtttggttagaaccctgttcagcttggggtcagccctcccctagtcactgccctttagcctggatgtgtctgggcccctgcacttcccgtgcttgagtcacgtggctgcatggccgggcgctggccggatggaacacctcccccagcaagggaccagggaccagagccctggcctgccctgctgagccctgctgtgcag

SEQ ID NO: 11538 - DNA, 2549 bp, Homo sapiens
aagcctgtcttccccactggactgtgagccccatgcgggcagcgctgaggctgtcttggtcatcactgtgtccctagcactgccggcctaggaccaggtacaatatagaattgggactcaaaatattcgtggagtgaatgaccagattaatctctccactccactcatgcccacctattgaccttgcaaatgacattccctttgtgcggcactcccgtcctcttccctctttcttagacctacttccagctcagatgtcccccctctcagggcgccctccctgaacttctaggaaggtcaggtacttcctctgggctcctccagtcccctggactcccccatcatggctctcgccactatctggggtgtcagtgatgggtgtttctcccaactgtgagtcccaggaggccaggcacagaggaagcagctctccatgaatgtgtgttgagtgactcagtgactcattcatcctgtctctgacctccacagcccacaggagtcttcagccgcctgggggccaccccagaaacggacgaggatctggcttgggacagcgacaatgacagcagcagctctgtcttgcagtatgccggggtcctgaagaagctaggacggggcccagccaaggccagtccccagccagcactgactgtcaaagccaaggccacaagctcagcgacaacggctgctgccccgacactgcggcgcctggcgctttcctcacggtctgggcttgagaggaagccggagtccttgtctaaagtcagcatcatcaagagactgggcgcagctgcccttgtgcccgaggcccaggacagccaggtcaccagcaccaagagtaagtcctcagccgaggtcaaggtcaccattaagaggactctggtggggccccgggggagcagctccagcgagggccttggtgcccagatggaccacgcgggcactgtgagcgtgttcaaaagactgggccgcaggaccttctagcccacctgtgggcggggtgcaggcagcagagcctgcgggcatctgccctggccgccccaggctcctggcttcatcacgcctcccaccagctcctggatgacacagcttgtctccctcgggctctagagctaggcccgagcattcgggggatcaccccatttctcctagcctgggatggtcgtcgcagctggcctggcctgctccaggactccccttctctcatgtcctctgtgctttcttctctggctgtggccttggcagaacccacttttctacctctcccaagtgccagggggcttcttcctctcctacattccccttcttcccctgagcagggtctgctgcctcagaccccagctcatcagcctccctgtccccctcaactaagtgggtgtcacctggtgggcctcccttcccccactccccactgacctccctcactcctctgcgcctccccccactgctgtgacttctctctctccctgtcttcactttgttcatttctcttctgttttctgtccccgtggcaaggcccgactgtccgctgcgtcctgcccgaccctcctgtacctccggcctcccagcggccccctcgtcggcggtggcgtcgagcctgttgagactgttagccgccctctactcccaggctggagggacctctccagaccctgggctgcggctgaggcgcatccgttttcctgccctgggcatctgtctctgaaagtgtatggcgggtggtgggcaaggggcactgggaagggaggccagtgcctagagtgaagacagctgctgttttaatatatttttgtgactttcaaatcatttcccccactccttcagggtgagttgcaggactgtttcacactatgcgcagctgggctggggatggtggcagaggattgggctgtgtctctaaaggtcaggcttcctgcacacacatggtccatgtccctgctgcaagccctgagtcagggggagtaatggccacagtcaccattcagttaggccgccccctgcccccaataagccgtagtggttttgtcactctatcccctccccccatggatttcacctgcctgctggcacctttccaaatgatgggctccgtttgtgagaccatgagtttccactggtttggtcgcccacccctccctgctgcacagcgcccctgagccaggcctgtcctaggagctggtagcaggtagtgagcagggcctctccagggatggggtgtaggtaaagcggtggtgctggccaaggaatctgaggagtgggagaaagtggccagggccgcttcagtggttgtggataggaaggccttgcagaaggggtgacatggaggccaagttgggaatgtggcttcatgaagttcaggaggagagctttcagacagagggacagccaggggcagaggtgctgaggtgggacaaggaacaggaagaaggctggtggctgtgggtgagggtgggccctgcctccagcatgaggcagaggtgggtgggcaggggctaggtggctgggggtgttgtgatcaaggaggaggaatgtgcacagtgacccgggag

SEQ ID NO: 11539 - DNA, 1221 bp, Homo sapiens
cagatctcgctccacactctgctccctgatcccggggctcctccgactccccctgcctctcacactccttcccatcctcccctcccactcagaaactctttgtggtccccgcggatgaggcccaggctcgaatcccatatgcccgtgtcaaccacaacaagtacatggtgactgaacgcgccacctacatcggtgagtgtcttgagcaccacggggcgctgaagaagagggggttcagacaccaggggcggccccccgagggtgcccttatgctccacccattcctctctaggaacctccaactggtctggcaactacttcacggagacggcgggcacctcgctgctggtgacgcagaatgggaggggcggcctgcggagccagctggaggccattttcctgagggactgggactccccttacagccatgaccttgacacctcagctgacagcgtgggcaacgcctgccgcctgctctgaggcccgatccagtgggcaggccaaggcctgctgggcccccgcggacccaggtgctctgggtcacggtccctgtccccgcgcccccgcttctgtctgccccattgtggctcctcaggctctctcccctgctctcccacctctacctccacccccaccggcctgacgctgtggccccgggacccagcagagctgggggagggatcagcccccaaagaaatgggggtgcatgctgggcctggccccctggcccacccccactttccagggcaaaaagggcccagggttataataagtaaataacttgtctgtacagcctgtgcctgactgagtggtgtgagatggggtgcaggggtaggggacagctggcatgggcctctggtggggacatctttttgtgctgagccctcaacatgtcactggcatgtgctgagccctcagtgtgtgaccagtgtgggttagcatgtactgagccctcagcatgtgctggcatgggttggcatgtgctgagcccttaacatgtagtgtacatgggctgacctgtgctgagcatgcagcgtgccaccctgtggcccggcatggacttagcactcatgtagccagcatgggtatgtgctgcagagaagcatgttcccagattgatcagcagggaccaaaccattgccacatcccaagggtgaacaagcatggctgagcaccagagtgtgcaccaagtgtgaatttaggcctgccaagtggatttac

SEQ ID NO: 11540 - DNA, 1113 bp, Homo sapiens
tggtcactgagggccatgacgcggggctgaggatgcctccgctgggcatctccctgccacaggtggagctgaccggctttggggaggcaggtaccccagggcagcaggctcagagtacagtcccttcagcagagggcacagcaggctacagggttcaggtgccccaggtgaccctgtctctgcctggagcccaggttgcaggtggtgagctgctggtgggtgagggtgtctttaagatgcccaccgtgacagtgccccagcttgagctggacgtggggctaagccgagaggcacaggcgggcgaggcggccacaggcgagggtgggctgaggctgaagttgcccacactgggggccagagctagggtggggggcgagggtgctgaggagcagcccccaggggccgagcgtaccttctgcctctcactgcccgacgtggagctctcgccatccgggggcaaccatgccgagtaccaggtggcagagggggagggagaggccggacacaagctcaaggtacggctgccccggtttggcctggtgcgggccaaggagggggccgaggagggtgagaaggccaagagccccaaactcaggctgccccgagtgggcttcagccaaagtgagatggtcactggggaagggtcccccagccccgaggaggaggaggaggaggaggaagagggcagtggggaaggggcctcgggtcgccggggccgggtccgggtccgcttgccacgtgtaggcctggcggccccttctaaagcctctcgggggcaggagggcgatgcagcccccaagtcccccgtcagagagaagtcacccaagttccgcttccccagggtgtccctaagccccaaggcccggagtgggagtggggaccaggaagagggtggattgcgggtgcggctgcccagcgtggggttttcagagacaggggctccaggcccggccaggatggagggggctcaggctgcggctgtctgaagcccctagtcagatggggatcccttcttgccttcctttctctaccccctcgctgttgtgtgtgtgataactagcactaaccctaagagggccgggaggtgggtgactgaccagggctggcagggag

SEQ ID NO: 11541 - DNA, 1185 bp, Homo sapiens
tccagaggtgcagctgccgaaagtgccagagatgaaagtccctgagatgaagcttccaaaggtgcctgagatgaaacttcctgagatgaaactccctgaagtgcaactcccgaaggtgcccgagatggccgtgcccgatgtgcacctcccagaagtgcagcttccaaaagtcccagagatgaagctccctgagatgaaactccctgaggtgaaactcccgaaggtgcccgagatggctgtgcccgatgtgcacctcccggaagtgcagctcccgaaagtcccagagatgaaactccctaaaatgcctgagatggctgtgccagaggttcgactccccgaggtgcagctgccaaaagtctcagagatgaaactccccaaggtgcctgaaatggccgtgcccgatgtgcacctcccagaggtgcagctgcccaaagtctgtgaaatgaaagtccctgacatgaagctcccagagataaaactccccaaggtgcctgagatggctgtgcccgatgtgcacctccccgaggtgcagctgccgaaagtgtcagagattcggctgccggaaatgcaagtgccgaaggttcccgacgtgcatcttccgaaggcaccagaggtgaagctgcccagggctccggaggtgcagctaaaggccaccaaggcagaacaggcagaagggatggaatttggcttcaagatgcccaagatgaccatgcccaagctagggagggcagagtccccatcacgtggcaagccaggcgaggcgggtgctgaggtctcagggaagctggtaacacttccctgtctgcagccagaggtggatggtgaggctcatgtgggtgtcccctctctcactctgccttcagtggagctagacctgccaggagcacttggcctgcaggggcaggtcccagccgctaaaatgggcaagggagagcgggtggagggccctgaggtggcagcaggggtcagggaagtgggcttccgagtgccctctgttgaaattgtcaccccacagctgcccgccgtggaaattgaggaagggcggctggagatgatagagacaaaagtcaagccctcttccaagttctccttacctaagtttggactctcggggccaaaggtggctaaggcagaggctgagggggctgggcgagctaccaagctgaaggtatccaaatttgccat

SEQ ID NO: 11542 - DNA, 1224 bp, Homo sapiens
ctcagggagctggacacctccatggatgggactgagccccctcagaatccagtgactccccttggcctccagaatgaagtgccaccccagcctgatccagtcttcttagaagctctgagctcccggtacttgggggactctggcctggatgacttctttctggacattgacacatctgcggtagaaaaggagcctgcacgggccccaccagagcctcctcacaacctcttctgtgccccaggttcttgggagtggaatgaactggatcacatcatggaaatcattctggggtcctaaaactgtgatagaggggatcgatccttcctcatgtcatcttcggtggcctggatccctgaatgcaactctgggtgtgtgtttttgtgggggctcgaagcagtgactatggcctcctttgttcccatttcagggttccacaaactgtcttgcatgtgtgtgtgtgtctggttaccccgaccttctgtgaaggtgggtcttcctgaattaatttatctattccaaatgccttaacgagactctgtttctgggagtctgattttccacttacacatttcttccacctttcctgctagttcccactcccctgtgaccactggggcctcagggaagataaagaaagctgggcctgtcgaaggatgacagggatgtgctgccaggttgctatagaaacccaggctctgcctcttgcaccttgagggggtgggaggggctggtgtcctccctccaggctgaaccccacttcctcggcaggaccccagtctcagcagcctcctgatttcataaccaggccggaccacgtgcaatagggtggaaaccaaactgctccatgccgggttatttaaaagaaaggcagagtttgtggtggcttttttttttttttttggattgtttgtaatttttttaaataaaagtattttggaaggagggatgttgtctaatgtttctaaacttcactgggtcagtgggagggacctggtaagttcctaaacatcagcaccacttccgtgccatagctggggtaggtgtatcattgtacatgacatttattgagtgcttgttggctgagtgctctagctcccacttggaatcctagcactttgggaggatctgcttgaggccagcctgggaaatgtggcgaaacactgcctctacaaaaaatacaaaaaggagctaggcatggcggcctgtagtcccagttactgggga

SEQ ID NO: 11543 - DNA, 2335 bp, Homo sapiens
cctatctctttcacagcccctgcctcttctcagaatcccttctctggaacctggttgggttcataatccctgaccctggcccctgacttgaggcagaattctggaccctgactataacttctgatcctaactggattcagattccagtcactaactctgacccatggctcagccgaatcccatccaatgatcctagtttataatacttgactggtcccttgccctagttgatttctgatccctgtctgatccctctcctgactccaaaatcctggcacaggtagttcctagaaacctagacccacaggacttgcaaccatggtccccggaacccgagaaccttggtcagccctacccacctctgccatagagccctcccccagcctccaactcatgagacttcccaccacctcccccagacaccctactccaaggggattggtcgggtgtgtcccgagactggaccctttctgaacacccccaccccccacagatgtggacgaatgcagttcgggtgcccctccctgtggtccccacggccactgcactaacaccgaaggctccttccgctgcagctgcgcgccaggctaccgggcgccgtcgggtcggcccgggccctgcgcaggtgagcagcatagggacccgccagagagtctgggagtagggcctgggttccagggcaaagccggctggaaaggtggaggcgggaccaaggcgctgtgggaggagcttagaaacctggcattggtgggggcggggttactgcgatgtgggcggagcttgtctgggaggccgggtcccgtgactccgcccaatctcccgcgtaccctagacgtgaacgagtgcctggagggcgatttctgcttccctcacggcgagtgcctcaacactgacggctcctttgcctgtacttgtgcccctggctaccgacccggaccccgcggagcctcttgcctcggttcgtacccgggctgatcctggccccggaaagggtgggcttagggcaggaaaaggcgggacggggagaagagggcgaaaaggggaaaacgagtttttagccggggtattccagcaggatcagggggcagctggtgggagtctcgaggcagtgagggggggcggggcgtggagatgaaagggccgagtctgggtatttggaccgtgattgtaaagaagctgttctaaacccgtcggggggcggtgtttgcagggagggaagtagcgtgaggcaggttggggaaggcgtgagaggcctaggagagccgaggggcggtggaggggtgtggcctagaatgttaggcggagcgggaggtgggccgggccttcggacgccctgtcccgcagacgttgacgagtgcagcgaggaggacctttgccagagcggcatctgtaccaacaccgacggctccttcgagtgcatctgtcctccgggacaccgcgctggcccggacctcgcctcctgcctcggtgagaggccccgccccggcctgatccctcctcccttcgactccccgactcgccgattggcctcccacctctgtctttcctcctccgcttctcccctccccttacctctttcccccgcctcctctcctagcctccccaactctcctctaccccaatcttctcctgccctctcctctgcttccccggcctcccccttctgactctcctctcccctctttgtatcccccatcttgcctccctgcttcccacatccgaccacccgacctctctcctcagacgtggacgaatgtcgcgagcgaggcccagccctgtgcgggtcgcagcgctgtgagaactctcccggctcctaccgctgtgtccgggactgcgatcctgggtaccacgcgggccccgagggcacctgtgacggtgagcctgcccccacccgccttcgctagcgcttgcaacgcggtgctggaggctgctcccttggggactgaggaggggcgccctgcttcccagacttaggcggagggaaagaacaccctctcaccgtatctctgtagtggaaataagccgccaccgtgtccatgtattttcttgtgtcaggatcacggccaagcctcccttccagccgcagtccattccccctctgcagctgaagcccggtccacattttaggctatgcccccagtaagacaccgccccaaaactgttaggccccgccccttccaatcggcctctggattaaaaccccctcttcaggccccttctcttcctaacagaagtttggacgtgccctttccgcgccctccaccagtcctacttccagccttccctccaaagaggcccaatcccggtggccctaggccccattctttcccaatga

SEQ ID NO: 11544 - DNA, 1180 bp, Homo sapiens
gatgggtttttgccatgttgcccaggctggtcttgaactcatgggctcaagcaacccccccacctcagcctcccaaagtgctgggattacaggctccaacacactctctctgtgcttcttgccacctctctttttgcccactgtcccaaccactcttctctcatttcctgtgccttcagcacttacccccatacagtgagatgtcagacaatgctcagagaagcaaagcaactgccccgaggccacacagccctccagaggccagacttgggtagacccctctcaggccctacctcccagtcattggacaccttcttctgccctctcctcctatatgacagtctccttgttcctcaatccagaaccctggagtgacctcagagaacttccagagttagatcacagctgatgagaaggatttgctgataggcagagggtgcctgggctgctcagcaggggaagggtccagcccctgggaggacctgagtgccaggcccactctgacacatgctgtctccacctacagatgacaatctgggagtgtgctggcaggaagtgggggctgacctcgtgtgcagccaccctcggctggaccgtcaggccacctacacagagtgctgctgcctgtatggagaggcctggggcatggactgcgccctctgccctgcgcaggactcaggtgctggcactggcctaggctgaactcagaggccttgccccatgggctccaaatctaggccctcagatccccagtcgcagaacccccagactctatccaaactctgtcccctagaccaacccctatgtcgcagcccatcccaaaatcttggtccccgattcacactccaaagacttccaagtctcagccacagacatcccaaggcctgacccagcagatcccatagtaccagacccacaggcccctgaggtctggtctctcatatgctcagctcctggtctctagaaccaccagacacagcctatgagatgtcctcccctaaatcctgggcccttagacctgaaatgccagttgctcagacctcaccatcctggccccagaccccctggtcacagccccacagacctccaagtcccattgccttagacaccctccaagtcccattgccttacacaccacatccgggtgcctaagaccccaacacacagccccagagattcc

SEQ ID NO: 11545 - DNA, 1108 bp, Homo sapiens
cctaagctggtctcaaactcctgggctcaagcattcctcctgccttggcttcccacagtgctgggattacaggcgtgagccactgcgtccatccagattcatgatatttagatgttgaaatgtggctttacagactcagacagctctctgaggcaaacaaagagggagatgcaggtaccctcagcacaagccccaaattacctgcaggggagaggcggaaaatcagacaatgtagaaaccgggagaagaaaggtatggacagaccgatgcagataggaggggaaggaaatacctggaaatgagatagagaccggctggacagaccccggggaccctgcaggtcaccacacccttctctttcagctcacctgttctccaggaccagccctgctggggcccaggcccaggctctgagaggccgtgtcctaacctgccctggccccggagaagctacgttgccacctgtcccccttccctggcctggtggggcctggctttggggcaagactgagccacgggggaagggggaatcccgtacctgctgctgcttcctctgtcttggctaacgtctgtccccctgaacccctaaccataccccaagagctcccaaagcctgagaccagggtcatttgtccccaactccccatctggccctgctgttgctagtacctgttatttattacctggaggcctgtccagcacccaccctacccccataaagcattgtttacacctgtgtcttggcctccattattgtgagatggcagggagatggaagaggtccctgatggaagaatcatgtgtcatggtgtttgggggccttgtttctgtttttttgttgttgttgttgagatggagtttccttcttgttgcccaggctggagtgcagtggcgtgatcttggctcaccacaacctccacctcccgggttcaagctattctcctgcctcagcctcccgagtagctgggattacaggcatgtgccaccacacttggctaattttgtatttttagtagagatggagtttctccatgttggtcaaggttggtctcgaactcccaacctcaggtgattcgcccgcgctggcctcccaaagtgctggaattac

SEQ ID NO: 11546 - DNA, 1108 bp, Homo sapiens; identical to SEQ ID NO: 11545

SEQ ID NO: 11547 - DNA, 1221 bp, Homo sapiens
ggggcctaggtgggagcagaaccgggtggctcaaaaggatggccgcctagtgtgtgtggatatggtagctggaattgcagaaaactaatgtccaaccaccctggtctccaggtacgccatcactgtctggtattttgatgccaaggagcgggcagcagccaaagacaagtatcagctaggtacctgcttccctcccttcagtccttcctattctgtgggccctcttgggcctgatgccaccccatccccctcatcagcctcttgttaaatcccaccactcatttttcttcatctctgcccaccttccttagcccactctcctggtaccccaacaggagccccatttcttcctggtcctctccccatctccccaggtttcccttggcttctttgtccttctgatgactcactgtctcctgtcccctctcacccccagcatcaggacagaaaggtgtccaagtacctgtatcacagccgcctacgcccacctagtggccagtcccagagccgcatggcagacagcttaaatgacttcaggagagccctgggcctgtgctggctgctccttccctgccaccgctgctgcttctgactttgcctctgtcctgcctggtgtggagggctctgtctgttgctgaggaccaaggaggagaagagacctttgctgccccatcatgggggctggggttgtcacctggacagggggcagccgtggaggccaccgttaccaactgaagctgggggcctgggtcctaccctgtctggtcatgaccccattaggtatggagagctgggaggaggcattgtcacttcccaccaggatgcaggacttggggttgaggtgagtcatggcctcttgctggcaatggggtgggaggagtacccccaagtcctctcactcctccagcctggaatgtgaagtgactccccaacccctttggccatggcaggcaccttttggactgggctgccactgcttgggcagagtaaaaggtgccaggaggagcatgggtgtggaagtcctgtcagccaagaaataaaagtttacctcagagctgcacacatctgactccatctgcaatttagggcctttattgaccgaggagggtatggaggtttgagggccagtgagcccaccatagtggagcctgacctcagcaggccactggctggagctggaagtctggggggacactgcccaggccagtgcactgcaggtga

SEQ ID NO: 11548 - DNA, 1221 bp, Homo sapiens; identical to SEQ ID NO: 11547

SEQ ID NO: 11549 - DNA, 1203 bp, Homo sapiens
catattagtgtatctataggatgctgagttatagagcatgtgcatttatggggttttgttgtttttttcttttaatgtttttgtaaagatggggtcttgctatgttggccaggctggttcctaactcctggcctcaagccatcctcctgccttggcctcccaaagtgttgggattacaggtgtgagtcaccatccccagccatttacagttttgatagagacttctagattgccctctaaagacactgtaacagtttatctttctactagatgttacaagagtctcttaaactaaaacataaccgtattttgaaatgcctgtctctgtggccctgtactctactgatccctttggaggccctggcttcgattcggttcaacaggcttttcagagctgcttaaacgcttcttctccagcaagaaaagccattgctattttttaatgcctgatatgcttccctcctatattggctcataacctacggcctccagagaagcaaccctgagcccttttgtcctctttcctcagatcaatgaggaaatctccgtgaagcaccttccgtctacagagcctgacccccacgtggtccgtatcggctggtccctggactcctgcagcacccagctaggtaaggaggggtcagctatgcagtccagagaatagagtgactgtccctacccttggattttcaaggctcctaagcttccttttccagcgtcagacttagaatagaactaggctgaagtggaacaggtacaaggattaggtatatgccactgtctctgtcatgctgtattcaactgagaggactatggtcatgaaacaacttttctgtgaagaatcaattcttatccttcatcttttaggagagggtccaaaattctctttaggaatctattccctttctgtaaaaaggatcagtgtctcctgcccttaaaccaagctgctgataagttcccaagctccattaagttctgtctgtattttctgtccggagcctaacctagaggaaaaaggggagcagagaccagtgaggccagggctagttgggagaggggcaggggctgcctattgaaaggttttgaattttgcgggtccccaggcttcaatgaccttctggtcccaagtgactgattattctgaccaatgctgacacctcctgccttccgtttatgatcatacaaacgttccaattatgaaaa

SEQ ID NO: 11550 - DNA, 1393 bp, Homo sapiens
agtagccagtgtgacccagaggctcccggaggcccctgccggcttcctccaccagcgcctgcctcggcccctcctctgcccccgccagatcccgtggtgctggggatggggtcatcccagggctgcctccctccagcccactgcctcccctctgaggggcttccttcccctccatagggccaggcatttttttctggattcaaacaggcaacaatgaccttttattttctgtttgtccccacctccccagccttccacctcctgttcttcctaccttcttcctttttgactaaataatccccacctcccttgatcatacagtgaggctacagtgactgaggggagaatcccctcctgttcactctcccaaccctgctccagcccctcagcttcccagaccctcatgcagttggttgtaaattctcccaggagctgttttactgtctacttttcaggattaaaaaaaaaatcaaaacttaaaaaaaaaaaagtttaaaaagcaaaatggggagggggaggaagcagtgacttttttttggtaattatgcgcttttttttaatttttagaatttgtctttttactgtgggtgggctgttgatatttcatcaagataagcatttctttcctgagttcaggtgactgaggaagagccacaaaacaaaacacaacaaaaccaaaccacagaatcatctttaacccaactttttatacgatgccccagttccccataactttgcacacaagcttctgtgttcagttgaattgtaactgctttttgtatttggagagagtgactattgaacttgaaaccttttattccgggcgtcttggtagtttctggtgggattcagtgggtgagagggaagaaggggaggttggggggctccttcccttcagaacttgaagtttctcccactgcctcctctccagtggtctcccaggtgccagacccaaaagcttttcctacagtgataccctttatttttacttccccttgactcatatgttttaacatgattttaacaaactgcacttattaagaaatgtgtttgccctgttttgtttggtttcgttttgttttctttgaataaatgacatggcacctcctagcaggaaggaagcagggttgaaaccctgaagtgttactgcagttggccgttaattggggtgggggcctctttaaagggaaattatttactcattcattaaacaacttaactgagggattcatgtgcctggccccgattttggtgctaaaaatgcacgcttaaacaagggtccctggtttaaaatccactagttcatttttaaagtgcttctcttgttctctacctctcacagtctaaaatccctccaggagtttttgagtaaaggacatggaacaggcctcta

SEQ ID NO: 11551 - DNA, 1226 bp, Homo sapiens
ctcccctctcttctctcacctccctcttcctctctcacctcccccctcctctctcaccttccccctcctctctttcctccccactcctctctcacctgggttttctttccccaccttccatccccctccgatctccctgccacttttcattttttcagcccttcctccccttctctttcaagcccccctgccccctgccccccaccccccgcctcgctcctgcctcctggtgcccgtccctcaaccccccacccctctgctctgtgccctgggggccctgtcccccttacagctggggggcaggctctgcctcctgcccgtccttgtgccgctgctttggggaccctttggtgggtgcggggaggtgggtcaggttccatctgggcccacctctgaccctgtgcccctctctccccagaaggtggaagaggtgggtgcctgggccctgggtgggggaagggctagcccctcccccatttctcccagcccctcccctctccccatggccactccctccccttcactccctgtgaggggtgggtggggacatcaccctcccagttgaagagctaagtatggaaatcctccccaccccataacaccccctctgttgccatccccctgcctcagggaagggagggggtcagtcctatgctccatcctgggttccccatcccttcccccatcaaatttcagtatcccccctcccccaagaccccccactaccccagtgcccctaaaatcccaccactcctctgactctctcctctcttctgttgcatgtttgatccctgtcctggtcacccttgccccggtcctggtctctccctgtctctgtccctgtcctggtctctccccgtctctgtccctgtcctcgtctctccccaatttctgtccctgccctggcctctccccacctctgtccctgccctggtctctccccgtctctgtccctgtcctggtttctcttcgtctctgttcttgtcttggtctctccttgtctctgtccccggcatctgcctgactctgtccttggcctcggggtccaggctatcagggcgtctggggcgctcagagagcctgcgggtgagtgaccgccgccggccttcccggggcagcctcggggctaagggccggggtgggggccgctcccggagcgacgtggacatggaccccagttccgccacggcagtgcttggccctgcccgacgagccacgtatgtcaa

SEQ ID NO: 11552 - DNA, 1099 bp, Homo sapiens
aaggactatcagcggcgcctggacttgtcccaccttcggcagagcagcgaccctatgctgagcgagttcaaggtgtgaccataccctcctgcctcccccgcccccctactccttggcccaggggattctgtgatacagcccccagcctgtcctgcccatcccataatacacccaggaagcgagagctctgtcccccacctcatgccaatcccatgatccccagcctgtggtcatccccggccactgccctgcccttcccctccccaccaaccccaatcaccccctgccaacctgcacaaaccatcaccccctcctgccccagaacctggacatcaccaagaagaaattggtccacgagggcccactgacgtggcgggtgactaaggacaaggcagtgggtgagtgccagagcagctgcctagtgcagggtgttggggcagtgagccaagggcggggagggggtcgcgcgggggcacgccgtgtgagcactgctcgccccgtagaggtgcatgtgctgctgctggacgacctgctgctgctgctccagcgccaggacgagcggctgctgctcaagtcccatagccggacactgacgcccacgcccgatggcaagaccatgctgcggcccgtgctgcggctcacctccgccatgacccgcgaggtggccaccggtgagtgcagccactgcatggcccagggcagagggtgtcttttttgggcagagctgcctgtggagtggggagcagaaccctctagagagccagggagccagcattctagcaaagaggttgagaagtaggtggaggtgggcagggcggggccaggcctagagggtttataagtgaggtaggaactgctgcaggtgtttgcacagaggcgtgtcttgtgtaaacaaggagaagaaaggccaggagtccagtgaggagggatttgtaaacatactactaggaagttgcaccagggccacaaacactggaagcggctggagggtgggagtggctggaggggtttcgttaggtaagccagggtacatgcccgattccataaggaggtgtgagaggtggggctcaggaggacacatcgggccctggatattagc

SEQ ID NO: 11553 - DNA, 2058 bp, Homo sapiens
gggcttgtgccctatctccctgactatacactgggccggggcctgggttatgtctccactggctgtgggcacatgctgacctgcacccttcctccccacccggggtcatttctgggccctgcctcctctctccctgctctgtgttctgtccgggcctgtattatctcgagtgctgtcagtctcagccccttcaggaccttggctcttttatggccctagggagaagttgctgcttgaattggagtttggggaacccctccatccccagcccttgatgctgggacacagttgaggcctaggggacggagtcagtgtgtctggagacgtgagatgatgaggatggacatgcgatgagggtccgatttcaggcccaaggtgggctcctggagtcagtccatgctcctggcccctccccctccctacctctctctctctcgcctccctcagttgctcactctccgtgcatttctctctaactgtccacttctgtcttcccctctgtccccctccacccctgcccggcttcccctccagcagaaggcagacctggctgtggccgccttcaccatcacagctgagcgggagaaggtcatcgacttttccaagccctttatgaccctggggatcagcatcctctaccgagtgcacatggtatggttcccctggagaccatgggctgcttgcctggcatggaggctcagggcctgcgagtgggagccagacagccccaggacctcagatgggccggtcaggctcccaggtccctggtagggcaggggctgggtgtgaggctcaggccaggggtgtctccgggtctcactccctctccccacagggccgcaagcctggctacttctccttcctggaccccttctcccctgctgtgtggctcttcatgcttcttgcctacctggctgtcagctgcgtcctgtttctggctgccaggtgagtccactgcctactgggaaggaaggggctggaggaggcacgagccgaggcctctgggaccgacctgcctcttctctctcggaactgtccttggcctcccctttggggcctcggattccctgtgccctcctttctcagttttgtgccctgtgtctgagtctcattcttccccttgtggctctgactgtgctctgtggttctctgttcaggtctctccccttcccgcctctcccttttttgcctcctcccttctctatttctctctgagtatctctgtgtctctctctgcctcttctgtctccatctctgtgcatctctctctgccttttctctgtgtgcttctgtccatcttgctcctttttccatctctccccctttcttctgatcactgtgactttcctttgcttctttccttttcctccccacctgggctctgggccccatccacacgctgcacgtctctccacaggctgagcccctatgagtggtataacccacacccatgcctgcgggcacgcccccacatcctggagaaccagtacacgctgggcaacagcctgtggtttcccgtggggggcttcatgcagcagggctcggagatcatgccccgggcgctgtccacgcgctgtgtcagcggagtctggtgagaagctttctatctgcctctgcccggggcgagggagggacccatctgaggcctggatggggttggggctgtggcatctcctggaagatttgattccccgttttcccttgcagagctgtgtgacgaggaatggggtggggagagctgagctccagctctgccgcttactggctatgtgagcttggccagaccgcaaccctccctttgcctcagtgacctccctgaaagatggggagaaagatgcccatgtctcagggttgtgaggattcagtgaggctgctaaggaataaaagaatggctactccaattgcttgaactcaggaggcggaggttgtagtgagctgagaactccccactgcactccagcctgggcaacagagcaagactctgtctcaataaataaataaataaaagaatgactactccaaagacagagcagccctgagggctgctggttgcccatt

SEQ ID NO: 11554 - DNA, 1117 bp, Homo sapiens
tgcctcctgtgcagccgtgaatttggaaaggccttgcagctgacccggcaccaacgttttgtgcatcggctggagcggcgccataaatgcagcatttgtggcaagatgttcaagaagaagtctcacgtgcgtaaccacctgcgcacacacacaggggagcggcccttcccctgccctgactgctccaagcccttcaactcacctgccaacctggcccgccaccggctcacacacacaggagagcggccctaccggtgtggggactgtggcaaggctttcacgcaaagctccacactgaggcagcaccgcttggtgcatgcccagcacttcccctaccgctgccaggaatgtggggtgcgttttcaccgtccttaccgcctgctcatgcaccgctaccatcacacaggtgaatacccctacaagtgtcgcgagtgcccccgctccttcttgctgcgtcggctgctggaggtgcaccagctcgtggtccatgccgggcgccagccccaccgctgcccatcctgtggggctgccttcccctcctcactgcggctccgggagcaccgctgtgcagccgctgctgcccaggccccacggcgctttgagtgtggcacctgtggcaagaaagtgggctcagctgctcgactgcaggcacacgaggcggcccatgcagctgctgggcctggagaggtcctggctaaggagccccctgcccctcgagccccacgggccactcgtgcaccagttgcctctccagcagcccttggaagcactgctacagcatcccctgcggcccctgcccgccgccggggtctagagtgcagcgagtgcaagaagctgttcagcacagagacgtcactgcaggtgcaccggcgcatccacacaggtgagcggccatacccatgtccagactgtggcaaagcgttccgtcagagtacccacctgaaagaccaccggcgcctgcacacaggtgagcggccctttgcctgtgaagtgtgtggcaaggcctttgccatctccatgcgcctggcagaacatcgccgcatccacacaggcgaacgaccctactcctgccctgactgtggcaagagctaccgctccttctccaacctctggaagc

SEQ ID NO: 11555 - DNA, 1102 bp, Homo sapiens
tagcaccacccaccaaatgttcttttccagaaggtgaaagagaaagggcctgaacaaccttacaccaaatattcagtagcttcatccaaaggatgtacagaatttttagcattgtgctcaacagaatgtgtccctaccatgtgtccccttctcccctggcccccagctctccccacctgggcagggggtcttgctttaacctcctccctccccccagcaggggagagttcaagggaaggcctgcggacaacttttcatcccctgttcctccctcttttcccctttgaagggtgggctaggccattttgccaagttctagctctcacaagtccctcctcaaccctgtcaccctcctctgctctggaactgactccctccccagcctatgggaaggtggaaatttcaggcaagaggggatgaagacattcagttgagggcattcagttgtctttttccatcctgtctgtttccctgaaaaaaaaaaaaattcatattccagtgcctatccgtgggatccttcacgttctttgacattaaccagaaaccaaaaagagaactcacctcgcttttcccaccctgtgcccctctggtactggcgaatgcctctccctccccccacatgcacgcacgcacacaccccagtggtggggttcctcgagatggcatccccatcagggtccatgtggtggggacagtgccacagcctgtggtccccatctgagagggcgcggtggtggccaccactcccacaagacctccacaactcttggctggaccctgtgtttgaccagccccggacacgtctccactgacgacggacagaggagagacaccactgggagccaccctgccctcctgctattgtggaggccaacaaagttttgaaccgaaaaccaaaaaaacagaaacaaacaaacaataaatttaaactagaaaaaaaatttatatatatatataaacatatatatatatatatatataaaagggaaagaagatgaggactcttcaagaataagatggaaccgcgaggcggagccaagcccctgcaccggtggtccaggcccttgttccccaaggcggatggaaggacggatgcttcttt

SEQ ID NO: 11556 - DNA, 1160 bp, Homo sapiens
catgttggcgaggctggtcttggcctcccaaaataccgggattacaggcgtgacccgccacgcccagccagtagtccctgttttaacaagtccttcaagtgattgtggtgcacattaagagaaccaaggtttcaaatgggtttccccaaagctgtgggggcagcagggagagtgggcctggaagggctcttcaggccaagctggtggggtagtggtgctgtatggggaaagctgggctaaagttctgctatcctgtgcccgccgcaggtgtacatgtaccagctcttccgcagcttggcctacatccactcccagggcgtgtgtcaccgcgacatcaagccccagaacctgctggtggaccctgacactgctgtcctcaagctctgcgattttggcaggtgggcctggggcatgttgggtggctgaagaggcaggggggaccccaacccttgcctcacgtgtacccctgcccatctcttcccacagtgcaaagcagttggtccgaggggagcccaatgtctcctacatctgttctcgctactaccgggccccagagctcatctttggagccactgattacacctcatccatcggtcagagttatgggagggtggcggggggagtggcaatctgggaagttttggagttttctgtgtgctgtatgccaagcttggtgatgaaagcttaacttctgttcttgtatccagtcctcacaaacttaggaggctgatgctgttgaatgctaattttacagatgagcttagagctgtgaggccgcctgcccgcactggcaccactaggactgggcaggactgggatttgaaagctgacctgactccagagtccataccagctctggaacctccctgtcagccctctgttctcagctagggggaagggctgctggagaccttgggggaaccgggaagcaaggctttgccaccatgaaggtgcaacttgctcccagggcctctgtgtccttccctgtttgtggggacaactgccattttccaggcatgaggggaagtctgaattgagggaatgggcatgagagtttgaaagggcaccttccacagcagcatgacgaactgtggagtccttaggtatgaactcgtgctgtgggggtcaaggtacaaagcagggaggggtgagactgccac

SEQ ID NO: 11557 - DNA, 1874 bp, Homo sapiens
atcctctagtcctgccttagatgtgaggagagagctggtacccaccctctgggcacttgatttgtcttttgtggcctacgttcctcagttggcctttgggaaccacacctaagtgcgtgttaaggtgtggagtctagacctgggtcccacgtacctgaccttcccaatggcatttctgtacccacagctattactataacaagcgcattctgcacaagaccaaggggaaacggttcacctacaagttcaatttcaacaaactggtgctggtcaattacccattcattgatgtggggttggctggtgagtaccagggatggttggtgtggagagggtctacatgccccttcaggctaggccaggggccttgacactgtctcccttctgccagggggtgcagtgccccagagtgccccgccagtgccgtcgggtggtagccacttccgcttccctccctcaacgccctccgaggtgctgtcccccaccgaggacccccgctcaccaccagcctgctcttcatcttcatcttccctcttctcggctgtggtggcccgccgcctgggccgaggctcagtcagtgactgtagtgatggcacgtcagagctggaggaaccgctgggagaggatccccgcgcccgaccacccggccctccggatctgggtgccttccgagggcccccgctggcccgcctgccccatgaccctggtgtcttccgagtctatccccggcctcggggtggccctgaacccctcagccccttccctgtgtcgcctctggccggtcctggatccctgctgccccctcagctctccccggctctgcccatgacgcccacccacctggcctacactccctcgcccacgctgagcccgatgtaccccagtggtggcggggggcccagcggctcagggggaggctcccacttctccttcagccctgaggacatgaaacggtacctgcaggcccacacccaaagcgtctacaactaccacctcagcccccgcgccttcctgcactaccctgggctggtggtgccccagccccagcgccctgacaagtgcccgctgccgcccatggcacccgagaccccaccggtcccctcctcggcctcgtcatcctcttcttcttcttcctccccattcaagtttaagctccagccgcccccactcggacgccggcagcgggcagctggggagaaggccgtagccggtgctgacaagagcggtggcagtgcaggcgggctggctgagggggcaggggcgctagccccaccgcccccgccaccacagatcaaggtggagcccatctcggaaggcgagtcggaggaggtagaggtgactgacatcagtgatgaggatgaggaagacggggaggtgttcaagacgccccgtgccccacctgcaccccctaagcctgagcccggcgaggcacccggggcatcccagtgcatgcccctcaagctacgctttaagcggcgctggagtgaagactgtcgcctcgaagggggtgggggccccgctgggggctttgaggatgagggtgaggacaagaaggtgcgtggggaggggcctggggaggctggggggcccctcaccccaaggcgggtgagctctgacctccagcatgccacggcccagctctccctggagcaccgagactcctgagggctgtgggcaggggacctgtgtgccccgcaccccccatgcttcttttgctgccttaagccccctatgccctggaggtgagggcagctctcttgtctcttccctgcctcctcccttttccctccccacattttgtataaaactttaatttcttttttttaaaaatggtgggggtgggtgggtgcccagggctaggggctattccctgt

SEQ ID NO: 11558 - DNA, 1184 bp, Homo sapiens
gattccagacttgggtggagtctttgagggtggatgtgttgcctggaggccttgttggtacctgtttgagctggggccaagggaggcggattgacccctgcagcctgactggatttgggagccgcccatctttagctggccaccttggccttctctctctagtggcaccagggaccctgctctgcctccccactccttcccttcctcccctttccctcctcccacccctccattaccggctgcctggtgctgaattattgatggcccctgttgttgggaaatgacaacaaccgcagtccccccaccccccaccccccaccccaggctgcccaccccctccagagaccagccagcccaccgccaacctctacccaaggttaatgctgggggtgggcaggcaggtgggcagggaaggagctgaagatgagaaggcagaagtgggaagagggtgacagctccagggtgcctgctcaagctccaggcctgggctgggccctccagccaggtggggcctggatgcctgggtctggggagggcagtgtagctcagagggtccagggcttggggggcctctcagacagtctgggtttcactctccagggaagacagaagcctctgtgtgtgcaagcgctgacctcatcggcaaccgagtcaccccacccctcctggtccttttaagaaaaaaaaaaaaaatcttcctctcaggtcttggggttgggagtaggggctctgttgggtcttcggaggagacagtgcatgtttctaaggaggacatccgaggagctggggtggtgcaactggctctgaatgggagtgggggtaagctggggggctgtaccccaacccggctggccacgtgtgccccttcctgcccctcccccactggcagccctgcccgccagcctggcttggtgcctggccccctggcactggccccgggacccaccgccgacggtttcctgtttctcccggtgtcgctggagcgggctccagcttcccctcccccccagctcctgtctagcccctcacatgcagacagacagacacgcactgtcttctcttaaatcagatcttgacttggctgaggtgagacagatttccccatgttgaaggcagggcagaggtggaccctgggatgggacccagagccctggacttggcagcctgaccccaggccactccct

SEQ ID NO: 11559 - DNA, 1181 bp, Homo sapiens
cccctgggaacctgagaccatgctgaggaagccccctacaggccctgaggaagagcaggcagagcctggggccaccctgccaccctgccctgctgccctggaccccaaacagcccgaggatgctgaggtctctaagatcagctttggtggcaacctgggtactcactgtgaggagggcgaggagaagcaccctccagccctgggtaccccagccctgctcccactgcccccaccccagctcctgtcaccaccacccaagtctccagcctttgtgggccccggccgccctggcgagcagccctcgccctgccaggaggggagccagggcggcagccgcagcagcagcgtggcctccctggaaaaggggacagcaccggcagcccgggcccgcacgccactgacagccgcccagcagaagtacaagaagggcgatgtggtctgcacacccagcggaatacgaaagaagttcaacggcaagcagtggcgccggctgtgctcacgagatggctgcatgaaggagtcacagcggcgaggctactgctcacgccacctgtccatgcgaaccaaagagatggaaggcctggcagacagtgggcctggcggggcgggccggcccgcggccgtggcagcccgtgagggcagcacggagtttgactggggtgatgagacgtcgagggacagtgaggccagcagtgtggcggctcgtggagactcacggccacgcctggtggcccctgctgacttgtcacgctttgagttcgacgagtgtgaggcggccgtgatgctggtgtcgctgggcagctcgcgctcaggcacgccctccttctcacccgtctccactcaatcgcccttctcgccagccccatcaccctcaccctcaccactcttcggcttccgccctgccaactttagccccatcaatgcctcaccagtcatccagcgcactgcagtccgcagtcgccacctgagcgccagcacccctaaggcaggcgtgctgacgccaccagacctgggcccccacccaccgccacctgccccccgagagcgccactcctctggaatcctacccaccttccagaccaacctgaccttcaccgtgcccatcagccctgggcgacggaagacagagctgttgccgcatccaggggccttgggggcccctggcgcagggggtggaggag

SEQ ID NO: 11560 - DNA, 1168 bp, Homo sapiens
ttccgtgatgtctctgtgcatcctgactctctcaagtcctcagtgtctgtaccctcctccttctctgtgtccccacctctcactgtcatcttgcccatcctgttctcaccccaagttctgtgttccttgcttttgcttagagtcccacttgaggtcttggtcttcccctgccccagtctggggccacagctcaccctggcctatgggtgcccttctccacagatcatccagctgaccccggtgcctgtgagcacacccagcggcctggtgccgcccctgagcccagccacactccctggacccacctctcagcctcagaaggtcctgttgccctcctccaccaggtaattgcagctgagcccatactcagaggccagggaaggggtggggcggggccggcttacctcactcctccccatttcctctcctgcggcagaatcacctatgtgcagtcagcgggcgggcacgcgctgcccctgggtaccagccctgcgtccagccaggctggaacagtcacctcgtacgggcccacgagctctgtagctctaggcttcacctcgctggggcccagcggccccgccttcgtgcagcccctgctctcaggtgaggggcggcctggcaggcagtgctggggacccagggtggggctgaggcagtccgggccctaacttggtctcctgcttcttcttctctgtctttcagcaggccaagccccactgctggctcccggtcaggtgggcgtgtcacctgtgcccagtccccagctgccgcctgcctgtgcagcccccggaggtcctgtcataacagcattttactctggcagccctgcacccacctcctcagcacccctggcccagccatcccaggcccccccaagcctggtctacactgtggccaccagcacaaccccacctgcagccaccattctgcccaagggcccgccagcccctgccactgccaccccagccccgactagccctttccccagcgccacaggtaggtgtcagatcaacccagagcagagtgagttgggggacccaggggatgggctccagtcaggcctggctcagcaaacaattttctccccactagcaggttccatgacctacagcttagtggcccccaaggcccagcggcccagcccgaaggccccccagaaagtgaaggc

SEQ ID NO: 11561 - DNA, 1064 bp, Homo sapiens
ggccctgagaccatggtgagcgcctgcaggccgtggggctcccactgccacttggctgtgcctctccattgacgtctttgcttttctgtcctactcttctttccatgcctgtgtgtctctcaggttaaagggtcccctctgtcccttctgcctgcctgtgttgtctcctctcccatctgaggcccctgtcttggccttcctgaggccgtgtgacagccttctcaaggggtctgctgggcgggctcagatccaactctttgtttctggcctttgccccagagtctgagctcagtgttcgccatctccctgcccatctccaccccaggccagcaaattccccagctcatcttcagactggcgcgtccctgggcagggcctggagaatcgtggggagcctcccactcctcccagcccggccccagctccagctgtagcccctggtggcagcagcgagagcagcagtgggcgggcagccggggacaccccggagcgcaaggaggcggctggtactggcaagaaggtgaaggtgcggcccccgcccctgaagaagacctttgactctgtggacaagtgagcatgggctggggccttggtggagcgtgttagggtggcgggagtgggagcagctgcaggctgaggcgggggaggtgaccctgccggccctccagcagggtcctgtcagaagtggacttcgaagagcgctttgctgagttgcctgagtttcggcctgaggaggtgctgccctcccccaccctgcagtctctggccacctcaccccgggccatcctgggctcttaccgcaagaagaggaagaactccacgggtaggcgagcattgggcacccagggtccttaggtggagggcagactggggccacctgcactgagtctgcttctgtttggccagacctggattcagcacccgaggaccccacctcgcccaagcgcaagatgagaagacgctccagctgcagctcggagcccaacacccccaagagtgccaagtgcgagggggacatcttcacctttgaccgtacaggtgccgtggtgggcagaactttgggg

SEQ ID NO: 11562 - DNA, 1127 bp, Homo sapiens
cctgtgctccccaccgtttttctatctccagcccaggccacagccgccttccaggcccgctatgcagacatctttccctccaaggtttgtctgcagttgaagatccgtgaggtgcgccagaagatcatgcaggctgccactcccacggagcagccccctggagctgaggctcctctccctgtaccgccccccactggcaccgctgctgcccctgcccccactcccagccccgcagggggccctgaccccacctcacccagctcggactctggcacggcccaggctgccccgccactgcctccacccccagagtcggggcctggacagcctggctgggagggggctccccagccctcccccccacccccaggtccctccacagctgccacaggcaggtgagggacccctgagaagatgccaggacttatagtaccccctcaggacatggacagtatgtgggggcaggaaggttatctcctcccgggtaaagccatttcgtcctctccagtttggggcggaatgaggcctgctcctcttgtaaatacccccttccctcgaagctccctcccggtgctggggggcagctgaggggctgcaggggcagtctccctcctccaagcccctgtacataacctggagcgtgtgaccttcagagcttttcactttatgcaaaatggctcctgtgagggctgcaagctggagggtggtgcaggccttgggccacagggaggcgcctgtggaatagggggagttcatgcaccccttttttccccagaggggctggactcaggttagtttgggggtgggggctcctgcactttgccacaggcacggggagggttttctcctcaccccctctgccctcccaacttgggttgtactttctaagaaggtgattccccctgcccttgcccccttccccagaacaaaacatgttgatcatgtgcaatatttcttactgtgccgagaagccgcaatgagcgagattaaagctgtttaacacacctgtgtggctgtaggctcttaacagggagggctgttggttgtaccagtcctgtcctgagttgtcatggagcggtaggctttccatgaggtgggggcaacaattccagtaccactgcccccaa

SEQ ID NO: 11563 - DNA, 1147 bp, Homo sapiens
tcccagctacttgggaggctgaggcaggagaatggcgtgaacctgggaggcggagcttgcagtgagtcgagatcgcgccactgcactccagtctgggcgacagagcaagactctgtctcaaaaaaaaaaaaaaaagaaaacgaaagagggtaaaacccagaagtctcttgctaaatgagggctaggatgtgatatttaggaactaccctcccaccctccccacttgcccatccctagtgttttctgcagctggaaacttcatggtggtgggtggaggacaggttggcacagagaacaagatactcaaatgcttgtttccttactacgcctcgtgttcctgctcagggcctgcttccgcgaggccaacatcccaacccacttcgggagaagaaccgacaggtgaacgagctggtacgggcggcactggctggccaccctcgggcccacttcctagatgccgaccctggctttgtgcactcagatggcaccatcagccatcatgacatgtatgattacctgcatctgagccgcctgggctacacacctgtttgccgggctctgcactccctgcttctgcgtctgctggcccaagaccagggccaaggtgctcccctgctggagcccgcaccctaagcatcctgctgccttcccacaacattaaactctccttcctcagtgtgctgtttcctgctttatggtcgaacctgtctgggtatctgggtaccaccattagtccttatcctgatctgtgaccctgcagttctgcaaggtgttttttgtgtgagacagggtctctctccgtcacccaggctagagtacagtggtgagaccacagcccactgcaacttcaacctcccaggctcaagtgatccacccacctcagcctcctgaatagctgctactataagcatgtgccactaggtccagcttattgtattttttgtagagaagtggttttgccatgttgcccaggctgatctgactcctgagctcaagcaatccacctgcctcggcctcccagggtgctggcattacagacatgagccaccatgcctggctgtggttctatttctgcccagggcaggtatcactgatccattaaggcactgtgattcttgtggttaggttaatttccactatcacaata

SEQ ID NO: 11564 - DNA, 1192 bp, Homo sapiens
atggtctcgcctctccctccccccaccccgtgccgggtgcgcggcctgggagtcagcggcccgagcgggaagcgccgggcgagcccactgtgcggccgtcgtgggggaagcgaaggttcctgattccacctacctcctaagtgaaggcttccgtccctggagaggaggcggcgccctgtatcggccttcgtcctccgcgggtgtgctagcgttgggacggtcctttgttgccgcgaggggtaggagtgggcgtggcggagccagctccgttcggaacactcccgggccgacccgactcgctcatcctgcaggagctgcggcgccaagatgagtggagaggagaacccagccagcaagcccacgccggtgcaggacgtacagggcgacgggcgctggatgtccctggtgagcgttcccacctgggatattgaggagtccgggggcgcggggggtggctcaggagaacggctggttcgtgccactctcactacctgattgggaaactgagggcagttgaggaggcgctgcctaagggagcagggcggggcgggccctggagcgtgcatgccattgactccctctcgcgcgctcccgcagcaccatcggttcgtggctgacagcaaagataaggaacccgaagtcgtcttcatcggggactccttggtccagctcatgcaccagtgcgaggtgagggcagtccctctccccctgccccatccagccctgtgtccatgctgacacatctggaccagaacccaggccaggtgaggtattatgagagtacccagattggcctcaggcagcccgaggctctgagaatcttggtgtaaggtgcaacattctattgagaaagaaatgtatgccttggttttatcagattggatttgtgtataatgtactaagacctaaaatgaggctttcctgccataggcttgcctaaagtgaggctctttcttgtttgctttaagtagtgcgcagccctgttgggtttacacaaagctatagtcactttacaggaagcgaagggcaactctaatggcactccacaaagaggactcaatcataataatatctttccacaaagcatgtccaactgtaatgggtttcatcaaaataagtttcaactgtaatgccattgattcaatgcatggctcaagcagactggattttcatgaagtgagtcttgcttcta

SEQ ID NO: 11565 - DNA, 1155 bp, Homo sapiens
ttggagacatggtcttgttctgttgcccaggctggagtgcagtggtgcaatctcagctcactgcaacctcaacctcctgggctcaagtgatcctcctaatttagcttcccaagtagctggggccacaggtgcgcaccaccatgcccagctaattttttattgtttgtagagacggggtctttctacgttgcccaggctggtcttaaactcctgggctcaagcagtcttcctgcctcagcctcccaaagtgttgggatcacaggtgtgagccaccgcccttggccttgtttctgctgtcctttgaccctgtgtttctcctctttccctgcatccttctctgactggcatcatggtgtgggtctcttcctggagtctcctgctctctatctgtctgaatacaccatctttcctcaggctcggcctctgtggggcccccaatggaggagtctgtggcccatgctgtggcagcagtcgggagccgcctgtatatctctgggggtttcgggggagtggccctgggccgcctgctggcactgaccctgccccctgacccctgccgcctgctgtcctcacctgaagcttgtaaccagtctggggcctgcacctggtgccatggggcctgcttgtccggggatcaggcccacaggtaaccatggcgaccatgacaggcagtggggagtggagccctctaatgggggtcctgtgctaggccacaccaggatggaggcctcaggagtataccgtctggttcaggaaaggggtgaatcaccgcaggcagggtggccgggggagctctgagtggggatccctgcctgggactggggtctcatgcaagaatgcttgctggaggagctgggtctgaactgggccttaaaagaacggtagagttgagaccatcagtgattcagaagtgaggctgagaccggaagctggagggggtcagctcagaaagggcttcccatgcctggcagaggcactggctctgtccagctccacagatccttcagctgcggttccaggaatgcagacatcctggacactgaaagtgttttcttaggcttagcacagactcacttcgctgcccagtcaccctcactgatatgaggctattagttggccttatttgcccgaagggtgtgttgtcagttactacag

SEQ ID NO: 11566 - DNA, 1219 bp, Homo sapiens
cagccccacggctatgagtgcagctgcaagaccggctataccatggacaagtgaggccgcaggcggcgctggggccaggcaggctagggtgggagagtctgtggggagcagtaatggatgaggcctagagccaagcaggacagaagaaaagaaagctcgaggcatgaaggcagtgggattgattcctgaaggtcaagagtggtgaggctgagcagggaagagtgagtttcatagggtaccccaatggccgggcacagtggctgatgcctgtaatcccagcactttgggaggccgaggcaggtggatcacttaaggccaggagttcgagaccagtccacagggagaccccatctctacaaaaaaataaaaaagaaaatagggtaccctcaaaagaggagagagggttgtgggctacacctggagggggtggtgggctagatcctgaagagaagatagcaacgggacagagcagggatgagcaaccagttgagaagagggtggggtagttggttgggtgctaggccatgaagccacgaggagggtggccacctgccctgacccccactttgcccctgcagcatgacagggctgtgccgccctgtgtgcgcccagggctgcgtgaacggctcatgtgtggagcccgaccactgccgctgccactttggctttgtgggccgcaactgctccacggaatgccgctgcaaccgccacagtgaatgcgctggtgttggggcgcgtgaccactgcttgctctgccgcaaccacaccaaggtgggccgcccggagcctcagacccccgaccctgggacccaggccctcacttgccttcatcccacgctcaggcggctcgcatctcatcctgagccctgataagccagggacagataagccagagccctgtcccagggagatgtgtggagacttgggggacgctgcctgggtttggatcccagagggtctgccctggaatagtggacggagtgggtgctgcgccaggaggacaggcacgtggaggaggatttgagataatggagggaagggcttttgaactcagcactttgggctgcaggtgtgcaagggaaggcgggggctaaatcccgctgggattgtccaaaccaggtacccgagcctctgctgccctcccgtgggctctcagaacctgcccctgtgcccccaacgccctcctacccctgatgactctccagcctctctaactacc

SEQ ID NO: 11567 - DNA, 2329 bp, Homo sapiens
tccatgagcccaaacgccgggcgctaggccccggccgcactgtcctctttggcgtgcagcccaaattcaccaacgtggacatccgcctgacgctggacgtgaccttcggggccgtggacctctatgtctccacctcctatgacaccttcgtggtccgtgtggcccctgacactggcgtccatactgtacacatccagccacccccagccccaccacctccaccaccccctgcagatggtgggccccggggggctggggatccaggaggagcaggggccagcagtgggccgggcgccccagcagagccacgggtacgggaggtatggccgcggggcctgattacctacgtgacggtgacggagccgtcggcagtgctggtggtccgcggcgtgcgggaccggctggtcatcacctacccacacgagcaccatgccctcaagtcgagccgcttctacctgctgctgctgggcgtgggagacccaagtgggcccggcgccaacggctcagccgactcgcagggcctgctcttcttccggcaggaccaggcccacattgacctgtttgtcttcttctccgtcttcttctcctgcttcttcctcttcctctcactctgtgtgctcctctggaaggccaagcaggctctggaccagcggcaggagcagcgccggcacttgcaggagatgaccaagatggccagccgccccttcgccaaggtcaccgtctgcttcccacctgaccctactgccccggcctccgcctggaagccggctgggctcccacctcccgccttccgccgctctgagcccttcctggcacccctgctgctgacaggggccggtgggccctggggacccatgggagggggctgctgcccaccagccatccccgccaccactgctgggctgcgagctgggcccatcactctcgagcccacagaagatggcatggctggcgtggccacactgctgctccagctgcctggcgggccccatgcacccaacggcgcctgcctggggtcagccctcgtcacactgcggcacaggctgcacgagtactgtgggggtggtgggggtgctgggggcagtgggcatgggactggtgcgggccggaagggactgttgagccaggacaacctcaccagcatgtccctctgacatgcccagggttctcatccacagcagctgggtcacctgatagggccgccctggacttggggtccctccacctgggggcccctggacactgtctacttggagaccactggcccccttcccccagggttgcccagatggggcctcctttgttctgcattcagcagctatttatcgagtacctactctgtcaggcactgtcataggcgtggggcaaagcaggaaccaagagacgaggttccctgatctcatgggacttaggttctggtgaagggagacaatcagtgcacatgcacacaccccacacgcatacacacatgaacacatgcacatgtgcacacacaagtaagatggcttcagagagggagaagcactgtgaggcctccagaggatgtggcagtgagggacgatggggtgaagtcagctgggcattcaaagaagctagactgagaacgcctgagaagaaccagctacgggaagagctttgggaagcaaaggcagaggccctggggtgggagcaggcttgttttattggaaggaccagaaaactggtaagtgtgacccagatcaagtgtgaggagatgaggctggggatagtcaggggctggatcacccagggccttgtgggccccacatagggttttgggttttattctcagggcaatgggaagctgttggatggtttgatgaaggggagtgacaggatccgatgtacctatttaagaatttaagagggtcgggtgcggtggctcatgcctataatcctagcactttgagaggccaaggtgggctgatcacaaggtcaagagttcgtgaccagcctggccaatatggtgaaaccccatgtctactaaaaatacaaaaattagctgggcatggtggcacacacttgtagtccgagctactcgggaggctgaggcagaagaatcgcttgaacccaggaggcggaggttgcagtgagctcagattgcgtcactgcactccaacctgggtgacagagcgagactccacctcaaaaaaaaaaaaaaaatttaagaggtcactcagttgtgctgtggagaatggaccggagggacaagaggggcagcagggatggtgggctggagtagggtgctggcaatgagggagtctggctcagatgtgggatgtgtatggaagaatataaatgatggtgtgga

SEQ ID NO: 11568 - DNA, 1202 bp, Homo sapiens
ccttccgcctcctgcctctattacggatgtgggcactctcccttggtgagactttccttatcttgtgggtgctgtgggtgctacaagtctcaatgcccctccttgccactggagcatgttgctgagaaacacatctgggcaaaaatcaaggccttgtgaactggtagaactcttcacaagtggattgtggcctcctgtggttctgcccctgccccctctctggtactaacatgctgggtctggaccatacactctgagggaagtaaattccttaactgatccttaaactccccaccctccaactgccacctccttcagctagaatcacctgaagtcagctttgcatttccatggatcgctaactcttcttttgcttctccagctcaggaccactccaatgacccacctaacaaggtaagcatagccggttttcatgggcttattttctcatggaaatgattctgtgtagaattgattattcatgaagacacaatgtaacatcaagtttgggttaatgttcctcagtgcaacaacaaagacgtatttgtaatcactcccatgagtctactttgcagcaagaacatgcattttggaattattcccatcctgtgtctgaatactggatgtgactcttagtagctctgtgacccttgtcaagtaacttaacctctttgatcatcagctttgtcatctgtaaaatgggcattctgcctacttcaaagagaagttgaagggattaaacgagataacctacaaagagcacccagcacaatggcctaaaaaaggaaggcactgaatcattctcactcccctaccttcagtctgatcctgctcttattgtcaaaaggataatttcaattttaatagatctgagatcctgttttttaataataattttatagaatttttcattttatggccaggcacagtggctcatgcctgtaatcccagcactttgggaggccaaggcaggtgaaacacaaggtcaggagatcgagaccattctggctaacatggtgaaaccccagctctactaaaaatacaaaaaaattagccagctgtggtggcgggcgcctgtagtcccagctacttgggaggctgaggcaggagaatggcgtgaacccaggaggtggagtttgcagtgagccaagattgcgccattgcgctccagcctgggcgacagagggaaactctgtctcaaa

SEQ ID NO: 11569 - DNA, 1230 bp, Homo sapiens
ggttgtgcagctgctgttagatgttttctatgtcgtaagactctggagggaggtggaaactgaaccctcacccacaaagccagcactgtgtggagtgggagaagtttaggtggtggagacttgaggtcttagtccaagccctggaaccttcagctttgcataacctgggtgagctaagaaaagttgggccacctcccatcactgttaggatcctccctgtatcccagtcgaggagattgggttccaagaggctcagagtcacatctcaggtcataaaaggggcctcagtttctccacctgtcccgggttggtgctgggctggggggagccccggccaggcagccctgactgttggcctcctcacaggttccactacgctgcccggatctgggatggggtgagaaagtcctctgctctggcagagtacagccgcctgctggcctgaggccaaggagaggaatgtcatgcaggggacctcctgggtccgcagtgtactgcgagggagcacagatgtccatcccccgctggggtggagagcggcagcaggcctgatggatgagggatcgtggcttcccggcccagagacatgaggtgtccagggccaggccccccaccctcagttggggctgttccgggggtgactgtgagcgatcccaccccaaacctgagatggggtagcccgtcctgtgtcctccacagggacaagcagtgggaggagtctgaatggtcaccaggaagcccgggctccatcttgacctcctttttcagggacaggagcaacaggcccctcttccctgactctaagcccttccctgtaaggtgaggcagggtctggagagctctttattggaacagatctggtggttcaaataaacacagtcatgcaagcctgttcttatgttccacttactcctctacccaccatgcagctctgggaagcaggacaaattggacacccagcccttgcgggcagatggagatcagtctctgctaagaagtccctagaaggggttattctgtttcctggggtggcatcaagcctcccctgtgtatgttttggatgggaaaatacactggtgcagctgagtacagcaactaccctcgtgtcttctgctctcacttaaagacagttacctgcctttgggttaaatgcccagttaaatacagtgcctaggctgggcatggtggctcacgtctataatcctagcactttgggaggccgaggcaggc

SEQ ID NO: 11570 - DNA, 1178 bp, Homo sapiens
tgcctggactcctgggtctgatggaggagggctgcgggcctgggatccggggtctgatggaggagggctgggtcctgggctcctgagtctgagggaggagggctggggatctggactcctgggtctgagggaggagggctgggggtctggactcctgggtctgagggaggagggctggggtctggactctaagtagcgaggtgctccaggctcctggttcctggggaagaagggctctggggcctcggactggttgttcctgagagggagggggcctaaagacctcctagtgaggagggagggggctggggacccagaattcaggtactagggaaagaggaggttggaggcccagtcttctgggtcctggggaaggaggagcatggggcccggactcttgaatctgagacaggaggtgtctcaggtttctgttcctggggaagactgcaggatgaggaataagggttcagaaaacctgggggaggcaggactagagagcagggctggacacaggtccctcacagtcactgttccccagacaccgctccacctggctgtgatcaccacattaccgtctgtggtccggctcctggtgacagctggtgccagccccatggcgctggaccgccatggccagacggccgctcacctggcgtgcgagcaccgcagcccgacctgcctgcgagccctgctggacagcgcagctccgggcacgttggacctggaggcccgcaattatgacggtaagcatttaccgcggggcaccgctgggctgtccagcggacctggagtccatcagcggccgcaaagcccgggcctaggtttcaccgagccctcctctccctcagggctcaccgccctgcacgtggcagtgaacaccgagtgccaagaaaccgtgcagctcttgctagagcgcggtgccgacatcgacgcagtggtgagcgtgcactaggagctgggagggagcggggccttagcaggggcggggtcttggcgggggcggggccagtgtggggctggcgtgggagagcacccgggtggggtggggcttggagtatcagacccaagagagaggctggaccccgcgaatgggatgtggacgggatgcgggtcgccggctgctggagcagagcttggagaaactaagaccttccctccccgccgcaggacattaagag

SEQ ID NO: 11571 - DNA, 1175 bp, Homo sapiens
agctgggacaagacaaatcaagtcactcccctcagtggtctactggaggtcaggggtcagacactgaggttgcgctcaaggttcaaaggactgtttagagcccaaggttaagtatttgaggtcaagactgaggtgaaaggttcatggggaaagatttgcagagatcgagtgtcaaaagtgagtcccaggattaacagggtgagttgcacgagctgggctttgggttaaggaagggctgaatgaatgtcccagtgcaatatggcctcaggggacaaggagtgaggtggcatcttgttggcatggggagagagcggtcaggattttggggtcaagagcagattggtaatctgtgtcgtgcgtaggaagtgatcttgagttcctgtcctctctctacctccaggaaatgcctcgataccatgagctgcccaccttggaagaacggtcaggacccttgcaccctggagccacaagcctggggtcccccatcccggtgcctccagggccacctgctgtggaagacgtttccctggatctagaggatgaggagggggaggaggaggaagagtatctggacaagatcaaccccatctatgatgctctgtcctatagcagcccctctgattcctaccagggcaaaggctttgtcatgtcccgggccatgtatgtgtgagctgccatgcgcctggcgtctcacatctcacctgttgatcccttagctttcttgccaaggatctagtgccccctgacctctggccaggccactgtcagttaacacatatgcattccatttgtgatgtctaccttggtggctccactatgacccctaacccatgagcccagagaaattcaccgtgataatggaatcctggcaaccttatctcatgaggcaggaggtggggaaggtgcttctgcacaacctctgatcccaaggactcctctcccagactgtgaccttagaccatacctctcaccccccaatgcctcgactcccccaaaatcacaaagaagaccctagacctataatttgtcttcaggtagtaaattcccaataggtctgctggagtgggcgctgagggctccctgctgctcagacctgagccctccaggcagcagggtcccacttaccccctccccaccctgttccccaaaggtgggaaagaggggattccccagcc

SEQ ID NO: 11572 - DNA, 1189 bp, Homo sapiens
gcgatgcctcagcgggcgtggcaaaatgctcagcacagaccaatggcgggttagcaccggaacccgcggcgacgcgagccaataggcgcaggcgctgcgagccaatgggaagggtgggaggggcgccgtggctaccctgcgagtgagaaccaatacaaaaggacatttcagggaaagtgggcgggactttatgcacaagtccaatgggaagaccgagtcttgacgctggtgggcgggcctcagggcacactaaaccaatgggctaggtggggcggggcgacggtggtggcggcggcggcagcgggttcggttgcgcgtggcgcacggggtgggagcggagcccaggccgggagcaggcgccgccgccagtgagaaccggggccggagccgggtgcggatttgctggggctgagtcgggggcgcgcgggccctgacctctgccctctgacctctcccctagcaggcgaccatggggaacgtgttggctgccagctcgccgcccgcagggccgccaccgccgcctgcgccggccctcgtggggctgccgccacctccgccctcgccgccgggcttcacgctgccgccgctgggaggcagcctgggcgccggcaccagtacgagtcgaagttcggaacggacccccggggctgcaaccgccagcgcctcaggggccgccgaggatggggcctgcggctgcctgcccaacccgggcacattcgaggagtgccaccggaagtgcaagggtgaggggcgaggggcccccgctgggctgcgatggcctggatctcgggggaagggggaggacactggggactctgggatttggcgcgcaccattggaattatttaacagcactaggaggtgatgttgggatcgaatggtggaacgttggacttggggcttagaatgatggaatcaaatgctggaaacgggatggaatgtcatagcagtagagaaaagcctttagggacctgaggagccccgggatcagccaagccagacttctcttgtgatcgggaaggcaactgaggcccaaggtcacggtgtcagcaaggtgtcagcgaggttccttgggtatgggacccaaagcctccggatcccagcctggagcaattagagtagtagtagtggtggagatttatggagttctgttctggtgttcattatacgttaactcattagatccttg

SEQ ID NO: 11573 - DNA, 1261 bp, Homo sapiens
aggccatgctcggccagagcaccgaggagctgcgggtgcgcctcgcctcccacctgcgcaagctgcgtaagcggctcctccgcgatgccgatgacctgcagaagcgcctggcagtgtaccaggccggggcccgcgagggcgccgagcgcggcctcagcgccatccgcgagcgcctggggcccctggtggaacagggccgcgtgcgggccgccactgtgggctccctggccggccagccgctacaggagcgggcccaggcctggggcgagcggctgcgcgcgcggatggaggagatgggcagccggacccgcgaccgcctggacgaggtgaaggagcaggtggcggaggtgcgcgccaagctggaggagcaggcccagcagatacgcctgcaggccgaggccttccaggcccgcctcaagagctggttcgagcccctggtggaagacatgcagcgccagtgggccgggctggtggagaaggtgcaggctgccgtgggcaccagcgccgcccctgtgcccagcgacaatcactgaacgccgaagcctgcagccatgcgaccccacgccaccccgtgcctcctgcctccgcgcagcctgcagcgggagaccctgtccccgccccagccgtcctcctggggtggaccctagtttaataaagattcaccaagtttcacgcatctgctggcctccccctgtgatttcctctaagccccagcctcagtttctctttctgcccacatactggccacacaattctcagccccctcctctccatctgtgtctgtgtgtatctttctctctgcccttttttttttttttagacggagtctggctctgtcacccaggctagagtgcagtggcacgatcttggctcactgcaacctctgcctcttgggttcaagcgattctgctgcctcagtagctgggattacaggctcacaccaccacacccggctaatttttgtatttttagtagagacgagctttcaccatgttggccaggcaggtctcaaactcctgaccaagtgatccacccgccggcctcccaaagtgctgagattacaggcctgagccaccatgcccggcctctgcccctctttcttttttagggggcagggaaaggtctcaccctgtcacccgccatcacagctcactgcagcctccacctcctggactcaagtgataagtgatcctcccgcctcagcctttccagtagctgagactacaggcgcataccactaggattaatttggggggggggg

SEQ ID NO: 11574 - DNA, 1133 bp, Homo sapiens
gggtcacacatggggcaggggaactgggaacggtggggaagggcaggggctggttctggcttgtggggtgggagccagcgtagcaactgaccatggcacccacctcatccacagctggaccgagagcacagggtggcaggaatcttcccccgcctatccttcaaggacaagtccacgtatatcgagtcctcgaccaaagtgtatgatgatgtgagtgtcctgcacagtgggcccctgggggtggtctccaggtaccacgtatccctgaggcacccggggccggccatctgtctgccggacccatgctttacagcctgtgccacatcctctgtgtcccccatctgccataactgcttccctgggcgagtccggagtccccagggctacctggaaattccccctgcccggcctgccagaccaggtgtggtgggtgagggcggggagcagggctgccaggcagggctgaggagctggctgacagccccaccctgtggccccacagatggcattccggtacctgtcctggatcctcttcccgctcctgggctgctatgccgtctacagtcttctgtacctggagcacaagggctggtactcctgggtgctcagcatgctctacggcttcctgctgaccttcggtgagcggtccggccgccccaggagagagcaggccccatgctgcgcagggctcacagccccagtgtaggagacagacccatccccagacagggacaacctagggtgggcagagctgggatatagggaggcccgagggcacacatggccccatctggggtcagagaggacttcagggaggacatgaacagtacgcttcagtcctcattctcagggggcctttgtgtcttgggaacaagtaaacaagtagggccaggtgcagtggctcacacctgttatcccaatgctttgggaggctgaggcaggaggatcacttgagcccaggaattcgtgaccagcctgggcaacttggcaagacccgatctctacaaaaaaacacagaaattattggggagtggtggtgcgtgcctgtagtcccagctacctgggaggctgaggtgggaggatcccttgagtccaggaggttgaagctgcagtgagccatgattacgccactg

SEQ ID NO: 11575 - DNA, 1188 bp, Homo sapiens
ggccggcggcggggggcggggtcccggcgccccgccctgcccgcccctccccctgacgtcccttcctccctccccagcccctccaccgcctccctccgccgccgcttgggccggctccgcgccccctccgcggcccccgcccgcccgcctgcccgccgcccccatggcgcccggggtccccgctgcacggggccactaggaccctcggcgtcccttcccctcccccgccctgccccctctcccgccgcgcggacccgggcgttctcggcgcccagcttttgagctcgcgtccccaggccggcggggggggaggggaagagaggggaccctgggacccccgccccccccacccggccgcccctgccccccgggacccggagaagatgtcttcgcggacggtgctggccccgggcaacgatcggaactcggacacggtgagtggggcccggccccttggggagccctggctgggtccagccgccaaacccttctccccgttgtacccctcgccccgcgagcccctaccctcgtttcctgggcccgacccggctcgtcacctctcgacccctcccggacttccaggcctctccaccctccccaccttttccagcccagcccgacccctgggggcgcccctctctcgggacccctctcttgtccccgtgcagaccgcttccgctcgggtctgttccctccaggaagccccttcccctgcttccaggagcccctcccttctcttgcctgtgctaagccgtttcccctccaggccgtccgcgtccgacacctcgccccctcccggatttgcagggcccctgaccccccaaggcccggccctggcactctcagcagggcctggcccagtcctgcctctggctccggccttccctgtctggggctgggtgccggctccccaggagcccccctcctcttattcccagccctctgcccctccaggacgcacccagggcgcctgtgggcagcccctggcaggaagctggtttccacctctcctgggccccggcccttttctggcttcttcaaggtctctcccgtcccaggcctggtccccatcttccaagcagccctgtccctagatcccagcaccccggggcccccagatgccacctggaccctttctggtctcttcctctcccaggaagccttggcctccaacttctaggccctcac

SEQ ID NO: 11576 - DNA, 1367 bp, Homo sapiens
tcctgggtgctggcgctgagggtccgaggggccttgtccaggtgccagctgggaaactggagacaggcacaggggatggttggaggggaggtgaggggcaagtgttacatccaccctccagctccaggtccagcctggcagccaactatccaaccccctcgcctctaccccaagtaaaacccatctttgctcctgtcctgggtctcttctgacaccaacccaccacctgctgactccaccactggcccgaccgccctgcctttgcctcatctctgcacctacccacatggcctcctctatttttgacccagatgtccccctcacctgagtcccaggagcccttggagcatccacgttcagtgtgttgagtgacatggctctcttcattctgcaaagagggcagcagggaggaaatgagtgaatccaggagtggcccccctccacgagggacctttccagcacagggtttgatctgtgtgtatcacaggggagatgggagccatggaaggttcttgagcaagatgggggtgggggtggggtgggctgtggattctgctgatgtcagggctctttgccgacctgatcaacactcacccggctgctcctgccgccgcctcgcctcggagccgggagaccagcttctcacttcctcgcctgatagactcacggatcttggagagtgagctgctgcggcgaagggcctggggaggggccggggatgctgctcagtcccccaggcccatgcagtccccacgcccaccccaggagccgaagcacagcccatcctcacctgttctgcgtcaccagctgtgcctgtgttgggggcacctagggggaaagatgggggacactgagatggggacatagagaagccaccaggagggaagacagacaggggctaggggctcaccgagaggggcgggtaggtcctccttgtggaggatttctttgtacagctcttccgcttgttgatacttgttctgtttcaggtaggctgaggcctgcggagaagggagtgtctgggaacttttcggaccccagttcccaacactgcatccagtcccgcctttttttttttttttgtagagacaggggtcttggtatgttgcccaggctggtcttgaactcctagcctcaagtgatcctcctgccttggcctcccaaagtgttggggttacaagcgtgaaccaccacgtctggccccactttctaatgtgctgacctggccgtatccttcccctgcctaaagccttgccctggggcagagtgggtttggagctcggccttacttcctgccctggggatggaggacaggcagcctcctgtttctgagcctgtctgctgtactttgggctggtggcatggcc

SEQ ID NO: 11577 - DNA, 1254 bp, Homo sapiens
ctgcaaagccatttctaactcttgggcccagaaaggatcaccaatttccctgtcattctccgttagactattcgctactgagacgatttttttttttttttgagacgaggtggaggggcgggggttctcgctatcttgctcaagctgatctcgaactcctgggttcgatcaatactcagacaatcttggcaggcgcaggaggaccaaattctagtgaatgagatcgagtctctcggctctttcccttccatgttttctttttgattggccctcgacgatcctcagtgacgcctcccgcaccgcctcacccgagagtcagccgccctcgcttttccgtgcgcacgcgcagtatcccgattggctctgccctagcggattgacgggcaggttagccaatggtctcgtaatataggtggagcgagccctcgaggatgtccacgacccggcctctcgctgaatattcatgagggaggcgggtcgaccccgctgcacagtccggccggcgccatgaagtgagaagggggctgggggtcgcgctcgctagcgggcgcggggggtcttgaagatggggtcatcggtgggcgcgcctgggtccccaagggggcgaggggagggtgaaggggtgggacgggggcagccgcagggagcagcagtgatagcgaggagacactgagggggccccgaggctcctgaggacctgagggttaccgggggcgccgggcccgtcacccttctctgggctcgacgaccgggcactgtggaggcgggagaggggctgaggggacgggaactgacccagcagcccctgccgccaggctcaacgtggacgggctcctggtctacttcccgtacgactacatctaccccgagcagttctcctacatgcgggagctcaaacgcacgctggacgccaaggtgggtggccggtgggcccgacccgcccactcgaccggtggggctgccacgcctgggcctaagacagattgcaggacgtctggattttagaagtccgaggtccctgggaatccaggaccccataatcttccgttatctaaaacaataatggtgaataggctgggcgcggtggctcgcgcctgtaatcccagagctttgggaggacgaggcgggcggatcacttgaggtcaggagttggagaccagcctggccaacacggtgaaaccccgtctgtactaaaaatacaaaaattagccaggtgtggtggcgggcgcctgtaatcccacctactcgggaggc

SEQ ID NO: 11578 - DNA, 1168 bp, Homo sapiens
cacaaagcagtggtgagattacaataaggtaggcatgtaaagcgccaggcacatactaactgctcaataaatgggaggcatcataattgtatattattcacagcccaaggaaagtgtagcccagagagggcaaggaacttccctgaggtcacacagaaaatcatgtgctggttgtatgccctggaagttgtggagagggagtgttgggtgtctcctggggacctgtcctctgatgggctcttgttccggctaggaccccccaaaccccccaccgagctggagcctgagccggagatagaggggctgctgacaccagtgctggaggctggcgatgtggatgaaggccctgtagcaaggcctctcagccccacgaggctgcagccagcactgccaccggaggcacagtcggtgcccgagctggaggaggtggcacgggtgttggcggaaattccccggcccctcaaacgcaggggctccatggagcaggcccctgctgtggccctgccccctacccacaagaaacagtaccagcagatcatcagccgcctcttccatcgtcatggggggccagggcccggggggccggagccagagctgtcccccatcactgagggatctgaggccagggcagggccccctgctcctgccccaccagctcccattccacccccggccccgtcccagagcagcccaccagagcagccgcagagcatggtaagtaatacaggaggaaaccggggtatgtttgctacatgaatccaggagctgtagcaaagagccccccaaatatagtggcttagatgagatcgaagttttctcctcttttgagtagaagtccaagagtttgcagcccaggactgtaggcacctcactggagtcaggacccaggctctatctacctggggctctgccatccatcggggagtaagcctgccttcatggtcctagatggctgtcaccaagtctgccctccagccaggaagagagaaagaagaagagaaagtgccctttcctgtttcaggcagaacctgggagttccatacatcactctgcctgctcccactggccaggagcctcattgcaatgggatgctgggaaatgtagtctttaggatagctgtgtgtgactatatggagggccatctgggagtcttggccacatagagatg

SEQ ID NO: 11579 - DNA, 1211 bp, Homo sapiens
caggcagctctggcagctcccaaaaagaagacgaagaaagaaaaacagcaagatgccacagtggagccagagacagaggtggtggggcctgagctgccggatgaccttgagcctcaggcagctcccacatccaccaagaagaagaagaagaagaaagagagaggtcacacagtgactgagccaattcagccactagagcctgaactgccaggggagggacagcctgaagccagggcaactccgggatccaccaagaagaggaagaagcagagtcaggaaagccggatgccagagacagtgccccaagaggagatgccagggccgccactgaattcagagtctggggaggaggctcccacaggccgggacaagaagcggaagcagcagcagcagcagcctgtgtagtctgcccccgggaaactgaggaactaaagaaagctgaaggtgcccacctgggccaccagaaggtgacacccccagaatccctccccagagactgcaccagcgcagccagcaggagcctggcctgggaggacgatttattattacactgggggtttccttggcagctggggtcatcagggtactttcaagaagggctcgtgcaggacatcaaacagcctccgggcctggatgggagggagaaaaaaatgaggaaccagtcattaaaggagctgtttcctgggtaaatctagagtggggttttggttctttattttcccctataccctcaagcatttatccattgagttacaaacaatccagttacaatctttttaagttattattattattattattttttttttttttgagatggagtctcgctctgtcgcccaggttggagtgcagtggcgcaatctcggctcactgcaagctccgcctcccgggttcacgccattctcctgcctcagcctcctgagtagctgggactacaggcccctgcccagctaattttttgtatttttttttagtagagatggggtttcaccacgttagccaggatggtctcgatctcctgacctcctgatgcgcctgcctcagcctcccagtgctgggattataggtgtgagccactgcgcctggctaagttattattatttttttgagacagtctcctggtgtcacccaggctggagtgcagtggtgtgatcttggctcactgcaacctccgcctcctgggttccaacgattctcctgcctcagcctcc

SEQ ID NO: 11580 - DNA, 1167 bp, Homo sapiens
tctcctggggtaatgtccccttgaaaaggctgaggaggcaattccaatgtaggccactaggtggagggcaggagctggcttcgggctcttggtcagtttcccacccagctttccccgttgtccccagatgcccaccccgcgtctcttgccccacctcgtgatcccacctgtttctccttcaggatccgagctaaaatcccagggaccggagccctggcctctgcagcagccgcagtctccggatccaaagccaaagccgaatgagaacggtgtctctgcccgcaggacgcctgcccccagcccccgcagccctctggccccctccatctcttgtccgttcccacccacccccctcctcggcccgagccttttcccggtgggtgtcaggatcactcccactagggactctgcgctaattacctgagcgaccaggactacatttcccaagaggctctgctccaggagtccaggaaagacgaggcaccttggccgcggggcctgctgggacttgtagttgcctagacagggcaccaccctgcacttccggacccgccgctggaggcgccgtgaggcgttggtgtctcctggatgctactagccccaacgccggggctttgcatggggcccaggggaggcctgagcttggatttacactgtaataaagactcctgtggaaaacccgaggcctcttgtgcttccagaaccctccagttgttcacctttctgcactgaaaggcacttaagtgacactccaggagaaccttccccatctctggagaaggagctccctctgccatctgtgtaggttatgaaatgattgaggggaggccgggcgcagtggctcacgcctgtaatcccagcactttgggaggccgaggagggcggatcacttgagaccagaagttcaagaccagcctggccaacatggtgaaacctcatctctactaaaaatacaaaatttagccgggtgtggtggtgcatgcctgtaatcacagctactcgggaggctgaggcatgagagtcgcttgaatctgggagatggaggttgtagtgagccaagattgcgccactgcactccagcctcggcgacagagcgagattctgtctcaaaaaaaaaaaaaagaaagaaatgattgaggggaagatgctgacagaccacccattcca

SEQ ID NO: 11581 - DNA, 1351 bp, Homo sapiens
ggttttagagtctgtgtgcagaatgttctaaaaatcccgtgattcaaatattctaagattccaggactgggacacttctgtgattcggacagtctaagcttctaagagtcttcgattctttccctctcgcagaagaagctccgtctacagcctcctcaactcctgattccacagaaggtaagtggtggggagcatgtgaaggggctcagggctgggcagctcagggacctgctgagggaaacaaggctctccttcacccactgcaggagggaacgacgactctgattttcgagagctgcacacagcccgggaattctcagaggaggacgaggaggagaccacgtcgcaggactggggcaccccccgggagctgaccttctcctacatcgcctttgatggtgtagtgggctccgggggccgcagggattcaactgcccgccgcccccgcccccagggccgctcagtctcggaaccacgagaccagcaccctcagcccagcctgggcgacagcttggagagcatccccagcctgagccaatccccggagcctggacgacggggtgatcctgacaccgcgcctccatccgagcgccctctggaagacctgaggcttcggttggaccatctgggctgggtggcccggggaacgggatccggggaggactcttccaccagcagctccaccccgctggaagacgaagaaccccaagaacccaacagattggagacaggagaagctggggaaggtgagatgtccgaggtgctgggaccaaagccaagaggggtgggtggtttctccttggggcacctccaagaagaaagctcacggcctcctctctctaccgtatcagaactggacctacgactccgacttgctcagccctcatcgcccgaggtcttgactccccagctcagtccgggctctgggacaccccaggccggtactccgtccccatcccgatcgcgagattcgaactctgggcccgaagagccattgctggaagaggaagaaaagcagtgggggccactggagcgagagccagtaaggggacagtgcctcgatagcacggaccaattagaattcacggtggagccacgccttctaggtaagcaacgtgtatgaagatgctgcattggcccacagaaggcaaaaggtgagaggattttgaattaaagggaccaacctcgcaaaggaacagtacatagtggaaaagggaagagatagacgtgatatcacatctggctagacgtgataaactccgctttttaaaaaaatttccccggccgggcgcggtggctcatgcctgtaatcccagccctttgggaggccgaggcgggcggatcacttgag

SEQ ID NO: 11582 - DNA, 1134 bp, Homo sapiens
gatgggatttcagggagaaaatctgagaccacttgcttaacttgagggtcctcctcgacccccaaaattgagcggagtacgagatggagaagtcgatggggaaagaaatcgcgccccttccgagaccctcctcagaattcccacagtgggagcgaactaggaagcaagggaggtccccttccccttcaccaacttgcccctcaggtgggggtgattcccagggtgcacccctgggctacaacattggggagaggagcgagatcgcggaagccgagggtgcagagttgcccttttaagcgccctccaccccctcgcctggaggcgcacgcggcccctttaaggcgcggggcattgtgggtgcggggagtggaattttggaacgaaatgtaacgaagagaagtacagtagtaagagtaacactgtagccgccaccggcaaggggtgcgcgctggggagcggacgctgcatcccctttctgctgcaggaacctctcatcagaccgcctgagggaagcggcgcccggagacccgccccggcccggtccacattctccccaggaagccggactctatggggcgggaccctgggggagcctgagccgagcccggagccagccccgaacccctgaacctccagccaggggcgccccgggagcagccagcccgtgggcgagccgcccgcccgccgagcagccatgaggtgagccggacctgccccccgacccgtccccgcccgggcgggctccgcgccccgcctttgtccccctcccccccagctagctccgggctggaatttggggacagatccttgggagcctcggatttgagctgaatccccttggacgcgccccagaaccgtcgatcacttctccacgactgactccccaagctcggggggtggtggcggtgaggttctcctgggagccctcaagatttgggggcgctcggaggactcccgaattgttaagactttttttagaggacctcaaagttggcagcgactccccgcagggatgccaggattgaggcagggctcagactctcctccccctccccccagacttcagctcgaggtccgggaaggattgtgggggaccgatttgggataccctgggacttggaagagagactgaga

SEQ ID NO: 11583 - DNA, 1517 bp, Homo sapiens
atttctcagggacccagtcgaatccaagcccatggattcaattgtcacatccttcatcttccatccgtgtctcctaatctgtgtgctcttgctttctttcctcggagctctggactgacccgacagcctgtcttcatgtagcagtaccctcctgcctccatagcccccggtcccacccccatcctaccaattaggccagcagttggccttaactgcttgattaatttccttggactgccataacagatcaccattgggtggtgaacttgatggcttaagtccaacaggaatttaattcacacagttctggagtccagaagtctgaaaccaaggtgctgacagggacacgctccctcttccagctcctggtgattccaggccttccttggctctgcctgcagcttcacatggccttttccctcttctattttgtctcttacaagaacacctgtcattgcatttagggcccatcttaagttcaggatgatcccacctcaagacccttaattacatctgaaaaaacactttttccaaataaactgtcataagcacaggtcctgggggttagtatgtggacttgtctgttgggggcacaccattcaagccattcagcccactattcctcctcaccccaagagtacgctggcgtccaggtgcagtggctcacacctgtaatcccagcactttgggagaccagggcaggagggatctctttgagcccaggagctgaagaccagcctgggcaacatagtgagaccccatctctacaaaagtaaaataaaaaattagccaggtgcggtgatgcatgcctgtagtcccagctacttgggaggctgaggcaggaggatcacctgagccctggaggtcgaggctgcagcgagccgtgatcgcgccactacactccagcctggatgacagagtgagaccctttctcagaaaaaaagtaccctgggactcctgccaaccccgcgggccatttggccttcctgctagctgagaggaacagtctaggaaccacccttttctactgggtttctcttccaggatctgccactgaagcgggagggggtgggtcccagtagcctgcagtctgtccttccgactgtagctctctcattagaggagctgcaaggtgatgaaggcatcctgaggctgtacctgaaccaccatgtggatctccacaatgggtacagagcttattaaaatcaggagggaaactgggagggttctgatggggagaggcccaagagtcaccctatgagctggggaaactaaggccaggggtaagcaaagggacttgccagagatgccacagccagtgaggggctgactgcccagggtggtgaagtagtaggggcagagtgagaggcttggattaccccagctgcagagtgaggagggagaggcgatggctgagcagaggctgggagggtgacgatctctacacagaggcccagaccatcccagaggtggcgttgatagtgggagaccctctctatcccctctcagagcagccc

SEQ ID NO: 11584 - DNA, 1181 bp, Homo sapiens
aatgtctggctgggcacggtggctcacgcctataatctcagcactttgggaggtcgaggcgggtggatcacaaggtcaagaaatcaagaccatcctggccaacatggtgaaaccccctgtttactaaaatacaaaaattagctgggcgtggaggtggtgcatgcctgtagtcccagctcctcaggaggctgaggcaggagaatcgcttgaacccaggaggcagaggttgcagtgagccgagatcacatcactgcgctccagcctgggcaacagatcaagactccgtctcaaaaaaaaaaaaaatgtctgttaggcatctagctgatgatactcagaaggctgaacaggaggacagatgtggtgggacaaggttggggagacactgaagccaaggccctgatcacccatcctcacagctccagcctctcaactccagcctctctcacttattggttccatgtttgtccatgcaggagcctcctcaacaagcccaagagtgagatgaccccagaggagctgcagaagcgagaggaggaggaatttaacaccggtccactctctgtgctcacacagtcagtcaagaacaatacccaagtgctcatcaactgccgcaacaataagaaactcctgggccgcgtgaaggccttcgataggtgagtgctgggtcctgggaggtgttctccgcaggcctggagaggccactccagctccagtctgaagagctcaaagacagctgtctcagaagcctggggtgtatggccaggcgtggtggctcatgcctgtaatcccagcactttgggaaggcaaggcgggtagatcacctgaggtcaggagttcaagaccagcttagctaaaatggcgaaaccccatctctactaaaaatataaaagccaggcgtggtggtgcacgcctgtattcacagctactcaggtggccgaggcacaagaatagcctgaacccaggaggcggaggttgtggtgagctgaaatcgcaccactgcattgcagcctgggcaacagagtgagattctgtctcaaaaaagaaaatgataattttcaatggccctgtgaggaaggtaacgtgattatcttccctcttaaaaaggagcaaactggcacagagaggtgcagtcctttgcctcagcctcaacctaaggactggcagagttgctttggcagctt

SEQ ID NO: 11585 - DNA, 1264 bp, Homo sapiens
ctcccccaaccctgattcggccgcttcgcatcccgctagctcctcccagaccttcggccgcctccacacgcctccggattggcccgctgcggagcctccggcccacaacgcaaaccgcggacactgtggagtccagagctttgggcagatggagggccttttattcgcgagggtcgggggtgggggtcctaggtggggacagacaataaataccgaggaatgtcggggtctcagtgcatccaaaacgtggattggggttgttgggggtcctgtagcctgtcagcgagtcggaggacgaggtcaataaatatccaaaccgccgaagcgggcggagccggctggggctccgagagcagcgcaagtgaggaggggggcgcgggatccccgaaaaagcgggtttggcaaaagcaaatttcccgagtaagcaggcagagatcgcgccagacgctccccagagcagggcgtcatgcacaagaaagctttgcactttgcgaaccaacgataggtgggggtgcgtggaggatggaacacggacggcccggcttgctgccttcccaggcctgcagtttgcccatccacgtcagggcctcagcctggccgaaagaaagaaatggtctgtgatccccccagcagcagcagcagcagcagcagcagcagcagcagcagcagcagcagcagcagcagcagcattcccggctacaaggacccttcgagccccgttcgccggccgcggacccggcccctccctccccggccgctagggggcgggcccggatcacaggactggagctgggcggagacccacgctcggagcggttgtgaactggcaggcggtgggcgcggcttctgtgccgtgccccgggcactcagtcttccaacggggccccggagtcgaagacagttctagggttcagggagcgcgggcggctcctgggcggcgccagactgcggtgagttggccggcgtgggccaccaacccaatgcagcccagggcggcggcacgagacagaacaacggcgaacaggagcagggaaagcgcctccgataggccaggcctagggacctgcggggagagggcgaggtcaacacccggcatgggcctctgattggctcctgggactcgccccgcctacgcccataggtgggcccgcactcttccctgcgccccgcccccgccccaacagcctacagctgttgttagtccactcgcacgcctcgaatcccgtccgaactcgtcattggctgcttcctagcggcctgtgtt

SEQ ID NO: 11586 - DNA, 1142 bp, Homo sapiens
tcactcaggatccgccaaggactttgattattgcgtgaaagtgctgactgccaggacaggaagctagctaagatgcaagttcccagcctagagcagtggcctctggggggtctagggcggacccaagggcaaggccagggtggcagcagctttggggactctgggctggctccctccccttgacactggctgaagcccaggtggtctctaacccctcccatctctccctctcatcttccccagggcatctcctcccaaccaggcaactccccgagtggcacagtggtgtgaagccatggatatcgggcccccccaaccccatgcccccagcctcctagccataaccctccctgctgacctcacagatcaacgtattaacaagactaaccatgatggatggactgctccagtccccccacctgcacaaaatttgggggccccccagactggcccggacacgggcgatgtaatagcccttgtggcctcagccttgtcccccacccactgccaagtacaatgacctcttcctctgaaacatcagtgttaccctcatccctgtccccagcatgtgactggtcactcctggggagagactccccgcccctgccacaagagccccaggtctgcagtgtgcccctcagttgagtgggcagggccgggggtggtccagccctcgcccggcccccaccccagctgcccttgctattgtctgtgcttttgaagagtgttaaattatggaagcccctcaggttcctccctgtcccgcaggacctcttatttatactaaagttccctgttttctcagcgggtctgtccccttcggaggagatgatgtagaggacctgtgtgtgtactctgtggttctaggcagtccgctttccccagaggaggagtgcaggcctgctcccagcccagcgcctcccaccccttttcatagcaggaaaagccggagcccagggagggaacggacctgcgagtcacacaactggtgacccacaccagcggctggagcaggaccctcttggggagaagagcatcctgcccgcagccagggcccctcatcaaagtcctcggtgttttttaaattatcagaactgcccaggaccacgtttcccaggccctgcccagctgggactcctcgg

SEQ ID NO: 11587 - DNA, 1238 bp, Homo sapiens
tagccagtagtataggaacatactccctgagctgaaaaatatttccggggaatccagatccagtactcttccgtggccatcacctgcaccccatccctctcttcaaaggtgacaaaggcacaaatgaggggaatctttgaggatctttttctgtgcacttaagtacatgggtgctgctcctagaaactcatttttattctgtgatgatcgatccccaccctggtacccccaccccccaacacacaaacgggaccttcctaggcataagggtcctcggctggccttcctcgcttcactccttgtctgctctgagagttcctgcgtctgggtgggagaagtcgcagggcacgattgcggagtccctggattgcccaccctacactgacatgctggctcaccctcccaccaggtccgcataaagatcctggccagcctggtgacacagttcaactcgggcctgaaggcggaggtcctgtccttcatcctggaggatgtgcgggcccgcctggacctggccttcgcctggctctaccaggagtacaacgcctacctggccgcaggtgcctcgggctccctggacaagtatgaggactgcctcatccgcctgttgtctggcctgcaggagaaaccagaccagaaggatgggtgagggggctgaccctgcaccctcctgtccccgagaggcttcctctcctggtgctgccctccctttctgattgcgaccacctccctcttcgtcaccccccgagtcagtcctcctcgcacccatcccaagtctcctctcctcctccccctctggaggcacgttcaaggttgtagttttgcatgtgggctccaggtcgcactccctgagctgttcctcagctctgccacttgctctgagcttgctctgcgtggctttgtcactccctctctctgccattttcccatctgtaaataacagtgctcacccatgggcctggagatagacttctctacaccccattcactacctgagttggttctgtagcttcctccctatccgtggcctccagcttactcgtctatcctccacacagcagctccaggaacattttattatataaatccttttattacttccccacaaggaaccttccatggttctccattggtcttgggataaaacacagcctccttactgtgaccagtgaggccttatgtgacccaatctctttggctttaccccccgaacattagccacattggccttctgtctg

SEQ ID NO: 11588 - DNA, 1223 bp, Homo sapiens
ccggtggaacgcgggagctgggcggcgcgcggactggggccatggcgtctgtgcaggcgtcccgccgccagtggtgctacctgtgcgacctgcccaagatgccgtgggccatggtgtgggacttcagcgaggccgtgtgtcgcggctgcgtgaacttcgagggcgcggaccgcatcgaactgctcatcgatgccgcccgccagctcaagcgcagccacgtgctccccgagggccgctcgcccgggcccccggcccttaagcacccggccaccaaggacctggcggcggcagccgcacaggggccccagctgccgcccccgcaggcccagccccagccgtcagggaccggcggcggcgtgtcgggccaggaccgctatgacagggccacatcatcaggccgcctccccctgccctcgcccgccctggagtacactctggggtcccgcctggccaatgggctgggccgtgaggaggccgtggctgagggggcgcgaagggccttgcttggctccatgcctggcttgatgccccctgggctgctggcagctgcagtgtctggcctgggaagccgaggcctgacgctggcacccggcttgagtcctgcccgtcccctcttcggctccgatttcgagaaagagaagcagcagaggaatgcggactgtctggcagaactgaacgaggccatgcgaggccgggcagaggaatggcacgggcgccccaaagcagtgcgggaacagctactggcgctgtccgcctgcgccccgttcaatgtgcgcttcaagaaggatcacgggctggtggggcgagtgttcgccttcgatgctactgcccgtcctccaggatacgagttcgagctgaagctcttcaccgaatacccctgtggttccggcaatgtgtacgccggcgtcctggcagtggctcgccagatgttccacgatgctctgcgggagccgggcaaggcactggcttcttcgggcttcaagtacctcgaatatgaacgccggcatggatcaggagaatggcggcagctgggcgagctgcttaccgacggcgtccgcagcttccgcgagccagctcccgcggaggccctgccccagcagtacccagagccggcccctgcggctctctgtggcccacccccgcgagccccatcccggaacctggcgcccacgccgcgccgtcgcaaggcatcccccgagccggagggcgaggcggctgggaag

SEQ ID NO: 11589 - DNA, 2686 bp, Homo sapiens
gagaggaccttggatagaggggaggaaatgggaccatttctctttgaggaggtccctaagaggcattgcaaaagtgtggacatggagctaaattgggtcccccttccacagccctcccaccctgagtttttcttagaatctttgtaagaaaaaaaaaaaaagacagaaaaaagctctccttttcaacttacccctatccttttgggtccccccaaattccaccagccaaggagaatcccacttgccaacttcctggcaaatctatggaaactggggaggaggagacaagctcaactcctcctctgctagcccaaggggcggtaccaactggattcaagagaaggacctcaaagctcctatgagaagagggggttcgatgtgccaaattaacctccttcatcccccatctcagggggctctgagccaacctgcccagccaccttcttctgccctgtcccagccacctctacatgggcaaggaggcttcactgcaataattagtaggggtggtgatcagaagacaatgattttgccgtttctatctgccctaacgcctaccctggacttgtagttgggaattatgggtatcccaagtggatgttgataaaagccgacctatagatggttggggacctctacttggaacaccagggtgtcgcttatctccgaggtgtatttcctctcccctctggaccaccaaatccttcaatatcccctcattctgtttctcctccctgttcctccatcccacatcctccttcttactttgttttgattggtggccaattgtttggaaaatgagaggagtccccctgaatggatgattgctgtttcaggaccgggattagaggctgtgatagactgtgcagtggcaaaagtattaacaagagtggcgatgaggatggcagttggggcgtccaggctgctgactgagtgcccgcctgtcggtacagccagccaggccttcgacaagcacctgcctggaaaccgggctcgctgtcctgaaagcctggactggatgtcacgatggggagaacgggatcgcgatacccaagctggggcacaggcgagccagggacactggtttactggggtgataacacccagccctgctatcgcgatccgtttgcactgtggtcagctgtctccacgccgtggttggagagggcttgtctccgggcgccactgctggtgtgtatggtctgtcttagtgtcccctgcaagttgcattggagattgctgggtggcagggagggaaatgggaagagaatctgtggggtcatggtggtgaaggctgctggtttttaatcccttctcaaccagtccaggacacttgtctcccagagataactggggggggactgcctaaccccccctcccccacccctttccctaccccacctctccccccaaaaccaccaacctctcatcttctaagtgactccatcaccaccggccaccgggacctgcggcctcattgctccagcccgccccactcgaccgtcagactcgctcatcgaactctttttgattaaccctttctgtgttcatcccacggaaaactgtgtgtccggcaggggggaggggggaggctaggggcagttgctacctttcctccatctcctcccaccacccatgcctccccacccgcaccccatcccatgccccacccccatccctcacccctagggtctgccccaccctggggattgacatcctctataaatatctatgctatttggctttgtccctttaaaaggcgggtccaggggcgtggcctccctcaaatggagcgctcactctgaccccctccttcgtgtgccccccacacactccccacgccttcattgtaaatagtcacttttgtactgggtttgagccaggggacgtggggagtcatttttcttttctttatgttggcatctcaggccactggaggcatggcccacatcccgggtcgatttgggagaattttaaggtatgtcccctcacctgtccccatcgctaaggatttcaagctatcagtattactctagagggatggggtgcatagattccccggcagggtggtgggagaggtgtggaaaggtgtagtctgggaggatgcctccgttttccccttctgtgaaatggattcatcctccaatttccctgaggagcctcagtgagataatggtggagtcagaggagctagaacctctcttccccctttctctgttggagacagggtagcagaagaatgggggacaggggaggctgcagggccatctttggagaaccgattgctaaatccttcttaggaccttaaggtagcctcctctccaggcttgttctccctcttggaatatggggaggactggaggacctctaaggtcccttggttctccccagtccttagattaaaaggcccaggccccaggctggccccctgcctgctgtcccactccttcattccatttcttggaatgtggccatgcctccagtgcctccattcaaccccctctaactgattccttccatcctctgcgaccagagacgccgcccgcctcctgcccaccacctccagaagctcctggctggggtgcactgccgtctcctcccactccccacattgccatgcctgggccacgcccaccccacccactcacccacccccagtgtccgttgtgtgacctagtgcaccatg

SEQ ID NO: 11590 - DNA, 1194 bp, Homo sapiens
tgtttccatatgggaggaggggagggagcctctgggtcacccagaatgaggggccttcccaaaacacaacaccccacctctctgctttcagttctagatctgagggaagccatgggagtagaggtagcagaggcgtctgagctgaaatggggcatttggagcaaggaccccagagttcccagatcttctcagctactctcctcccactggagctgtccctcctaggtgggaatgttcactcttttgttgtcaggttgtatgggggggcagggacagtgctgctgggaaggatgccagctctgggattgggccagtcctgtgggcaagacttgcaagaggctggatcaacttggtgtggtatctctgatggcttagagtaatggcaatgagggtctctgttgtgatgtcactgagtactttctggggtgcttctgggcaccccttatgatgtcacaggaagcagttcctcagaggttacttcctgtgaacataagggagcaggtacttcctgtgatgtctcaatgagttcttccttgaaggtcactttggtgatatcatgggaaggtgtacttccggtgatgcctagaggtcacgtcctgtgatgtcattaggctgaagcatgtacttcctgtattggacagtgaccagtctctgacctgccttctccctccacacccttctttggtgggtgttggcctgggggtcttcctaggaagagaataaggcacgggacttggatccaatctggaggactctaacggaaaaaaaccaatattgtcagggtcatctccattcaaacacgtcaagtctgcgaactcgccctggagggaggggtgggagatggacctagtgcaaactactgttaaagacctcccttcccacccctgccttttgtgtgcatgcctgtgtctgcgtggctttgtttcattgaatcgggtgagccaagtgtgtggtggctctgtcaggccagtatggccaggtgtagagttcagtgagccatagtagggtcccttgggccagaatgcttcgtgtggtctgataggttagattggtttggtggcttccagcaagctggcatacttcggtgatgtctgatggatcagaatgttttggtgtgctcaccaggggctctggagaactagaatgttctgatggagtctgacaagccaggcggccttgagagttggtttagga

SEQ ID NO: 11591 - DNA, 1215 bp, Homo sapiens
tgtgtctgttgtggctctgtccctccctctccctctgtcccttcttgcccagccattccttctcttaacccaccagccccacccagccctgaccacactgtccactctgctcctgtccctgcagcgaccagatggggaacaaagcctcctacatccacctccagggctctgacctacggcctcagttccaccagttcacagcagtggtgagtcacccctcagggcccctgccccttccatcccggcctggggacaaggaggctgagaccctggtaaggggcaggggtaggttctgccggtgggtgctcaggggctctgttctgacttctgtccatcccacctgccctggtcccacagcctcatcccaacgtcaagcccatggcctatgccaacacgctgctgcagctaggaatgatgtgaggtgacgggcggggcggcctgcatcccagggcccctccaatcccaccggacccaggccctgggctaggggcagagcaggccccgccccagggcaatgttggacccccttttactttgtaaagtttgtatttattcccctttaggtttgcagagggggtaggggcagagtcaggggctggccagagggtctgctccctggacagagaggaaggaggtggagcagctggggctgggggcacagcctgggcattctgtggggaggccgtcctcggggtggggtggggccgagtggctgccctgcccccctcatttgcatggctcctcccccactcaagcaatagggccccgccataggaagacccccagagagagggtcagcaggggggccccgcctgcgcctcccctcctatagccccatggtggggctaggctggggctcacccccctccccagctattttatgtctgtaattaaatatgttaaaataaagtcattatcggaagtcagcttgtctctggatggtggagccgaaggagctgcccgggttgggttacgcctgctcaggagatccggagggtggggaggccgcaaagtcccgctggccgggcccacccagctctgggctgaccgcccaagtggcctctgcctctgcccagcaccgtgggctcctggggagagttctgccccctgggtggggcgatgaggccagcactgagtggagcggagcggaagctgaggcatagcctcatcctttgctggctccagcaacaagcatgacagtgccgctccctgctc

SEQ ID NO: 11592 - DNA, 3420 bp, Homo sapiens
ccctcctcgtcccagccagccaaccctggctaacacactcagacaaagaatcctttcggctctcattcactccatgactttggttcatttcatcatttcaagggagaagtcaaagccagggaccaaacagaaatgtagaatcatctaaggacagctgtcagaccattttccccactgtcttcactggctggccagaaaaatagcttcacctagcacagtgttgatgttcaataactgttgaatgaaggttggaagggctttgccctgagcactgaggagagagagctggttgcgtgggacttgaagtctgtctcagtttctttaggtgggactgatgcccttggccttcctccagggaaggcatccagcatccagaggtaaggattctcctgtggaccttgtgacctctgactcctcccccttcttcccccagagttcaaggaggccttctccctctttgacaaggatggagatggcactatcaccaccaaggagttggggacagtgatgagatccctgggacagaaccccactgaagcagagctgcaggatatgatcaatgaggtggatgcagatggtgagccccacagagcgcgtgggcagccctgctcctggtcaccccgagtgactgcagggagcctctctcagggtgatggatgagcccgtgtctctcagggcccaggccaagagcattctccatcctttccccaccttccagggaacgggaccattgacttcccggagttcctgaccatgatggccagaaagatgaaggacacagacagtgaggaggagatccgagaggcgttccgtgtctttgacaaggtaagcagccctctccaggggcggctctgagactgacgccagccttcaggcagacaggcggaactggagccacggagctaccacttccaggaggtccgggtcccggtgccagcctcattgccaacctgctctgccacctcaggcagcctccctcactgtgctcactgctgagggatggtgatgacagccacccctctcactgcctctctccccaccgggagaagtgcccagtgaaaggctttatccccaacccccaggatgggaatggctacatcagcgccgcagagctgcgtcacgtaatgacgaacctgggggagaagctgaccgatgaggaggtggatgagatgatcagggaggctgacatcgatggagatggccaggtcaattatgaaggtgagtcaaggccaggcttgatctctggaacaagaagagaatcgcagcttcaggaacaagcccccagatccctcttgttggggagggccgctcgccacttagcctgcccgcctgacctcctctctctctgcttcactccacagagtttgtacagatgatgactgcaaagtgaaggccccccgggcagctggcgatgcccgttctcttgatctctctcttctcgcgcgcgcactctctcttcaacactcccctgcgtaccccggttctagcaaacaccaattgattgactgagaatctgataaagcaacaaaagatttgtcccaagctgcatgattgctctttctccttcttccctgagtctctctccatgcccctcatctcttccttttgccctcgcctcttccatccatgtcttccaaggcctgatgcattcataagttgaagccctccccagatccccttggggagcctctgccctcctccagcccggatggctctcctccattttggtttgtttcctcttgtttgtcatcttattttgggtgctggggtggctgccagccctgtcccgggacctgctgggagggacaagaggccctcccccaggcagaagagcatgccctttgccgttgcatgcaaccagccctgtgattccacgtgcagatcccagcagcctgttggggcaggggtgccaagagaggcattccagaaggactgagggggcgttgaggaattgtggcgttgactggatgtggcccaggagggggtcgagggggccaactcacagaaggggactgacagtgggcaacactcacatcccactggctgctgttctgaaaccatctgattggctttctgaggtttggctgggtggggactgctcatttggccactctgcaaattggacttgcccgcgttcctgaagcgctctcgagctgttctgtaaatacctggtgctaacatcccatgccgctccctcctcacgatgcacccaccgccctgagggcccgtcctaggaatggatgtggggatggtcgctttgtaatgtgctggttctctttttttttctttcccctctatggcccttaagactttcattttgttcagaaccatgctgggctagctaaagggtggggagagggaagatgggccccaccacgctctcaagagaacgcacctgcaataaaacagtcttgtcggccagctgcccaggggacggcagctacagcagcctctgcgtcctggtccgccagcacctcccgcttctccgtggtgacttggcgccgcttcctcacatctgtgctccgtgccctcttccctgcctcttccctcgcccacctgcctgcccccatactcccccagcggagagcatgatccgtgcccttgcttctgactttcgcctctgggacaagtaagtcaatgtgggcagttcagtcgtctgggttttttccccttttctgttcatttcatctggctccccccaccacctccccaccccaccccccaccccctgcttcccctcactgcccaggtcgatcaagtggcttttcctgggacctgcccagctttgagaatctcttctcatccaccctctggcacccagcctctgagggaaggagggatggggcatagtgggagacccagccaagagctgagggtaagggcaggtaggcgtgaggctgtggacattttcggaatgttttggttttgttttttttaaaccgggcaatattgtgttcagttcaagctgtgaagaaaaatatatatcaatgttttccaataaaatacagtgactacctgatttggctcctctcctcctgtctcagtttctggcctgcccccctccaacacacatacacaccaaccccagcactgactcctttggcccagaggtggaagagcctctcctcaaagctggctctgaagctgtgtccagtcagtgcagcccagtggacgcctctgaaccacagttctgatcccagctagatcgcagggtcatcaacggcagggtcctgtcctagagatagtcgcacaaatggactgaaaggcggggactgagaaggctcctctgaggcaggcccatcatgccatgggagcacacagagaaggggtcagcccagtcaggtggcaggactgagctgagacctacctgaaagatgggcagtcccctagccgggtaggggaaggacggaagggcattcc

SEQ ID NO: 11593 - DNA, 1100 bp, Homo sapiens
ctgtacagtaagtgtccatgtatgcaaaaggggtaattcggtttgaatttccccgttttagtttagaagcctagtctgtttgttcccctccaccgctctccctctcattcctgatgagccctctcattcctcctttccttgcccagctatggccccctctcattcacaaagtgccccctccatgtccctggacccttaagatatccccttggcaccctggtcagagactctgtgtctgactcaggtggtccctgcagagtgccctgggaagggaaggagcactgatttgggggttttgagggtcaagtaggggttggtaacacctggaaagaaggactctttcacttcgatccctggacaattatggaggattcggaggtagaagaggggaaggaagatggtttctatctcatgacccccactccctgtgagagggaatgggggaagcctgatgaccctcagctgttccaatctagtattttttttcttttttaaaattactgtatttattatgacgatggtgactccccagtgcaaaggggggccagattctgtgtgtttctctaacctctttgtaaataaatgcacagtgtaacatatgtggtggactctcactgaatgattaaatgggagaaatgctctttttcctttggactaacatttattgagcaacttctgtttgctgtggatatggcagtttccagggaggtcccagggtgaatctcaacatcatcttcctaccattggctattttacatcaaggaatctaacctttgattgggttatgtttggttataaatacgatttcaggcgggatgtgatggctcatgcctataatcccagcactttgggaggcaggggtagggggatatcttgagcccaggagttcaagaccagcttgggcaacatggtaaaaccccatctctacagaaaatacaaaaattagctgggtgtggtaggtcattcctgaactatcagctgctcaggaggctgaggtgggagaatcatgtgagtctgggaggcccaggctgcagtgagccatgattgtgtcactgcacgccagcgtggatgacaagcaagaccctgtctcaaaaaacaaa

SEQ ID NO: 11594 - DNA, 1499 bp, Homo sapiens
cgctgttgcctgccaccccagcaaggccctcattgccagtgctggcgctgatgccctggccaaggtcttcgtatgatgcccacctggccctgccctggccgccacgctggctggggtgtagggccgggcaggtggggctgaggtgagggcagaaaccccgcattctgagtctctgcacgcccatgcctagtactgccaggtgtgctgagccccgcagtccagtcaggggcgtcctgtgagaatcactgggggagccctgggcatgcaggggaggggttgaggccttagaggcgccctagaggcggcggctcagtctcccctcccttctctttcccgcaggggactcccagcctcgctggaggtgcagaggcctggcctctgtctgtttgccatggagcctggtggtgctaacggccctttccccaggaatccctccccaacggctgccttccccaagcatccagcctggggatgggcccctttcaggaatcacccccgaggatggcctcggggtttccccctgtgccctgacagccgctcctggtatcagagctgctttccagagggcagcacagccagggccgggtgtctttagggatcagtttttccaagactccagaaggtgccaggttctccccttgagctcctgctcccccatcccccatcctcccagacctgggcaggagctgtgctgggagaaagggtggcagccgggagcctcagagctgagccccggcctggctgcccctcccctccggccctctccactgctttccagacactaaccaaggcttccaggccagggattgcccaacactcctagggcagccctcccagcgccccatggggtcgcccatgggtagagacggctttcttgtgcccctccctggggcatggagggtggagtgggcctcgggtccccctgaactccctgtatatctgtataaataacgggattttcatggcgccgccccacccgcattatcactgtgtgatggtctcagtcagtctcctccctgtctccactctttccctctatttatttcactctcttgtttggttctaccctgcaccctcggtccccttccaggttcctgtttataagccccaacccctctgtccccatcttgtatgtgaaaacttgtctcaataaaccctttggagtaagatgggtgacggtgccatctgttgagggcactggggactttgggggaggagtgaccggctctgcctgggttgggtggagtttggagagaggggatatgatgggttggggttttgtggtagggcagcaggggccggagacgggcccagagcttgggtggggtgtgggtggagagaagtggaggcactggaccgaatctccttgtgccctttctgtccctaagtgctccctccccaggggtagagccctggggagcagatactatgatgacagtccagctgaagcctcagccccgcctgggatgtgtgagggtggtggcgaggccaaagggctg

SEQ ID NO: 11595 - DNA, 1544 bp, Homo sapiens
gtggaggttgcagtgagccgagattgtgccactgcactccagcctgggcaacagagtgagatcctgtctcaaaaaaaaaaaaaaaaaaaaattctggaattaattattggcaatggttgcacaagtctgaatatactaaaaaataccaagatggacacttttaaaaggttaattttatggtaggtgaattataattttttttcgagacacagtctggctctgtcacccaggctggagtgtagtgatgtgatcatggttgtgatcactgcagcctccacctcccaggctccagcgatcctcctgccccagcctcctgagtagctgggactataggtgtgcactaccatgcctggctaattttttttttttttaaatatatataaagatgggatctcactatgttgcccaggctgactccaactcttaatttttactttttagattccagggggagagaggcaggaggcttaggccttggccctttccttccctctcaccctctcccctcccgcttactttgctgtcatttctacccctttagcgaccggtcctgtaccgtcctcaatgtagaaggtgacgctctgggggcaggactcctccaaaattacgtggaccgtacggagtcgagaagcacagagcctgagttgatacaagtgaagagtgagctgcccctggatccgctgccagtccccactgaggaaggaaaccccctcctcaaacactatcgggggcccgcaggggatgccacggtcgcctctgagaaggaatcagtcatgtaaaccccgggagggaccttccctgccctgctgggggtgctctttggacactggattatgaggaatggataaatggatgagctagggctctgggggtctgcctgcacactctggggagccaggggccccagcaccctccaggacaggagatctgggatgcctggctgctggagtacatgtgttcacaagggttactcctcaaaacccccagttctcactcatgtccccaactcaaggctagaaaacagcaagatggagaaataatgttctgctgcgtccccaccgtgacctgcctggcctcccctgtctcagggagcaggtcacaggtcaccatggggaattctagcccccactggggggatgttacaacaccatgctggttattttggcggctgtagttgtggggggatgtgtgtgtgcacgtgtgtgtgtgtgtgtgtgtgtgtgtgtgtgtgtgtgttctgtgacctcctgtccccatggtacgtcccaccctgtccccagatcccctattccctccacaataacagaaacactcccagggactctggggagaggctgaggacaaatacctgctgtcactccagaggacattttttttagcaataaaattgagtgtcaactatttaatcaggtgttcttgagaatttgacttaaagcactggccactgcaatgacagtatctgctcatcaagaaacaccactgggctgggcatgggggctcacacctgtaatcccagcactttgagatcactccaggccaggagt

SEQ ID NO: 11596 - DNA, 1490 bp, Homo sapiens
cagccctcagtgtccaagacccaggcagcccgggtccccgcctcccggatccaggcgtccgggatctgcgccaccagaacctagcctcctgcagacctccgccatctgggggcactcaacctcctggagccaagggccccacgtcccacccagagaaactctcgtattcccagctcctagggccaaggaacccgggcgctccgaactcccagctttcggacatctggcacacggggcagagcagagaagcctcagcgcccagcctggggaatttaaacactccagcttccaagagccaaggaacttcagtgctgtgaactcacaactctaaggagccctccaaagttccagtctccaggtgctgttactcaactcagtcctaggaacgtcgggtcctgggaaggagcccaagcgctcccagccagcttccaggcgctaagaaaccccggtgcttcccatcatggtggccgatcctcctcgagactccaaggggctcgcagcggcggagcccaccgccaacgggggcctggcgctggcctccatcgaggaccaaggcgcggcagcaggcggctactgcggttcccgggaccaggtgcgccgctgccttcgagccaacctgcttgtgctgctgacagtggtggccgtggtggccggcgtggcgctgggactgggggtgtcgggggccgggggtgcgctggcgttgggcccggagcgcttgagcgccttcgtcttcccgggcgagctgctgctgcgtctgctgcggatgatcatcttgccgctggtggtgtgcagcttgatcggcggcgccgccagcctggaccccggcgcgctcggccgtctgggcgcctgggcgctgctctttttcctggtcaccacgctgctggcgtcggcgctcggagtgggcttggcgctggctctgcagccgggcgccgcctccgccgccatcaacgcctccgtgggagccgcgggcagtgccgaaaatgcccccagcaaggaggtgctcgattcgttcctggatcttgcgaggtcagctcccgctcccccgggaggtggggaagagtgttacggatggcgggagtggtcacgtggacaggacggggctttggggcccctggagcagagacttccctctagagtcttaggaaaactcgacaggatattgaggggaggctccagccctcgggagtgtgagtctagtctcctggggaaggggtttctaaatctgggggcctgggtacataagtggggtcttatagagggagaagaaagtgatttggggagacataggagggtctgcctaggggagaaagacactgaggggaggggaccccaggaggaacttttgcggggggaatctttgcgtggtcaagggccccaagatggggcttctagatataatttggggccagggttggagagtttgggtaaggagcccctggaggatctgagatctgagtaactcccaccaggccctcttcccagccctgggg

SEQ ID NO: 11597 - DNA, 1873 bp, Homo sapiens
catcagtgtggtgggattatctgggaccgagaaggaaaagggccagtgtgggattggaaagtcttgtttgtgcaaccgcttcgtgcgcccgagtgctgacgagtttcacttggaccatacctccgtcctcagcaccagtgactttggagggcgagtggtcaataatgaccactttctctactggggagaagttagccgctccctggaggattgtgtggaatgtaagatgcacattgtggagcagactgaatttattgatgatcagacttttcaacctcatcgaagcacggccctgcagccctatatcaagagagctgctgcgaccaagcttgcatcagctgaaaaactcatgtacttttgcactgaccagctggggctggagcaggactttgagcagaaacaaatgccagacggaaagctgctggttgatggttttcttcttggtattgatgttagcaggggcatgaataggaactttgatgaccagctcaagtttgtctccaatctctacaatcagcttgcaaaaacaaaaaagcccatagtggtggtcctgactaagtgtgacgaaggtgttgagcggtacattagagatgcacatacttttgccttaagcaaaaagaacctccaggttgtggagacctcagcgagatccaatgtaaacgtggacttggctttcagcaccttagtgcaactcattgataaaagtcggggaaagacaaaaatcattccttattttgaagctctcaagcagcagagtcagcagatagctacagcaaaagacaagtatgagtggctggtgagtcgcattgtgaaaaaccacaatgagaactggctgagtgtcagccgaaagatgcaggcctctccagaataccaggactatgtctacctggaagggactcagaaagccaagaagctgtttctacagcacatccaccgcctcaagcatgagcatatcgagcgtaggagaaagctgtacctggcagccctgccattagcttttgaagctcttatacctaatctagatgaaatagaccacctaagctgcataaaagccaaaaagctcttagaaaccaagccagaattcttgaagtggtttgttgtgcttgaagagaccccatgggatgccaccagtcacattgacaacatggaaaacgaacggattccctttgatttaatggataccgtccctgcagagcagctatacgaggcccacttagagaagctgaggaacgaaaggaaaagagttgagatgcgaagggcgtttaaagaaaacctggagacttctcctttcataactcccggaaagccttgggaagaggcccgtagttttattatgaatgaggatttctaccagtggctggaggaatctgtatacatggatatttatggcaaacaccaaaagcaaattatagataaagcaaaggaagaatttcaggagttgcttttggaatattcagaattgttttatgaactggagctggatgctaagcccagcaaggagaagatgggtgttattcaggatgttctgggagaggaacagcgatttaaagcattacaaaagctccaagcagagcgtgatgcccttattctgaaacacattcattttgtgtaccacccaacaaaggagacatgccccagctgcccagcttgtgtggacgctaagattgagcacttgattagttctcggtttatccggccgtctgaccggaatcagaaaaattcactctctgaccctaacattgatagaatcaacttggttatattgggcaaagacggccttgcccgagagttggccaatgagattcgagctctttgtacaaatgatgacaagtatgtgatagatggtaaaatgtatgagctttccctgaggcca

SEQ ID NO: 11598 - DNA, 1311 bp, Homo sapiens
cctgctggggtcccactcacccacttaggtctagtcgctagatcccccgttttcccaagaagagggttcgagcccttggtggggacagctggggagatggcagtgcaggctggaacctgggctgccccagaacacagtccattacgatagaaacactaattgagcatgtgcgtggggtgggggtgtgtgtgcacatgtgagtgtgagtgtgtgtgggcgcttggtggggggttggggacagctggaaggtgccaggtgcacttggggttggggttggtgtgttgggtgttgaagtggaatcgtttcatcccagccatggaggccaccagcaggagtgttcatggggatgtgggcgaggtggggcactttgaaggaatggcggtctgctggtgccctcgaaggggcatccttcctggtcttcgctgacccagaggcgctgtgcctgcatatcatccaccaccaccctagcccagccttcccactgccccaggaaaagctcttctcctggccacctctgccccccagcacctcaaacttgcatggctgggctgtggcctctgcggccaggaagcctgacactaggcaccccccaggcgagagctagtggggtgcagagggccccatgccagacagcccttggggctcgttgcactttaagaaataggatctgtggtgtattccagggggcctgatggacacctttcccgggcgtctgcagctgccctgcccgtgcccgcctgcagtggttggagacgggagtggcccttcggctcccgagctccctctggggacggctggctcactgtctccagttctcaatggccaacgaaggtgcttggaaacacctaaccttgcaagttttaccgccttttgaggaacacaaatcggagaacaaacccagggttcaggcgtgttttctgtgaatgttggatgatgaatttttgtctcttctggtggagctgtgcctggccctgtaggcccagggttggctggaaggtgacatctgtgtttcgttttagctgaggttggcagaaacgttcccaaactcccccagccctggaccccagcagatgaggaaacggccccatttactgaccccgcccccttttcgaggttatgctcacctggtcagctcctcacgtaattgggggtggagggaaagcatggtggtgccctgggccgtccctgtgtgaacgcaggcaaaagcagcccagtccccctcactgcttgagctaacactgccacctcttttgtgtgagcacaaaagccacgtcccaagccacctggcccgattccacagatgtatgtgcg

SEQ ID NO: 11599 - DNA, 1510 bp, Homo sapiens
tcatgcagagtgacatgggtcgggaagcagcatatggtgagtgcagaccccccctctcgccccacggaaccagggaatgcagagcccctatcacctgccctggtgagagtagactctcctaccccatcccactcccagtagtaagtatagaacccccattcttcccccaccagaagacacccctcccataggcactaggtccatctgaatgggtggcccaggacatggttatggtcccctcccctccgatctgattctcaaagatgcaggctagcccctggcacggccctgcctctgttcctgtctcctcaaccctggctttgctcccagaccatcccccgaccttggccctgttgctaccctgcctctcccgcaggcttcttcctgctgggcggcctgtgcgtggtgtggggcagcgcctcgtacgccgtgggcctggcggcgctgcgaggacccatgcagctgacgctggggggcgcggccgtgggcgcgggcgccgtgctggccgccagcctgctctgggcgtgcgccgtgggcctctacatggggcagctggagctggacgtggagctggtgcccgaggacgacgggacggcctccgcggaaggccctgatgaggcgggtcggccgccacccgagtgagcgacacggccgtggggcctggcaggcgctggacagcgcccgaggactgggacattaaacctgacctcccctcctccagatgcagagtattggttcgtgttccttgggaagggcggcgaggagcggactaactggagaggcaggagggcgggtggagggagaggggggtgaggacccgggggagacagaaatggacagaggagctcacagcccggagcccaaaccactgcagggagagccggcgtttaattctcagggctacgggcagagccgggcctactgtcctgggggaccccggttgtcgcagggtccggcgccggcagctctgccagtcctcagtcccccttccgcggcagcctggtgcccgcgggccccgggtagggcaggcccaggggcgggtaaaaggcctccgggagcgcggggcccggacccagcctctgcaggtgcgggtacaccaggcccagctccgcggggccgtagcggatggtgccgggtgtgcacaggccccgcaccaccggcggcaggaagcccgcgtgcaggagggtgggcggggggtccccgggaggcgccaggccccatggccgcaccggatcctgcttcaggacccctgcccggatgacagaggtgaactcgggcctcggtgtggccgggtggctggagggatcctcgtcgccactgtcctcggagcctttggtttccctcgggccgggctccactttgatgcgtttgccctgggtctggggggcctcgttctccgctggggcagcctgcttcccttccgtcggaggctccggctctggaagaggaagatgctgagggcctgtgtgtgtccccagccctcagtcttcccatctgtggaatggagctg

SEQ ID NO: 11600 - DNA, 1166 bp, Homo sapiens
gtggggtgaacaaggctcctatcccaccccaccccaaaaagagaaaaatgaaaaactcatagtttggagccaggaggcagggtgtcctacagggctgcacagccctgaggggtcagtgctgggatctggttggttggtttgtctttttgtctttttttttttttttttttttacacaatcattaatgagatttgtcttcagccaccagtgttggccttgaagcagagggcacagcccttggtgtttgtaaaataagtatgaatacacagtgtggcagtgttgtggtttttgttgttgtttttcctctccttttgagaattttcttttgtaaaagaaaaatattttttaaaccgaaatctgtggatgaaatagaagctggagccctcctcttggaatattcagcctaagaacctcataggactatgaattcacccgaaattctcatttgccatcaggccgagcttttaaagaaaaattgttctctaaccaggattgtaacaaaagtgtaaatactgtttcagagttgagagttggtggtgcaaatatgtatataatgaactgtatttttacaatgatcgccgcatgactatttcacaccctttttatactccatatctgtcttccagaaacgtcacctgcctttctcctgtggtctcttaatccagtaattgtattactgccattaaaggatgcagttattttaaaaagcttgtgggtctggtctctccaggctgccccagaccatcccttgccctgggaattaacgagggtggaaggtggctggggggtgaaacaaggacctattctctcagcggtcggcctcagggtaacatgaggacactgagggacaatttgtgcctccaaacagtgtcagctgtcctcagtggatggcagtagatcacctactagcaacatcccaaggtccctgagcttctgtgcgggccacgctcagcatttgggatccaggggtgacctgcacagtcctggatctgcccctgcagtgctcatagaaagaccattaacacagacaggacagctgggctggcttccagggacgggacgagctttagcaggcaccctacccatgtgatagccaggggtatcctctgaggaggggtctgttgtgatgttggaacttactttgaaatgcatcaacaaatatgaag

SEQ ID NO: 11601 - DNA, 1102 bp, Homo sapiens
caggtgacaccggaaactggtactcaagtgatgaggatgagggtggaagcagtgtcacctccatcctgaagaccttgaggcagcagacgtccagccgacccccggcttcagttggggagctgagcagcagtgggctgggggacccccgcctccagaagggacaccccacaggaagccggctggctgaccctcgcctcagccgggaccccagactcacccgccatgtggaggcttctggcgggtctggcccaggtgattcgggaccctccgatcctcggctggctcgcgccctgcccacctccaagcccgaaggcagccttcattccagccctgtgggccccagcagttccaaggggtctgggccgcccccaacggaggaggaggaaggggagcgggccctgcgggagaaggccgtgaacattcccctggacccactccccgggcaccctctgcgggacccacggtcacagctgcagcagttcagccacatcaagaaggacgtgaccctgagcaagcccagcttcgcccgcaccgtgctctggaatcccgaggacctgatccccctacccatccccaagcaggacgcagtgccccccgtgcccgcggccctgcaatccatgcccaccctggacccccggctgcaccgcgctgccacggcagggccccccaacgcccggcagcgcccgggcgcctccacggattccagcacacagggcgccaacctccccgactttgaacttctgtctcgcatcctcaagacagtcaatgccaccggctcctcggccgcccccggttccagcgacaaacccagtgacccccgggtgcggaaggcccccaccgaccctcggctgcagaaacccacagactctacggcctcctcccgggctgccaagcccggccctgctgaggcgccctctcccaccgccagcccgagtggggatgcctccccaccagccaccgctccctacgacccccgcgtgctggcggccggtggactgggccagggcggagggggcgggcagagcagtgtgctgagcggtatcagcctctacgacccgaggactcccaacgcggggggcaaagccacagagccggctgctga

SEQ ID NO: 11602 - DNA, 1190 bp, Homo sapiens
acaagaagatcccctccttgtttgagatcgtggtgcggcccacgggacagctggctgagaagctgggtgtgaggtgagtgccctggacccccgtgacaggcagtgggcgctgtcctgggcccagccaggctcctcttgttagggcaagcctggctgtgggagagtcctgcctctctccccagctgtgggagtcctggtctggggcccatgaccttcggctctgcagccctccgcctctcctctggggtgtggccactgccctcctcggcagcttccgtcacaggcaccttttccctcttctaggttccctggacccggtggacccccagggccaatgggccctgggcccaacatgggacccccagggccaatgggcggtccaatgcatcctgacatgcaccccgacatgcacccggacatgcaccctgacatgcacgcagacatgcacgcagacatgccgatgggccctggcatgaatcctggcccacccatgggccctggcggccctccaatgatgccctacggccctggagactccccacattctggaatgatgccccctatcccgccagcccagaacttctatgaaaacttctaccagcagcaggagggcatggagatggagcccggactcctgggggatgcaggtatgcgggactccaggtgtggctgcctggggctgcaggctttacccagtggagcagagttggggagatgtgatttttcttccttcgtccaagtctctttgaaagcatgactccatctctgtcccatttaatggttgaatgttttcagtgacataggatgtattctgttgaagaagaaaggagtattctgtgtattaccaatataggttatttctttttaattttgcaagctgtgcctggaatcggaagcatgggaagttagagggacgagtgtgcaagggtgtgaggctgagaggctggtgggcccatcaggactcagttagtggcctggccaaaaccatctctttccgggcagttctcggcttggagcaaccagtgtccaccccaggactctgcgggttctgtgcccattaccggccgttttcctgcctttttttccttttgcattggtaacaaatgtccagtgagcagaggggtttagatgacgctgctgcagccataggagatgtggtgtgcagccctctggaggagggccaggcacga

SEQ ID NO: 11603 - DNA, 1227 bp, Homo sapiens
ctgggattacaggtgtgcgccaccacacctggctaatttttctatttttagtagaaacaagatttcaccatgttggccaggatggtctcaaactcctgacctaaggtgatctgcccacctcagcctccgagagtgctgggattacaggcatgagccaccacacccagcctcttttttttttttttaactaagtctttgaagtccaatgtgtgttttggagtcttgtctaaatcacaggtccaaactacagggctagcttgtcttgtcagacttcaaggctagcatcttgtagtttggaccagacgtgttagttgcacattagcccatgggctggtgtttgccatattggacagtgcagttctaagtagacaagtccctgtgaggaaggggagtgagtactggagtagctgtgtgtctggggtgctgagggacccccattgagagaaccagagggtccagtagcctacctggggcatctaggaaggcttcttggaggaggaggaggaggagaaggaggaggaggcagctgaagtgattgacctcaggagcaaaatgtgggttgtcttctttcttgctggtggcatctgctcctgctggaggctcactatctgaatctccatgcaggcagccgaggccggggccggggctacaggggccgaggaagccgtggaggatcgcgaggccgcggcatgggcaggggcagccgaggcaggggcagaggctctatgggaggagaccacccggaggatgaagaggatttctacgaggaagagatggacgtaaggtttcctctggccctggggacgtcggggtgaggctggtgggctttccggggcgtgagcactgctggtagaggctgtgaggccaaggtaggaagacatacggcccttctgaaggaagggaagcctcagagcgcagatgtatgtgtttaaaaatattcatttatcattttggaatagataaaaccttcacgtggtttaaagtagaaaaggtatcggctgggcgcggtggctcacacctgtaatcccagtactttgggagcctgaggcaggtggatcacgaggtcaggagatggagaccatcctggctaacacggtgaaaccctgtctctactaaaaatacaaaaaattagccgggtgtggtagcacgcgcctgtagtcccagctattcatgcaggagtctgaggcaggagaatcacttgaacccgggaggtggaggttgcagtga

SEQ ID NO: 11604 - DNA, 1201 bp, Homo sapiens
gtgccaccacacccagctaatttttgtatttttagtagagatggggttccaccatgttggccaggatggtatgaatcctcagattcatatttgttaatgtagtttatattaggggctcagcctctatttggattaggtgcaataattacatttatagaaaggagtggagaagggatcagaagacgatggtttctgtagctagtgctggaatctgagatgggaaccatgcgatggggaaagcaagatgaaggggccagaattggtttcattgaactgagaggaaagacatgaccaagcccatatttactctttgctttgtagatttaaatgttgagaaagaaaaacagctggtcagaatgttgagttaaattacgctaacgaggggattctaaagagtgcagaaaccacaaaagagactgcagaaaaccacaaaagtggaactctcagactctccagcaaggcggcgttggagattttctttctcattttgtgtttgtgttggagtagtttggtgctgtaagtgtgatacagaggaattaagccctaattttagtgtctattcacagaaccataattatccagagtgaaccttggtgttttggccaaaacttgggtgcctttctttctttttgaggcccagtcaagatttatctgaatagctccgtgaatttggtggggggagataaattgttaacaaacggaggagtacaaaagctgctttgtgggtgctgtcagtttataaatcacaccctcttacaagtgtgacacttggccttggtgtgaagggttttatggcttaagggccttctctgattgaggcaggtctttcacattcaaatggagagagtgcctagctttgttagccattcacagctggaagtttccctggagtcagttctgatggtgcccactggggtggatctggaaacctcttttgggaaccactttatctcgctatgaggagaatgtgggcagcccaggcctttgcccaccattccggagggccctacaggcacagaggtttttgtgcagcctcttcctacgtggagctgagctggaaggtatcaaaatattccccagctgacattgttagtcagctgttacacttgaacaatgcaggctcggattccaaccccaagcccttaaggttacgaggcattcagtgcattcctgctgacaatccctgggattccaaaccttg

SEQ ID NO: 11605 - DNA, 1604 bp, Homo sapiens
cggagggagaagggagcatgagcctttgctttggatcctggtgggtttgtaattatgcctaagttgttgctaattagggggctgctaattagacgtatcattaggggccttgctgagggggctaattgtgcggtggccctttaagaatcacccctctcccccacccttgcctgcacacacacacacacacacacacacacacacacacgcacacaggcatgctcctcgcttgctctctccttcttgggaagttctgccaacacgctgcctccctcccccagaggagccagctcccagcccatgggtatgtaggtgtgagttggggacaggctgtgggttagactctcagaagaacttttcaagcaaatggaagcccctggaagaaatgaggctggtggcagaggggtctgggagggtggaggttcccaggacacctctcttcctctctccttctctttttgataagccactgggttaccatggcaacatgagggtggggcggaggagctcagagtcagggccactcttggagaggcgacctgggagccagagttggtgctggatgatgtgggcaagttccgtaacctctctgcgccttggtcctctcacctgtggaatggaggggtgctccccagagggggagggtgtcattttggatggggtgtttggggaagctgacatcagagtggaaacctgaaagggcagagagagcaaggctagcggatatgaggggaagagtgggcggggcacggtggcacgcacctgtgatcccagcactttgggaggccaaggcaggtggagcacctgaacccaggagttcaaaaacagcctgggcaacatagagactcccggctctacaataaattagctgggcatggtggcgcacgcctgtacttcccgctacttgggaggctgaggagggagggtcgcttgagccctggaggtcgaggctgcagtgagatgtgatggcaccactgcacttcagcctgggtggcagagtgagatcccgtctcaaaaatacataaatagagaagcgtgttcgaggaagggggaacagcaggtgccagggctccaaggcagaagcttgtctggtgaggctgaggagcagaggggaggagagggtggctgaggcagactgggcaagggggagagggtgggaaaagaggccagagagggagtcggggccaggttgggcaggacctcacgggccctggagaggacgctggtgctgtgagtgagatgggagctggcgggggttctgaacagtagggggatgaggcaagctgatttgtgggctttgtttttggttttgttttgtttttgaggcagagtctggttttgtcgcccagactggagtgcaatgacatgatctcggctcactgcaacctctgcctccctggctcaagcgattctcatgcttcagcctcccaagtgctgagattataggcacacgccaccacacctggcttttttttttttttttttttttttgtatttttagaagagacagggtttcaccatgttggccaggctggtctcaaactcctgacctcaagtgatccacccgcctcagcctcaaagtgctgggattacaggcgtgagcc

SEQ ID NO: 11606 - DNA, 1186 bp, Homo sapiens
ttgtttgtttgttttcgagacagagtcttgctctgtttcccaggctggagtgcagtttcccaggctggtgtgcagtggtgtgatctcagttcactgcaacctccaccttccaggttcaagtgattgtcctgcctcagcctccctagtagctgggatgacaggcacctgccaccaagcttggctaaattttatattccttttatattccttctaatctcacttccttacatttgggtctaggctttgtccctcccactagaaattcgcttaaggccactccccttcacccctgtcacagaggcccattcccatcccacacactgtggtctgctctctgccctcccacgtgggccgagctcctggcctttggagttgcttcactccagacggtcccgctgtggtcccacagctcttcctcagctccatccccctcattctcttgttccccacagcacagcctgattcaggcctcagagctggtcttgacccggcttcgacatcaagtggagcagaggagacgtcggctacaggggttggaggacggggcaggtgcagggcctgctgagaatgcagcctcttaagcacccatgcacccactcttcccagacctggggcgactcatggcgtgctcacctccagccgctggtggggggtgtcctgaaggacaggatgctctccccagacctccccagggtggtgaagctgtgccctggggccccagctaacccactcctctctctgtacgtcaatgtccctatttgaaagcagggatgatcccattccaccctgtccactctggatgagaattggccacctgatggttatttatacgtccagaagaacatcatttcccagttgtctcgattctttttttcggcaagcatttggtgagcacctgctgtatgcctggctctgtgttggatgctggattcacccagaggaattgagggagagggatttgggggagagggaatccaaggctagacccagatacaggccggaggttagatcccagggtagaacccaagagaaagaaatggggtgacaccttagcagaaaggctaaaagttaaaccactgtggaacagattacgtaaaatggaagggaaagagctgaggttagaccctagtggagagagctgacatgagaccccagtggaaagatctagatctaagggtagatccca

SEQ ID NO: 11607 - DNA, 1553 bp, Homo sapiens
cgcccaccaccacgcctggctaattttttgtatttttagtagagacggggtttcactgttagccaggatggtctcaatctcctgacctcgtgatccgcccgcctcagcctcccaaagtgctggtattacaggcgtgagctactgcgcccagccatggacctttttttttttttaaagctacaatatctttctcccccaagggaaatgatgtgcccagcatagtcaagacagacaagagggagctcccatggctgagttggggcctcaagccctccctctactcctcctcagagaccaggggtgacagagacagatcttgaaaaccttgggacaagtgcccttgggctgcagggttgggaacggggggagcatggccagcctatcacctggtgtgccctcaggtgaaggaatacgactccatctcccggctggaccagtggctcaccaccatgctgctgcgcatcaagaagaccatccagggcgatgaggaggacctgcgctaagccccacccagccccccagtgcccgtcttcctgtcccatctgctcagagagaggtggggccgagacttgctggagagcttccctcctttcccatctggggagtgccgcgggccacagtgggcaggtggcaccgggggtcagcatgcaggggcgccagaggcccaggctgctggccggacagtcaccctctgttctcgctacatcccttgccccctgtccatttatttaagcccccataggtgcccttcacccccaaaaccagctgtacagaatctttgatacagacctatttgctaggggtgctgccggggatttggggtcagcatctggccccctatctcctgaccagctgagtcatgaggccggtttctctctctctcccacttttgtcccccagccaagctctaaagcacatgtagccgctgagacctgctgtttctgctgggggcaggctcctcttcccccagccccgggagcctcccccagcttcctgcagccccgacctctcaggttagaccctgggccctggagcttaggggattctccccaccccagccccacacctgctccttccctaatgctttgaggttttcttggttggaagctgcagctggcccaagaaagaaaataaaaaacaacacttttgcatgagtctctcttcctcctcacctctgctacccactctgcccctgggccagtcaccagtccctctcacactcctggtcccccagactctgggcgagctcttgggaggtcaggcgcatgcatccttgaaacacgtgtgggctgggtcagtttctaggtgggggagacccagggacggtgggcctggggaggagctctggcttgggagtcccagagcgcccatcttgatctttctctgggttcttggggtccaggggccttgatttcctcaactgggatgcacggtggtgatgccacccctcagagccagtgggagggtcgaatgtgacggtcctcatgactgctttggatgagaatgggtggaagcccaccgaatctcccatgtccacatttctctggcaggaa

SEQ ID NO: 11608 - DNA, 1184 bp, Homo sapiens
tttccaagtgaagaaaccggcgagaccagccgcgggggcgggactaagttctgcgcagaactgtcaaacccgggcgtgggccccgagctgtcacgtgagtgtctgcggtcagctgactgtgccagagttccgcggggagggcgagtgggggaccccccgccccagcgcgagccgagggctcctgctgattggtggaggaggatccagcagcaacaccgtggggcggggcctcggcggggggtactgccattgccttccacagggtcacgtgggaggtgaggtacagagcgctggggagagagtggagcgccgttcgccggtatgtgcgcatgcgttgaggtctcttgacgccgattggggggtcacgagtcacgggcggcgtgcggcggctggtgggggcgtgtccggcggagcgggcgcggcgttacgaggccgctggttggccagcgctagtcacgtggttcctggccgcaagcgacgcgcgccggtgcgacgtcaacgcagccgggcgagttttaccgatctgtgttccgcggcccggccgcggctgagtcttcccagggtcagggtcaggcgctttgctgagtccctttgtggccgccatggacaattccgggaaggaagcggaggcgatggcgctgttggccgaggcggagcgcaaagtgaagaactcgcagtccttcttctctggcctctttgggtgagaaccgggctgaggggtcggccgggacctaggctgagaggacgaaggagtcacgctcggaggtggcgggttagggcacgcagagctcgggccgaggggacggagaggaacctgcaataaggtgacatggcctgaggcggcagaggggacgcaggctgagggccaagagcctgggccggggcaacacggtttgaggagagacggtctgacatggcggaagggatttgggctgaggacacacggaccgaggcgacactatcttgaggcgaggaaggggacccaggccgaagacaggccagcgggcgggggagaacctggaccgagggagtacgtcctgaagccttggaggggaccggcctggggggacggagggagtccgggagagaagccaggtccagaggcttttcggagctctaggggagtctgtttgaaggctctcaggcggcagtgatggggcctggggctgaggacgcctgcccga

SEQ ID NO: 11609 - DNA, 1211 bp, Homo sapiens
cgaggctggagtgtagtgaagtgctcgtagctccactctgcagcctcaaactcctgggctccagtgatcctctcacctcagcctcccaagtagctaagaccacaggcacatgctgccacccctgactaatttttcttttttaaaatttttttctcactgcgttgcccaggctggtctcaaactctttggctcaagccatccatcctcctacctcagcctcccaaagtgctgagattacaagcgtgaaccaccatgccaggagggaatgttctttcttgaacgtggctgccctgtcacctcagcattctttgcggcagctgtggcctaagcgtagccccttgctaacctcagctctttccttcccacctttcccggcctgcagctccatgtgcaagaagcttccggcaaccacctgaacccagagcccaaccagccggcccccagtgtggacctagacttcctggaagatgacatcctgggctctcctgcgacagggggcggcggcgggggcagtgggggcgctgaccagccctgtgacatcctccagcagagcctccaagaggccaacatcacggagcagacgctggaggccgaggctgagctggacctgggtcccttccagctgcccaccctgcagcctgcggatggcggggcaggcccgacgggcgctggaggggcagcggccgtggctgcggggccccaagccctcttcccaggcagcaccgacctgctggggctgcagggcccgcctaccgtgctgacccaccaggccctggtgccgccccaggacgtggtcaacaaggccctgagtgtgcagcccttcctgcagcctgtgggcctgggcaatgtgacactgcagcccatcccgggcctccaaggcctgcccaatggcagccctgggggtgccacggcggccacactgggcctggcgcccatccaggtggtgggccagcccgtcatggcgctcaacacgcccacctcccagctcctggccaagcaggtgcccgtcagcggctacctggcctcggcggctggcccctcggagcccgtgacgctggcgtcggccggtgtctcgccacagggggctggcctggtcatccagaagaacctctcggccgctgtggccaccacgctcaatgggaactctgtgttcggaggcgcgggggccgcctcggctcccaccgggacgccctcgggacagccgctggcgg

SEQ ID NO: 11610 - DNA, 1199 bp, Homo sapiens
caacaggcagcatttcttgagcacttactgtgcccgggtactgttccaagcactttgtcaacttgtttaatccttatgacaacccatcgttcggccccgtcatgtggatcaggaaacagtccagagtggaggagggaggagactgagcagggggtcgctggggctggaccgcaggagtctccatcccgcttccgcaggtggatagtgacaagggcatctcccttcgcttccctcggtttattcgagtccgtgaagacaagcagccggagcaggccaccaccagtgctcaggtgaggtcctgggaagcaggggtgggccgcccagctgcttggccctaccagctttttagcgtggtggcctctctggaaccttgtggaggtgggagcagccagggagcttctgaccaccccgtcccaccctctctccgcaggtggcctgtttgtaccggaagcaaagtcagattcagaaccaacaaggcgaggactcaggctctgaccctgaagatacctactaagccctcgccctcctagggcctgggtacagggcatgagttggacggaccccagggttattattgcctttgctttttagcaaatctgctgtggcaggctgtggattttgagagtcaggggaggggtgtgtgtgtgagggggtggcttactccggagtctgggattcatcccgtcatttctttcaataaataattattggatagctactttgtgacagggtctgtgctgggctctgggggcaaagctgtcatgggtgtcacctgcatagcatgtagccatgtagccatggcctaggaactgccagagccagtgccagccatggaactgcctgcagtggtgggcgtcttctctatctgctctgtgcagtgtgaccgccactggccacctgcaatgcccgagcccttgacaggtggccagcatgacagaggatgcgaatttgttttgttttgttttgttttgattttgttttgagacagagtctcgctctgttgcccaggctggagtgcgatgatgagatctcagctcactgcaacctccaccttccgggttcaagtgattctcttgcctcagcctcccatgtagctgggattacaggaatgtgacaccacgcctggctaatttttgtatttttagtagagatggggtttcgccatgttggccaggctgatcttgaactcttggcctcaa

SEQ ID NO: 11611 - DNA, 1186 bp, Homo sapiens
gatgaggctggatgcagtggctcacgcctgtaatcccaacactttgggaggctgaggtgggtggatctcttgtgatgtgcacctgtagtcccagctactcgggaggccgacgcaagacagtcgcttgaattcaggaggcggaggctgcagtcagccaagatcgcaccaccgcactccagcctgggcgacagagcgagattccgtctcaaaaaaacaaaaacaaaaaacaaaactgatgagatgcccgtaaagtgttaattcaagctccagcaaggccgcagccccccgtctgatgctcctgaagtcaccgactctaaatggtgtcgggccctcttgccagtgactagccccatgctttaagctctcagaatccttctgacatcagggttcttccctctcaaggctttccacgaaccctgtcactagttgtgacccgcacatgtcctgttcgcctcacatttagggcttattgtctttattctcacaaagatgtctcatctctcttctccctgccggccctgcagtccctggtacgtgagcccctttcccggcgccggcagctgctccgggagaactttgtggagacagagggcgagtttgtcttcgccacctccctggacaccaaggacatcgagcagatcgccgagttcctggagcagtcagtgaaaggtgagggtgctcacttttctctcctgaggtctgcagcttgcgctgaccccggcctcccagcctgtccccagtcctggaccgtttgaccagaatcctgcctgctccggcgcttgtgagccagggcttcccaaggaccacgcttctgtgtctccctcagactcctgcgaggggctgatggtgaagaccctggatgttgatgccacctacgagatcgccaagagatcgcacaactggctcaaggtgattctcgacccccaactgggccttctccaccccgggtctggaggtctgtcccagctaggcagtggatttcgagcctccactgtgtaccctgtctgagctcagggccccttttcacaatcccaccccagccccctgctgcaactgagttcagaccttctccctgctgcgagcccttgctcacgagttctgatggagaacagccccagcccaagcaccgcacatcccacgaggtgcagcgtgatgaggtgtctctctcctgagcctgccgcccgtg

SEQ ID NO: 11612 - DNA, 1280 bp, Homo sapiens
aacggaactcgggccctggcgcatctgcaggccctgacccccagcatgggattgtacccacccccgggtttccccaaactagacccagtggctccgatcacttccgagcccccgcaagccacgcccagcagtaacatctcctgagtagaacctacctccctgcccagtcagcaggctaggaactaagccccgcctccttcacgacaggctgtcaattacggttattatacttttcactccaacttccaataactgacaggtgattatttttgctgcactgtgtgcttaagcaaagcagccaatcaaagcagctagcagttgttaagtcttccccgccccttcgatgaacagccaatcaaagcgatttagctctgcttctgttccatttcttagtcccaccctcaccataaacatccaagtgtggtttggctgaggagctgagggtgtctgccaatcacagctgctcagctctggcttctgtaaaccgccaggtagaagagttaaagctgcgccctcccgagactatatatcattgtctttttcagcccgctccgggcaaactgcccatcatgtgcaccaaggccgttagccctgcctcctggcaaacgtccagtgacagctgctgggttccatcaactttgggcagccggttgtcgctgcagggaaggaaccaataagaatttctaaaggaaacctgatcttgctatcaattgctgctgcttaaatggcaggccaactggtcagctgctgatcagggtgtctaggctgaaggagttggagaccttgtgctaggtaggtgaaccagaaaccaccctcgccaccaagactcgctcccaacctggctcccggcaacctcaggtgccttcctcgcccaggtctttcaccctttctacagaaactacctcggtctggatctccccaccaccagcagcctgtgcaatatttattggtctatcaatttctcccgtctcctgtcccaaagtaataaatcatgtttaataagtctggatgaggctactcttaacgcactgcctttagggtaaccctgctctgtaggagtggttaaaaaattatttttaaaaatctagatgagtgggatggctgcaggagttggagggaaggaaagcatttgaatcctggaaagaggggagggactctagctaggtcttggggtcccagacagagaaagctgtagtcctaaaaagaggctgggttcatggtcggtgaaacaaagacagtcatagaagaggatcttagaaggatctgattccagaggagtc

SEQ ID NO: 11613 - DNA, 1251 bp, Homo sapiens
ctcaaaaaaagaaagaaagaaaattgccagtagtgagaaagggtaggaaggaaagaaaccaggaatgtatctgtgagtcctgggggacctccctccctgtggatctgcccatctagcgtgcctgccctgctctggctgtgggaggctgtcccctccctgcaggggccccagcggtaatgccctccctgttttctctcctcacagtcctaaaggggaagaagttgagtttgccggcatagccccggtcctctccatctctctcctcggcagcagcgggaggcagaggaaggcggcagaagatgaagagctttcccatccaggggtgacttttttaagaacccacctcttgtgctccccatcccgcctcctgccgggtttcagggggacagtggaggatccaggtcttggggagctcaggacttgggctgtttgtagttttttgccttttagacaagaaaaaaaaatctttccactctttagtttttgattctgatgactcgtttttcttctactctgtggccccaatttttataaagtgtttttgagtgtcctatgggccggggcagggtccaagatcttttcccttccccaggcccctcggctccctcccagatcccacccccagccccactggttgccaaacactaaatctgccgacacccatctgccccacctcctgccatggccatgaaccgcgacccccactaaatttctagattggggatagggagaaagggaggcccaggaaggtctcccctgattttttttcatagtaatttttttccccagagtttgaattttttggtcttctcctggttttttggcaaattaggggggcccggggctcaagtgcgggaagggggctggcccgaggatcccatggctctcacaccatgtttttgtacagaactgatggttgaatctttgttctcttgaaataaacagaagaaaatgaaacctttcttttgctgctccttgccactctgtccctggtgtgtatggggtcccgcccccgcccctctttctgcttctgcttttgccttattgactatctgtaggcgacgaggcctaggaggagcaggaagaggagaaactgggtctcccaagactctcagctgtgcagttcctcgccgtgctgctgggaagaggttttggagagaatcttgaagagtcttcttaccttggcacagaacttgtctgatggttctccaaaccctcagggttgcagaggaccttcaggagaattggctg

SEQ ID NO: 11614 - DNA, 1221 bp, Homo sapiens
ggggaggagctggtcatggacgaggaggcctatgtgctctaccaccgagcgcagactggtagggctgagtccggactccagggtcctgaggtggctgatcccgagcctttaacctgagaggtgctcgggaagagaaggctggggtctaagagaagtgatttcataccggaggcggttgatccatgagggaggtggggactgagctcttactgtcccgtcttaactcgtaaaccccgccttccatccccaggcgccccctgtctcagctttgacatagtccgggatcacctgggagacaaccggacagagcttcctcttacactttacttgtgtgctgggacccaggctgagagcgcccagagcaacaggtaagacccgaggcttttccaggaccaggaggctcagtttccagccccttcctcagcacccaggagttagggcttccagtttctgcctctcgcagatccaggagtctgggtttccagcctctctccttcctaagaatcctggaatctagtgcctaactcaccccacaatttctcccagactgatgatgcttcggatgcacaatctgcatgggacaaagcccccaccctcagagggcagtgatgaagaagaagaggaggaagatgaagaggatgaagaagagcggaaacctcagctggagctggccatggtgccccactatggtggcatcaaccgagttcgggtaagtatggtcccaggagcctgctctgcatactctgaaacacatctgacccatcccctgtgtccataactcccaacacctcctcatgttcttttttttttttttttttttgagacgtagtctcgctctgtcacccaggctggagtgcagtggcgcagcctcggctcactgcaacctctgcctcccaaagtgctgggattacaagcgtgagccaccgtgcctggcccattttttttttttttttttttgagatggagtctcgctctgttgtccaggctggagtgcagtggtgcgatcttggctcactgcaacctccccttcccaggttcaagggattctcctgcctcagcctcccaagtagctggggctataggcgcctgccaccaggcccttctaattttttgttttttggtttttttttgagatgaagtcttgctctgtcgcttagactggagggcaatggcatgatctcagctcactgcaacctctgcctcccaggttcaagcgattct

SEQ ID NO: 11615 - DNA, 1288 bp, Homo sapiens
tttatgagtcgcaccaaccggccgcctctgtccctttcccggatggtgagtggctggtccagagagcacggtagacctgggagccgctgggtcttgtctgtctggaagggaggcaggacttggagctctgggagcaaccagggcatcaagggtttgtctcagccagtcgcgagcgtagagcttggactgttggttggaactgagtgtccatgggcagtgggcaagtctcctggtcctcctctccttctctttgtgaggtggaggtgtcctggtggcttcaggagattgccccaagtcataactgagttttatgtcaaaggctctgctgagggaggccctattgaacagtctgcatttttttttttatctggagctttccccagctggacctgaggagaggcctgtggggtttaaggggtgtggtgtgagtggggggtcccgttagagggcacagctgccctggcctggggatgcctcaagcggggctgaatgtaaacaccagaacaacttacgacgtacatcctccccaccctaagatccggaagatgaagcttcctggccgggaaaacaagacggccgtggttgtggggaccataactgatgatgtgcgggttcaggaggtacccaaactgaaggtgagctggcgggggctgggcagacccatcagacccttgctgtactgtgctgtgctgtgctgtgctgtgctgtgctgtgctggtccatcctcagtcttgccaccgctggtgaggcaagcatcctgcctgtctgagtggctttgaggattggtgtgggtcgtctctggcatggttgatggtggggtcccctgggcaagcttcttctggggcaagttgtaaactgttagtgctggcccctagagccagacagcctgggctcaagtctagactcctttgtcacctctgcacaggtctttttttggcccagcttccttgctgtagtttctagcataacaccagggatgtggtggtgaaagttccggaagtgttgagaactgctgctgtcagcccagggtgctccgggtagtaaacgatagtgttggttaccagggctctgctgcgccaaggcagtggagggtgagtcctggcagcccctgggtgaccacgcaggggtctgacccgccagccttgtcctctccaccaggtatgtgcactgcgcgtgaccagccgggcccgcagccgcatcctcagggcagggggcaagatcctcactttcgaccagctggccctggactcccctaagggctgtggcactgtcctgctctccggtgagt

SEQ ID NO: 11616 - DNA, 1231 bp, Homo sapiens
ttccagatgccccgactagccctgccagccccgcctcctcacctccaacactgggcccgccgggtcctccgggagccactgagaggccgtcggcgtcgggccagagcgtcaccgcgcgacgcatcgtgctagctacacgcatctcgctcccagatccctttcttccggaaagctatcgagaacacggcctgggtagggccagagaggcccccgacgtgctggcccttccctcttggacgttgcgcttgttcctgcgctctatgctctctgccgttatcgcccggctagtcagtcgtccaactcaccacagagaagtccggatcgtggtagagcgccgcgtcgcacccatgtgacgtcacggcggcgccactcgcttgaggctttccccgcccaccccagcccgttctctctttccggacctggccgagcaggaggcgccatcatggtgagctcgctttgcggcgttcggggctggataatccgctgccatccgccgtggttttgggctaggggcacgctggagggcggcagggggtctgcggctgcccggagggagcaattcccgatactggggacctactctgggggccaggaaagcagggatgggtcagtcatagcctaccgcccccacttagtagatgaccaagtggaggtactcggaggctgatatgactgggtttacaaagccaggaagtggcagagccaggattccgacccaggtggctggacccgcagccactcttagttatttggctttgctgcctttatctggacctgtcactttctagtatgaaaagtcgggttcgatgggggccgcggcgggtgagaggatcgagagccgaataactggatttggggaccaggcaggtctctgagtctcaggccccttcccaccttgtgatggtttttgagcctttgccccagtgtctggctgttcgttgggtacacagtaatctcatctgacaagtttgtgaatttgggaagaaataattcacaggagatgctcatcacggggttttgcacacagtaagtgctgcataagtggagctattaaatagttcttgtaattgtcaacacagtctgaaaaacttaagttgctcagaaaggcagcagggcggtaggagcctggcgaggcggctcacgcttgttatcctagcactttgggaggccgaggcgggaggattccttgcccaggagatcaagaccagcctggccaatattgtgagaccct

SEQ ID NO: 11617 - DNA, 1108 bp, Homo sapiens
agtggccctagcaacgggtctagtggggtactaaagcctgggggccaccgttccaccgcgggagacccgtagttacctgtcctctgataacagaccccacatcagcccaaaatttcttcaccagggaccttacacatcccgtcctcggtcccctgagataccttgctatcctcttcccttcagatatcaacagtgatggtgtcctggatgagcaggagctggaggcactcttcaccaaggaggtgagcatcttggaagcctcgggcacctggagggacgcccaaatcagccacttgtttcctcctgcagtccccttaaatccccctggatgggagctcagtgaaaactacaactcccatcagcccctggggcaaaaacggctcccaggagtggtagcgtgcccaaaggactgctgggagttgaagttgtcgggaatgagctcgctggggacctctcaatgctgtctgcctctcgcttgctcctgcagctggagaaagtgtacgacccaaagaatgaggaggacgacatgcgggagatggaggaggagcgactgcgcatgcgggagcatgtgatgaagaatgtgaggtgggggccaggcgggggagaggacgggcccccagctctgtcactcacccttatctggctccccaggtggacaccaaccaggaccgcctcgtgaccctggaggagttcctcgcatccactcagaggaaggagtttggggacaccggggagggctgggaggtgagaacatgggggatactcggggtcctgaacctctctctcttctagccatgacctttctttcagaatcttaggccccttctctttctctctgggtccccgtccattctcctgggtcactgcatctctatctctgggtctctgttttcccctgtctctaggactcttatttatttatttatttatttatttatttatttatttattctgagacggagtctcactccatcgcccaggctgcagtgcagtggcacgatctcggctcactgcagcctccacctcccaggttcaagcaattctcctggctcatcctcttgagtagctgggattataggtgcgtgccaccacacccagctgatttttg

SEQ ID NO: 11618 - DNA, 1575 bp, Homo sapiens
gctggacccctgggtgtgagggaggaggggctgggcctctggggtcctgggggaggaggggttcggatgtcctgtgccaccattccctccctccatttccagacgatgtacctgtcccagctccagccggtgaccagaaggaggtggacacttcagaaaagaaacttctcgagcggctccctgaggttgaggtgccccagcatctgtgatcctccgggaccccagccctcaggattcctgatgctccaaggcgactgatgggcgctggatgaagtggcacagtcagcttccctgggggctggtgtcatgttgggctcctggggcgggggcacggcctggcatttcacgcattgctgccaccccaggtccacctgtctccactttcacagcctccaagtctgtggctcttcccttctgtcctccgaggggcttgccttctctcgtgtccagtgaggtgctcagtgatcggcttaacttagagaagcccgccccctccccttctccgtctgtcccaagagggtctgctctgagcctgcgttcctaggtggctcggcctcagctgcctgggttgtggccgccctagcatcctgtatgcccacagctactggaatccccgctgctgctccgggccaagcttctggttgattaatgagggcatggggtggtccctcaagaccttcccctaccttttgtggaaccagtgatgcctcaaagacagtgtcccctccacagctgggtgccaggggcaggggatcctcagtatagccggtgaaccctgataccaggagcctgggcctccctgaacccctggcttccagccatctcatcgccagcctcctcctggacctcttggcccccagccccttccccacacagccccagaagggtcccagagctgaccccactccaggacctaggcccagcccctcagcctcatctggagcccctgaagaccagtcccacccacctttctggcctcatctgacactgctccgcatcctgctgtgtgtcctgttccatgttccggttccatccaaatacactttctggaacaaatgcatggctccatgcctgtgtatctggactggtccctccaaaacgctattgccacgtcacctgccggagtcctcatctttgaagactggattcaagcatcacttctgagaggctcaatcctggtatttttccatctgcccctgatgagtctgcagccttcactcagggtcccttcagccacaaggacagaaaacccaaacctgggattaagcaattttttttttttttttttttgagatggagtcttactctgtcacccaggctggagggcagtggtgtaatctcagctcactgcaacctctgccttttgggatcaagcgattctcctgcctccgcctcccgagtagctgggattacagctgcctgccaccacgcccggccttctaatttttgcattgttttagtagtgatgggggtttcaccatattggccaggctggtcttgaactcctgacatcatgatctgcccaccttagcctcccaaagtgctgggattacaggagtgagccactgcacctgg

SEQ ID NO: 11619 - DNA, 2019 bp, Homo sapiens
cagaatcttactttcccgaggcaccccaggaccccagggtcatcagttcacagggctgttagtgctcccataaaactctagcctcccagagggaccccagcccccaccctcccgcccacgaacccctgcatttccagaatcagccccagggccccaacccccccaagcccccatttcacaacacgctggcgctacaggcgcgtgacttccccttgctttggggcggggggctgagactcctatgtgctccggattggtcaggcacggccttcggccccgcctcctgccaccgcagattggccgctagccctccccgagcgccctgcctccgagggccggcgcaccataaaagaagccgccctagccacgtcccctcgcagttcggcggtcccgcgggtctgtctcttgcttcaacagtgtttggacggaacagatccggggactctcttccagcctccgaccgccctccgatttcctctccgcttgcaacctccgggaccatcttctcggccatctcctgcttctgggacctgccagcaccgtttttgtggttagctccttcttgccaaccaaccatgagctcccagattcgtcagaattattccaccgacgtggaggcagccgtcaacagcctggtcaatttgtacctgcaggcctcctacacctacctctctctggtgagtccccaggacgcccctggccctaatttcctccagctgcgcacctccggccctcactgcacgcgccagccttctttgtgcggtcgggtaaacagagggcggagtccccttggcctcgcctcccgctaaccattgttgcctccatctcttcccgtagggcttctatttcgaccgcgatgatgtggctctggaaggcgtgagccacttcttccgcgaattggccgaggagaagcgcgagggctacgagcgtctcctgaagatgcaaaaccagcgtggcggccgcgctctcttccaggacatcaaggtaactagtgtgtgggtaatggactacatctcccagcaggccgtgcgcgcgaggagccttgatttgagggcgtaggtgtcgcgtgggcttctgggagattgagttcggtcttgtgagccctcttaaccgctggaaatagaggcgcacctcgtgcagtgcccacaacacgcggcagtccacaccgctgcgtggtcttagggacgtatagctgtaagagctaggacagggtgcggagagtgataaatacaagctgtcacatgtctttgtggcctgggcctctgacccccaacgactcttgggaaatgtaggtttagttctatgtgccgagtgtgtgtattctgagccatttctcccttctatatagaagccagctgaagatgagtggggtaaaaccccagacgccatgaaagctgccatggccctggagaaaaagctgaaccaggcccttttggatcttcatgccctgggttctgcccgcacggacccccatgtacgtacccgctgcatccatggctacccaaccatacccctcaagcctctgctccctttgggcaaatttccttcagagcctcatttcacacctgtcacattttaatctgcaactggctgctctctccccctcttttccagggattgggtttctaatttctccctcttctctctcagctctgtgacttcctggagactcacttcctagatgaggaagtgaagcttatcaagaagatgggtgaccacctgaccaacctccacaggctgggtggcccggaggctgggctgggcgagtatctcttcgaaaggctcactctcaagcacgactaagagccttctgagcccagcgacttctgaagggccccttgcaaagtaatagggcttctgcctaagcctctccctccagccaataggcagctttcttaactatcctaacaagccttggaccaaatggaaataaagctttttgatgcagctggtggttttgtgtgtggtgtggaagatgaggtgggatctgttctcataaagcttctggctgggttggga

SEQ ID NO: 11620 - DNA, 1116 bp, Homo sapiens
gctacgatgaggacgaggaggccgccaaggaccggcgcaacatccgtgcaccagagtggccgcgccgagcgtcctgcacctcctccaccagcggcagcaagcgcaactctgtggacacggccacctccagctcactcagcaccccgagcgagcccctcagccccaccagctccctgggcgaggagcgtaactaagtccgccccaccacactccccgcctgtcctgcctctctgctccagagagaggatgcagaggggtgctgctcctaaacccccgctccagatctgcactgggtgtggccccgcagtgcccccacccagtccgccaaacactccaccccctccagctccagtttccaagttcctgcactccagaatccacaaagccgtgcctttctctggctccagaatatgcataatcagcgccctggagtcccctgggcctggaccgcttcccagaggccaggaatctgccattactctgcggtggtgccagaggttttaggaaacctggcatggtgctttcaggtctggggcttttagagccccccgtgtggcttacaaattctacagcatacagagcaggccacgctcaggcccggcatgcgggccaccaagttctggaaaccacgtggtgtccctgcgaatggggcgatcaagtccagagccggggcactttcagagtttgaaggtaactgagagcagatggtcctccatttcaactccagaagtggggctctgggagggatgttctagccctccctggcatgtcagagccaggctctgcctggaggatccctccatccggctcctgtcatcccctacactttggccaagcaagaggtggtagaaccacttggctgctcattccttctggaggacacacagtctcagtccagatgccttcctgtctttctggccctttctggaccagatcctactcttcctttctaaatctgagatctccctccagggaatccgcctgcagaggacagagctggctgtcttcccccacccctaacctggcttattcccaactgctctgcccactgtgaaaccactaggttctaggtcctggcttctagatctggaaccttaccacgttactgcatactga

SEQ ID NO: 11621 - DNA, 1213 bp, Homo sapiens
aggttgtactagtgggaatccacaactcctggtgatcacttgggtttgttgccccacgtccggtgcatttgtggtctccttggctcccccagggtccgcatggctcatgaggaagtagggagttctctgtcccttccatgaccccttacccttcttgtggctcctgcagcggcagtctttcccccctgtgtgcacccacaatatgctggatgactcctcagaccccatcctgaccaccatccgccgaatcggcctcttcaatagcagtgccgacagggtgaaggtgagggcatttggtcagggctgggttgggcacggcagagggaaggggttgggtcctgggcctcacacactccattcccctataagttttatcaaaggtattgctgtggttagaaagaaccctggcttctgaggcaggcagacctgggtttgaacattggtcctgccaaacacatgctgtgtgatgctagacaagctttttaccctctctgggccaccttgggatctcagggcttagctaaataaggcacttgggctgagtccttctttttcactaccaggtgattttccacccggagttcctctcctccacaagccccctgctccctgtggactatgaggagtttgtccgtggctgtcaccttggagtcttcccctcctactatgagccttggggctacacaccgggtgagtgtagtgggcaggggacagcgtggtcatggcatcctagtcagagctagcatgtcttggggcgaggcactggccttctctgagcctgttgccttctttgcaaaacaggaacaatggtaatcacctgttctgctacagcgcgtgcttttgtgatacaatagctcatgtattgagaaactagaagactgggttttgaggactagtgaactggatgtcacagttcacactgctttctcccagaaagcagtggccccccaaatagtggcaatgaaatgcacaattcacaaatacagccgagtgtggccaagtctcctcgtaagacgttcccagtgcccatcaactccaccttcctcttgttggttcacattagccagtgtttttaaagctaaataaggctgggcgtggtggctcatgcctgtaatcccagcacttggggaggccaagatgggcagatcatgaggtcaggagtttgagaccagcctggccaatatagtgaaaccctgtctctactaaaaataca

SEQ ID NO: 11622 - DNA, 1050 bp, Homo sapiens
gctcacacctgtaatcccagcactttgggaggctgaggagggcagatcacttgaggtcaggagttcgagatcagcctggtcaacgtggtgaaatcccatcggtactaaaaatataaaaattagccagatgtggtggcgcacgcttgtaattgcagctactcaggaggctgaggcaggagaatttcttgaacctagaaagtggccgagattgcgccatcctgggcgacagagcaagactctgtctcaaaaaaaaaaaaaaaaaaaaaaaaaaaaaaaaaaaaaaaaagaaaagaaaaaagaaaaagagacaaagaaagaaaaataaatgaggccagagctatgggaggattttaagtggaggagtgaccgtggggctgttgtgtgacactgctagctttacttgtgtgcctaagtggtcctttctcagaatcttactttcttttcgtataaaatggggcttagcattgccatctgcaggacaagtacaagtcctaataatagctgacatttctggaaggcttgccatgtgtactttttggcatgacatcattgggtcctcatcgcaaacctctgaggttgattctattttcatcctcctctgaaaaatgagtcactgcagtcagagagggaaggccacctgtccctgaccacacagctgatgtcaggcacgtgggtcctaagccttccagggcctgccccctgggtccccatcctccagcctggaggccccagggcacggcttccctgctcacacctcagtttccttgctatcctagaaacctaagggtagctgggcgcggcagctcatgcctgtaattccagcactttgggaggccgaggtggccaattaccagccagaggtcaggagttcgagaccagcctggccaacgtggtgaaaccccgtctctactaaagttacaaaaattagccgggcatggtggcaggtgcctgtaatcccggctactcaggaggctgaggcaggagaattgcttgaacctgagaggcagaggttgcagtgagccaagatcgcaccactgcgctccagcctgg

SEQ ID NO: 11623 - DNA, 1233 bp, Homo sapiens
agccgggcgtggtggcgggccgctgtagtcccagctactcgggaggctgaggcaggagaatggtgtgaacccaggaggcagaggttgcagtgagccgagatcatgccacggcactccagcctgggcaacagagccagactccgtctcaagaaaaaaaaaaaattagccaggtgtgggagcgggtgcctgtaatcccagctacttgggaggctgaggcaggagaattgcttgaacccgggagacagaggttgcagtgagctgagatcgcaccactgcactccagcctgggccacagagtgagactccatctcaaaaaaaagaaagaaagaaagtaagcagggggcacggaaaatattgcaacagagatggaaaaaatgtgtagcaggaataaatcatgcaaatagagaagtaaggctaaggcagcaggtgagaaattagcagcagatatggaaacagaagataagagagctgaggcttaagtctatagacatctgcctgcaaatgggagaaccacggatgagtgaagatatgaggctgaagcccagagcctccctatggtgcctccccaaccccatcccaggtgtatttcgggcgctggctgatcgagggaggccctctggtggtgctcctggacgtgggtgcctcagcttgggccctggagcgctggaagggagagctctgggatacctgcaacatcggagtgccgtggtacgaccgcgaggccaacgacgctgtcctctttggctttctgaccacctggttcctgggtgaggtaggccccgtctgacacattccacccatacctgaaactacaatgaccatcagcccctgggccagaggatgggcttctccctgggcattctgggagtcatagggtcctttaatccaaggattagctctggcctttgaggacatgaacatccaagggcccaggctctactctcgatgccaacttcatttactctagtcttccaagcatagggattcttggaatcagcctcaaagtgaggctggcgggcttgcccgaggaattctaggagttgtagttctctagtgtgatattgctggactcagctctcagatgctgccctggatgctcatgaatccccagcctgacctggttttgacccccttctaggttttaagaggctcaagaagcttagtttccaggctgggcacggtggctcatgcctgtaatcccagcactttgggaggccgatgggggaagatcac

SEQ ID NO: 11624 - DNA, 1262 bp, Homo sapiens
aatttgagctttctaggtcacattgggttaagtttgtatgaccaaatgaatcttgtagggttctgttgggcttaactgtgtagaggtgtgtggctggacatttttcgtggccacagcgagttgagttgtgttgaattgtacaaccatatgagccttgtaaggccagttcagttgggtcatgccactgtttgagtctcatagggccatgctgaattgagttccattgagttgtgtcactatgtgagtcctacaggaagttgggttgagttggactgtgcgaacgagttccatagggccacatcgggctgttttgcatttagtggtagcaccaggacccaaaggaaatagcagtggggaagcatcatgtatctgggagcatgcagtggcgagggctctgggaggtgtgccgagctggctccccagctcgctgtagggggcgggactggattctgtatccatgggattgggtgttcatccagaggcgactgggtaaattaggaagaggtggatgctcctcctgtttaccccacatccacttcattgtgctgttcactcccattctcccctacagttttatgctcagacatggaggtcagagccacaagggaaaggggagagggggagaaaactgtactctgtccagacatgatagagggacagagccaaaaggatagagaaagagacccagaaaaaggaagaggtggaaacccagagagacagagacccaaagggagagaaacagagactcagggagagggagacaatgacctggagggtggggtatggcagagacgcagaagagaggaacagaaatccagagtggggagacagagaccaagagcaggggatagaagccgggcgaagtggcccatgcctgtaatctcagcactctgggagaccgaggaagggggattgattgaggccaggagttcaagaccagcctgggcaacatggtgagaccccatctctacaaaaaatacaaaaattagctgagtgtggtggcacatgcctgtgatcccagctactcaggaagctgaggcagaaagatcccttgaccctgagaggtagaggctgcattgagccatgattgcaccactgcactccagcctgggcaacagagggagcccccgtctcaacaaacaaacaaaaagagccagtgggggagggagggacagagacccagagggcagcgtcagacacccagagttggagacagaacaacagagtctcagggaaagagaaccacaatagaaaaaggcaga

SEQ ID NO: 11625 - DNA, 1186 bp, Homo sapiens
gcaggggccccgccaggccccctgggagtgtataacccgcctctctgctccctgccatttcctgaagatttctcccacccccttctggttcattttctgttctgatgtctgttccccccacactcacccccctccaaaaaaaacaaaaacagaaaaaaccggtgtggtctggggtgcggagcgtcccagctgggcctcctgccccggcttggtgtctcagggtgcatgcttggggttgtggaggagccccctcccccacagcagagtccagcgtggagttaaccttcagtttctttgcagcgattttggccgccctggcgggagggggctgttccatcatgtgggagaggaagggccggggagcctagggggtggcgggtgagggtggacgtctcccccgaccaggagtggttggggcgctgagaggaagcagacgctgagatggagcaggcccttcaccggtttgggagagggttggtctggctgtcagttgcctggctgtctgttgggcgtgtgcgtgtgcgtgatgatggggacacggggcggggattctgtagagctgggcctgtcctgactagaggaccctctggggactcctctcccctccccctccccacatctgttacagccgcttacaaacacgcagatggcaagaagattgatggcaggagggtccttgtggacgtggagaggggccgaaccgtgaagggctggaggccccggcggctaggtgagcacatcctgccttcgacgggctctcgggggccctgggcctggtggccttgttctcccttctctgctgctttctgcttctctgtctcctgccggcccacctctcccatcgcgtcctcatctccggcttctctctcttgtggccatcacatttctgacagctgcctgcctcctcgttctgggttactgtgaggagcaggggcaccagcctggagaggcctgagcccacatgctggcgtccgcccttgctagctgggggtccccttttcctgcctcattgtactcctcttagtggaaataaccccgagttcactgagctcagtgtactgggcgcccagcttggcagtgacgcatgctggggttgtaaatgtcactcgctcatctgcttctgctgcttgctgttgctcttgttcactcttttactgattcagcaagtacctattggatcaccagc

SEQ ID NO: 11626 - DNA, 1309 bp, Homo sapiens
gatgacacctcccgctacgatgagaggtaagattgggcgaccggtgtcctggggtggggggcggtcacggggggagcccagccacacaggtctgcccacctcatccaggcccggcccctccccgcttccgcacagggaccgggaccgggaccgtgagcgggagcgcagagagcggagccgggagcgagacaaggagcgagaacggcgacgctcccgctcccgggaccggcggaggcgctcacggagtcgcgacaaggaggagcggaggcgctccagggagcggagcaaggacaaggaccgggaccggaagcggcgaagcagccggagtcgggagcgggcccggcgggagcgggagcgcaaggaggagctgcgtggcggcggtggcgacatggcggagccctccgaggcgggtgacgcgccccctgatgatgggcctccaggggagctcgggcctgacggccctgacggtccagaggaaaagggccgggatcgtgaccgggagcgacggcggagccaccggagcgagcgcgagcggcgccgggaccgggatcgtgaccgtgaccgtgaccgcgagcacaaacggggggagcggggcagtgagcggggcagggatgaggcccgaggtgggggcggtggccaggacaacgggctggagggtctgggcaacgacagccgagacatgtacatggagtctgagggcggcgacggctacctggctccggagaatgggtatttgatggaggctgcgccggagtgaagaggtcgtcctctccatctgctgtgtttggacgcgttcctgcccagccccttgctgtcatcccctcccccaaccttggccacttgagtttgtcctccaagggtaggtgtctcatttgttctggccccttggatttaaaaataaaattaatttcctgttgatagtgggcacctcggtttcttcctcactgctctgttttccccagaaggttgttcctgacttgatagccctgcttggtttggtttccagggtgtacttaaaacttgagcgttaggacatgaggctggctctgcccagtagccagagctgttgaaagtggggtgaggcggcctctcgggctccttgtctcccttgtgtttttcacccttttttctttttcatctctgccacacattcctcagggctgaccatacccctgtcttggtggggggctgggaattaggagggggcttgattactcaggggaagccgcagttttgaatatgcaagggaagctaccatctgcaagggagagcggcacacagggtgaggaaaggcagaatacactgggca

SEQ ID NO: 11627 - DNA, 1122 bp, Homo sapiens
ggggtctgcaggaagggcagggcctaaagaaaaggctgggctggctctggaatacagatgtctagggaggggccaggcttggaaaaggtgaagcgagggtgcactagtaaggagactagagtgccctggtgactaggggagcgggtagatgcctgaagacggtgagggttggcctgaaaagaacgctgggcctgggcttgagagtcccagaaagaatccctttaacttttccctacaccccccagggctgcgcgcagggcctccagaagtggctgcacaacaaccttatttccatagtgggcatttgcctgggcgtcggcctactcgaggtgatctggccccgcccccacccgcgatcggccctaaatccctagatggccctgcccttcatttcgcgtccttcggttgcctgggaaggacgagctcagggcggagcgcagcccaccccggccctcccgccgctccacccagcaccggagggtgggggcggcccagcttcagggagccctgattgggtgtacgcagggaaagcctcctgctattggctgcgatctccctcccctttctccgcagatgactgtcatggtgctgagcgtacagctacagcgcagggcactccgccggaaatgcgagccgcacgtgccgggcgctggggattcgagccccgggcccagcctgatcgctgacggcggcggcgggcacagcggcagtctgtggggtggctggggcatggcgggtgcctgccccaactggggagacaaggcaccgcagggcaagctgcccatggccctggggctctggccgctgtgggttcaagacgaggaccagcctgacactggaagtgcgggcgcagaattagaggaggcacaattagaggctgaggcagagggggaagacagatgagcctccaaaataaaggaccctgggcttgcttccgaccttactccttctcagcctctacccccacttgtagcagctattcccgcctcatcagccagccctgcggcagttcccgtcgagccccgcccttttctacctatccccttctccagccccttcccgcccaattcacggccccacccctgacctttctcgcccgggtgggcatcacccccgtctcgc

SEQ ID NO: 11628 - DNA, 1539 bp, Homo sapiens
cccgattaaccctgagatgtgatacaccataactgccaacgctcagctgaggggtaacccccattgcccagggaactgacttttgggcatccctttctcctggggaacatgatatggtggcggcctgtttcctggagatggaaaagagcctgctgggtattccatgatagcttggcaggggggcacaggggtccctgccctcccttctaagcataagtcccttgtcctggccttcctggcaggtggtgacaaacagagacacccaggaactgctgctctgcaccgcctatgtcttcgaggtctccaccagcgagcgtggggcccagcatcacatttaccgcctggtcagggactgaagggggaccccaaaactggctcaccccccagaacaccctcctcccagggagggtcctccagctcacctcatgcttcttatttggggagagggctgtgatgtaaaggggttgacctcagaggcctaagcaactggggccatcccccccattagaggggcccccaaaacttggttggagagctgaacaggctgggactgaggaaaggataaaccccgatattgggacctcacagtgggtgtctgaaaggacagatcactccggagtatcagggattgtggggacaggagtgagacaaccccccaggtacagcactggcttttcttttcagcccctgacaggccacccccactcctctgcatgtcttggagagcgctagttacacattggcttgtcccctttactttttcccagccacccctccccctgaaatttctgcccctctctaccaccctcactccatgacctgtgagatcacaaagtgaagatgaaccctttctgtgcaggagcagagccaggtgggccctggacattttttttttttttaatataacgagatatttataagtgggtgctagggtcttgactttatctccgctgcacaagcagtgtgttgaactttctaatctcatccctctcctaagtgagccctgagctagacggtttccttcctcccctctcaaagtttgtttgtttgtgttctgacagaggataaagctattttaccaaaaacgcaggggatttatttgaggtttgggtgaaaaataatcttgtgggtggtggtaggccgacagatggggacaggaagctgtggacgaaagccccaggtcccgtgggagaggtgacagcagcaggggcacgcagccacgtgggtccccaggggaatgtgaaggcggagggctccaggcgaactggggattaaacaaatatttacaggcagcagggaagtgcccagcgcacgtgacgggggcggggcgggactttggggagggcggggcctaacggtatcgagcgagccggttgtagacgtggtccaggtttctgcacaggaatatcgagagcgtcatgaacccgagctatagagaaaggagatgaggtcagagaagtcgaaggggtgctggcgagacgggggtgatgcccacccgggcgagaaaggtcaggggtggggccgtgaattgggcgggaa

SEQ ID NO: 11629 - DNA, 1179 bp, Homo sapiens
gggctgacaggtaatgtgtagtatagagacttagagtcactgagattgagaagggtcttatggatatggagaggttcttagggcaagaaggttcagaagtcacacttacagttgctggagacttggggaagtctcaagtttagaagtcagagtttgaagacgtcatggaggggtctttggagggtatctgagggctgggaggttagaggagtccagaggtctttgggggttcagagaatcactttgaggggcttgtgatttgcaggctcagagatcctgattcggatctccgagggttcaggcccagtctccagtcactgtgggtggggtgatgaaaggaaggtggcagtgagagtgagtgtggtggcatcttagaggcacagggtggagctcaattcctggggtgacccgtgggtctctcagccaccattttcccaactcccttccccttggttcagacggaacgggcccagctggaggacggcagatttgtgtaccgcctgctgcgctcgcccatgtgcgagtacctggtgaatttcttgcacaagttgcggcagctgcctgagcgatacatgatgaacagcgtcctggaaaacttcaccatcctccaggtgatgcctggggctgggctggagtggggccccccagtgtggagggacagtacctataacagaccctcagtctaggggatctcctcacccaggaactgacacagcagggactccaaagtgagccctcagcctgaggctcttttaactaggaaactgatgcagcggggaccccaccattgacccttagtttaggggacccttcacccagggtggggatgtcacagcactctctctctttttttttttgagatggagtctcgctctgtcgcccaggctggagtgcagtggcaagatctcggctcactgcaacctctgcctcccgggttcaagtgattctcctgcctcagcctcccgagtagctgggattacaggcacgccccaccacgcctggctaatttttgtatttttagtagagatggggtttcaccatgttggccaggttggtcttgatctccgacctcaagtgatccacctgcctaggcctcccaaagtgctgggattacaggtgtgagccaccacgcccagccccacagcactcgcacataaggtgggtccctccttccctggt

SEQ ID NO: 11630 - DNA, 1148 bp, Homo sapiens
cccattcattcactcttccatccattgaccatttatgagcacctgttctatataggaccaggcctagggggtgtgagctttgccctggggctgctggggagctatgggagggccatgaccaggggagggtcaggggcaggtctggagccacatgagggatgaactggagaggcgaggttggaggctggggtgagggtgggaggcctgaggtgaggctgaggcagtgaggatggagttgggggagttgtggcagggagttggggactgtaggactgcagggctgcaggggactgggtgcagaagcaggagtggggacgatgggtggcagtcaggcccagtgctgggtggactgtgtggaacagctggccagagctgtggggatggtgacggcatttggtgggctcaggcagcacaggctggagatccagctcacctccgacttctcacccacggccaaccctcctcagtaccagaggcacctgttcgtgcacatcagccagcactgccccagccccggagcgccgccgctcgagagtgtggacgtccggcagatctacgacaaattccctgagaaaaagggtggcctccgagagctatatgatcgtggccccccccatgccttcttcctggtcaagttctgggtgagttctcacagcaaaatcaaaagtgctcacaaatcctgtggtgtcccagcaaaggcctctggccctgagagaatctgtcgcgggccctaccaggtcagcctgggacttaccagtcagtcctcatggcttggagtgtcagccccctttgcaacaaggaacaccgaggaggccagcccccagggtgggttggaggtgtctgggcctccctggatcccactagacattgccacatgtaactaatacggtgagttacctggccatgtagctaatagggtcctgggcatgggcttgccatgttccaggcttccctgtgccccacctgactgcaccaagccgtgctgctaaggaaagacccctccccgtagccagtggacttgtggagactggtttctaaagaggggactgatgctttgcatcagtttcaccagaccttgttgctagagaatgtctggctttgaggaagtgatgaaaagagccatggagtggctttgccaagtcctgtat

SEQ ID NO: 11631 - DNA, 1654 bp, Homo sapiens
aagaagtaattatgtattaggctagtttttcatttaaacaggaacttagctctggcaagtactgcgctgtgtctggagggtgactgcataggcagtggtgggaccctcaggcggctcggccctgctaagcctttccctccctctaggccggaaggtggtggtcgtacgctgtgaaggcatcaacatttctggcaatttctacagaaacaagtgtaagttaggacctgggaggagcactggagagggtctccctgtggggtgttgaggctctgaaagcaattgcagccgtgttgggagaggctacttggggtttctgagaaggcccttggaagtggggttttgggggtgctggtagactgggcaggcctcacactctcccctctccctagtgaagtacctggctttcctccgcaagcggatgaacaccaacccttcccgaggcccctaccacttccgggcccccagccgcatcttctggcggaccgtgcgaggtgagcagagcgtggggactgcaggtggtgacgggcaggcggccggtgatgagaacttctcccactcacattcgagtttcccgaccatgagatgactccacatgcactaccatctgaggccaccccatgggcccacctcagtggggtgggtgggcatccttatgaggccctctgactgggcctgctatctgtcacccaacaggtatgctgccccacaaaaccaagcgaggccaggccgctctggaccgtctcaaggtgtttgacggcatcccaccgccctacgacaaggtgagctatgccaaaccccacaggcagcggccttacctgtggcgtccatgatgttccgcaactacctacattgtttgatcctcatgaaagcagcactggctgagacgccagtccagccgacctccttccctgtctgtccctcccgggctcttaagcccctctctttctctaacagaaaaagcggatggtggttcctgctgccctcaaggtcgtgcgtctgaagcctacaagaaaggtgagtcccagcttacgctgcaccatctacttgggagatttcaggcctgctgagggacctggggacctggagcctggcagatgatgtccttatctcacgatggtctgcggatgtccctgtgggaatggcgacaatgccaatggcttagctgatgccaggaggcttgggtgggtgcttttctaacaggcctgcagagaacagttgcattatgatatgcccagctgtcagtcacctcccagctctcaacagctccggctcttcagggtgtgggggcttagatatccttacaacttcatttgttcaccccccccccccccccccgcagtttgcctatctggggcgcctggctcacgaggttggctggaagtaccaggcagtgacagccaccctggaggagaagaggaaagagaaagccaagatccactaccggaagaagaaacagctcatggtgaggccaggggctggtgctgaggggggcatctcactcctggacaggcctggcaggtgccttgctcacagagtactcttaactggcaaaggaccagccggggttggggtgggatgcagtccatgtaatgagggcaatgcaacccctcctgaccaccaccacctgcacttattcttggcagaggctacggaa

SEQ ID NO: 11632 - DNA, 1654 bp, Homo sapiens; identical to SEQ ID NO: 11631

SEQ ID NO: 11633 - DNA, 1654 bp, Homo sapiens; identical to SEQ ID NO: 11631

SEQ ID NO: 11634 - DNA, 1654 bp, Homo sapiens; identical to SEQ ID NO: 11631

SEQ ID NO: 11635 - DNA, 1654 bp, Homo sapiens; identical to SEQ ID NO: 11631

SEQ ID NO: 11636 - DNA, 1838 bp, Homo sapiens
aaggtttttttggagttctccggtcttcaggggtaattctgtggaaacggactcctaagggctaatccagggagcctgccgtctggtatttaattctgaatccttatgtactacataaggagtgaatcctgggtgggcgatcttgggtcttggagaatgatcctcgctgaaaggtgtccagggtgtgagagggttgatcctggtttagaggatgaattttgcaatccctgagaggccttctggagtatataaattgaaataacctcgggcttagatctgagtatgaattacaggtaaggtcagggtggtcatgtcttagagggtgattctggggcaccaggccttggacgccggcgctttgcaagtaaatgtagagcatggggtctgggaggttctgggaaggtctctagggctggttggctgccggcttcaaacttagcagctcatcagttttctcctcataatctgtagactgagcgtgcctaccaaaagcagccgaccatctttcaaaacaagaagagggtcctgctgggagaaactggcaaggagaagctcccgcggtactacaagaacatcggtctgggcttcaagacacccaaggaggtgcggggaacctcagaagaaagaaggggaacctggcgttcctgcacgtgtgcccacgacgagttgccctgcctgcatctaagtggcttctggggctgctgggaattgtagttgcttccctgaggccacgcccctggctcttttaaggaaccgcccgcccaaggctcactcctttatctttcctatcctttcaggctattgagggcacctacattgacaagaaatgccccttcactggtaatgtgtccattcgagggcggatcctctctggtaagtgcgggagttactggtgtctggggcctgaaatactgaaagaagggtcttggggcccagactcctgggtcctgggtgagaggggtggttaggaatgcaaacttgtaggtccaggtacattggcagatgatgtttgttttcacgatggtcttcagatgcccacgtgggcactgctgagaaagccacttggtaaaactgatgccggaaatggggctttttgggatccctgctcagctgcttctgagtcccagcatgccctgggttacctatggccctctttcccatgggacctgacctatgatcggcccccgctcctaggcgtggtgaccaagatgaagatgcagaggaccattgtcatccgccgagactatctgcactacatccgcaagtacaaccgcttcgagaagcgccacaagaacatgtctgtacacctgtccccctgcttcaggtgagcgcagtggcccatcaggttgctcaggccacgctctctcagccttcagattccagatcggaccaatttaaggccaactgagggagggaaagactgaggtggcatctctgggaagccccagaatctcaggatttgtatatcatatgttcttcagaatcaaagcgttctacagggtgaatatctctacctgaaatgcttggaaccagattttggaatgttctcgcatacatagtgagatgttttggggatgtgacataggtctaaacaagaagctcatttgtttcatatacaccttattcacatagcctgaaagtagtcttacgcagtgcgttttataattctgtgtgaaacaaagtttgcgtacattgaaccattggaaagcaaaggtgtcacgctggtattgaagaagtttcagattctagccaggcaccgtggctcaagccagtaatcccagcactgtaggaggctgaggcaggaggatcccttgagcccaggagtttgagaccagcct

SEQ ID NO: 11637 - DNA, 1838 bp, Homo sapiens; identical to SEQ ID NO: 11636

SEQ ID NO: 11638 - DNA, 1269 bp, Homo sapiens
cagagacccagagacccaaagagagaaggacagggaccaagacggggacagattcagagagaaagggacagaggcccagagaacaagggtcccagagacttcgggacacgcttggatgcagggagggcttttgaaagcagggccgtgttgtcccctctgaaccctgaccctccctccaggatgggcggctgagcaaagcggaaatcctgggtaattggaacatgtttgtgggcagtcaggccaccaactatggcgaggacctgacccggcaccacgatgagctgtgagcaccgcgcacctgccacagcctcagaggcccgcacaatgaccggaggaggggccgctgtggtctggccccctccctgtccaggccccgcaggaggcagatgcagtcccaggcatcctcctgcccctgggctctcagggaccccctgggtcggcttctgtccctgtcacacccccaaccccagggaggggctgtcatagtcccagaggataagcaatacctatttctgactgagtctcccagcccagacccagggacccttggccccaagctcagctctaagaaccgccccaacccctccagctccaaatctgagcctccaccacatagactgaaactcccctggccccagccctctcctgcctggcctggcctgggacacctcctctctgccaggaggcaataaaagccagcgccgggaccttgtgtgtctgtctgttgtctgcctgtctctatgaagggtaagggggccctggagatggtttgggggctgtgactgggagttgggggctgagacatgcaataggggaccaggcatttgaaggaggggtgctgggtgttggagggattggagggcgttcctcagtataaaacaaacaaacaaaaaaaattgggccaggcccggtggctcacgcctgtaagcccagcaatttgggaggctgaggcgggtagatcacgaggtcgggggtcctagaccagcctggccaacatggtgaaaccccgtctctactagaaatacaaaaattaaccaggcctggtgatgggcacctataatcccagctactctggaggctgaagcagaatcgcttgaacccgggaggtggaggttgtcgtgagccgaaatggcgccactgcactccagcctgggtgacagagggagactctgtctcaaaaaaaaaagggaaaaaaagcctggactctgcagcgcacaaaccagacaggaagccctgccctctcagagctccagttctgtaaggaagaga

SEQ ID NO: 11639 - DNA, 1180 bp, Homo sapiens
cggacgggaaggccttgggaaggtgggagggactggcgaagcaaggcctggacttccccccatccttggattcccggcttggtgacccctcccccccgcgccccaggcactgctcttgcaaaggtgggaagaagagaagaattagaacgcagatctggggggcgcgaaccccctctcaggtcctattgttccgggactgtgcgaggccgcgccactaggcgcccccccaagaattccgcgcgcagagtgggcacggggccccgcccccttcctaagctggggttgtgtgtgtgtaagggagggggtcaggcgtctgggacacgccccctttaatgcccccacccccaaaggcagagaatcctagttgatcgcaaggagtggagcgtttgccctcttgagtctggccacggactggtgccgttgcatgggaagagtcggatgtttcccgggtgtgtgtttgtgtgtctgagcgtgggccctgtgcgtgcgtggctggcagcgtgttcacctgtgaatctgcccctttcctgttgcttattggtgtggcgccctcacacttcacctatccccagcacctcccccccaacacacctggatttcccagcagggcataaccccaagtgtgtcaggattttccgtgtgggattcctccgtctatatcttttcttccccacgggtgagttggatacccgtttgcacacatacctggcattgcatgggcccatgcatttgaacctcaacccccggggatggtcggtgttcttgttcacacttgtacctggtactttccccaggtcttattccctcttctctccaccccccaaaccgttgccgcttgggaaccgatcttcctcctgctcccaacttgttctgcaccaccccatgaagttcagggcctatgtgttcccgtgtgtctacggaagaggaggcgtccatgtggacctctggcgttggccccatagcctgtgtcgccggaacgggggctggggggggtttgtggggtcgacgggggagggctctcatttgcaaatcaagacgcttgctctgccttggaccctcttctgtgtgttagtctcgtctctgagcatgcctgtttgtaaacgtgagactatccgggctctctttattcgggctctggagtgggggccatttctgtggctctttagttgagcaccccgat

SEQ ID NO: 11640 - DNA, 1134 bp, Homo sapiens
acctggctgactataacccctgtccccggccaggcctctctggactcttcgacactggcctccaccacgcgggctcagcagggcccgacgcctccgtcatgaaccttatctcggccctggaatcccggggcccccagcctggcccctccgcctcctctctcctctcccagttccgcagtccttcctggcaaacaggtaagcccagcgccggccctgcagggccagggtgggactggctcgctgttctctctgacgcgcggtcttcctcatctccagccatgcacacgccaggccccacggagctcttcatctcgggtgccctgccgggttccagcacctttccgtcctcatctgccctgtcggcttaccaacacccggcttccttcggcagccgccccttcccagtgccctcgtccctcagcctccaggaccccccattcagccctccagctaacgggctcctgtcccctcatgacgtgctgcacctgaagccctcgcaggcacccacggtgccctcttcactgggcttcgagcgcctggcagggggcggtgtcttggggccagctggtctcggtccagcccagacccccccttaccgccctggccccccagacccaccaccacctcctcgccacctcccaactcagttcaacctgctggcttcctcttccgctgccgccgccgctgccgagcagtcctccccacagctctataacttctcgggtgctgccccgggcccaccgccgcctgagcgggccctgccacgccaggacacggtcatcaagcactaccagcggccagccagtgcccagcccccaccacccccgccaccagcccatgcgctccagcactatctgagctgtggaggcagctacccctccatgggccaccgggccaacctggcctgcagccccctgggtggtggggagccctccccgggtgctggggagcctagcaaggctggtcccagcggagccacggctggggcatctggccgggccacgggccctgaggcagcagggggcggtggggctgggggtggtggtggaggttaccgccccatcattcagtcgcctgggtacaagacgggcaaaggtggttatggagcagctgccgggggtgccaccaggcccc

SEQ ID NO: 11641 - DNA, 1817 bp, Homo sapiens
tcccctcggtcctcagccatgcccccagtccctctcccagcgcctccaaagtcggcgtccacctccttgagccagccacccgcgatggggcaccccagccacctccaccgccacccccgcctccaccacccatgcccctgcagctcgaggcccacctccgcagccatggcctggagcccgcggcccccagcccccgcctgcgacccgaggagagcctggatccgccaggcgccatgcaggaattgctcggggctctggagccgctgcccccggcgcctggggatactggcgtaggcccaccaaactcggagggcaaggatcccgcaggcgcctaccgcagccccagcccgcaaggcaccaaggcgccgcgtttcgtgccgctcacctccatctgcttccctgactccttgctccaagacgaggagcgcagcttcttccccaccatggaggagatgttcggtggaggggccgcggacgactacggcaaggccgggccacctgaggacgagggggaccccaaggctggcgctgggccaccccccggcccccctgcttatgatccctatgggccctactgtcctggccgggcgtcgggagccgggcccgagacaccgggcctgggcctggaccccaacaaaccgcctgaactgccctccacggtcaacgccgagccgctgggcctgatccagagtggcccccaccaggcggcgccaccacccccgcctccgccaccgccgcctcccgcgccggcctccgaacccaagggtggcctcacctcgcccatcttctgctctaccaagccaaagaagctgctcaagacatcctccttccacctgctgcggcgccgcgacccacccttccagacccccaagaagctgtacgcccaggagtacgagttcgaggcggacgaggacaaggccgatgttcccgccgacatccgcctcaacccccggcgcttgcctgacctggtctccagctgccgctcccgtccggccctctcgccactgggggacatcgacttctgcccacccaacccaggacccgatggcccccggcgccgtggccgcaagcccacgaaggcgaaacgtgatgggccaccccggccacgggggaggccccggatccgccccctggaggtcccgaccactgcggggcccgcctcggcctccacgcccaccgatggcgccaagaaaccccggggccggggccgaggccggggtcgaaaggctgaggaggcagggggcacccggttggagcccctgaagccacttaaggtgaggggaaatggggtcttgtaggggataggggaggaggagctgtgtccgatgtttgagtcttttttttttttttttgagacagagtctcgctctgtcgtccaggctggagtgcagtggcacgatctcggttcactgcaagctccgcctcccgggttcacgccattctcctgcctcagcctcccgagtagctgggactacagttgcccgccaccacgcccggctagtttttttgtatttttagtagagacggggtttcaccgtattagtcaggatggtctcgatctcctggcctcgtgatccacccgcctcggcctcccaaagtgctgggattacagacctgagccaccgcgcccggcctcccgatgttttgagtcttaaaggacaggtttatggccgcaccttggcatttttggggcagggggataataaggtttacatttctaaaatctgtgaggaagttagcgtgaggaatttcagggtctcactgacagaaagacctaagaattgaaattctgaatctaggctgggcagtgtggttca

SEQ ID NO: 11642 - DNA, 1103 bp, Homo sapiens
cggcgaggagcggggcggcaagagcagccagaaggatcggcgccgctcgggggccgcctcctcctcctcctcttcccgggagaaggggtctcgtcggaaggcgctggacgggggtgaccgggatcgggacagggacagagatagggacagggacaggtcatccaagaaggcccggccccccaaggagtcggcgccttcctcagggcccccgccaaagccaccagtcagcagcggctcaggctcttcatcctcgtcgtcctcctgttcttcccggaaggtgaagctgcagtccaaggtggcggtgctgatccgcgagggtgtcagcagcaccaccccggccaaggatgccgcgtcagccggcctgggctccattggcgtcaaattcagccgtgaccgcgagagtcgctcccccttcctcaaacctgacgagcgggcccccactgagatggccaaagcagctccgggcagcaccaagcccaaaaagaccaaggtcaaggccaaggcaggggccaagaaaaccaaggggaccaagggaaagaccaagccatccaagaccaggaaaaaggtccgcagtggaggtggcagcgggggcagtggtggccaggtgtcgctgaagaagtccaaggcggatagctgcagccaggcggcaggcaccaagggggcggaggagacttcctggtccggggaggagcgggcagccaaggttcctagcaccccgccccccaaggcagccccaccaccccctgccctcactccggactcgcagaccgtggacagcagctgcaagacacctgaggtctccttcctgcccgaggaggccactgaggaggctggggtccgaggtggggcggaggaggaggaggaggaagaagaagaggaggaggaagaggaagaggaggaggagcagcagcctgctaccaccacggccaccagcactgctgcagccgccccaagcactgcccccagcgcggggtccacagccggtgactcgggggcggaggacgggccagcttcccgtgtctcccagctgcccacgttgcccccgcccatgccctggaatctgccagctggtgtggactgcaccaccagcggcgtcctggcct

SEQ ID NO: 11643 - DNA, 1134 bp, Homo sapiens
tctggccctttcttgaggtctaaccatacccctcttgcttcaaaccagtttaccccaggcccccagacacttagtagcaacccctccaggttcacagcccccgctggcctcccccagtatcgccgctacttccttaactccacctccaacccccctttgcccttccctgtgtctgcccccattttccttcccctcccctccccagctgtgggctgagctagagacggggtcagagagactggagagatggtaggcgtggctgaggtatcggggtgctcccctggatggtgctctgggggggtcctggaagtggaaaatggggttgttaggttttggggttcctgggggggcaagatggcaggcgggggctgtagggttgtcatggtatgattttgggggttctatactactcttcagggaaaagtagggcgctggaggtttaagaggctgtggggagcccccagatctgacccatgatcccatcggccccctcccaggtgtcctgtggccaggcggaaagcagtgagaagcccaacgctgaggacatgacatccaaagattactactttgactcctacgcacactttggcatccacgaggtcagtggggacagtccccaaggccccaatcttaggggggcttaaatgttggggaaggggtggaacctgttttcccacgcatgcgcactgcttcccctggccgcaggccgcccccctgcccctctgctgcgcacttcctagggtcgcctcgccaagccgttgccttggagaccgaggttagcctgaatctctgcaggggcctcgcgccgaaggctggggtgggagagcgcatgcgtgcctggggccttagccagaggtcgggcagggcccactggtctctgccgccctctagtgaccggcggtgggactgcgccccggctgctcccgccctaacagcttctgcacacttcagatctgactgaagacactgaaatcccagaacgaagctggggtggcattctaaggaattttcttttccccctgaggcctttttcataaaattgtggcaaaatatgcataaaattgccattttttatttttagagacggtctcgctctgtcgcccaggctagagtgcattggtgcaatcatggctc

SEQ ID NO: 11644 - DNA, 1145 bp, Homo sapiens
tggaagacctgaccttcacctccccgttctgcctgcaagtgaagcggaatgactacgtgcacgccctggtggcctacttcaacatcgagttcacacgctgccacaagaggaccggcttctccaccagtgaggcggggcccacagggctgggggccgttcccgagccagggcggaggcgcacccacgtagtggagggggtgacagaaacgggcagaaggaaccatggggacacgcgtgttccagtgtgagctctgccatgtagcagtcacgtggccttgggcaagtgacctgagtgtgcagtgcctcagtttcctcatccacaaaaggctgacacggtccctgtctccaaagctcaatgacagggaggtgactcgcggatagcagtcccatcagctgtcatgggggtgggcattccgacagagggaacgcaagggtggggttggggggggcagcaggccgaggccggctgacccgcccgcgcccccaggccccgagtccccgtacacgcactggaagcagacggtgttctacatggaggactacctgaccgtgaagacgggcgaggagatcttcggcaccatcggcatgcggcccaacgccaagaacaacgtgaggctccgggcagctgggtgggagggtggcagctagggcggggagtgtagattggggggggagtggtgggggaggaatggtggcagcgggggtaggggatgggggcagccggggtgggggatgggggcagctggcgggggcgagcacctctgcctattcccgggtccccaagcccctcagccccatgcctgtctacacagcaggattgcttgagcattcaccggaagttatgggcctggggacccaggctgaaaccctgccctcctggtgcttccactctagacaagggggtcagtgacatggtgatgccagttggaggtgacctctgtcaggctgggagcagggcagacaggtgttggtgtaggtgggctccagggcaagaggcagcccccagtagagtgcacggggttttctagcccagctgggaggcatgagaggagaaaggcagctttttgttttctgctcccctttctttttcctcctgagcacttggcaggagctgccatcacctgagatcagggggcttccggggg

SEQ ID NO: 11645 - DNA, 1208 bp, Homo sapiens
tatcttcatgggggatggcatgatcaccttccacatctccagcaaaaaatcaagcacaaaaacggtgagacaaacgtgtatacccaccaactccctctttcctcaggaaccaggagtctgggcccccagcccctcctccctcagacccaggattccaggccccagcccctcctccctcagacccaggagtccaggcccccagcccctcctccctcagacccgggagtccaggcccccagcccctcctccctcagacccgggagtccaggcccccagcccctcctccctcagactcgggagtccaggccccagctcctcctccctcagactcaggaatccaggcccttagccctcttgtttctcagcctccaggatcccatctcccagcttcccctggctctgacctgttctccttccaggattcccacaggctggggcagcacattgaggacgcactgctggatgtggcctccctgttccaggcgggacagcattttaagcgccggttcagagggtcagggaaggagaactccaggcacaggtgtggatttctctcccgccagactggggcctccaaggcctcaatgacatccaccgacttctgactccttccagcaggcagctggcctctccaaggaataagggtgaaattgccacagctggctgacacaggacaggggcaactggtttggcaaccccacatccaggccaataaagatgtgtgagctgggtgtgtggtgtctgctatgctcttgggcagggcaggggtagaagaggtaaggaccagggtggaggaggacagaagctcccatccattcccaggcccagccagggattcccagttgcagtcacagcttcaaccacagcccgcaacacctgcccagtgtacttcatttccagcttcactcataccaaacccaaccctccaaggccagtgccaatcaaacacaacctcacaagttctcctgagcctaattcctgctgccccaacaccactgtccacctcaaatccatctccaggccgggcgcggtggctcatgtctgtaatcccagaactttgggaggccaaggtgggcggatcatgaggtcaggagatcaagaccttcctggcgaacactgtgaaaccccgtctctattaaaaatacaaaaaaattagccgggcatggtggcgagcacctgtagtcccagctactcgggaggctgaggca

SEQ ID NO: 11646 - DNA, 1220 bp, Homo sapiens
cacccagtcccttagaaaatcccactctgtttctaatacctggagattcccccaacagcgcccatcacctgcgcaccagcgcagaaaccttgactgtcccacccccacagtcccaaccctctagagtctcgccccttcactgctccttacccagctgcctggggtcctgccagggacaccccacacacccaggtcagtgctggccatggcgcccgaggccccgtggcctcctcaccccacccctaaagcacgcacagtgacacatgtgcacacccctaaaccccatcttcccgactgcacacacatcccgaccctgtcccgctcctgagcctctgctctcaggtaccacctcccccaggggcctgacttgtctctcctctgcccctgcagggtgtggtcacggccgccgtcagcctcatcacctgtctctgcaagaagaacccagatgacttcaagacgtgcgtctctctggctgtgtcgcgcctgagccgggtgggtgtggcctagatattggctgctggaggtggccctggcatccctatgccctctgacacccctcaggcccccactctccctgagaggcagcccagcccaaggtttacaaactcaggctctgagctggattcatcctggctcggcctcttcctggctgggtggccctggacaagtggcttcacctccctggcctcagctgccccctgtgttcagtggggataataccggtgcccacctggaggcacagagcgctgtggatagagtgctcagaacagggcctcgcgggccgagcaccccgggagccagccgccctcatgacctcctccctctcccacttctctctctgtctcccactttccctcttctggctttgcctcccgcctctctctttcctgtgcagcctctcactcctgcctggcgtccctctcccacctttgctcctgtcctgcccaggaacatcccctgaggccttgtgcatgccaggctccatgtcgggtgacaccagggacacagatgagtcagaaccaagctctgctcttaaggagctccctgtccttctggcagggaggtgactcagtcacagattgtcagaaaaggggtgactcgtgctataatggaggtaggataggtcacccataggaggcacttaacacagcctgtgagtccacgaaggcttcctgggggcggcgatcccagaattgagacttagaatacacatgcgcatc

SEQ ID NO: 11647 - DNA, 1254 bp, Homo sapiens
ttggcctcccaaagtgctggattacaggcgtgagccgccacacccggctggattatttcatcaactcctgaggacattttacacatgtccttgtgttgagacagggcctcactcacccaagctggaatgcagtggcatgaacactgctcactgcagcctcgaacttctgggctcaaggcatcctcctgcctcagcctcccaagtagctgggactacaggtgcacatcaccatgcctggctaatttttttgtagagatggggtcttgccatgttgcccaggcttacacatgtccagaggctaagagaggttaagtggttgcccacagccactcaggtggttaagagctgggattcaaacccaagtcagcctccagagctaatactattatgtctcagtgcggtgtgacattgtggaaggccaaaggaggcacctagggggcgcctcagaggtttccatagtatgaactttgtagttgaaccttgtaggattgagtccaggattgcaccatggggtccctcaaagacctgcaggcgggagctgccgggagctctggggttcctgacccagacctcccgggggcccacctcctctgtctggcttccttgactcctggcgggcacagctggctgtgcagaccaagcgcgtggcggcgcaggtggacggcggcgcgcaggtgcagcaggtgctcaatatcgagtgcctgcgggacttcctgacgcccccgctgctgtccgtgcgcttccggtgagtcaggtacggcgcggccggtgggcggagcctccggggtgaggggcggggcctaatggagcctccctttcacctcatcaggtacggtggcgccccccaggccctcaccctgaagctcccagtgaccatcaacaagttcttccagcccaccgagatggcggcccaggatttcttccagcgctggaagcagctgagcctgtgaggggtggggagggggcggagccaaagccgcgcctctgggtgggcgggtcgggccgtccaggtccctgacttgaaccttcccggtccccagccctcaacaggaggcgcagaaaatcttcaaagccaaccaccccatggacgcagaagttactaaggccaaggtgagagaccgcgggcgtgtttgccggcctatggctgctttgcttctctgagcctctgttttcccatctgtaaagtggggccaattcccatccccaagggttttttgggatctgggatgccactgtgtggtaactaacagctct

SEQ ID NO: 11648 - DNA, 1112 bp, Homo sapiens
gttgcaggcctgagccaccacgcccggctcgttcggctttattgtactcagtcttcagaacccagtgcaggttttattgttagaggcctctctgctaggactctctgctaggactccctgcctttccagtactccctgttcacatgtggctggcggctcccacagaggccagggcagggccaaaggggaaggagtacagtgacttggggcaggaggaatgggttggggcagaggacgtcgccagggtctgggcctgcgaggactggatggtgagaatcctggggagtagcaggtttggggaggacacacagcaccgctgggacaaggtgggtggagggtggtgagtgccatccaggggacgggcgggcactctgagtgggtggcgatgatgtaggccgccaagcctcagccccctctgtcctgctctggcccgcagggcgcggatggcgtcggggcgccccgaggagctgtgggaggccgtggtgggggccgctgagcgcttccgggcccggactggcacggagctggtgctgctgaccgcggccccgccgccaccaccccgcccgggcccctgtgcctatgctgcccatggtcgaggagccctggcggaggcagcgcgccgttgcctccacgacatcgcactggcccacagggctgccactgctgctcggcctcctgcgcccccaccagcaccacagccacccagtcccacacccagcccaccccggcctaccctggccagagaggacaacgaggaggacgaggatgagcccacagagacagagacctccggggagcagctgggcattagtgataatggaggtgagagggtgggggcaggggcgggtgcggcccagcgcttgaggtgcccgcaggaggctttgtcggggtgggggcctgcttagcccagagtacttctacagaagtgcagtctcaggaccccagagccagacaggcttgcctggggcttgctgtgtgatctaaagccagtcccttccctgctctgagccttactggtcctggggccagctctgtgctgggagtggtgggcacaaggacacagagcaggctcgggcttttttctcaaggggctcccggtctagccaaggaac

SEQ ID NO: 11649 - DNA, 1175 bp, Homo sapiens
ctcccccaacccaggggcttcaagctccgcctttatggcggaccccggggtcctggaatgccaaggcagagaggagaaacaggagacgaggtccgagggaacggtatccccgccccttagaacaggaactggtaaacccttaccaattacagccacccccgactgccacctgtggctgccgtcgcgacctgtcgcctcccacgcatgttgtggctgcgcccgcccccgtcagggcgtgaccacggcgtggactacaacgaccgtgatgctccacggagccaggagcctttgacgaaaggcagcgtaggcgagggccttcatgggactcgtagtacaaggcccatcacaagggtgcgccgtggagaaaaggggtgatacccttcgcctccctctcttcctcaactccgtgggtccatgcacaaagctttctcttcaaaaagtacgctctgaaaagaagcaacctaggcaggttcgttcaatggaaatattggatttttactgagtagcgctagctctgctacccggtgcgcatgcgcatcacctgggcggcacccgcggtactgcgcctgcgcggtctcgcgccttcccaggtccgctccgcgagggcgagcgcgcgccagtcccactcgtgcgccgctcttcatgtccccgcggtcgaagacggtcacatacgcccccaagaaaacgtcgccgaggatccacacaggtactggaggcgaagcgatgtccaaggcccggaagccggacaagcagaggcggacgtcaccctgagcaaactgcaaggcgacaaggcggcaactgggtgtccaggccgcaggaaccaccatttccctgggagtccgtgctctctccgcccccaaccccggggacaagaaatgtttctgtggccccttccggccctagtgatgtccaactaccagctccaccctctcaactccagtcatattacatcactgtggcgtcattatgacggacacctacctggatgacgtaatcctgggccgtgagattaaaccagacccccccaatgaggagtgagactgcggggagctttgggatttctgagcaccggatgatgtactggtggaggagaggaacaagtgaagatgggagattcctgctctgctcaaatcccgtccgtggctccccagtgccatggagtaatgttcatattg

SEQ ID NO: 11650 - DNA, 1260 bp, Homo sapiens
aatgtcagtgtgagggaaacactgggccagtggcctcttcaggccgcagtctttccagcatgcatttgatgtagtcacttccttgtgcatgtccagaactctgagccagggaacccacttctttccacctgaccattgaggagccgccttatagtcccattttgcagatttgggaactgaggcccaggaggggcagagtggcttgtacataagcctatgccactgggaaatggcagaggcgggacccctcccccgccggcccacgttcactgcacatggcccccagggcttcactccgcatgattctctccccgacagagcgtcacggggttcggacgtcagatgatcgagaaaaccaagcagctggtggagtctaagtacacagtggagaatggctacagcaccagtgccaaggtcgggggctgcccaccgctgccctgagatgggcccagggcaggtggggggatggaagccgggccggacccccatgtccccgtgcctcctggtcacaccctgcccactctcctgttgcatccttgggtcccgttggcattagccacctgccaccccccgacaccagtagttgacagaagggaccctgcttctcacatacacacatccccaccgcccgcaggtggtgtatggtgacactgactccgtcatgtgccgattcggcgtgtcctcggtggctgaggcgatggccctggggcgggaggccgcggactgggtgtcaggtcacttcccgtcgcccatccggctggagtttgagaaggtgcgtggctgggtcaggggctctgcatttaggtgccctcatcagggtactcagggtgtcccgttctttgggttcacaaaagccacagtgtgaagggatgttgctgcttagattctcctgaggctggggccttggtttgggaagcctccaaggccttgggctttgttaccctggatggcatctgttctttgaaaaccctgtcgctgtccctggttttgaggtgtcacagtgtccctggttttgaggtttcccagtacctgtcagatgtggagctgccctccacgcagggaccctgatgggggtgcaccttagatctgtgcaccattgcccctggccctctgagtgcggcacacttggtcccaggaaaccttgcaccatattttcttttgaagagtctgggtctcgctctgtcgcccaggctggagtgcagtggcgagttcacagctcactgcagcctccaactcctgggctccggcgatcctcccgcc

SEQ ID NO: 11651 - DNA, 1268 bp, Homo sapiens
tgctacctcacatgttgtgttctattatagagaggcagcaaagtctagtgattaagagaataaaatctggagagagactgctggattcaaatctcagaactgtcatttattacttgtaaaaccttaaacaaatcactgaatctctctgtgtctcagtttcctcatctttaaaatggtcatatagaactactgggctgggcacagtggccacatctgtaatcacagcactttgggaggccaaggtgggaagattgcttgaggccaggagttcgagccagcctgggcaacatagcaagacctcatctctacagaaaaatttaaaagttagccaggtgtgatagcacatacctgtagttccagcttcttgggaggctgaggtaagaggattgcttgagcccaagagttcgagggtgcagtgagctgtgattatgccactgcactccagcctgagtaacagagattccatctctttaaaaaaatacaatacttaaccttgtagagttgtagaacataaattaagtaatacatgtaaagtgcctggcacttgcaattgcatggacaattgcatggcaaatatgaagggttaactctttggggacagcagagggaggatgtactgtgaccccatcctgacccctacctctgtcctcgttctctccagacatctccgtgagcctgctgtcggtcatcgtgacattctgtggcattgtccttctgggtgtctctctcttcgtgtcctggaagttgtgctgggtgccctggcgggacaagggaggctcggcagtgggcggtggccccctgcgcaaagacctaggccctggtgtcgggctggcaggcctggtaggcggaggcgggcaccacctggcggctggcctgggtggccatcctctgctgggcggcccacaccaccatgcccatgccgcccaccatccaccctttgctgagctgctggagccaggcagcctggggggttctgacacccctgagccctcctacttggacatggactcgtatccagaggctgcagcagcagcagtggccgctggggtcaaaccgagccaaacatcccctgagctgccctctgaggggggagcaggctctgggttgctcctgctgccccccagtggtgggggcttgcccagtgcccagtcacatcagcaggtcacaagcctggcacccactaccaggtgagagaggatactgggttgggggtccactctgaacttctgctcctcctctgtgtctctttcctatctatagctcttatg

SEQ ID NO: 11652 - DNA, 1164 bp, Homo sapiens
acttgagggggacagagaggtcactctggagggaggatgaggaaggggcgggggacattccggggtcaggaagcccacctggctagaggagggtgagaaggaggcgaaggccagccaggcgtgtcccgaggaagtgggggagaggctggcaacggcgggcagaggagttggacctgacccaggaggaagctgggagtcgcggaaggctcgtgagcggagggatgacacagtcccagctcagcctcaggaagctgaatcaggcggtgcgcgcaggaccgtgggagggggcagagccggaagccaggaggcaggagagggggctggttggggcagctgcgggcaggcagagggagcccccaaatgccctcttccttggaggacgccagtgctgggaaaccccccctcccccctgatgcaccgtcctcttcccccacccaaggacccctgtcctcccagaggtgtcccctccctccaccctcccctcctctcatgccctctgtgtacgcagctccagcgggacaccccgggaagggccagccgggggcacggggggctcagggggccccgggggctccctgggcagccgcgggaggcggaggaagctctactcagcggtacccggacgctccttcatggctgtgaagtcctaccaggcccaagccgagggggagatctccctgagcaagggcgagaagatcaaaggtacccagggtggaagcagggcctgggctgggctgggctgtgggggcgatcagggaaaatgtggagcagagagcagaccattctcgggcacctggagtatctcatgcactctggagacctcagagagccccaggacaccccttgaggcttggaggaccatagagtgtagctcagatgaccctgtcaggaggcagtgaagtgagccgtgtcccactgcgggacactgatgccgtgtgcagggcatggctggaacttctcaccaaatcgtctcattagactcctgatggccctttctggggagggaggtcatgggccccattgcatggttgaaggaacagaacctcacacaggtgaagccacttgcccaaggtcctcagtccaagcccacagtccttcctgccacctggtgcagagcgtgaggccgagcagccttaactttgcctcctgcatctgtccaggggt

SEQ ID NO: 11653 - DNA, 1226 bp, Homo sapiens
gagttcacactgtaaagtgaaagcaagtttactaagcaagtaaaggaacaaggcagggtgcagtggctcacgcctgtaatcccagcacattgagagaggctgaggtgggcagattgcttgaacccaggagttcaagagcaacctgggcaacattacaaaactctatctctacaaaaaatacaaaaattagccaagggtaatggtgtgcaccagtagtccaagctagttggaaggctgaggttggaaattgcttgagcctgggagaatttttttttttgaggcagtgtctggctccggtcacccaagcagtagtgcagtaatgccatctcggctcagactctaattcaacacggaatgttgagcttctgagcgtgatatagcggaagtgccttctcttccggtctctctggtcttggccgcagaagccagatgacgaagggaacgtcattgtttggaaagcgtcgcaataagacgcacacgttgtgttgccgccgtggctctaaggcctaccaccttcagaagtcgacctgtggcaaatgtggctacgctgccaagcgcaagagaaagtataactggagtgccaaggctaaaagacaaaataccaccggaactggtggaatgaggcacctaaaaattgtataccacagattcaggcatggattctatgaaggaacaatacttaaacccaagagggcagctgttgcagcatccagttcatcttaagaatgtctatgattagtcatgcaataaatgttctggttttaaaaaatacaaaaaaaaatactgaatgtttactcctgaaacttatgatgcctaggttgagaaagactcaattttcctcatgctaaatactttatacatgtcctttattcatgcatacataggacactttacacaatataattgttgaaagtgcttctgaaatactgttcaaattgtctataatatttttacacatgcactataaaaattaaatttatcagacaataaatattaaataatttaataaaattgcatttttcaaaggctctaacaatgcatatttgagttatcatattaaacattgtattctatgatttttcaactgtaatataattttttttgagatgggatcttgctctcttgcccaggctgcagtgtggtggtgcaatcacggctcatgcagcctccacctccccaggctcaagtgatcctctcacctcagtttttgtgtttttagtagagat

SEQ ID NO: 11654 - DNA, 1187 bp, Homo sapiens
ttaaaatcaggacttgctttatagaattcagtgaggaagaacaagcacccctggtacaacacggaggtcctgcctagtacacacagtgagtagatgttctacacagtgtcagtgatgatcattgcactttgagaggctaagaactttctcctcagaaagcaacgtgtgtaattttaaggtttatggaccccagtgaaactccttcaaggacccctaaataagaacctttgtggaaggcacgctgacagagaccttctgctggctggcataatattacgtttttcctttgagtcattcattgcaaccatttttaaaggctattttaatgaaggtcgggatgggtaatagggaagttttctctgaggagatgagcccatgatggggtgcaggatggggctccagggctgcggatggtggagagggagctgtccagtgactttgtgttctcaccacagccaccgctggagtcgctggccacagtggaggagacagtggtgcgggacaaggcagtggagtccttacgggccatctcacacgagcactcgccctctgacctggaggcgcactttgtgccgctagtgaagcggctggcgggcggcgactggttcacctcccgcacctcggcctgcggcctcttctccgtctgctacccccgagtgtccagtgctgtgaaggcggaacttcgacagtgagtctctgcctccttggaagctccaagctcccatctcagctccaaccttctctaaagcctcagactccttttggtctagctggggcccaaatgcccctgaactctctccactcccactcctgcttaccacctgataggccacatcctcgagagttggtctctggacacggccacgtgtcagtttacccacctctgcccccttgctcacttaggaattgagatgatgacaggtcctccttcccactggttaatgtgaggatttaaaagaattatcacacataaagtgcttagagcaaaatctggaacataaaaactttcagcaacttacatctgatggtatctccagcctgtcccaggtccagtgcctttggcagataaaccacctcagttttcagcctcctgctcgtctactttgcaaacgattgaccgtcaagcccgggtttgagcctgactcactccagaactctggtttatggctgtacacttgcttagatac

SEQ ID NO: 11655 - DNA, 1190 bp, Homo sapiens
gccttagcctctcaaatagctgggaccacaggtgtgcaacaccacgctgggctcattttttatttttggcagagatggggtctcactatgttgctcaggctggtcttgaactcctgggctcaagcaatcctcctgccttggtcttccaaagtgttcagattacaggtatgagccactgtgcctggctcgttggttaagcaatttttatgggaatgatgtaatcgtcagcacttagcattgactagatttattatgcgcaatctgcgaagtgtctcacacacactattttcatttaaacctcatgcggacctgtggggtaggtactgttactatcagctccgtttcatagggctgggaagacagagagggggtcatcacttgcccaaggtcattcagctaaaacctggacccacacaactgcagagtctgtgcttgctcctctctgccatactgcctgctgcctcaggatccccgtccccgactcccaggtacttccggaacctgtgctcagatgacacccccatggtgcggcgggccgcagcctccaagctgggggagtttgccaaggtgctggagctggacaacgtcaagagtgagatcatccccatgttctccaacctggcctctgacgagcaggtgagttttgcttcctggccctctgctctcccgtccttctggtggttcctgcccatgaaagagaatcccagagctcagcaaggcctctgctgccctcccactgttcctctcctctccctaggactcggtgcggctgctggcggtggaggcgtgcgtgaacatcgcccagcttctgccccaggaggatctggaggccctggtgatgcccactctgcgccaggccgctgaagacaagtcctggcgcgtccgctacatggtggctgacaagttcacagaggtagatgagcgaccgttgacattgtcccactggtggggacactgacactctcagaagggaagcatataggagctgaggtttccattaggccgatggaaccattgggcgtttgagcaataagatctctatgatcatctaactgcgtctcgcttcgtgtgccaatcctggttgattgacatggcatcttaaagtgctgccttgagaaagattctgaggcaaagttaaggctacgtggaggaaagtgccacaggagcagagaagggtagcacatgtgggg

SEQ ID NO: 11656 - DNA, 1298 bp, Homo sapiens
gtcacccgcctgtgcagtgatcagagatttctaattcctgtgtgtgccctggattcttgagactcctcccaccttgggtttggtgtatccgtgtctgtgtacactctcttgcccaagagccctgtgcccacctgttgccccagtccatcctggctcaccctctctctccctgtctcctttcgctttccagcaccttgcagagtgaagtcaagcccatcctagagaagctgacccaggaccaggatgtggacgtcaaatactttgcccaggaggctctgactggtaagacctagaaagcacggagccctagcaggagggtggactttgaggacaggcactgggcctgtgggcagcagcttctgggagggggaggtaccttggcattgtgggcagagagagggctctggttctgattcttgcctgttcctgttttcctagttctgtctctcgcctgatgctggaagaggagcaaacactggcctctggtgtccaccctccaacccccacaagtccctctttggggagacactggggggcctttggctgtcactccctgtgcatggtctgaccccaggccccttcccccagcacggttcctcctctccccagcctgggaagatgtctcactgtccacctcccaacgggctaggggagcacggggttggacaggacagtgaccttgggaggaaggggctactccgcccacgtcagggagagatgtgagcatcccgggtcactggatcctgctgctgtaatgggaacccctcccccatttacttctccacctcccgtcctccccatcattggtttttttttgtgtgtcaactgtgccgtttttattttattccttttattttcccccttttcacagagaaataaaggtctagaagtagttggtcctctggccttagtcatcagcttggaggagggggcaccaccccagagccacaacatctgcgcttttctctggagaagatcttgttacaggacccattatacccctatgtcccgaaagaatactctggggatccccccaggagtgctgctggcctttggggtagagggtccatgaggtgctctgggtggtgtcctgtagtgcagttcagattcatagatgtcggccgagtatttggggggttaagagcaggtgccttggaaccagactgcctgggtccaaattgtggctccttcagttaatagacgtgtgactaggagtagcttgttaagtctttatgagctcagttttgtattgtgtaaaatgagagttacagtaatacctagattgcagggtgggtggc

SEQ ID NO: 11657 - DNA, 1820 bp, Homo sapiens
ccttataatgtcaaaacccacatttctaagaaatatctcaaagattttatctcttctttattactcacacaggggcaaaaagcaaataattggggaagcccttacaaatctaatggatgtggcatggtctttcctcaaaattcacaccttgcaagtcatcagagaagtcatactaaagagaaaccttacaaatgttatgagtgtggcaaagcctttagaacacgttcaaacctaactacccatcaggtgatccatactggcgaaaaacgttacaaatgtaatgagtgtggtaaggtctttagtcgaaattcacaactctcacaacatcagaaaattcacactggagagaaaccttataaatgtaacgaatgtggcaaggtcttcactcagaattcacaccttgtaagacatcgaggaattcatactggagagaaaccttacaagtgtaatgagtgtgggaaagcctttagagctcgttcaagcttagctatccatcaggcaacccacagtggagaaaaaccttacaaatgtaatgaatgtggcaaggtcttcactcaaaattcacaccttacaaatcactggagaattcacactggagagaaaccttacaagtgtaatgagtgcggcaaagcctttggtgttcgttcaagcctagctattcatctggtaattcacaccggagaaaagccttacaaatgtcatgaatgcggcaaggtctttaggcgtaattcacaccttgcaaggcatcagctaattcatactggagagaaaccttataagtgtaatgagtgtggcaaagcctttagagcacattcaaacctaactacccatcaggtcatccatactggagaaaagccttacaaatgtaatgaatgtggcaaggtcttcactcaaaattcacaccttgcaaatcatcaaagaattcatactggagtgaagccttatatgtgtaatgagtgcggcaaagccttcagtgtgtattcaagcctaactacccatcaggtcatccatactggagaaaaaccttacaaatgtaatgagtgtggcaaggtcttcactcagaattcacaccttgcaagacatcggggaattcatactggagagaaaccttataaatgtaatgaatgtggcaaggtctttaggcataattcatacctttcaaggcatcagcgaattcatactggagagaaaccttacaagtataatgagtatggcaaagcctttagtgaacattcaaacctaactacccatcaggtcatccatactggtgaaaaaccttacaaatgtaatgagtgtggcaaggtcttcactcagaattcacaccttgcaagacatcggagagttcatactggaggtaaaccttaccagtgtaatgaatgtggcaaagcctttagtcaaacatcaaagcttgcaaggcatcagagagttcatactggagagaaaccatatgagtgtaatcagtgtgggaaagcctttagtgtccgttcaagcctaactacccatcaggcaatccatactggaaaaaaaccttacaaatgcaatgagtgtgggaaggtcttcactcagaattcacaccttgcaagacatcggggaattcatactggagagaaaccttacaagtgtaatgagtgtggcaaagcctttagtcaaacttcaaaacttgcaaggcatcagagaattcataccggagagaaaccatatgagtgtgggaaaccctttagtatctgttcaagcctaactacccatcagacaatccatactggtgggaaaccttacaaatgtaacgtgtggaaagttctaaagtcagagttcaaaccttg

SEQ ID NO: 11658 - DNA, 1342 bp, Homo sapiens
ggagccatcggcagacgccgcggcctcccttgagccccgacccccgtcgtcagaacaaccccgggcccactcccccaaccccacttccgcttcgcgccgctatcgcgatagcgcccgggcccggggcgcgagaaaaaggcggcgggcgctcgcctcccccgcctgtcgcgatacgctcctcagcggcggcgccagctcctgtggtgagagcgtcaggctcgactgggccggaccccttcccttcctccccccggcgccatcggccgccctccccgccgcctcccgccctggcgacaccgccgtctgtcgcgacatggcctcccctcgcctgccccctgccgccgcctctgcagcgcggggctcccggcggggggcggctccctccctctcgccctcccgttcctgcgcctctttcacgttcctcagcgcctcccgggggtccttccgcgacccggaccccgggccccgcccgccgccgcctccccgcgtggcatcgcgtcgggccccccggtaggggtgtgagggtgcgaagcctcccgggcgcgaggtgcccgcccctctccgcgtcggtattggctcctggctggaaggatggaggcgcccctggtcccaggtgcccgccctctcggggctcaggtgcctgcccccctcggcctcggtccttcgcgttgtggggcagcctccgcgccggggcttctccctcgacggtggcggggagggggggtggtggtcgggacgaggaccccagctgggtgggggagtcacccttcccaggaccgaggccgccctccgcatccctcctcactgctcccgggagcgcagcctcccctggatctcaggttccagctgcccgtctgtatcggatgggagcctcttgggagaggagtggaggagaaactccccgttagttggagcctttgccgaagtttccacctctgtagtctgcagctcttccctctcatagcgagtagcgccctgggtggctccagcctcgccatcccgctgcactgggcgcctgcctttttgggggagtttggctttcccccacctggggtacaggaccgtcctcagtgtggcccacgtctggtctcagctctcacacttctttgatcctggcgtctgcccctggctttgcagccttgaactcccctgcatcgtgactctccgaccttctgggtgtgggcgtctcccagtgatatcaggaccactgtggtcttgttgctgggggctgctgggatcccctggcgctcaggtgcctggtgaaagacactaagccgccacgctgtccatgttagtgagctcccactgcgggcagcaccagcccctctttctgagcagtccc

SEQ ID NO: 11659 - DNA, 1114 bp, Homo sapiens
gcaagctcctcacaaatgggggttatcattgttactgctggagcaggtcggagggtatctgtatgccagaggcagtcacagtggtgggcgggctcagttgagaaatctgggctgtcaggtgaggtgcagatggaggccaagtcgtgggatggcacaaggacctctgggtcttttagaggtttccaaggactcctggagccagaaaggtgtggggagaggagggagcagtgggatcccaagatgtcaaggctaagattggtccccacagggctcagagggtgggtggaccccatactgccccaccccgaaggggatggcgtggaggctttgggtctccacaggggtcagggactgaggacaggttctgtgggggcaggaggggccaagcaggtgctctgcagcccctgagcctggccctgggctcgccagcagaagcaggaccggattgagggcttgaagcggcacatcgagaagcaccgctaccacgtgcgcatgctagagaccatcctgcgcatgctggacaatgactccatcctcgttgacgccatccgcaagatcaaggacgacgttgagtactatgttgactcatcccaggaccccgacttcgaggagaacgagtttctctacgatgacctggacctcgaggacattcgtgaggccctggggctgatcgtggcacaggaagtgagggcccagaatgggctgtgtgagccagctaagcatgcccttcttctgcccccacagcacaggcgctggtcgccacctcccctcccagccacagccacatggaggatgagatcttcaaccagtccagcagcacgcccacctcaaccacctccagctctcccatcccgcccagcccagccaactgtaccacggtgaggccccacgggacactagtaccttgtgtttccagcagggcaggactcgaggagacaaatctgggtcactccaaagtggctatgggagcgtaattgaggaaacacagatctaggtatccagggtctaggctcttggagcacacgctaaggtcctatatctgggtccctaaaggacataaagagcaatagggtgcatcccgcgccagtttaggtcctggatctgggaagtggga

SEQ ID NO: 11660 - DNA, 1153 bp, Homo sapiens
aaaatgtccctgcagagtgcttggatttagactctgagactgttccattctctagaacaagggtgacagtacccactgcctcgaggtctttgtgaagattaaatgctaggctgtgcatcctgtactcacgtgagaggtgctcaaaagccacagccctcgaggaaacgaaggctgtgcactcacacctggggctggggccccgttctggcagctggcttcggtggaacctctgcggccccctccgtttcctcctcgctgaagtggcatgataacatttcctacccaagaagaaccttgtgaggatggatgagagtgtgtgcgtgcagggcagctggcccggtgcctgacacatccacagccctaagaattgtcccctttgtctgttggtccggcccagatcccagaccacctcctcgtccactcactgaccgccttctcccccggccagggcacctacatctactttgactacgagaagtggggccagcggaagaaggaaggcttcacctttgagtaccgctacctggaggaccgggacctccagtgacaccggcccctccctctacccacccccttcccccgcatgctgatccccctgcccaggtgagggccctgccctggaagactggagggaggccccaagccacggggcatccccctctcccaggaagcagggagggggccgggaggttttcctctcagccccaccctgggggcccgggggcgagggctgccccctcctcccctccccagtgagggacattttttggtaaacctattttcattttggaaaatatttatgaataaatagttttatatgacggctggcagcagcggcctctcctgtaccccctcaggagtcagtgagtaaggtgagggtcctgctggcgggggcgccgggccagctgggggttgaattgggagttgtaccgccgccgccggtcatccgtctcgtcttcttccggctgaccctcctgtagtgcccggccttggacccgggccagcagggcctctgcccgagacctctcagctgcttccctccgcagacgttcagctcgaagctggtccagggatggaggcctgtggggagaggagtgaggtcagaaagctggtagcccctaggaggccattcccccaacctctcccatagagg

SEQ ID NO: 11661 - DNA, 1176 bp, Homo sapiens
ctgagtggggagggcctggggcctggtctcctggatctgagggaggagggaggtggggtctggtctcctggatctgagggaggagggaagtggggtctggactcctggatctgagggaggagggaggtggggtctggtctcctgggtctgagggaggagggactggggcctgatctcctgggtctgagggaggaaggggtggggtctggactcctgggtctgagggaggaggggctgggcctgcacttctcggtctgagggaggaggggctggggtcctggactcctggatctgggggcagtgggcactggggacctggactcgtaggtcctgactcccagcctcctcctcaggagcgcctggaccatgctgctgagcgcctactggcacggcctccacccgggctactacctgagcttcctgaccatcccgctgtgcctggctgccgagggccggctggagtcagccctgcgggggcggctgagcccagggggccagaaggcctgggactgggtgcactggttcctgaagatgcgcgcctatgactacatgtgcatgggcttcgtgctgctctccttggccgacacccttcggtactgggcctccatctacttctgtatccacttcctggccctggcagccctggggctggggctggctttaggtgggggcagccccagccggcggaaggcagcatcccagcccaccagccttgccccagagaagctccgggaggagtaagctgtcacgacgctccctctgccagctggtcccgggaattctgtgaaccaggctgctgtctcctccccagaaagagtccttaccttggagagggtcctggagagaatttcctcttccccagctaaataccctgcctgcaactgaagcagacccgggggtgtcctccctgccctctgcccagaggccacctccactcctacaaaatcaaagtattgtccagacaagagtcactggcccctgctccagcttctgggtatccagagagcactgcacttccccaaaacggaaggggcccctgggcagtgggttttgggcaaattccctttctttgcatccacaatgtggggtcggagcttgggggcaggtcctgggagtgggaagcctcttccttgtgtctttcgctccacttttagctcatcgcaccaatattgcaga

SEQ ID NO: 11662 - DNA, 1251 bp, Homo sapiens
ctctcagatgaggaggcaggtgtattttgccctcctgtcatctgcagtttactatgaatgatgacctgacaaccatagggtagtttggttttttgtattgttttgttttgtgacagggcctcactctgtcgcccaggctggagtgcagtggccccatctcaggtcactgcaacctccgcctcctgggttcaagcagttttccttcctcagcctcctgaatagctgggattacaggcagtgcgccaacggcctggctaatttttcgtaatcttagtggagacgggctttcgccatgttggccgggctggtctctcaaactcctgacctcaagtgatccgtctcggactcccgaagtgctgggattacaggtgtgagccaccactcccagcccgtagggtggttttgacagtgacatgggtcacggtgatggcgctgtactacttgtgcctcaccgccgcggcatggagctaccaagaggcggagccaggatttgaacccaagaagcctgaggtcagaaggcggaatcagtgtttcctcccactcttcccaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatatcaggtaccacctcggatgggcacctgaatcttcctccacctgcccctctgatggttgccctcactaagcctgctgtccctatctcctatgcagccctcggaggtgatgggtgtgaactcacccagagggtacagattcacccttgcacacagctcaccagggagctggggcagcctcttgccccaatagcccagcgcaagggtcactgcggctctagccgtacaccttgtgaaggcctctgccaggcatgtgggcagctggacaggtaacagctcttggtgtccccagtggagggagagaaccagcctcacctcgcttgggtggtgggttcagctgtctcctggctcgcttgtgaagttgattccagaccccgatccatgactgcgttctgggtactcagtgtgccctttctgtaatgtggcaccattgagggggaggagctgtacagaaagagggcaagatgtttgcgtttagaatcttcgccccagcccttcactaaccctgtgagccgtaggca

SEQ ID NO: 11663 - DNA, 1149 bp, Homo sapiens
ttgtgtgtcaatgctttcgtcggagacgtagcctcgggttgctgtgttattgtgggcattgctgctgcacgtggtaatacagctcagtgtcaggtgtggggttcacgatatttcagactcggaacttgggggctctcacatggccatctcatttgctttgtggtcttaggtgggatactttcagatttctcctataaaatggggttgagaaagtcatctgaagcatttttggggattaaggtgataccctaaaaccccggagggcgcacgtaggatcaggtgcacccttcctgcagcgccttggtgtctgcagccgtggcggcctcacggggtgggtggagaggaaagagtggtgcggtagctggggttagcgtccgtttctcctccagtccacctcaccttgtcgcttcttccagggtccgcaagcaggtggtgaacatcccgtccttcattgtccgcctggattcccagaagcacatcgacttctctctgcgctctccctacgggggtggccgcccgggccgcgtgaagaggaagaatgccaagaagggccagggtggggctggggctggagacgacgaggaggaggattaagtccacctgtccctcctgggctgctggattgtctcgttttcctgccaaataaacaggatcagcgctttacaattggtgtgtgggggtctctcatccttgactctttcccctgctctaaacatgcagccttccctgggaggctcactcacttgggagtgcctaccagctagtggtccctggcctctcagtactattctacagtagtgaacacacatctttaccagaaacttctgtcatcaggggagagacgagtggtatttttggaaaaactgtgtcaaaaccagaaggaaattccaagtaagccggtgtttgcatataggggtgggagggagccggtcattgctaggcagggcaggcgccgagtggaggtgggggccttccctgcctgctggccctgggaccctgaccccgccaggcaagagacaggtgggacgggagctgaccagaggctgacgggttgctggggaaggtgaactgttggtgattgttggggaacacttcacagaatttgcttgctagtttcaaagcttgtgatgcggttgatgttgggcaagt

SEQ ID NO: 11664 - DNA, 1179 bp, Homo sapiens
aggtccccgacgcgccacttccgcagaaggtactgaggctcccggctggggctgtgtgtgagggagggggaggcgtttcaggcctgaccctcctgcttcttcctgcagtgactcccactcagactccgacagctcctactcagggaatgagtgtcaccctgtgggccgcaggaacccgccccctaagggccggggcggtcgaggggcccatatggatcggggccgaggcagggcgcagcgtgggaagaggtgagactgtgtgagggctcgacacacgggccagggtggaggagggtactggggacccatgggagaaggaggaggagggccggacaggtggacagccagctgccaaaggggcgaggctgaaggggggctggagacgcctgtcgcgctcactgcccctcatcccttcctaggcacgatctggcgcccaccaagcgcagtcgaaagaagatggcggcgctggagtgtgaggacccggagcgagagctgaagaagcagaagcgggcagcccgcttccagcacggacactcccgccgcctgcgcctcgagcccctggtgctgcagatgagcagcctggagagcagtggggctgaccctgactggcaggagctgcagatcgtgggcacctgccctgacatcaccaagcactacctgcgcctcacctgtgcccccgacccgtccaccgtgcgccctgtggcagtaagtgcccagcagggcagttctgctctgtgaggccgtgctggctcaggacttggggagccaacccagggagggtggcagaggccacacgggggctctggtatggcaggggaagctcggccagagacgcctcggctggtcggcgttctgagaggagcgcaaaggcgctctgctgccctggagccccgcgtggcgggtgtgcagcttggccggcgaatcgcttgacctctgggccgtggttcctggcttaggtgacacggagcataaagccttctcccaggcccgtgggctgtggggcgtggggggctgtgcttccagtgtttggcgtagtcactgttctgctgcagaacctgtgaacagccatgtgcttatagggaaatgggtgtggaggtggccactcttaacccatgtcttgtgggtttgttttctctttttttgggagagagtctggctctgtcgcccaagctggagtgc

SEQ ID NO: 11665 - DNA, 1392 bp, Homo sapiens
ctcctggaactggagagattcgtgagtaggggcagtggggatgggggccagaggcgtccccagcctcacatccctaagtttggaccaagggagccacattgcccttcccagctggcccctggccttcccctgccctcctcagcctcactcagtttctgcactttccctgttcattccaggagcgcagggccctggaacgcaaggccgcagagctggaggaggagctgaaggtgggggctgtgggggctgtgggcagagggccgagggtgggtgggggtgcaacccgccagggctgcccagctgacccttgccgtcccccaggccctgtctgacctccgcgctgacaaccagcgcctcaaggatgagaatgcagcgttgatccgcgtcatcagcaaactctccaagtgacccggagggactttcccgcacccgtatttatacagctgcttctgccacacgcaccccttcccccgtgtgaacacgagtgacagggctccgggggaagtctcagagaagccatagcccccctgggacctccggactgggaggggagcagagtccccaggagccgagggggccacccgaggccaggatggaggtgggaggccgagccaagcagggggacgttgccagaggggaccagggccagagacgggaccaggaaggaactgaggaccaagaagtgcaaggatcagtagccaggaccagagtggccgcctggaggtccccatctcacgtgtgatgccaccccgtcacccctcccctcctgagcagggatccaagaatgtgccaagagtcccgccagcctcagccaggtgggcctgtatatagggtccatgtgcaatagggagggacgtcttctattttttgctgccccctccccgcccactgtctggggcagggggagaaggtattttcgagataaagcacaggcaccacaaataaaagtcgtgaagttgccactcaagctctgtgttcccagccagagggagggcactgtttcctgctcctgctggggggccgtgcgtgtccatgaccaaaccactgggccacttgggtgggtgccgggggatgggctggtgcttactcacctgtgtggtgaaggagcttcaggatgagcccccagcgggagcgaaggctccaagacggagcccgcgtgatcgcaggcggggggctgaggggaagctgatggggcaggagggatcagcgggcaagacctctggggccaaggatgtggagctggggagtttgggttttgccatcagtgtctttgaaacaaatttagtcaattgccaacatttaacatttggagaaatttgtgtgtaaaaatctggaattttggccgggtgtggtggctcacgcctgtaatcccagcactttgggaggccgagg

SEQ ID NO: 11666 - DNA, 1271 bp, Homo sapiens
tatgtgagtttgaccgtgatccttaaatagcagcacagacccatttgcaaaccgtggattgatgtggccccagcggagcaggggagacggagatgcagggggggtgttgtgtgcttggtggagggactgggttctgcaggctgggacggccttcccggtcctggacccccagtcagtgtttttctgcccgcctgtgcctctaggtcccagccgtcggttcaagcgagtggtggagaccatccaggcacagctcctgagcactcatgaccagccctccgtgcaggccctggcaggtgggtggtggggccgtgggtggtggggggcgtgggtggcgggggccgtgggtggcggggggcgtgggtggcggggggcgtgggtggcggggggcgtgggtggcgggggcggtgggtggcgggcagaggtccagcatgagcaggtgctctggggtttggtttgcagaggacgcccagctggtgggctccttcaccattgtcgtagctgaggtcttatctgcagagttgtgagcaggttccccgagaggctggggcctgaggagggtctccttagcaacctgaggactggctcccaggagtccctaagaagatgacaggctctgtgttgggggtcagggaacatcctgccaacagaggttctggacctctgtccaggaggacggtgacccaccgtcctggtttgcttgggactgaagggtgtttctgggatgcagggctttgagtctaaacccaggacaaattggtcaccatctttgcaggtctcacaagtcacctcaccctggggctagggcctaatggtccctagcaaccagaattctaagctgagttcatgggaatgtgcaagatcttgctctggggaatccggccttcccgggctcccagtcctggtcatcaaagactcaaattctctagcaatcaggagagcagagggtttgttgcaaaggtgtcttagttcgttcaggctactataagaaaataccatacactgggcaacttacaaataacagaaatttattgctgacaattctggaggctgggaagtccaagatcaagctgccagcagcgttggtgcctggtgagagctgcttcctgggtcacagacagcacgttggtgctgtgtcttcacatggcagaaggggcaagggaactctctggggcctctttcctaaggacactaatcccattcatgaaggccccaccctcatgacctcatcacctcctaacataacctcctaataccatcaccttgggattggg

SEQ ID NO: 11667 - DNA, 2952 bp, Homo sapiens
ccaaaggcagggccagagcacacacagattgggctgtggagtgaggcaggcctcagagaagcgggggcggcccgcagcaggcagagctcggacctcagctgccaaggcacagtctggcggggggcaggcagctcaggaggggatgggcttgggtgtggcagaggaggtggggcttggcacggggccacagaggctggagggagtggtcaccactgctggcactgcacgctgccagaaggtcaggttagatcatcgtcctgcagggaggggtggaaaccagccagtgggtggattgtccaggggctacaggcaaaggacaggccctcggcaaggcagccgcctcggaatgccacttttaggggctcagctgttgccccattccaggagaggacgctccgggccagggtgcccggccaggtgtggggagtgggtgagccctcccctgtgccctgggccagggcgctgagtgggcttggccctcagtttgtgcctgcagatgggaacgcagcctgcgtgaaggtgctccgggacattgagcctggggacgaggtgacatgcttctacggcgagggcttcttcggcgagaagaatgagcactgtgaatgccacacctgtgagaggtgggaccgggcgagaggcggctgggttcgggtcgtctgggcttcttgagcccagaaacgcaccctcgggacccatccctgagtgtgtccaaccccagcctctcatctcccttccacccggcctcatctccccttcacccggtctcccaggaaaggtgaaggagctttccgaaccaggcctagggagcccgcgttgccaccacggcccctggacaagtaccagctgcgtgagaccaagcggcggctgcagcaaggcctggacagtggcagccgacagggcctgctgggccctcgggcctgcgtgcacccatccccgctgcgccgggacccattctgcggtgagcacccctccctgccatcccagcagcccctcccctgtctgctcctggtcatctgtctcctttcttctgagctctctgcctagcctggaaccctccctcccaccctcagtcgctggcaggcctcgctgttgagcagttcggccgcatcattcctctggggagcgcagggcagggctgcctccttgtccagaggaggaccggcccagcttgcactgacttcacctctcctttgttcctcctctccctgccacctgggccttcacagccgcctgccagcccctgcgcctgccagcctgcagcgcccgcccagacacctcacccctctggctccagtggctgcctcagccccagccccgagtgcggccccggaagcgccgacgcccccggccccggagggccccagtgctctccacccaccacgctgcccgcgtctccctgcaccgatggggaggctgtggcccccactgccgcctgcgaggagaggccctggtggccctgggccagcccccccacgcccgctgggcccctcagcaggactggcactgggcccggcgctatgggctgccttacgtggtgcgtgtggaccttcgtcgcctggccccagccccaccagctaccccagcccctgctgggaccccaggccccatcctgatcccgaagcaggccctcgccttcgcccccttctccccacccaagcgcctacggctggtggtcagccacggctccatcgacctggatgtcggcggtgaagagctgtgacaggccggacggggaggcccagcagggagagagggtctctctcctagctgctacccaggacctccagaaggagcccttggacctctgggagggagctgacccttgactccagcatagctctgaccctggaatggggttggtttggacacccccagggatctgagccctgaccctttgtgactgctgacccctgagccacccccactcccacagggagccccggccatttgctgccctccccacccctgccccagcctcaggactgcaggagccatccgcccccctcagccccttcctccccagggagcaaagccataaggggcaggggccaccccacggcatctccccagaagtacaggcctcaggaggaggtggaactgatgtagggggtggcactccccagagactgccctcacgaggggactgggttcgctctcagctctgcagctgtctgcggtggggggaaggttggggggtgtctggaggcatgttcccctcaccaccccccgtgggtctcagggaggccgggtgtgacctcatctttctcatggtgctatcctggtgctattggggtggggagctccctcccctcccccacaccagaaaggggtatgttgggggcttggaagcacttgaactttttattttattaaaaccttgttataagcagcacccttggcggttttttgttttggcttatgttttgaagggatgtgaggagggtgagaccctcagctgtgctgatgagagggggaggaggcaacacaggccttcagccctgagagctgtcgggagagggatttgggagcgtgatggactaggggactgaggctggagccccatccccactcaggctgtgcttgtaaaaatgccttgagacccatactctcctaggagtgggtcctcccattttccaggcgaggtcaacatcgtttagcaagcagagtgacttgccaaggccacgtggggacttgagggcccttctcccttctcgcgcttctcaatgagatgcccctcccacatctcactccaaacggagagagactgctgggggcctggctgagtgagggtgtgggggctgcccaggacaccagagccgagcctgggggaggcggcgctgacaggaccttcctcagctgtggcatcttgggctttgccgtgtgtgagaccaggaagatgaatcttgtttcttcaggtccgctccaggatctggattttgccagggcgtctta

SEQ ID NO: 11668 - DNA, 1342 bp, Homo sapiens
cattcaccagttcattcataaaacaaatgtttgttgagcgcccatcatatgccaatcacagtgacaagtgctgggtgagcaatactggagagataacgctgaggtatgggtcccaggacctctcgaattggagccactcggaaatccagcggtagagtttcgaaaacttccgaacggttcccggaatacgctctcggccctctaaccgaagagttccgaatattcccgagcgttgagcgaattttcggcggaagcagccgaacatcatcgagccgcctcggaggtggggaccgacaactcctgtcgtgcccgcccggagaggaagcggaaatgcgtgtacggtattaaaggcgtcgcctcgcccctcgccttcctctttccgtctcaggtcgccgctgcgaagggaggtgagcgttcgtcttcctcgcgtggtcgccatctccggcccgccgcgcactccctctcagtcctctgcctgccttctccccttgcgcctcaagggtcattggcggaccccaacccctccccgtgaagtcgttgtgaattttcaagttattttcccctcactctcattcgccgcagctagtctcggctgcctgaattcggtcccgccgccttaggtcactcagtcccgcctgacaagagttctaggtcgctgtctgccctcaggggtctcccattcacccaagttcccagtcgctctcttcctctgctgtccgagcgtggcccgtggcctaacgctgctttagttctctgtgtctgacgctttccctgtgcccgtttccccgcagccgccgccatgtctgcgcatctgcaatggatggtcgtgcggaactgctccagtttcctgatcaagaggaataagcagacctacagcactgtaagtggggcccggatgcgtggctcctgcgggaggagggtcctgagtctcttgactctgggtcagagggcgggaccttcgcatgtctccgggtcccttattcacgatgccttgtgccgcctccttcccaggagcccaataacttgaaggcccgcaattccttccgctacaacggactgattcaccgcaagactgtgggcgtggagccggcagccgacggcaaaggtgtcgtggtggtcattaagcggagatccggtgagttttgtctggtttgggccagagagcggcccctttcccgggtctgggagctgtgattttttactgtcaggcaggaagagcggtaactgccatcgcggcgggcatccctggcgccagggtgttggtctgggtaccggcttccctctcggccgacttgtcagctctgtgagccgcgcgcgtctgagcccgtgtcctcacctgtaa

SEQ ID NO: 11669 - DNA, 1203 bp, Homo sapiens
ccgcccttcctgcctcctggcgcctgttgctccccacactctgccgccccccgcccgccctccccagcctctctgcccacccatctctacgtttctcaccctctgaccgtttctctcccgcccagcgctccaacctctgctctcgttctccccgcagcctggcggcccagtgcgaccccctgcaagccccatgccggccctcctgctcctcgtactcctggcctctagcgccggccaggccagggcgcgcccgtccaacgccacgagcgccgagcccgcgggcccgctgcccgccctgctggcgcacctgcggcgcctgaccggggcgctgacgggcggcgggggcgcggcgagcccaggcgccaacggcaccaggaccggccccgcgggcggggcgggcgcggcggcccgggcgccccctcccgccgagctctgccacggctactacgatgtcatgggccagtacgacgccaccttcaactgcagcaccggctcctaccgcttctgctgtggcacctgccactaccgcttctgctgtgagcaccgtcacatgcgcctggcgcaggcctcctgctccaactacgacacgccgcgctgggccaccacgccgccgccgctagctgggggcgccgggggcgctgggggtgcgggcggggggccagggcccggccaggccgggtggttggaagggggccggactgggggtgccgggggccgcgggggcgagggccccgggggcagcacagcctacgtcgtgtgcggggtcatcagcttcgccctggccgtgggcgtcggcgccaaagtggccttcagcaaggcgtcccgtgcgccccgggcgcaccgggatatcaacgtgcccaggtgcgtgtgctctcgggcgggaggactgcgagcctggggcggggcccagcaagggaggtggagccatccgaggaggaggggctgcagggatagggcgtggtggtcagagacccaggtggcggccgccggcgtagctgaaggtgggcaggggctgagaaagtcgcgccagagccggcccggctgttgcggagtgatgcagggagagggagaagcccagactctcattcattcgacacatatttcttgagcaccttctgtgggccaggagctggggatacaccagtgaacaaaacaaggtctctgccctggtggaaaagcctgacttccaaatccaagttcaca

SEQ ID NO: 11670 - DNA, 1136 bp, Homo sapiens
agcctgggtgagagtgaggggtggatgcccagatggggctaggcagaaggaagggggaaggcaggaaagcaagaagaggtggaggtggggcccctgggcccaggaggagacccctgaggcagtggtctgaagtgggggtctgggttggtttattttcccaggggctgccaggaagggagtggacaggttgggggctcctggagagggctgtagagccgtcgtggaggggcctctggcttgtcctgggttctgggctgggttgtgattggcctcatggggagctggtcccccaaccctcggggatcccctgagaatcccaggcacgaggcacctcccagcagtccacccaaccccagtcgggagccacgagatcagcctcttcccccagggcatgctggggaaggggcagggggccgcagaaatgtgggacctgcctcaggtccagctggcccaggtcgcgatgggacagacccggcgctggcaggggagcatcagaaccagaggaggggtcccatggcattgaggcacactctggggtgagcgcaatgttgtcaaagaggtcgagggtagaggtgtccagggcagcgagactcaggctggcgctggcatggggagcctcagtgggggccacagcacaggccactcccaggaagggggatggaggcggtgggggtggcttttggagcgagggtctctggggaggtgcctcctgggacaggatggagagggccaggcgctgggtggcagcctcaatcttggtgaactgcctgtaaagacagatgtgagcaggctggtctctaacgcctgaactcaagcgatcctcctgcctcggcctttcaaggtgctgggattgcaggcttgagccaccacccccggccagcatatttgcaagggtcacctatgtggtcgcatcacaccgtgctagttatttattttggtgattcctgaccgtccgccacccccatgaaaacacaacctccacgacagcaaggaactttatctgctttgctaactggcctggcacacagtaggcactcaataaatgcacgttgactgttgctggcatccagccctgggggctgctcctctctgtctgtacctggtctcccccagccaagggtgctggttgctccttc

SEQ ID NO: 11671 - DNA, 1112 bp, Homo sapiens
aggtccctggaatgagtgtgggtagccgtaagtccccaagacatggggactttgcagtgagcaatgggtctccacaagtacctctcatcttgagagccctaatactaaaagatgggcacccacccccaccaagggaagactgccccattccctgagagccatcattcctaacgaccttgatctggagaatgtggagggagcatgtccctgaattttcctagatccctccaaatgccacccaccagagtcactggtgaccccagaaaatggatatagccgaaatctgcctttcccctttttcattccctgtgctgaaagagggaccagggtagatgccccctgccctcgaatcccccctccccgactgtggaatggatcgaccctaacgatcttccccgccccaaacactagaatagactggcctgaaatccccttgcccagtagaatggactgatctatgtgcacacacccccatcacatggaatgggctggtctaggctgtggcctgccaccttccttagagtgaatagggcggacactcctctcttttcctgtagcgtgtggaccggtccacgcaattctttatcctgtgaactcatctgagtgggaggtggtggacactggggtttccttccctctctccgtagcatccgttggtctttctctccatctctgttggtttgtctgtctctgtcttcctcccaatccctaggggaagggggcatttggctagggggtgcccctgtgagcctcgaccttgccccctcgtccctctccccagtgtttccaggacccccaataaaccttgtcctgtcagtcgctgatgcctcattttctgatccttggctccaggcgggggggatggggaatctcttaggacagactccctaaatagagacgggtcctcgttttctcctgagaagtttcaaagctttgaatagtacatgcccttttaaattagagtcggtttaggctgggcttggtggctcacgcttgtaatcccagcacttggggaggccgaggcagataacctgaggtcaggagttcaagaccgtgcctggccaacatggggaaaccctgtttctactaaaaatacaaaaattagccgggtg

SEQ ID NO: 11672 - DNA, 1139 bp, Homo sapiens
gctctggagggggctgactggccagggaggcaaacacaggccataaggatgcagggaatagggggtgatttagggcgctatggggagggagggcaagagtgtttggggaaagaagcccctgactagcttgtctccactagagcacaggttaatcgtagctgtcactgactggacatctcctagaggcccgccacggttctaagcacgttacacatattaattcactgactccccacaactctaaataggggcagctgttcccgccgttggataaattagaaaactaaggcatggagaggcaaagtgagttgccatggtcacggagtaggagtctggatcaatgggcttgaaccccattcccacccttgcccccacagcagtgtttcactgggctgttccccgagtgaacaaaggtgaggggagaactatcaggataagagctttatttagggatgtcttctgggttatgaggggtgtctatacaaggggcctggtgggagagggtggtggttactttctcttctgcctacagtgttcttcgccagatttcaacaagactccctctggagcctccttgggtctctactcagcactccccaccccatcactctccagtccctcatccagccgcaggtgtttcattatagttattgccaccaactcatgtcattccttttctgtgtgtttactgtttggcccctctctaggaaagcaaggacttggcctgtcttgctcgcccctgtgaccccagcacttagcgtagcactggcccagtgtgggtgcttgacaaatatctgctggtatgtgaaaaggaaacaccaccttcctaaattaccaatgggtccacaaagaaatcatacattagaaaatgctggccaggtgcggtggcccacacctgtaatcccggcactttgggaggccaaggcaggaggatcacctgaggttaggagttcgacaccagtctggcctacatggcgaaaccccgtctctactaaaaatacaaaaattagccaggcttggtggtgggcgcctgtaatcccagctacttgggaggctgaggcaggagaatcgcttgaactcgggaggtggaggttgcagtgagctgagatcgtgccactgcactccagcctgggcaacaa

SEQ ID NO: 11673 - DNA, 1164 bp, Homo sapiens
ccacgaccgctccccctcccacccgcgggacaaagggcgggggcggggggggcgcacccccacgcgtgacctttccccgtactgcgcacgcgcccagcccccaccaccgggggacggtccgcccgcccacgcgagtgcgggggaggggtgtgggggccccgaaggtagaggaggcagcgcgcacgggctggacctcctcctaccctgggaagttggggcagtttccccctgcacctgcctcttccttaggcctggcagtggcccgcgatgagagagggtccttccccttcaggctaggtgtccctggtcaggcgaccccttggggcacccagcaatttagggcttcagcttccttttccttcgatacccaggagcccacgtccccagctcacttctcccccaggacctaggcggctgggccccctgcccctgactccaggagcccaggagtttgaagcccaggcgcgttttgcctcagtcctggggtccaggctccctcctccctcagaccaggggtccaggccagaaggtccctcctgtctcacttcacctcccccaggatggaccctccagtccatctgcgtctctccatttgtggctgccgtttctgtccagtgcccctgaggccctcggctgctggggtccgtaggaagccgcgccatgaatgaccggagcagtcggaggcggacaagtgaggaagctgggtccccttccctaccctgggtcccagtgcggtcggctccaggctgccgtggttggggggtggcctgagaggcccggggaattctctggggtaacccggggcctctcctctccagtgaaggacgatgagaccttcgagatctccattcccttcgatgaggcaccccacctagacccacagatcttttacagtctgagcccctctcggagaaacttcgagggtgagctgagggggtgtggagggactggagtcagctgggaagccaagccctgagtcccagggtgtgacctggtccccccaccctcgctgtgtccctagagcctccggaggctgcgtcctccgccctggctctgatgaacagcgtcaagacccagctgcacatggctctggagaggaactcctggctgcagaagcgcatcgaggacctggaggaagagagggacttcctgcggtgccagctg

SEQ ID NO: 11674 - DNA, 1194 bp, Homo sapiens
gaggctctcagatggtgcttcaccggttctcccggggtttcccttttggtgctggtagggcagtccctgagacctggcacggctcctgggttggcggagctgctcccataagatgaccacaatacagtgttttgagcaaacgaagctctcattgtttttacctgtccagcatcagtgtgtgggagagggttcttgccataggggaagctctgcccgcgtgtcactgcctgtagtctttgtctctgcggaggacgggccagcttctgtacgtgtcgccttctgcttcagtcctttcctctgctacctgtatctacagggaatttccttgtctatatcccaggcacccagcgggcatcattgctttctctgcgtgggttcctgtctgcctgcttgcctgtttcagagccttagcagcagaaagggctcttggggctcacagcctgtccatcttataagcgaggagctgtgcccagtgccgtgcctgtgtgcccgctgctctacactgctggcctgtcctgccgattgttcctcccaatttcagtttttgattttggggtttttggccttcaaggggacaattatattgtcattaatggttctagccagacctgagtgttctgcctgatccacattcgagagtatggcctcgtgcttaactcactgatgtcagagtgtttaaattctggtgtcaccatttcctagctgtttgaccttggtaattgtgatctctctataccttagtttccttacccattatgtcagcccccagcagtgtttttccgaagcagtagtgaggattaagaacaaacaaaacaatttagtacagattccggttgtaggaagcatctcaatatttgttgctgtttttttccctgctgggtgcatatttttctgagtgttggtggttttggaattgtgatgcttttccagacattcacattgcatcgcaaaaacgtgagacaaaacactgtgggtgaggctgaagtttaacatcctccctcagtgccctttcctcctcttgtccccagggatgatcactccaggagatgcgtgttaacatatataagcaccttaacgtgtgcatctgttttgtgtgtgtgcttcatggctagctgagaaatctgggtgtctttgaattaaggaaatggtgtggcggtgctcatgaacccccccgcccccccatgctcatggttt

SEQ ID NO: 11675 - DNA, 1158 bp, Homo sapiens
ctcttttctcctcccctcccgtccctgcccctcctccctacactcctcctctcctgcccctgcactcttgacttcctcctcctcgctcgtctctgtcctgctctccctttctgtcctttgctcgtctctgcccctgcctgccacttcctttctactttcctgccacttttctgtctgtctccactgggtggcccttcctgtgtgctctgtctcttcatctcttgtgtttcgtgtttttcttcattttgtgttgtcatcatgccctctgccttttcttgaacaatcttctcctttcccctgattttttggggcccctgtggctgtcccccaacgcctgtccatcgcctgcccttggccgtctcttgctactgcttcctccccattttctctcttgcttctgttcttactattgacttctacacccccacccatattccactgttccttccccccctcctccctcccctcatccctctccccttacccccaaacccctctgtgtctccctctctcacccttcccctcctctctccacctcccttcccccgcccccccccttgtctcctattccctctgcaggaggccatgatggatttcttcaacgcccagatgcgcctgggggggctgacccaggcccctggcaacccagtgttggctgtgcagattaaccaggacaagaattttgcctttttggaggtgagctgggggagtgagtgaggtccaggaaacgtgtgtgatgtgagggcccagcccttaggctgatgttgtgtggagctgccttgtgctgtttccaccaggccctctgcagcctcttctccacccggtcgctgaagtgagccctgttatagcattacagatctgatcctactttctgccttccatttgctttctgtgtgacctgagaggcctgtttggcctctgtagacctctttggccttttccagaccattccggcccagtcctctctgcactctggccacactgaccttcccagaacctaccatgctcctgcctgcttggctagagttctttacaccagctaactgatgttcctaactagtcttctgttaccccagctaactgatgttcctaactagtcttctgtgtctgtgtttctcaactgtcgggaaaaggccttggtttttgattttcgactct

SEQ ID NO: 11676 - DNA, 1177 bp, Homo sapiens
ttttccaggctcttaatcccctttgccttcccctcttcccccaccaatgccccggcttgggggtaggtgtcgggctcctggtccctgaccccacctctccccgcaccccccgacccctcatcctccaaacacaggccattgcggggctgaacggcatgcagctgggggataagaagctgctggtccagagggcgagtgtgggagccaagaatgccacgctggtgagccccccggcacgtcatcttccattggcttgagggaccctgggggtgggaggggctggctagtaggggacaagtgttcctgatctttctcccagctttcatgggaaggcatttggggggcattcagtgcagtgttggggagtcgggctttaggtgttggaagtggagagatggcctttcccctgggggggcatgtgaggggcctaggcttgagcagagggagactgggtctgggccccctgtgacgccgctgcctcccctggccccacagagcaccatcaatcagacgcctgtgaccctgcaagtgccgggcttgatgagctcccaggtgcagatgggcggccacccgactgaggtcctgtgcctcatgaacatggtgctgcctgaggagctgctggacgacgaggagtatgaggagatcgtggaggacgtgcgggacgagtgcagcaagtacgggcttgtcaagtccatcgagatcccccggcctgtggacggcgtcgaggtgcccggctgcggaaaggtcaggaggcctcgggctcagtgctctctcaccctctgcccctcctcttctccgcgccctctttcttcctctcttgctccctcaccctctccccctcctcttctccgcgcgctctttcttcctctctctctcctctcgcagcgcgtgcgtataggtgtatgccatcactgagtgccgccctcaggccgggccatgggagatgttggtgaccctgaggggtttgtggccctgtgggggcccaagacctgcaggcgagacagtagttggggaatgtagctctgtatcgctgtagaacttggccctgctcccccttatatggcctggcttgtgcaaatggttttgcctggtctgtggagtggggaagagtgccgggaacagtcccgagacacctgctggtgtctcctgtgtgccaggcaccctgccgaagctgtgt

SEQ ID NO: 11677 - DNA, 1310 bp, Homo sapiens
ctgcctctcctttccccacagatctttgtggagttcacctctgtgtttgactgccagaaagccatgcagggcctgacgggccgcaagttcgccaacagagtggttgtcacaaaatactgtgaccccgactcttatcaccgccgggacttctggtagaggcggctgggggagggtgggggcagggctggctgggggcttctccccactcccgccccccccttatccccctctgaagacgatgggcagaggagtgacagccgcagacacacgacagccggcagcaactggaatggcagcaattaagggtggggggcgggggttggggggttggggggttagggcagggaggggactggggaagtgcgcacacagcccacacagacaacacgcacccacacagacacagagggaaggggttgggatggggacagggtgcacagcagggcggggtaggaccccagcccctcccaaaacagcctctccttctcccatagacccctttcttctccccttccccacggtaggaacatagcgtgtttatattttatggccaaactattttgaattttgttgtccggccctcagtgccctgccctctcccttaccaggaccacagctctgttccttcggcctctggtcctctctggtcccctcctgggtttcttacgtagttgatttttcctctttagtctcccccgacctgcgcccagccccgtggcccctgcccctctcctactctctgtggcagtttcatatttgctaagacgaatttgctcattaaacattttgttgtattttactttatggagcggctgtgtgtccagtatgtccgaccctcttcctcggttctgggctcgggtgggggttcccttggcaaactgcgggcccctggctgggacgcccctgctgccggcgccggcagcctcgaggccttccctgcttgcgcggtgcccttctcggggtcggcacaggcacagccccgggggacgtgaggttcccgagtgctctcccaccccgccgacaggagggatggtggccgagcgggccggggcgggcgtggcgtgggtgtgccaggagctccgcggttgccgccaagcgagctggagctgactctcggcgttccgtgagcaccgcgcggatcccccgctgcagcgggcggaagtgacgtagaggcgcctagcaacggggcccagcgcgccggaagtgatgccttccaggttggcttggctgcggaagcgactcctgccagggcggggtgcggcacgggagggcggggagcgcggcaatttccgcttccggtccgtcgcctc

SEQ ID NO: 11678 - DNA, 1310 bp, Homo sapiens; identical to SEQ ID NO: 11677

SEQ ID NO: 11679 - DNA, 1881 bp, Homo sapiens
tctgtgctgtctgtccacttggaagctccctctggggctgtgtactcaaggagcgtctgagggcaggctcctctgagcctggaggcacctgtgaacacgcccccgctgccttcccccgcgggcctatagaccctggacggccccaccctgaagcagttgctgccctctggttgtcagagggtgacacctgcttctgtcatccctcttgtgtttgctcactggaatcagacccaccttatgggaatctgggctgacgtgaggttttggcctgggcaagcgatgcttccgctctgcacctcagttcctccttcccgaggcctctgggcaccgggctctttgaagcgccccctatgatggcctatactgctcccgggttggagcctcactgctgtctgccctgtctgagcccctctcccggatccttccaggagagctggagctgctggcaggagaggtgccggcccgaagccctggggcgtttgacatgagtggggtcaggggatctctggctgaggctgtgggcagccccccacctgcagccacaccaactcccacgccccccacccggaagacgccggagtcattcctggggcccaatgcagccctcgtcgacctggactcgctggtgagccggccgggccccacgccgcctggagccaaggcctccaaccccttcctgccaggcggtgagtgtgggcccatcacctgctcaagtccttcctgtgggttccaccagaggaggtgcctcacggggcagggacacttcgccctttgcctgcacatgctggatggacacaggtgggctgcgccactgactccactccgtgtctctggtttactcttcctgcaggaggcccagccactggcccttccgtcaccaaccccttccagcccgcgcctcccgcgacgctcaccctgaaccagctccgtctcagtcctgtgcctcccgtccctggagcgccacccacgtacatctctccccttggcgggggccctggcctgccccccatgatgcccccgggccccccggcccccaacactaatcccttcctcctataatccagggcggaagggggcctggctccatccggctgccccattccggctccctgggagatcagtgttgtgagtgcatgtgaaatgggggatccccacccccagtgcccttccccttcctggggcccactcacactacaccctcttcctttcccaccccacctccccggagagaaactggacatggggcctggggaggggagctggccagaggaggacccctttcccgtggcattagaagggggaggggtggctggggcccccacccattccccctccctccaaactcccaacccccagtcagtgtttgagcctcctcgttcccctcacgcacccgctcacgcaccctcggtgaatccttggtgatgattttggcaactttgggaataaatggcaattcccacgggcttggcactcccagattcccatctgtgatttcgtgtgtcccccagagccccttcatccagggacccagggctcaggtcacatctctttctcgggggtggctggcaaccagcccctctgtctcagaagccctgatttccctgaccctcccaggtcaagggatggctgggttgagggtggactgtgcgaggcctggcggagctgtagcccacacaggtccaggtggtcgggaggccactcatggccagacgcttccggtgcaggaggccttgctcttgtgttgaggggacaccaggatgaggtcagagagtgcactggggttcagggaggagaagaatcctgagagatggcacatgtgcaacacaggtcaccgtcgccatcgcccgggcccaccgcaagcatcactaatccatccctgca

SEQ ID NO: 11680 - DNA, 1286 bp, Homo sapiens
ttgcactccagcctgggcaacagagtgagactttgtcttgaaaaaaataaaaaataggctgggcgtagtggctcaagcctgtaatcccagcactttgagaggccgaggcaggcggatcacctgaggtcaggagtttgagaccagccttaccaacatggagaaaccccgtctctactaaaaatacaaaattagctgggcacagtggcacgtgcctgtaatcccagctattcgggaggctgaggaagggagaatagcttgaacctgggaggtggaggttgcagtgagccgagatcacaccattgcactccagcatgggcaacaagagcaaaactccatctcaaaaaaaattaattaaaaaataaagataccttcaatcacaccagacactttccccgcctccgctatcattcctctctcaagccaacagataccacgtggtctaagctgttcacaggagtggacaaaacagtggcccgtcaggaaggaataaaggaaactccagttaatgctgctgaaccttctcccgctgttccactttcctcgagagaggcagactctctctattccccgcctcttgcaggttggtaaagtgtcatctcaccgccgcgtgctgtgagagtctgtcctgtgtgatctcgaggagcagacacctgaagagcctggatctcacggacaatgccctgggtgacggtggggttgctgcgctgtgcgagggactgaagcaaaagaacagtgttctggcgagactcgggtaacttcctggggcgcctctttgcgggccgggctgggaggaggtgggggaccccagcatgaggttgcttgaacagggatgatgatgatctggtttccatgagtccctcaagttagatggagtgcaaccttcgcagcaccacagatctgggtataagttccagctcggctcctatggatgagacggatgaagtggcaaatgcttgggaacaaggtctggaggtagaaaaccctcaactgccgattgaacgacccctgcgtgctagtcctggtgctaaatggcggaagtatggaagtgaaaagacctttgtgttgtagtgtgaacagtctagagacaaagacgggcagaaagcaagtgattacctgagtggtccttaaaacttcagtgagcatcagagccagccaggggcttaagacagagctccaatatagtggactatggttcagccatgaaaagaaaagtgctgaggctgggcacaggggctcacgcctgtaacaccagcactttgggaggccaaggtgggcagatcacttga

SEQ ID NO: 11681 - DNA, 1412 bp, Homo sapiens
acatatactctcctcttatcttgttcattcttgtttctgtgcacaggtttatgattataactgtgtcaaaatgtatattcaaaatagctgttacattacctttgtggaattatggttaaatactttcactttaattttttcaaatgttccctataataatgtcctgataacagtgtattatgtgtgtctccattggtgtgcataatacatacccagaggaaaaattagaaaataaagtaaattattttaaaaaattacctatattcccaacacctaacaactactgctaacatcttgatctgtttcctctatcttgtttcagtgcacacgcttgtgataacagtgttaaatatgtgtgcataaagtcttaaatgaaaagatgtggaaaataactaaaatagtgttgtcattgtgggaatttggttaaatattttgtctcaaattccttaaataatctttggtgttttggtaataaattttatgtatgtattttccattacaaatataatacatactcatacaaaactttggaaattcagtaaagaaaattcacacatattcccaacacccaacaacaattaactgttaacatcttgatctgtgcactagtctgtgattattagggtgttagtgataagtatgcataaatgtcaaagatgggaagaaagatgaaaaacaagaaatagttgtgtggttgttgtgggattatggttattttgtttcggtttccttgaaaggtcatcattctagtgttttggtagtccacctttactacatatatttccattatatatgaaatgtgttcattatagaaactttgaagttacagaaatgtagaagagaaactcacccatgttttcaccatccaaagagtgtggttaacatcttgatatattttcttcatcttgtttctgtgcacaggtttttggtttgttaatatggttgtggtcattctatctgtaatagtgtcaacaataaaaataaagttaaaaataaatatttctcagtctcttttgtctgttttgtttttggggctttaaatatgttattttgttagagttataaatccaaaagcttagttcctcctttagcctaaaaagtttggtttgcaaatcttactctatttttaagtattatctatttcaacaattacttctaagggatttttaaatactgtttgatttcacatttgtaactgcccttatgaaactaaaacatatgttccaacaatttttttaaagttgataatgaccgcaagtacatcttagttacttgagtgggcatttttaattggaaatgtgagattgtctcaaacataaaaaatcacagacaataataaacccttaacataaaagtgttgatactatgttatagaatctcaagtgtttattcctgactcttgcctgaggtta

SEQ ID NO: 11682 - DNA, 1851 bp, Homo sapiens
agtgctcaggctacatcgaacgtgccagcaccagcacaggtggtgccaatcaagctgatgagaagtacttcaaatgtgacgtctgtgggcagctcttcaatgaccgcctgtccctcgccagacaccagaatacccacactggctgagggcatggggtaaaggttagaaaaccttcacctaggacttgacccttaccaaaccacagagaatccaaaccaatccatgataatgtcagtaggagacttaaccttagtgtgttacacacctgacttaacatctctaaactcagattgaaaagagaccgaatgtgcagattccacagtcttaagctttccccttcagatgtcagtgtctgcatgtgggaaagccatagcacacatcttacctttccaagtaatcagattgagaaaaccctatgagtattccagactacagagtttgcccaaatcaactgtaaatgacacttgtgtaacgtatatatagtgtttcatgaggtgtatataaaatagcaaattatgacagaacagtgatcacatatatttggatttatatgatatacagttacagtttactctgcagaggtaccttacctggtattctttgaattttttttttttttggaggaggaagagagcaacaaatttgattatatttttaagtgtcttagatcctgagaaagatttattgtgcattatttgaaccctgtcaatatctttttgagtaattgttttgtttcttacccttaaatagtcttgtgaagctgtaggcatgatagataacatggcttttactccttactgtttgaaaagataagtactttagcttctttctgcagccatttcatctgcgccaacactttggaacctaatactgtgtaaggctttacaatatacggattggctttttgtgacccagattgattggttgccacatgttatgtttgttgaagtggttctcatgcaaaaatattacacatttgtgttctgggttttttttttttttaaccaactcaatatgtgtttgatgatagtgaattgataaaacccgaagcttttccctgtaaatcttacatctttgcctttaaagaatgggttacaaccatcactagatcacagtagtgcctaatgaaggttgagaaccgtaggagaggctctcatgctgtaaataatgttgcaggctaataacctttcatcacttcctttgtgcgcttcctgccttaagtgacaagtagcaacatggcttgggtcccctgtgcagcatcagcttatgctgccacaagtcagtttgcaccctaggtgcccaggagctagtatccttagatctttctatcgctaacttaattctcttcgttatttatctgaccctctaactccatgtctaacttgcattaaaaaaaaaaaaattctttacagtcaacccaagcttaacatggactcaggttccccagcagccttaatttgttttgttaacatctgttccttctttttcagctctcctagagtatttctgagtgttgtgttcatctaatcttagtattcttttaattacaaattgacctcacagcttgaggtttcttgtgtcctattctgtggactacctgtgctcctttgcttcccctcccctcgcataataactatattaagaaattttttttggccttgagttggctggaaaaaaaatataaaatttaaaaaatttaaaaaaaaagatttgcaaaatgtaagtgtagatcatttgaacaagcaaaattaaagtacccactgggggaaatgtgtctgaatcttactcttctggatctgcaggattagggcttggaagtatgtcaaagatgcagggagtgtcaaagtttag

SEQ ID NO: 11683 - DNA, 1163 bp, Homo sapiens
agtgtggaggaggaccccagcactgactggactcaaagaagggagaagccattgggctgagccttcctttccttcacatatcagtacccatcccatgtcagaaagcaggcctaggccctggggggcacagcagtgagcaacacagagaggggccctgccctgagaagcttttgacagttgcacaaataagtattgacacaaatgttgtatataactgctcatcattctcagtgtcctcaaggaaaaatagagagttaacaagaaattgtaacaagggccttgatttggattgaagggaaatgtcttggaggcattaacagttgccatttagagccaggagcacgccgggtcaggtgttgggggaggggaccccaggcattagggagagctcagctaaagttgtgggatgggaaccaaaccaagggccaggtggctgggatataggaagaaggctggaggcatgtgtgggcctggccactggtgtcttggtagttgggctttgtcttgttttgctttttaaatgcccttccttgacaatgtgtgaagaattggcatccgagccccatgtctgcataattaaaagtctggaagctactgattcctactgactcagtatggtggtaacaccagcagcaaatgacacaaattacattttgaaggtgtacacaacagaaaattctctcatcttttagcttcatgtgtaaatttcttaattgttcacatgtatagatcatgttgtgaaaactacattgagccatactagcattgttttcagaacagcatctcttccattgaacttgattgcagtttgtatgcattaagatgtcattgttgattacaaacacaaagcgaacaaccaatttagggctgcccactggcctagattttaattttcaatcaaagcgtgctttttctttcatgtgaaaaaagaattttatctgtgaagctctgctgtgtttccttgccctacttagtttttgttgttgtttctgcttttttgtggcaggacacaggcagttcatggataaggcttccctcttaaacccagatacccgtacctctttgtctttgcttactcagcaagtcctcttttttttgctacatttttcatgttgctccatgcctcttcccagcaatagaactatggtagatttaatatcaag

SEQ ID NO: 11684 - DNA, 1163 bp, Homo sapiens; identical to SEQ ID NO: 11683

SEQ ID NO: 11685 - DNA, 1257 bp, Homo sapiens
caccctgggccagcgctcgcatccgaggggagccgccggatgtggaagaagactcggctttcctgcagccatttagtgccgccccatgctaggttatttgacattgtgcagtgtagagttgccttaaagtgcgtgatctgccagtgctttcttcaagtcacccttgccccgattcctcctgtttgcgctccccagggttgctcaagtggaaattttgtcagctgtttagccttttcgtacttggcgtgatgtcaacttcacttctaatctgcaaaagcagaagctgtttcctagtttacctcgcgtgtgtttacctatatggagtagctcgcagagatcacagaaatgcttgcagcctaaggcagggttttcagaccgtgggtcccagcccatttagtaaaatgggaaatcaattagcaagtggtcaccagcattacacagcaatgaagcagaataaagtaggccagaatgcatcatgtagtaaaggcaaatactgttttgtgaaacttttcacccatacatctaaatgtgagaactggttgcaatgtaagacatttcttgctgggaagttgtgagcaaaataagttgaaaacactaataaagatctgtctgtctgagcaaaggagactaaactccttgggctacataaggtgatcttttcattgattgcatttattctcaagattacagtatcattcccattgcctgcgcataaacttaactgctccctgcgcataaacttaactgctccctgtagatacagaaactggtgcctctttttctgtcactgtgtttgagcaggcagtctgttgtaatgacccccaaatcacagagacttagtaagtacttattcatgggccgggcgtggtggctcacacctgtaatcccaacactttgtgaggctgaggcaggcagatcatggagtttgagaccagcctggccaacatggtgaaaccctgtctctactaaaaatacaaaaaattagccagctgtggtgatgcgtgcctgtaatcccagctactcaggaggctgaggcaggagaattgcttgaacctgggaggcggaggttgcagtaagccaagattgtgccactgcaccctagcctaggtgacagtgcaagactccatctcagaaaaaaaagaaaaaaagaaaaaaaaattatttactaacagtcgattgtcctgtgttggtgttgctgttgcttatatattggtttgcactctgctccatacagtgattcagggatccaggccccat

SEQ ID NO: 11686 - DNA, 1055 bp, Homo sapiens
gtactgcacacaccacagaatgtgtgagattttcctgtttgaatgtatgtctgcattatactcctgcaataatgctgaggactcgttgcaggagggcaaactaggtgaataaattacctgtgaatgaacaatgaagtcgttcctcttaagactgaaacaagcaggccagatgtggtggctcacgcctgtaatcctagcactttgggaggccgaggcggccagatcacaaggttaggagttcaagaccagcctggccagcatggtgaaaccccatctctaccaaaaatacaggaaattatctgggcatagtagtgtgtgcctgtaatcccagctacttgggaagctgaggcaggagaattgcttgaacctgggaggtggaggttgcagtgagctaagatcgcaccactgcactccagcctgggtgacagagcgagactccatttcaaaaaaaaagactgaaacaagcttgtgctaagatggaaagggctgcttctaacagatgtggtttgttgctttagttgttgaagcaaaaatactgagttgttatgtttatgttatcaccccaccactacctccatggttgttcatttaggatgcttctaattcagccactgtgaaccattataaaggttttattgccatgttgaaaatgtttataatatggcaaaaaggggcatcaaatagaagatttactattattccagccatgtaaaaatatgtgcacatatggatgtatgttgaaagtggatgatggagaaataaaatgtggttttctttggggactggaattttgtatcatatttttttctctgttacagatacttgttggcataataatttggtaataaattaaaaagtgaagccaaaaggaggttaatttggggtttctttggacctttagtagtagggactggatcagggcaacagggaagctgtaagtgtggatggaggggcattgggcagtagcgtctctggaatcagcatcccaaagcccagggcatgagaataacttccttctttgggacttgggttataaggggttgtcagtgtagaag

SEQ ID NO: 11687 - DNA, 1110 bp, Homo sapiens
gggatgccagagggataaaaatgaagcacttcatctgtgtgcttccatcagaagcccacgaagggctaaagaatgcaagggtttcagtggctctgactcaggaacacgtgggcaacatggatgtccttggtctgtatggagcggacacaatccttcccatgaccttcctaggaagcctggagttcttatctcccccacagggtactccaagacaccctcattaagctgtccctctacccacccttctacttaccttcctcctcagacatccaggtcacaccctctaccagggccaccacctcttggcagttctctgggtgctgcgattccacccatgtccggagcttcacaggcagtgcacctaggaactgctccagcaccagcagctccaggatctgctccttggagcgtgccttaggctgtagccactggtgacacagctctcggagctggtccagggctcccggggacctgtcatgtccttataacggaactgccggaacctctggcgcgcggcctcagggtcacctggatgcttgccctgctgttggacctgctcactgggggcatctgcactcaggcttccatcttcagcatatagggcctggatctgggcattccggggaccagccacctcctggttcagtgtgaggacctcaacaacctcaatgttcattaggggactctcagcaggaagaggatccaatttagggtccagctggagctcaggatactctgtaagtcaaaagcagagcaagacaaatgagaacaagcacatgaaaagatgctcaacgccattattcactagggaaatgcaagtcaaaaccacagtggaatatgcttcaaacccactagcatggctgttaccaaagacagatgataacaggagaggatgtggaaaaactagaatgctcacacactgttggtgggaacataaaatgctgtaccactctgcaaaacaggttggtaaatcctcagaagttaaacacatagttatccatgacccagacattccccccaagtatatatagctaagaaaattgaaagcatatgtccccaaaaacttctataagaatgttcaccaaagtgttatccataatagccaacaag

SEQ ID NO: 11688 - DNA, 2876 bp, Homo sapiens
agtgaaacctgtctctactaaaaatacaaaaaaactagctaggcttggtggcaggcccctataatcctagctactcgggaggttgaggcaggagaaccatttgaacctcggagtcgtaggttgcagtgagctaagatggcaccactgcacaccagcctgggtgacagtgagagactcaaaaaaaaaaaaactgaaggggttgccagtggcataccagatggctgttaaacatcctatagtgtgcaggacagccccccagacaattatctggtccaaaatctagtctccttagattcccactcttccattacgaaggaagtgtactttttagcgacttggtaaagtcacctgttcagggtttttttcctcatggtggatggggcttacatccaagtcccctgttgaggcataccaggatcccagacagctgttggactaccccgaatgggtacttgatctctcctctggtgtctggccaacgcccatgctgctcctgaccattttcccttcatttcctgctccctgctgccccaggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgaggtagggctctgtggcctggtgagggcaggctgtgccctcagtacacccgaaagccccacggagtgtatgtcaggcttatcccctgtgtggtgtggtcactcttgttttaggtatgaggaaaggggaggaatgcatggggctggatgtcaggctcatatcccccttctctctagaaccctctgcaggtcctggtgaacgccatcatcaacagtggtccccgggaggactccacacgcattgggcgcgccgggactgtgagacgacaggctgtggatgtgtcccccctgcgccgtgtgaaccaggtgagcctggggcttatgcacgtggcagggtggacacagccacgggagtgggtggggtcttgcctggggcaggaaggctcctctctgtctgcatgttttacctgcagcatcacttcctctaggaagccttcctggattcccaccctgcataggggctgatccaggctctgggtcctcttcgggaacacatttggcagaggtcttctttctttcctttgggtgtatatttttacactgtgtgtatatgtactttttttttttttcttggacattttgagaatcagttgcagacattttgattgtgttttccctgaacactgcaggtgtctttaaaaacaaagatgacctacccccgtcgtcacccccaggaaggaatttatattcacagcaatagtcgttgttccatttagcatctgtccccagaatgccagaatgccctttatagtggcgcattgtcaattgggtccaagttaaaagcaaatatattgccttgttttttagaaataattgagatggaatctcagggtgttcttgaattcctggtctcaaatgatcctgtcccctcagcctcccaaagtgctaggattacaggcatgagccaccacacctggccgccttttttgttgtcgtcggtttttttgtttgtagaggtggggtttcaccaagttgctcaggctggtctcaaactccctgccaaagtgttcctcctgcctcagcatcccgaagtgttacaggcgcaagccaccgtgcccggccgtctagcagtttgctgttgaggcaggtctcaatctcctgtcactggggacgcaacttcagcctgtgtgtgtgtgtgtctggacacttgctcttgtgaccctctatctgattgcaaatcaggcatgatgccaccacctcttgtctcagtgggcctatgggtgacaacgtggctggcagcatcagttgggagtggccccagggtgctggaggaccgcagtctgtccttctagcctgacccctgctgtcttcctaggccatctggctgctgtgcacaggcgctcgtgaggctgccttccggaacattaagaccattgctgagtgcctggcagatgagctcatcaatgctgccaaggtgggtgagggcactccggttggggggtcttaagttgggcatttgtgggggtccttcagaattcagagctgtgtgtctccttgcagggctcctcgaactcctatgccattaagaagaaggacgagctggagcgtgtggccaagtccaaccgctgattttcccagctgctgcccaataaacctgtctgccctttggggcagtcccagccacctgtgctgttgtctgtcttcggtggggggatgtgggtggcatagccctggtggccttgggagctgctcaccttcctgacctgttggcctgtggggacctggaagtattgctgactcagaaccatggcaccccagggctagcaggtggggcactggatgcaggccaggctgcctggagtgtcccagcaggtactggaaatgagatggggttatccataacttctgagggcgtggcacatgagatgttgctgtggtctgggtggatgggtggcttgggtgcctgtgaggtctgggtagtcacaagaccatcctgagaggcttgtcaccttgaagtagcactggggagaggaggaaagctcagctgtttagggcacacgatttcagacccctagcttcacccccctcttggagtgtggggtggtttcacactggcgaggttgtgctcctggttacctccccggctacactggttgtggctgcaccctgggcctgcacacccagtttctgtgggct

SEQ ID NO: 11689 - DNA, 1319 bp, Homo sapiens
ctcctgaacgttgccacgggaacagctggaggcgggcggatatgccctagcgttatctaggggctggcccggggaatggcgtgggggcggcggggccaagcaagcgccacctctgattgggcaaaaccccctcccctcacctgccaatagaaaccggcccactgtacagacgcgcaagtttataacccgggaagagctgctctcagagcggagggagaccatataaccctgggactctgccgtacctcctagaggaacagagcgcctctcaggcgtcagaggctgctgcaaatgcgggtcagcgggtcacggtcgcgcctgtcttgctgatgctcatgggaaatgtagttcaaagggcatgggcggtgccttcggtgcaggcgagagattggtcagcgcggcgtcgccggggcaacacccggctgaggcgccccgcgttgtgcggcgccacatccgggaagcggcctccaagcaaccgctccgggttgaggtgagcgcaggctgccagagtgggcgcagcctttccaccccgtgggagggcttggggtcgccctctggggcctgaacggctcctgctgtcggcgccctggagggcccgcccacttcccgacaggccgcgcgcgtcacctcagccttcgctcaggcctttcctaccctcaacgccgttccggggggccgggcctggcaagtcctcttggaacgcctccctcttgccttccccttttggggacagatcccgaagttcgagcatccctcggataggccgggtgtcaggcctggtctctcaggcccgtccaggtgggcgtctttcactgcagaccttcagggccgggatgctgtggccatccctcgactccgcgcaacgtggagctttggccccgtttttcttggcctttgcttttcgttttcacatgcacgggccccggcagtgtgagtcgcccacggctcgctgtggtcagcgagcacgatgtccacgtgccccctccccagagccattcctaaaggaggtcccacccagtcaacctccccgagattgtggagggcgactcgtccccgtacattacagcctggccccaccttctacccgcccaccctggtccactctcctcgcacctcggctagacactgtggctcctcagcctggcgctggaactctgtgatgactgtctttctccacctctttagcgtcatctcccagcagtcccctgctggacccaactgtttgcaatttccaggaagctccctggacaccttgcgtccaagcatttgtccctgaggcttcctcctgctctcatttgccatcattgtttgggtcctgt

SEQ ID NO: 11690 - DNA, 1186 bp, Homo sapiens
ctggccgctgagatgggacatctgactaaagttggagaaaagaaggctcggggaggggaggggctggttcgctgcgggataatggtcgggggcccacccagcaggggaatggtgggggccataacctgggtgggaacttgtaacagtctcccacatccctgcttctcgaagtggtggactgtcccgtgtgcaagcaacagtgcttctccaaagacatcgtggagaattatttcatgcgtgatagtggcagcaaggctgccaccgacgcccaggatgcgaaccaggtgcgtcctatctcagcaaccacaaggaggtttctggggagggggcatctgcgcaggaggagcttggcaccagctccaggctgttactccactttcccaaggctctgggtgggctgcctaggttgggtcaagggaccaatcttaaatctccggttgtattttctgggatgtaaacgtggatctatcaagttgtcttgccttctctgaccctgcctttgtctggcagtgctgcactagctgtgaggataatgccccagccaccagctactgtgtggagtgctcggagcctctgtgtgagacctgtgtagaggcgcaccagcgggtgaagtacaccaaggaccatactgtgcgctctactggtacatgaggctgaggggggctgttggagttgttctcccatgtgtgccctcagttgcttttatgatgttggttgcatctggtggatgggtcctagagttctctagggggtgccgcccgaagggcccgagggcagaactccagaagcagaaaaactggggttgtggtgtgtagtctctagggcctaggtgggagagggtgggaaggggaaataagggagaccttaatgtgctgcagggaggtacaaagggtttgagaaggcttatcagggagttgtcagacctggtggtgaagggctcagcatatgcaaacagggaaaggcatggtgtgaagggctttctgggtttgtggttccctggcacacatctggtataagatgctgctagggaaagtagactgtgggtccatggattataagtgatgatgatttttggaagtgttttagcttttgagttggcagagacttacccaaagtttggtttggcatttccagcttttcacagacacagctagctttggtttggaaggagcttgagagtcttttg

SEQ ID NO: 11691 - DNA, 1103 bp, Homo sapiens
ctacaaggtttcctctgggcccttggattgtaagagaccctggtgttctcttgtcagggaagagggaggaagttaaccatgaaaggagaagaaaaggaatccagggtggtgtgtaggcagaattctgagtatgtccacttggagaagtgttcagtaaagggaacagtgtggggaagggtcagcgggggtggggggtggggtggggtggtcctctttttctagacgctgttatccttacccttacattgttgttatctctagaagctagaagaaagggatgtgtttctcagctatgttggggcagaggattctgggagcaaggagttgggcttgcaggcctgtgttcttccctggccacaccctctacatcttcccaataaatggcccagtgtcacagaacaggccggaaatgaggccccaactcattctgcttcctgagttgggggtggtgaagggcaaggtccagccttatgattcccactccccagggccagccaagtctcgggatggtgaacgtactgtctattgcaacgtacacaagcatgaaccccttgtgctgttttgtgagagctgtgatactctcacctgccgagactgccagctcaatgcccacaaggaccaccagtgagtcccaaggcatagtggttgggtgggtgggtgccaccccttccgtagcttagtgctcaggaacacatctgtctgctctcaggtaccagttcttagaggatgcagtgaggaaccagcgcaagctcctggcctcactggtgaagcgccttggggacaaacatgcaacattgcagaagagcaccaaggaggttcgcagctcgtaagtgtgggttctggggctgtgggggtggcccagggcagcaagaccctacctagcctgacctgctgtgtcccctagaatccgccaggtgtctgacgtacagaagcgtgtgcaagtggatgtcaagatggccatcctgcagatcatgaaggagctgaataagcggggccgtgtgctggtcaatgatgcccaggtaagccttgtgccggtgagaagggtccctgagccccctctgctgattgatgatgctgtctggggtgaggagtgatcctagtat

SEQ ID NO: 11692 - DNA, 2596 bp, Homo sapiens
gattgtggcagagcgtcctggcactaactcaacaggccctgcacccatggcccctccaagagccccagggcccctgagcaagcagggctctggcagcagccaggtgagcaggagagaggacccaggaaggggtgggcagggaatggggtccagtagcaggagagaggacccaggcagggggggtgggcagggaatggggtccagtagggttcctgtcccactgaggcagagggttctgctttgttcacagcccatggaggtgcaggaaggctatggctttgggtcaggtgagtgggtctgcctagtgggtggggaagggccccagtgctgtttctaccccaacctgccagtcttctttctccattttctaaggagatgatccctactcaagtgcagagccccatgtgtcaggtgtgaaacggtaagtatggcacctcccctgggggtgaggtggatggagggtgggggtgtactcatgccaggttgctgcatctacaggtcccgctcaggtgagggcgaggtgagcggccttatgcgcaaggtgccacgagtgagccttgaacgcctggacctggacctcacagctgacagccagccacccgtcttcaaggtcttcccaggcagtaccactgaggactacaaccttattgttattgaacgtggcgctgccgctgcagctaccggccagccagggactgcgcctgcaggaacccctggtgccccacccctggctggcatggccattgtcaaggtaagcctgtcccaaggaactatagctgtaggatgaagcctgtagtccaggtctggaccctgttgaacacccctcatcaccaccttgcaggaggaggagacggaggctgccattggagcccctcctactgccactgagggccctgagaccaaacctgtgcttatggctcttgcggagggtcctggtgctgagggtccccgcctggcctcacctagtggcagcaccagctcagggctggaggtggtggctcctgagggtacctcagccccaggtggtggcccgggaaccctggatgacagtgccaccatttgccgtgtctgccagaagccaggcgatctggttatgtgcaaccagtgtgagttttgtttccacctggactgtcacctgccggccctgcaggatgtaccagggtgagtgtgaggctggtgggggtcaagtctgggtgttgggctgtctggacaggatcatgtgcagacccttattttcttcaccctagggaggagtggagctgctcactctgccatgtgctccctgacctgaaggaggaggatggcagcctcagcctggatggtgcagacagcactggcgtggtggccaagctctcaccagccaaccagcgggtgagggctggggttacttaggtggggttgcccagagaggctttataggtgctgcccagagctgtgacatcccttacaatgtttgtagaaatgtgagcgtgtactgctggccctattctgtcacgaaccctgccgccccctgcatcagctggctaccgactccaccttctccctggtgagtcctaggatgggaaaggggaagggggtggtggctgctgggtctcgccctcaacctgtgcatgtatatgtgtgtctttgtgtgtgtatgtgtgatctctgcctgcaggaccagcccggtggcaccctggatctgaccctgatccgtgcccgcctccaggagaagttgtcacctccctacagctccccacaggagtttgcccaggatgtgggccgcatgttcaagcaattcaacaagttaactgaggtgagccagtggaatggagaggctgtgggcagggggagatgtgaaggaaagaactaggacccattcatccactgcattcctgcttggcccaggacaaggcagacgtgcagtccatcatcggcctgcagcgcttcttcgagacgcgcatgaacgaggccttcggtgacaccaagttctctgctgtgctggtggagcccccgccgatgagcctgcctggtgctggcctgagttcccaggagctgtctggtggccctggtgatggcccctgaggctggagcccccatggccagcccagcctggctctgttctctgtcctgtcaccccatccccactcccctggtggcctgactcccactccctggtggccccatcccccagttcctcacgatatggtttttacttctgtggatttaataaaaacttcaccagttcctcaggcgttggctggttgggggactgtggtcctggggcctggtttattgactgtatctactagtcagccttatcaagcactggtggcacaagggaggggggtcttgtcccccacctatcgaagcccatgtgtatggatgcctagggagtggggaagactgcctccttgccctttctgggtatggggagggtcacccagggcaaaggatgtacacactagaggcttgttgggtaccctgtgggatactgggtaggtgtgacctacatccctgtgtaggcagggttagccccaggtgtagcacagccactctactgaatgcttcctaaattttggtgctgtagctgtttctcatcttcagaaggtcccac

SEQ ID NO: 11693 - DNA, 1191 bp, Homo sapiens
aatttaggctattgtgctgtgaacctcagagtcagagggggtggggtagggtggcgggggttggggacttgagagtgtgggggtcacatggaaagctgggtctgagagacagagaagaggaaggacagtgaggactgagggttggtgggggtgggcaggatctttgagtttgggtgaacaggtagatactgtagagtggaggtcatggatggggagcctggggtttagggcggtcagaggatgtttgggagtgggggcatttgggagctgtggatacagaaaagttgggggtcaccctgggccaggagttgggacacgcatacacagctgaacatgcatgtttggggtatgctgtgtatccacaagagccaagctggggagcagggagagggctggaggtgtggagcacagcccaggagaggcgcctgggggtccaggaggagacgatgggggctctgctaacaaacacccgccctaagtgtcctgctggctccctctctctctctcttcccctccctctttctgttcccgactctctgctacccaaacccagacataaacgagctgaacctgcccaagacgtgtgatatcagcttctcagatccagacgacctcctcaacttcaagctggtcatctgtcctgatgaggtgagggtgcatatggctgaattcccaggagcaaaccaagggtgtccccactgagaggagggagacatgttctgcccatcgggccccacaggatggaaccctaaaattttcttctcccccttttcctcccagggcttctacaagagtgggaagtttgtgttcagttttaaggtgagtcccaggcgggcagggatggctccctggacagaggaggcagcagctgaggcccttccaggcacctacccatctctcttttcttttcctggagccaggtgggccagggttacccgcatgatccccccaaggtgaagtgtgagacaatggtctatcaccccaacattgacctcgagggcaacgtctgcctcaacatcctcaggtgaggacactggccctctaatgccctcctcagcgctgcctgccaggcctccctcatggtcttgtgggcactacatcagactctgtcccttcccacccctttgttgtctgtggtttcttgatttcccagtcatcttcctcatggcctgaccttggttttctccttgg

SEQ ID NO: 11694 - DNA, 1485 bp, Homo sapiens
ctgacctgagtatccaccatgtgccaggcacagtgctgggcacacgaggcaccaaggtccgggccacctgcccgcagcaaggcccagctgaggtggtggagggagcccctgaggtcaggggccgtttcggttcagggtggcaggtgtccagcactggggtatggcgtcgaggcttccatggggtgggggaggccagcttccttctgacaggatgggcgcatacagtgcctggtgtgatttgtgcacaacccgtgttccaggtgcacatcctcccaaggagacacccagacccttccagcacgggccggccaagttgctgcggcggaggcagcatttcagctgtgaggaaggtcattggattcatgtgttttatctgtaaaaatggttgtcttaacttcttaacctcatattggtaagtgattgataaaaattggttggtgtttcatgacatgtggacttcttttgaaatagcaagtcaaatgtagtgaccaaattgtggaagagatttctgtcaaataggaaatgtgtaagttcgtctaaaagctgatggttatgtaagttgctcaggcactcagatgacagcagattctgggttctgggagtgttctgtgcctcttacatgccctggaggcctcatggtctcagtgctgaggcggcacacctgtagcacacctgcgtaatgtgcggtctgggccagtcacaaggaattgtgttgtctaagccaaagggggaagctgactgtgatttaccaaaaaaaattctgtaattcaaaccaaaatgtctgcggaatcaccagtttgatactctctgtaatcagaacagtgggcagtgcctgggtgaacgtgtctagcagccactgtgcgggatcgctgtaacaggagtggaatgtacatatttatttacttttctaactgctccaacagccaaatgccttttttatgaccattgtattcagttcattaccaaagaaatgtttgcactttgtaatgatgcctttcagttcaaataaatgggtcacattttcaaatggagaatggctttatttttttttacctgaaaccagtacatgaggctaaaacttttccaggtgagatcaaaagcctgagaagggaaggaggtaggtccaggaagaagccccagaactgtcctagtcactaatcattttgtgactaaatgtgaaaaaattactaaaaataaggtattagataaagttgacttccttttccgaagcagctgggatgctttaacccgactgaattttggcaggtgggagtgagctcttgggaaaaacctctggcaaataaatgcccttgtctcctggaatctttgtgctgtggagaaggacatttctttgtcagagaggagtgtacaagcaattcacacaccgaggtgtctgagatgggcagatgcttttccagaagcaagagcgcaggtcaggagggcacagtgcacggaagacagacactccctttccaggcctgagct

SEQ ID NO: 11695 - DNA, 1205 bp, Homo sapiens
gtcagctcaggtgcccatcctggctacccaatggaccaatgagcgctgcgactgtgttactcaactttgcagcgtctcatcggtaaaatggaagtgtaacagcttattcatagggttggatgaagctccttatggcagtgcgtgtgaagcgctggcccagcgctcaggaacgccaagtacatacaaatgacaatacatggcggcgcccaactacggcgtgagcgattcttagatgcgatggctagctaaggctaatcgccgcttgctcccgacggcctgcgctcggagccggcctccacccacagccggcctccgcggcccgctccgcccaccaacttatttcctctgggccgggttctcacctccaggagtccccgcgctgagagcccggatgtgagcccaagtggccatgcgcacaagccagcgccgctgccattggtcgctggtgaggaacagattgatgacacatccgaaaaataggaagtggccactacggaagctgttctgggccagaaagacttccagtttggagtcgtttgctgcggggagggaatgaatgggcgctgggaacacgcccgcgaggtggggacgcgccggccgtagcgaggtccttagcgtgtgagtggccggggtcgggtcgcttccccgcagcatggaggacgatgcaccagtgatctacgggctggagttccaggtgggtcactgggagggcggcaggtgctgctcggcctggctgttgatagcatgcgcggtcccatggtgacttcggtttgcagatctcccaccagccctgcaaggacccgtgtctgttccctagttcccattttgcagagaagtaaactgaggctttaggaggttaaacggttgtactggataacagggttggccacagccggcctgcctccttccccttcacatcctgtcccgaacatgacttctgacctggaagttatcactcactttggtggactcatttatttacacgcccaccttttcctctagaatttgagttcctgaaggtaggaactgtatgttgtttaaaataaaaatgtttgattttgaaacaatttaaagtatttagaagagttgtaaaaatacatagaaagttcttctttaccctccacccagcttcccttaatgttaacactttacataaccatcgtacatttatcacagcttagaaattaacattggtacactaatat

SEQ ID NO: 11696 - DNA, 1271 bp, Homo sapiens
gaagttggttttcttcggcctccttctctctcccaggcccagggctgggacgaggccggttcccgcctgcaacctgcactgaagacgggaaccttgggagccggtaccggaacgctcggaaacggcaccaaagtacgaatcctagggcggaaaagcgttaccaagacactcgtccccagagccgcttcctgggactctctagcctcctaccgcttctcagtgatgttccggtttccgccctcctcctcgcgctgtttccgcctcttgccttcggacgccggattttgacgtgctctcgcgagatttgggtctcttcctaagccggcgctcggcaaggtaggttggcggcctgctctccgacagaacttttcttcttgggttgaggaaaacgccttttggagtcaggccctggaggggcgagccttgctcacagggtggggatacagccgattacccgccctgtgctttccgatggcttctgcggggcgagcggggcctggccggggggtgcgggcgggagggcgagccagcggcgcctgcagcccgggccgcgtaacgctgaccgctgtgccttcagttctcccaggagaaagccatgttcagttcgagcgccaagatcgtgaagcccaatggcgagaagccggacgagttcgagtccggcatctcccaggtgagagggtttccctggggtctggggtggggggaggcgccccgcccgggaggggaggcggccgcgcgtgtgttgggcccggggtgctcggacgcgcgctcagggtcggtcctgctgttcgttgcttcttaggctcttctggagctggagatgaactcggacctcaaggctcagctcagggagctgaatattacggcagctaaggtaagctggcgctccctcggctgggagggaggttgcggcgcgtctccccgcgcagtgcctgagagggttggacctgggttacggttgatgatgacttgccgcctggccgcctaacctgaactcaggttcggccgtgttgtttgggagtgataccgcccaggtgcggggagtggggttgcaggtaccctgcggcttaagctgtccacatgcgggcggtggagaaacgtggagtagggagggcctgggcccatttcggaccttatttgcccttacttagttatagatacggcaaagagctgtggggagctcaggatgagattctctctacccttagcccggagttgccgcaagtgggggtgcagaagtggtagtgattggcctcctggcctgaacagtc

SEQ ID NO: 11697 - DNA, 1299 bp, Homo sapiens
gctccatggagaggatgcagcgcggcgtgattcacgctggaggactggtgcgggagtgcttagcagaaacgcaacggaatgccagatcctagctgccttgttggttttgaaggatttccatctttttacaagataagaagtcacagttaatctcccccattcagatgaaacccttgttttcaaaatggttacagtttggtttttcctcccgtggttcacgtggctctgaagctaccgtctcaaagattgagaaaagattttgcagttaattaggatttgcatttcaaataggaactgctcaggtttctgtttgtttgtttgttgtttttaagcactgacttaaaagatgcacctaaagttatcttacagcaaactgtagtttgcctccaagacaccattgtctctttaatcttctcttttgaatatatttgttacacacggtgttctttgttccttttcataagcttataccactccagggattttgtttttaaggcatactgacagcatgctttacttagtagccggttcccatttcccatttgccatctacagtgtagattctgcttaaagtaacttcttttttgcttatgcatttgcatgactattagtgcttcaaagtcaattttttttaaatgcacaagttataaatatagaagaaagagcaacccactaaacctaacaaggacccccgaacattttcatactaagactgtaagtacatcttagctccgcgtttaagttggtcaaaacatctggaagaaaatgactaaaactgtttgcatctttgtatctatttattacttgatgtaataaagcttattttccttaataaaaggaagtgcatgaggtctgtcttgcttttgtggctctgagaggggatcttaaggaaacttactgttctctatttctctttgtttctccagattcttgcacaggagtggaaaaactatgacccatcgccagtttttgtatggactgcgagctaaaggttcttacatttttaaatagcaaaatcaaaagattgatatttattgtgtatgacattatataaaattcaaactttagtgtccttgagtaaagttttattgttcaacttggcactattgacactttgggttgcatgattctttcctgtggggagggaaggttctgtgcattgacctttagccgcatccttggcctctacccagtaggggccagcagcaccccttctccattcctgacaatcaaagtcttctgcatatcttgccaaaagtgtccgggaaggcaaaatcactccctggtgagaaccgcctt

SEQ ID NO: 11698 - DNA, 1253 bp, Homo sapiens
catccagctgtgcccaagaagccaccctggtctgttctccaactcttttaaatggtgcccaacttttctaagtgagcttagcaatgagaagaaaaaaaaacatgaattctttttctggaaaatcagggagacatgggtaataataggtactaataaatatttatagatgagtgaatgaggaaataattacatcaaaaaggtcagtgacaattgataaatgacaaggaaatatttaattaggtaaaactaaatcattgctctctatactaggatagactttatctacttcatctgttcctaagtcagcatgttagttctggggaaggatcataagaaaggaaatactttttaaaaaaaaatttggaaacatgtaacaaagcaagggtaaaatatatatatatatctatataagtgctgtgactgtaaaagtgtactttccattaattattagccgagttaagagaatggtcacattgaagtactgtgtggactagaaatgtaccctgtcatcatgcaatgaaatattgttatcgttttaacatagctcatttatgtagaatgaattctggtggtttaccccaagtcacagttaggacggtagatggtgagatcgcagatgcgctattatctagattcagtgttacattttcgatgtttatcactcagtgggtttttattaatatgctgattaagttatttactgggccagtcattgtgctaaatagttgctcttttgtgtttcattgccttgatgtttgagtgtaatctagcattttaatacagtgtttattttgcatgatctttaacaaatgttttaagcaattttaaaaaggcaggatgttattgacattatacactgaagtcttaacattttaacatttatagtgcttatttgcaaaattgtataattaggaattatttcagagacaatgttttctttttcaggtgagtagttgccgcgtaatatcattggagtacattctttatactgtttgtgaaattaatactagcatattaagtgtacaaatagatttagaaaacaataaaaaattgcatgctattctgactcatgaatttttattcactatgatgattcacattttgattaaaaataaaagtagtttgtgtgtttgttttgtcacatgtctgaagtttgttaaagactttcaggttcatgtacagtcatgcagttggcagaagtgttctgaactgctcccaactagtctttttaagagaatgtggctcgtaagtcc

SEQ ID NO: 11699 - DNA, 1251 bp, Homo sapiens
gaagttttagatcccttggatacaatatgatgaagatctgaaaacttcagctcttgtaaccattgaggtagtctgtagaaacactcaaagttgcttaattgtctagtataggtactttaaaattattttgtaggtttattttttgtattcatataatattggcatcagtagttttccatctttttgcgtgtgtgttttttttaacctctcttcttcctcttattaagcacggcacccttctctcttgagattaggcagtaaacatttgagaagttgacctaggctttgttcatgaaatgttctgttttcttagaaaaaatggttttgaccaggctgtatcagctgtaataaaagctactcattaggttataacagtaactaaatctgttccctaatggtatttccttaccatgctaaacatatttgtttttttttactttacttcatggtataacttaatgagtttttctctgtcacatgacctcattatagatggcattaaatgcttattcatacctgtatttttccttgacttctctaggggtcaggcccagccccaggcccagtggtattactgaattcactgaatgtggatgcagtatgtgagaagctgaaacaaatagaagggctggaccagagtatgctgcctcagtattgtaccacgatcaaaaaggtgaggcagccacttacacacggaccagagacagcgctgggggcggaagacaggactgtgtgggtcgtgtaaactttatgtatagcttcccaaacatgcattccctgttaaaatgggaaagctctaaatggaaaacataattcttactagtttgtattctaaaattgccctgttttctcttattttataaatggataaaataaaataaagtagctgtcttaccatgttcttttttaaatgacgtaatacaagtaaagaatgccttgatgagaaagagaaagctctgagggattcccattgggataaacagaactcatctttccagtgtggaaccgaaaacctttgtgttacatttttttctaattgtaatatttgttagtgtgatttagtgattatcaaagtaagccacacttgcctcattttctccaaattctcattttcatgtcatgtaggacttaggatcatgtcacatttgatgaaaccacataggtttgggtttgcaaggttaatgcatttgcatagtttttttttcttctaagatcctattgcaattctagcagctatcaggaagttggcta

SEQ ID NO: 11700 - DNA, 1211 bp, Homo sapiens
gggtaagtgatgcaaagatgacatacattgaagttatttgttactttagataataaagtaatgtttgatttgttcttttcttcaaggtttttgtttacagattacaatagactgtccagtgtaggtggagaaacttctctggctgaaatgattgcaaccctctcggatgcttgtgaaagagagtttggctttttggcaaccaggctttttcgagtattcaagactgaagatactcagggtaggatttccttccttccttctttgtgtgtaagggatgggggtgggatagatgttcagtttattttcatgaaaacacaccttgaacattagactcatcaggtattgtgactataatgttaggattttctagatccttgatatgttaattattaaaaccatttgttgcattacaggtaaaaagaaatggaaaaaaacatgttgtctcccatcttttgtcatcttcctttttatcattggctgcattatatctggaattactcttctggctatatttagagttgacccaaagcatctgactgtaaatgctgtcctcatatcaatcgcatctgtagtgggattggcctttgtgttgaactgtcgtacatggtggcaagtgctggactcgctcctgaattcccaaagaaaacgcctccataatgcagcctccaaactgcacaaattgaaaagtgaaggattcatgaaagtaagcactcattggttattagaaaaaattgtaatgcgaatatgttgccactgccatgctcatttgggctttaggaagtacactctctaaatgttaaagtgttgcatttattttagtttaatttgttcattcattcattcgttcattcaagactataatttaaggtagttttaagttcacggtaaaatttagagggaagtgcaaagatatcccatatacccacttcccccacacatacacagcctccccaattggcacgattacccaccagagcagtacatttgttacaattgatgaacttaggctgacacatcataatcacccagcatccatagtttacagtagggttcactcttggtgtggtacattctgtgggcttggacaaatgtataacatgtatccaccattatagtcttatacagagtagatttattgccctcaaaatcttctgtgcttcacctcttcacacctgttcacccctccctccaccctcctccctaacccctgg

SEQ ID NO: 11701 - DNA, 1100 bp, Homo sapiens
acaaacaatgtttgcaatcagaatcaagaaatagcctcgagacattcatcactaaagcagtgatcgggaaggctctgagggctgttttttttttttgatgttaacagaaaccaatcttagcaccttttcaaggggtttgagtttgttggaaaagcagttaactggggggaaatggacagttatagataaggaatttcctgtacaccagattggaaatggagtgaaacaagccctcccatgccatgtctccgtgggccacgccttatgtaagaatatttccatatttcagtgggcactcccaacctcagcacttgtccgtagggtcacacgcgtgccctgttgctgaatgtatgttgcgtatcccaaggcactgaagaggtggaaaaataatcgtgtcaatctggatgatagagagaaattaacttttccaaatgaatgtcttgccttaaaccctctatttcctaaaatattgttcctaaatggtattttcaagtgtaatattgtgagaacgctactgcagtagttgatgttgtgtgctgtaaaggattttaggaggaatttgaaacaggatatttaagagtgtggatatttttaaaatgcaataaacatctcagtatttgaagggttttcttaaagtatgtcaaatgactacaatccatagtgaaactgtaaacagtaatggacgccaaattataggtagctgattttgctggagagtttaattaccttgtgcagtcaaagagcgcttccagaaggaatctcttaaaacataatgagaggtttggtaatgtgatattttaagcttattctttttcttaaaagagagaggtgacgaaggaaggcaggaatgaagaagcactgcgtggcctccggtggaatgcacggggcacagccgcgactctgcaggcagcttcccccccatgccagggctctgcgccgtcatgtgagacttaaaaaaaaagttgaatgacttcgtgatactttggacttctaaattaaatttatcaggcataaattatgtagaattagaggctttgaaaataatactggtaggttgctcaaaggttttgaaagagaaatcgctaggtaggttactatct

SEQ ID NO: 11702 - DNA, 1113 bp, Homo sapiens
ttttcttttgtaaattctaatatttagcactttttgttgttttgtcagtcatattgttaaaaaggtaaaggcagagtacaaagttggtactggagaaactagtttggggaaacaaccgatgttctgtcaggacgatcctgaaattcatattaattactttttaaaataattgtgccttgagttatgaagaaagctataatcctgagccatgtaatcccacacggcttccatgcagccaggagacatggagtgctgggcactgggcatggctttaggccttgttttttccccccagctcttctggagcctgtggtatgggactctctctttagggtgtccacaggattttaagctcctgaagtttcattccttatttttttttctgggaatactgtgttatgcataagtattttttagcttaattcacttcagcttgatgtttgtgacttggcatccctcttctaatagtgctcttactttttataggtatgccttacactttcttgtacaaagtggaatttcctactgtatcatgatcatcataggagtggagaacatgcacaagtaagtattcactttgttcacatgaaaatatatatttcacttgaatagaactgcatcaaaatagaattttatttattacattaaaagtaattatgaattgtgataattttttaaagaagaattgtcataaatacaaaaataaaatcattggtatgcatcattcttctttttacttaaagcaccgttgacattttgggatggatgattcattgacattcagtactaacctgtgccttctaggatgttaggcagcattcctggcttttaccacctagatgccagtagcaccccttgagctgtgacgaccataaatgtttccagatattttcacatgtctcttggagaagcgaaattgcctgctgtgaagaaccactggcttagtctgtaggtgatagcagtggagagatgcagtgaactgagtagactggagagagagttagaaggaccggtaggaaataaggtgtcaaggatgacttccgtgtttccagcttgaggagtagagtagatggaagcactgtcttctgaggtggggagtcctgaaagtgggga

SEQ ID NO: 11703 - DNA, 1150 bp, Homo sapiens
gcatcccaccagatcctccaggccctggtgcccttatagtctcagggaacttggggacattgacccctcccagagcttttgcgaagaaatttagtgctcctctttttcacgggttacagggttccctcagtcattaaaacacgtttctcttccctttaaccgataggtgccctgggctttttgtttctgtgtctgcagaccagtgtcaatcagatttttccaggtgtccttctacacctctccccacgtggccacacctgtctcctgccaggtctagcagagacagtattggtgggcattggcccatcacttggaacttgaggctcatccttgggatttccctcaatttttgtttttgttttgttaacttggaaggtcaatttttgtgtaaccttggtgtttttgtcctgagaatttcaatgtaacatgatatgaaaaattcaggtctgtgttgctaatacaaaattttaatttttctttacaggtcaactttgtagtgtgccaactctttgccttgctagcagccatttggtttcgaacttatctacattcaagcaaaactagctcttttataagacatgtagttgctacccttttgggcctttatcttgcacttttttgctttggatggtaagtaattattttgatccttttaaaatgaagactatttggatgtatttgagaattgagtgtgtggaaagatacattatgtagggttttgttcttatatttacttaaaaagttttttctccaggccaactttcatatttttatttttgaaacaaaaaataacgaatgggaaatgggcttgctctctctttagtcttagaggaaaatttactatttataatttgtggaaagacagatgaagaggatataaaggcatttgattctgtcatgagtagttctttacacctattttgcaaatcttttatactgacagaaaagccatttaaatgtgtttttgtttgcctgttttttctctgggcaagtagcttttaagagcctgataaagactatggatagaactttattgccattttttagattctgccattaccaaaaagaggctttttgtttgttcatttgtctgttcttcctggggaagaattatttatgatggaaagcttttatttctgacttttcaaat

SEQ ID NO: 11704 - DNA, 1158 bp, Homo sapiens
ttcctcactgcttcaagagctctttgtctccctgctttaaaaatgcttcctatgttgttactgcctctgtaggtacaaacagccttcatctccttcaactcggtttattgggtccatcagggccaactttccagggaaataaaaacaactcacactcagcttttggctccagttggtttaacaggtgggactctacaatgatagcacttggtaagattcctttaaaataaaagcagccataaatacgaccctcagcagagtggtcttttaatgatttttatgcgtgctatgggtgattgaagcaggcttttctcagtatgtagtgtgtggcaactggggcagctgatgggtggaaaggtaggctcaggattcaggagatcggaacaggcactggtgacgtgcctcttctaccatggcttcccaatcctaaccgtccttcctgtatccactgcaccttgcacacgaatctttttctgaatcccatctgatgtgactgcttccttatttgagccacgagagtattttggatttggcattgttctggcatttacattctgcttaatgttatacgtatcattcagggttctgctaagagatacagattgaagtaggtaactaaggcaaccaggtaacttaaagagctatttacaaagatgtgggcaggtcttgggaaatcagcaaggaatagcgaagttcccgagccagctgcactagatgtggagggtcaagagggaaggaaggagcagaaccccaagatagtggctgtggagcaggggctgcttcacagcaggggaggaagagctatggcctccagttgaaggacgcagccagcctacagcgaacctgagtgagggctgcggccgggagagcatgcccctgcctctcgcttctcccatcctctcatctcctgctggggtctacttcagaggacaagttggtgctttgggggcacagaatagagaggagagtggatctggaggggcatttaaatacaatccaggacgttagggttgcttcaatatgacttacttctctacccgatgaatacaaataaaaaacctgttgtcagactcctttatgcacattgttattttgtctctttcttctcagtcatacattttgaaagaatagttgatttcctaattccagttcactttt

SEQ ID NO: 11705 - DNA, 1098 bp, Homo sapiens
gtgggctgagatccactcagccaagggcccaatcccaccctattagggtatcagcagctttctatctgatgcacagtggtggggatgcatgtggaaggcatgctctttgcttctgccagccccaggctggattgctgtgtcatattatggaatggggcacaaagggggcattgatttgctggcaatcctgccatggaatcccttggtcacggcttttccatgccctgtctccagcatactcagactgatccagtgtgcccaaccagccgtttccacaggtctggcccggccagggaccttcttgccacattctgggctctgcccactggagagttcaggacaggacccgggtgcagaccggaggcccaggcgcagagttgttatgctcagggccatatggaaaatgtgaacagggcctgaacaaactgcacagctcacttcttggcatttgcaagtgggactcaccaagatgcaatgcagaggcggccagtgaggtcaactttggctgagaaccccgaacagactgggagagtccaggagagaaaggaagggacactggagcaaacataacggggtgtagccctgttttaaaaacaccaacagagaaagcaacctttggaggaaaagtgcatggctccaaatcccaggggggcccactcttgtcgggggtctgatatctgacccctgggctgcccagaagcattcactaaatgctgctctccaaccaagttaaaagaaaacaactcccaaactctttgcaaagagagtcacacacatggccttgcagactttgggaattccgcagaactgagaaaatgaagtctctgtttcgagccatgactaggtctcttatatgactaagggttattacttctgcttagaggcaggaaacatccacagctccaaatcctacaggccaaccaaccactctctgtgtggcggttaggcaagcactttcagagtgaatgttgggcacttacagatcccttgggaactttttgctctctgatcacaactctgcaagtggttccccagagatgtgaaagagcaagtgctctaagaaggcgcctgctcacttacaaacccactcacctctaa

SEQ ID NO: 11706 - DNA, 1159 bp, Homo sapiens
gggagacagagcaagactccatctcaaaaaaaaaaaaaaaagccattctttccatgcgtggatgtgagggtatgagttctgtagaccaagggaagcaaatttatccagctatcactgtctttaatattaggaatgttagattagatgagactaggcacccttctaaataccttccagatctcaacacctgtggttctgtggtttgctttcgaattggtgtccactcgctgtttgtttgaactccgattgactgcctcagtgcagaaactgtcatacaactaagttctagttcatgcttttacagctctgaagtcaaggggcatatttgcttcattgagagttcccctagatccaggcctcagcttaagccagtgagtggctctttccatggcagctggaaaacaggtctggtaatcctttgctgacagcataaacttcacttcgagtcacttccatagcttgagcttcctctcaaaagatgtggaggcttagttgtctttaaatttggatgggttgccccagtttttggcagatagtacggttataaccggcattactgggatgctgagaactcagcttgtcacacagcgtgtgcatatttaataggtgctttgtgtttggaggggaaaaccctctccagggaatctccacttccagaggtctcctcctgcctttagcagccatcgccgcctacatcctgcaggggtggtaggtggggctgtcttgattcacttcctcgctgccatgcagaaaaataaagtagttttccagccctccgttcagtggctgagtgttccttttctcaccttttccctatttccctgcgtgctctggaagtcagaatccagaggacccctctgtatgactgcgtctacagagaggttgcatgtggggaagtgagttcacccataccaagaaagagaattgagagatgcccttttggtttggtttggttttgacttgatttcttgtgcagctcacctgtttggccagcagctcctgagtgtgctcgtttacagtcaggaaaaaagggcacatttccaaagacttgattaagtggaagtctaagagcagagcctggcacatagctgcgaagcaggtctttaagaaatggaagcacacagggtgtatttacactggtaggaaaacccttcccagg

SEQ ID NO: 11707 - DNA, 1158 bp, Homo sapiens
gttgtgatggtgcatttgattgaagcagcttgtctttattatgcaagactgtgtagagttttttttttttttggcattgtactttttgtttttgttataaaggaagacagaacaaactggaatgttttatgatgttgtatagcaatcgctttttacctttcaaagttccgggtaaaaatgtgttatatctgtagttttttgtttttgtttttttttaaagcactacatctgttttcactaattgttaatttctgtttgaacccttcatttaattttctcatagatttaagtaaacagatgtattttgcacagtgcacttatgtctattttaacaatcctcctgcatctgtattttatagtcagccttttgaccacctggtgccagctatataaggaataaagttgattcatatcaacattagaactccagtcccaaactaatctgtcaggttcactggtacataaatacctaggaaatatttttccagtctacaatttggtgctattgtgcagtaactaatagtactcttaccagaggagaaattatattaacgaccctgctaatatcctttcttagttatttgctccttgcaaattaaaaaagcaactaagagaaagaaaaacattgtagatatctatttatatttaaagtttatgtttcatgaactgcagctgcaggattctggcattttgcatgccattctccatcagatctgggatgatggctcagaacatgtacacagactaagagtaactgtgtgatctgttaaggggtggataacataatatgcagcttaggatgctattttgagatgtatgatattcagttcattcacctgattactttggttgcagcacaactgtatatattgtataaccgaaattgattattttcattgtccttaatgcagtgatttataattagagcatgtttaataagtttactcttcttgttaactagtcatttgactggaaaaaaataaaatacttttaaatggacatggttttatttttaatgtttttaatctttaaagttttgtatattgacagtcctttaaaaaaagtacactatcatactgtacatgggatctttacatacttttagcatgagcggtaatcttttaaggttctcttaactctaggaattgtggttggcca

SEQ ID NO: 11708 - DNA, 1113 bp, Homo sapiens
aagattattagtgagtttcagtcaaattcagtaccaaatgttgagtagatagccacatccattccttgccaagtaatttgtgtggcatagatgaacttccctggagtatcatttactagatcaaactgtgggctttgatgtaaatgtagtttactagactttccccagtctttcaccccagcctcaagtcatcactaattaggaccgtgctgctgtcaggaagcactgcacgcccacaagtgtgtagggcggccgttctgtttcatggtaatcagtcccaccatgacctctgcacacacagatgattgttcttttttttagtttgagacccggtctcgcagtgccgcccaggctggagtgcagtggtgcagtcacagctcactgcagcctcaaccttcccggctcagtgatcctcccacctcagactcttatctgggaccacaggcacacgccaccacagctggctaattttttatgagatgatggtttttttaaagagtattcatttatcttctatataatcattatagacttaattctaacagtcttgtttgtgcctcactttcagactgtagaatgtgaagagggaagtgaagacgatgaatccctccgagaaatggtggagctggctgcacagagactgtacgaggccctgacgccagttcactgagactgtgcctgtatatgaactttgaaaaaatacttgactctacttttgttacctaaaataaaatgcattcgtttctctgggggagcctgtttacttttaatgtcaaatggcctttatttcaacagcctgaatactgctaaattgctaattaatttgtccattattctagaactaactactagatcaactgcccattattttagaattttggattcttcttccaggcatgtatgtgcagctcccattgaaaccatcaagatctgccgatagcaaccgctgctggttaccctctcctctggggtaaccaatttgagttaataataaggattctaagttgcacttgaatcttttctgtcttcatctccactgctgctgttcgagtccaagtctactctcccctctgaattcctgcaaccacctccatctcctcccctatagctgat

SEQ ID NO: 11709 - DNA, 1143 bp, Homo sapiens
tttctctttaataccattctgtagtccgcctctcgccagccctcactgtcctgtttgcagcctcctgagccttctcccctagccccagccccaccttccaaaccaacctagcacaatccccagatactgcactccagccttccctggtgcagctccctgggaggatgaggcagcctgcacttgtgttagatacactcaatcgttctgtgctagctgctttgctggtgtttagtctcttaatcctgccaatattcctgcaactaggtaggcactgtcatcataagaatgcagaaagcttcaggacggttaagctgttcaggcacaccgctatttagtgaaaattgtaggcatcaaaacgaaggtctctttgtctaaagccgacaaatgattttgctgtgttgcggtccagctgttacatgtaagaagccagcggtgtcagcgcagcgttcagcttccatggcctggcatttcctactagtgcagcccttaccagcccccagcccagctcctgcagccggcactctccaagcagcccagccctcctgggcctttcctgcctctctgcctctgttcaaggtgtcctctagaacatcctccctggcgcctcagaagattccggttaccactgaaggctccttcttcccactgcaccttgtcctctgctgggtagagcagcacaccagtaacctgcaaggctcatcaacatataccctaaaccccggggctggcccaagtggggtcaatatttaatggcattttgaaactgtctagatgagtggagcagaacttacacaagggccagcacttgggtttaccaactgccacctctatttcttctcttcaataggttgcaaactaaatcgcctgaactctgttgttggtgaatatgccaatgcgtgtttacaagtggcccaagactgtgggactgacgtacttgacctgtggaccctgatgcaggacagccaggtacggtggcttgctcggtcctctcggggtaaataggatcacacagaagtaaaccaggtgtgtgtgcagcagctttccctagaaaggccctgcttagctaagacagtcatccctttagccaatgaaaacaaacaggcttgggggaggggaggaatggaggttccaggatggctcaca

SEQ ID NO: 11710 - DNA, 1366 bp, Homo sapiens
tatggctcttcataattctaagactaatgctctctagaaacctaaccacctaccttacagtgagggctatacatggtagccagttgaatttatggaatctaccaactgtttagggccctgatttgctgggcagtttttctgtattttataagtatcttcatgtatccctgttactgatagggatacatgctcttagaaaattcactattggctgggagtggtggctcatgcctgtaatcccagcacttggagaggctgaggttgcgccactacactccagcctgggtgacagagtgagactctgcctcaaaaaaaaaaaaaaaaaaaaaaaattcactatctacaaacctagaatatttaaaatacaaagattgcctgttttcaaacactattgaataagagggtgagatatttcttaacaacaacaacaacaaaaaaaacaggttgttttgaatgtgatgagccagccaggagatagaatactacctgcccttagggttgggggctgtccccacaagacttgatacttcagaaaccctttttattgacccacaagcagatatttgaattacttcttactttattgctccaggattctggatgggctgcatttactgtgtgaaggataaaaatcattagcctggattctgatttctataaattgccattaaaagctttttttcccctaagaactgaaatgtgctcaccagccaaaacattttaacttgtaaattttgagggcagttaaccaaacctgtgactaatcatatctcctcctaccccccatttccaaggacatttgttactcagatacttgttatactaatacttgaacttgtaccttatggtatttgctatcttttaactagtcatgatattcttatactttagttacacttttggaatttgatacaaggttgagtggggtgtgtgggtgtatgtatgagtgaaacagttctcaaaagaatgtaagaaaaaccatttttataaaattgtgactttttaaaaacatagtctttgtcatttatagaattaacaagctgctcagggtatattttatagctgtagcactgatatctgcattaataaatactgtcgaaacacaatggacctaagtataaaacttccctgaaaaatcatctaatacttttattattaatatcagtggcaaaggtttaagcctgaggaaaaaagcgtacctctacgtattgacaactttgagttctgtagataacaagcagatttgggtctcctgtgattggctaatggtctccatctcccagcagacttaattcaggttttgcttctgctacatcccgccagtaaggaagcagcaaaggtagagaagagacctttttctctatca

SEQ ID NO: 11711 - DNA, 1344 bp, Homo sapiens
atagcttcatttcatataaacataagtaactcccaaacacttatgtagaggactaaaaatgtatctggtatttaagtaatctgaaccagttctgcaagtgactgtgttttgtattactgtgaaaataagaaaatgtagttaattacaatttaaagagtattccacataacttcttaatttctacattccctcccttactcttcgggggtttcctttcagtaagcaacttttccatgctcttaatgtattcctttttagtaggaatccggaagtattagattgaatggaaaagcacttgccatctctgtctaggggtcacaaattgaaatggctcctgtatcacatacggaggtcttgtgtatctgtggcaacagggagtttccttattcactctttatttgctgctgtttaagttgccaacctcccctcccaataaaaattcacttacacctcctgcctttgtagttctggtattcactttactatgtgatagaagtagcatgttgctgccagaatacaagcattgcttttggcaaattaaagtgcatgtcatttcttaatacactagaaaggggaaataaattaaagtacacaagtccaagtctaaaactttagtacttttccatgcagatttgtgcacatgtgagagggtgtccagtttgtctagtgattgttatttagagagttggaccactattgtgtgttgctaatcattgactgtagtcccaaaaaagccttgtgaaaatgttatgccctatgtaacagcagagtaacataaaataaaagtacattttataaaccatttactatggctttgtaacaattgcatacccatattttaagggacaggtgaatttactactttctaaagtttattgatacttcccttttatgtaaaatgtagtagtgatacctatatttccacattgtgcattgtgacacacttgtctagggatgcctggaagtgtataaaattggactgcatttcttagagtgttttactatagatcagtctcatgggccatctcttcctcagatgtaaatgatatctggttaagtgttatatggaataaagtggacattttaaaactagcaaagttaattatgtgattgtgagtgccttggctgttattagaattgtgcttcagtggatattcaaaaggaatgtaagagttcagacacagatactcctcaacttaaaatggggctacaccctgataaacccattgcaagttgaaaatacgaagtcaaaactgcactgaatacacctgacctaatgaacattatagcttaacctatcctacattaaatgtgcccagaacacttagccctacagttgggcaa

SEQ ID NO: 11712 - DNA, 1264 bp, Homo sapiens
tttataggtattttacttggatacccagggatgatttctactatatttattttgaaatctcctctttttcttcccatcatgattacctactcctacccctgacaccttactctaccctatgattataagcagtgatgtgcctacagagcatactgagcagagtaatcaaagaaggataaatgatgttaagaaggaaacataaaagattagaaagtcatgcctgccaggtttggttactagaatagctgtgcatcagccacattcctcaaagtggctcaaaacgagagaataaagaggaccctgtagagataagtactacttaactggaaagaagtctgttaagcattgctgctgttccgttgtcctgtgaaagaaccaagacatgcttgtttactaagtgtatagttttataaaattccagtcatactcataagttcttaaactgggagtgtgagagaatggttctgttgagtttgttgatggtagaacataaggtgggtgttcacttattttgtaaaaatggtttgtaattgtagaataaccagttttcgtcaatgcacatattttaccatggatattaatatttatcaggcttttgatgaggccattgctgaacttgatacactgaatgaagactcatacaaagacagcaccctcatcatgcagttgcttagagacaacctaacagtgagttgtttactcttttaattttattttcttttcagaaacaaaagtatttatattttattttggacttcgtgtcttttagggaagatacatacgagctgaaagtatgagatacgtgttagtattttatgggacgaacattattttgtaggcaggttttcaagttgaataggcattttatcagaccttcctgagaaggttctaacatgataggaactcaatattaatattactatttcattgggatgaagatgttgataaattatgttaataaagagcttatcaagtttcaatattttggggcaaatcagctatagccagttagggactatctaaatatctacgctttcttaaaatcacaggaagtaccttgttctaataaaagtttactttgtgaattgtgcatgatgttctacaagcatttagggagtaaacctatacctaaacttactccttctctgcttctaggcaaaagcttctgttttgtttgtctttttctccctgcttcttagataggcaattgataaaggaagtaatcaagaaaaagtacagcttaagctttactttaacattcttt

SEQ ID NO: 11713 - DNA, 1430 bp, Homo sapiens
cagaagtttttttgttttggttttttttttaaagaaatggtagaaaatttgataatctgaatcaccagcattcaaacaaatatttcggcaataaagtttacaaaatctggatttttacaaccttttctattgatgttttgtagaaataagacagggtactaatttttatactggtttttagaaaaatatttatattgttggtgctcaaatcaccaatttctagctagatcattttgcagccttcttttcagtgtttaataacaaagtttttcctaatggcccttcttttagtaaactggacatgttattccactacaaaaaccacaagttatctggccttttagatctttttggaatcggacctggttgagtaaggacctcttaaaagggaaaaataaattttgccgtcagcttcttcataacgttttcaaggaaattctaggcaatcattcctgtcaccaaagaactaaaattttggttgactggaactagtgagctgtgtccatggtgtgtcatgaaggatgtaccccagagagtaacatgagccactgggcagatcccagggaccagtacttgctgcaggatctagtctgtaatagtcttggccatggctctgctgaaagcaagccattcagtttcttgtttgtacctaaaacaccaaaaaagaaacactcaaatccagctgctttgtcaattgtcagttctgactccttttgctgtggccttatccgtactatattgtgggtagagtaacttctcagaaaaaaaggaaatgtctgtattggttggatgaaactccaccagagcacagcttagctggggcgagatgcatgtgaaggcaggcagtgccaagattccgcttcctttgtttgccaaatactagaaacacaaggaaatgcaagttacgctaaatggcagtaatactacccaactgcctttctgttcattttgtttgaaggaaattgttttgaccaaacagaaaattacttggaatggtgtgttttacagtctacctagaaaatagatggacaatatttttcaactgtatgagcacgtagataaccgagagaatgtggccacctgtgttcaagaagccactgatactggtttttgttaaacattggaagttcaggcaatggaataaatgtaggaacatacagaatgttgcactaatttggtagcctgggaattttttttattgtgcagtatgtatttaaattttgtctatgttaattaccagcatttacctttatttaaatgatggtaaggtggaatattgaataaaattaggttttgtgttttgttctttgtagtctgataaaatctccacctggtcattcattgtgtgtgacttgatacctgttaacttgccccttagtatcagctgttacttgacacaaatgtgtgtgttattcagaggttttcagtct

SEQ ID NO: 11714 - DNA, 1121 bp, Homo sapiens
ttttccaggcctttgcaccaacctcgttggctaagccccctgcccggcggcggcccggctgggaggaggtgctttcgggaggcggggccgcggcccggggatcctctcgcgcccgcgggctccaatcgctgctcctcacgcaatcctaaacggttcccgggcgaaccggggcccgcgcgcgccaaggccgccgagaccctcaggggctgcggccctggtcccgcgggacctgtgggggcctgggcggcggcgcccccgacccagccagcggacgggccggggggggaaccgggaggtcccggggggcgtccacgggggtgtccccgggggtctccggaaggcgccggcggaggctcccgcgctgcgcttgaaaatcgcgcgcggccccgcggccagcctgggtaggggcaaggcgcagccaatgggaagggtcggaggcatggcacagccaatgggaagggccggggcaccaaagccaatgggaagggccgggagcgcgcggcgcgggagatttaaaggctgctggagtgaggggtcgcccgtgcaccctgtcccagccgtcctgtcctggctgctcgctctgcttcgctgcgcctccactatgctctccctccgtgtcccgctcgcgcccatcacggacccgcagcagctgcagctctcgccgctgaaggggctcagcttggtcgacaaggagaacacggtgagcccgcggggagggcgctgcgggcaggggagggaggcagggaaagcgaagccgctcctcactcacacgcgtctccccgcagccgccggccctgagcgggacccgcgtcctggccagcaagaccgcgaggaggatcttccaggagcccacggagccggtgagtggcgggcgtggggcagaggggccagggacggccttgggcgtcttggcgccaaagccgcattgtttcctcagctgttcacactcccgccccggctcctttcccgcctaggcggcccctccccagggctgcctcccgcgcccctcggcccatttcccggttcgggcgtgcgctcctctgctgcgacccacggagtgcgacgggacagccacgttttcacatcgggccccgtgaaattgccgccaatggaaaggactt

SEQ ID NO: 11715 - DNA, 1156 bp, Homo sapiens
actgcatttgctgtgaattataggtaattattcatcctgatgaccatttaaaaaagaagaacaatattattaggtagaaatagtccctggctccccggttgcccaccgtgactataacagcatatctagcttggtagttttcaaattatttccacgttttatttacttctcacagcctccctgtggggttgcaggtgcttctccactcctccactgacaaggtgcctgaggctcagagaggctgagaaatgtgctctgggctgcacagctggggatgaggcgtagaccctggccctgctctgttctgggctctttctcctccactctggcctttggaggctgtggctaagatcttcccccagccccttccttcccaccttcccttcctgctcttgtgccccgtttttcacagtcctcagtggctggtttctcagtcccccaggaggtgcaggctggttcttaggaatggtctctgtcaatgttcccggcagtacctccgagcctgccctctgaggatgggtcggccatggctgcgccggcttagtctgtatttaggtatcactgactatcactggacttggggaggggatttactatttttagagaaagtcaggggagctccataaatcctgttagtcaacagaactgcagagaggtggctgtttatgaaggagagtgacttttttagaagtggcgcatttagaagaccacatattctatcattctgtgtacatgagcggtgcagaataggcaattctaaagagacagaaaatagattcgtgattgcagggagtggggaggagggatgggaagcgactcctaaggggcacggggtttcttctgggggtaatgaaaagcgttctggaattagatagtggtggtggctgtaggacctggtgaataataaactgaaaatcactgaatcgtaccccttaaaaacacacaaagcaaattgacaaattattgggaggcaacataagagaatggggtgtgaactttggatcagtgcggcctggatatcagctgtgtggtgttcaaatagattgcataacctcgttgagtctcagtcttcccatctgtgaagtagggatcattcctacttcgtagggttggcatgagactccgtgagatgaagttggtgggtcacttggctggg

SEQ ID NO: 11716 - DNA, 1138 bp, Homo sapiens
gttccactgattttaagttgcattttcccccccgcatttccacattctccaagtgagaacgtgtcccgcagtgtgagggtgagctgtcgtgatataattagagtctcttggccttcttggtggtccataagatagcggcatgccttccgatgggggacccgggagttgctgagtcgcagcgcttgcacagcgatgggcttatttggtctctccggcacatggctcagccctgctccgtggccgtgggtggcgtccccggctgaccccctgtcttgcaggtgtagtcgccgccgccagccgccatgggcaaacagaacagcaagctgcggcccgaggtgctgcaggacctgcgggagaacacggagttcaccgaccacgagctgcaggagtggtacaagggcttcctcaaggactgccccaccggccacctgaccgtggacgagttcaagaagatctacgccaacttcttcccctacggcgacgcttccaagttcgccgagcacgtcttccgcaccttcgacaccaacggcgacggcaccatcgacttccgggagttcatcattgcgctgagcgtgacctcgcggggcaagctggagcagaagctcaagtgggccttcagcatgtacgacctggacggcaacggctacatcagccgcagcgagatgctggagatcgtgcaggtaccggcgcccgaggccccgggtctcaccgcgggcccaggtcccctcccagctcccagcccccagcccagggcttttttttttttttttttttttaagacaggaatcttgctctagtgactggagtgcagtggcactatctcagctcactgcaacctctgcctcctgggctcaggtgatttttccgcttcagcctcttgagcacctccatgccctgttaatttttttggtatttttgatggtagagagagggttttgccacattatccaggctggtcttgaactcctaggctcaagcgatctgcccgcctcagcctcccagagtgctagaatgacaggtgtgagccaccgtgcctggcctccctgtgttctttatgttcactcgacattgggtctttcttggccaggttgctacctggtgcactttggaaagtgagcagttgtcacctgattgggca

SEQ ID NO: 11717 - DNA, 1188 bp, Homo sapiens
gggagcagggaaaggaaaaaggattttttttcagaaatgcctgtaaagtgaatggagactagacaccgtccagcttcaagaaggctcaggactttcaacaaagggagcatacctgacctgagagctgtccccatcctctctggaagcataaagaacagtgagcactggctaatcccattgtctctggtcccctgcaggcaaactgtccttggaagaattcatcagaggtgccaagagcgacccctccatcgtccgcctgctgcagtgcgaccccagcagtgccagtcagttctgagcgagcggcccctggacagttgcagagaaacacaggcttgtcgtgccgtttaagctttgcttgcaagagtggatgccccgcaatcgttcctgctctcccgggccccgggcctggggcatgcgttgcacctgcccagcccggtggctgcgcctccctcctccacctgaccaacgcgacattcctcccctcacgcctggcccggtcccttccagggcaactcccagggatgtggtgacatgcagggttcaagtgttcttggttccaggcacctcccggctcacggggagctcagaggtccatgccgaggagaccaggcaggacctcccgaggctgcgccccggccggcccatgcgttttgtgatcccaagtgactctgtgggaagggtggggacgaggcgtcgggagggtatacagggagcccctcccgtgcatggctgcccccccgttcattttctccaccacagccgcttgcacgtatagatactgtggtcccctttcttttaatatataaattatgtatggtgaagtggagtgtattgtgtaggtcccgtatttaatgcctctgactgcctttgaagcgcagccctctgtggcccgcagccccctgagcctggctgttgtgtggtatttatgctctctttgtctgcctgtttctaaggaaatgcatgtgtgccctgagccgtgatgatcctcccatccgtgttgtgagcacaggcatttgtgtctggtctgtcctccctgttgattggtctggcatttccggtattaaaatgataaaataaatggcattttctgagttttgcgtctgcccgcgggagcccccattcctcaggccgtggcccctgcactctccaggcaaggcgggtgtgctgcgtgccaccgctgttggtaaa

SEQ ID NO: 11718 - DNA, 1587 bp, Homo sapiens
ctatgcttcctctccttaaaatacttgaaatgtttagtcacttaggaagttaagccattatattggtgcttgaatttataaaatatatccacatggtttgttaaaatcatgacgtaggcagaataggatttttatcctgttggcatgtatttgttaaaatgttttgacatcttgatgccttcctaggtagtagttagttgcgtactgttctttgataaaaatcatacccataacatcctaaaggagatagggtgcctggaggggaatgaaaacgagccacctgggatatgtagcctggttttcagggagatgttgatgtttttttgcttttgttactttaatgataaacctgtctgttgatgcctggtctcatgatgtcatgtcacaaggccctgtgatgttactcccccatgtgaatttcccacaatgaaggctgctctttcttttctgtttcactctcttagatcaccggcgtaatcaacccagcgttggacaaatactttccgtcagactctggagtgagaatcatagctgagcccggcagatactatgttgcatcagctttcacgcttgcagttaatatcattgccaagaaaattgtattaaaggaacagacgggctctgatggtatgtataaaggacgaatcacttcatgtataactgaaagctgatgcaaaaagtcattaagattgttgatctgcctttctagacgaagatgagtcgagtgagcagacctttatgtattatgtgaatgatggcgtctatggatcatttaattgcatactctatgaccacgcacatgtaaagccccttctgcaaaaggtaatttctgagcatactgtataaaacaattaagaggactggtcacaacacgtgtaattaagtagtacttcctctctccgtctctttatatagagacctaaaccagatgagaagtattattcatccagcatatggggaccaacatgtgatggcctcgatcggattgttgagcgctgtgacctgcctgaaatgcatgtgggtgattggatgctctttgaaaacatgggcgcttacactgttgctgctgcctctacgttcaatggcttccagaggccgacgatctactatgtgatgtcagggcctgcgtggtaagtaagccatgcatgttgatggtgctgccaagaataggcaccttcttggatgtgtgcttcttgtctagacgaataagaaattgtcttgcctaagattaaatatatatggatatttttcctaagaaaagttttagaaaagactgatgagtgtatttctatgtaattggaatatatttaagttcatgccatgtgtcttgtggtttccttattaccaaaacggtgactgaagaaacgcttgctttagaaatacattgaattggccaggtgtgctggctcacacctgaaatcacaacacattgggaggccaaggcagaaggatcacttgagcccaggagttcgagcctgggcaacatagtgagaccctgtctctacaaaaaattaaaaaattagttggccatggtagtgggcgcctgtagtcccagctgcttggctaaggtgagaggtttgcttgagc

SEQ ID NO: 11719 - DNA, 1467 bp, Homo sapiens
gactgaaatacagttggtgcagagtctgggggtgcctccagagaggattatctatgcaaatccttgtaaacaagtatctcaaattaagtatgctgctaataatggagtccagatgatgacttttgatagtgaagttgagttgatgaaagttgccagagcacatcccaaagcaaagtgagttattcccccatctgagggcaagatcgggagcataagatatgtggattcttatcaaacaaacttaaatttctgattattatatttctatactttagtagaaagtagttgaaacccccattgagtcatgaagcctgggactcaaactacagaatatatcagcgacagtatttagaacaggattgtttttattttaattgtggctataagtgaacatctatcatgagacatttgctgcactttccttgcttgtaggttggttttgcggattgccactgatgattccaaagcagtctgtcgtctcagtgtgaaattcggtgccacgctcagaaccagcaggctccttttggaacgggcgaaagagctaaatatcgatgttgttggtgtcaggtgagattttggtgggatagctagaggtcaagacattgaacagtttgagttttacaggctttctcctagtgtttgctattattttaagaaatactaagacacagtgtctcgtctctttattttaccccagcttccatgtaggaagcggctgtaccgatcctgagaccttcgtgcaggcaatctctgatgcccgctgtgtttttgacatgggggtgagtatacgtgaccctgttagggaagggcgggacacaactgacaataactagtcttaattctagagttaactttttatggcagttggttctgtattacatgggtttcagcctatctgctgcatacatttttgttattagctgtggatctggctgacttattttcttgattctaggctgaggttggtttcagcatgtatctgcttgatattggcggtggctttcctggatctgaggatgtgaaacttaaatttgaagaggtaatttagaacaaaactgtaatactcagtagccgttctaataaattcctttttggaatatttcaaaatttaagtgtcttaactaataccacaatgggctgaagtgtcttggtgtgatattttgagtgatttctttgtgctgtctgacattacacttgataccatttggttttctaaagtgtgaatcagctttcccagaagtcttggataattggttacattggaaatcatggctcacacctgtaatccagcacttggggaggccaaggtggtaggatcacttgagcccaggagtttgagaccagcctgggcaacacagtgagaccccatctctacaaaaaaaattttaaaattagcctggtgtggtggcgggcacctgtaatcccagctacttggaaggctgaggtgggaggatcacttgagcccag

SEQ ID NO: 11720 - DNA, 1118 bp, Homo sapiens
ccggcctgcggagacacgtggtcgccgagcgggccacgaccttgaggcgccgcttcctcccggcccggggttctcccgcggctggataagggtgatccgggcgcctcgttctgcccccgtcttcacagctcggggctggaggggcctaggggagacccacccggagaccctgcggccccgcgccggcctctttcccaacccttcggcggccgcgcgctggccggggagccgttggggaggccctggcggccgcgcagcaggtgcaggggcgcagagcccgggctcgccttggtacagacgagcgggccccggccttggcgccttcagtttccttccagtttttattttcgctgtgtctacagagcagatgacaccaatttggaaacccgcgagagtgggtagagctaagatagtcttgctgtagtagctgtgatattagatgctcggccatgacttagaggtgtttatttaaggactgtgaatgactcggtgatttcggaaaagcttggcttagatgaacggacatacacaggggagacagccctaaggtttgcagaaaaggctgattgtgctgtttgcgaagtcgaaataattggtgaaagtgtagaaggcagaacctctcaggaatgtctggggaggacaaagaatgtgttggctgactttgtttaaacataaaattgggcagactttaattgatttgtgaaatttttttcaaagtttgtttgaattagcccctatctcttctaacattatcctcttgtgctaattgattgaccattttaaataacttagctgttacagaaagaccgaaaggtgttcttcagtaaaatatattcaagtaagttacttaagtaacgccttaaaagatacagaaaagcaaaaaagtattggcgtattaaaaagaaatcaaaactttccaagtttaggcctgaacattgccttaaaaatatttaataaggcctcaaatgacccagtccgagactgcatgagcctatttattattaaattgtaaatattcttcatataaacaaaaatatataaccatgtctgtaacaaaaatggttttgctagcgttgttactctcttcccttctccgaggggtgatttaggcaacttcg

SEQ ID NO: 11721 - DNA, 1140 bp, Homo sapiens
tagtctgaacagcagaagaagcaacaggaggctgagaaactgcatcgacaagaaaggaaaagactccgtcgttcggccggacacctgaagtcaagacacaaaagaggacggtcgtttcattgatttgggaagtggtcctacctgtgattagggaggggtacgtctcccccaaactgatcatcgttagggtgttaaacacagacgaggaaacacacgtttttaaagttcatgtacgttcttgtacacagaggtaaagatttgaaaacctgtgccttgtgggttggactttgaagctggccccgccgacggccaccgcacagccccaggggtgtgcttgcgagtcgttgctccctggaaacattgtcctttccccacggcgttaatcatgaaaaccaggctggggtttttttaatattgtgaaatgtacaccatgaaatgaaaggtttatcctgtgccagaaaccaaggtttatcatgctctaggaacttttttcttacactgcctaccgccattcatgattaaaccatccagaaataccatccctgttttacctggtgtctgtgtattgcctgtgtttgtgtttataagtttatgctgataggtttgttcggcttgtttatgtattagtttgggatttgtttttaaataatttataccaagagagtataatctaatggtgcaggttgagagcatcccaaatccgaaaatctaaaactgtttgagcactgtatttatctgttcttgcactgctataaagaactacctgaaactgggtaatttataagtaaagaaaagaggtttaattgactcacagttctacaggtggtacaggaagcatggctgtggaggccctgggaagcttacaatcgtggcagaaggtgaagcggaagcaggtatgtcctgcgtggctagagccagaggaggagggcaaaggggcagatgctgcacactttcaaacaccagatctccaagaactcactaacacagaatagcaagggggaagtctgcccccatgtttcagtcacctccctccaggcccctcctccaacaccgaagattacaatttgacatgagatttgtgtggggacacagagcaaaaccatatcaagcactgacatgacattggaggaaaatgctcat

SEQ ID NO: 11722 - DNA, 1166 bp, Homo sapiens
gagaagagagtagagtgaggggtactgaagatcagaatctgagggaggtgaactctctgtaaccactatcatcttgcaggtatgaaaattattcctgtctatgatagtccttttaaaattgctcagttatgtattttcacacataaaaaaagcatgctgcttgctgttgactctgtggtttcgggatactgacgtgttgttgaaagcacttagagatatttcgtttggttggtagtgaaatgaaggccgttcaaacaggaagcattttggttttcctaagttaccatttgttccttttcccctggactcttgcagatactgcattcatattcctgtcaacttatccatctttccttgtattcacttgttaataaatattatggactacatcaactgtgtgttgggaacgatgctgtatgctggcagtattacagcatccagggtgctgcccttctctttgaggagttactgttgggaatccaacaagaaagtaggcagttgccattcagtgtgaggagtgctaccagggtactgtggtgggagcacgtaggagagaccctgtacccactgagggcccaggagctgatgagaagtgtggttggcactcagggaatacttcccagagggagagactttgaaggagggaccgaaggatagctgcgtcgactgggtgaaggggtggggtggagtgaggtgcccagtgggagaagggtttttttttccttttcagtcgactttcccaggttggacagtagatcggatcttgacagtagagtgggtgcagagctgcgggagcaagtacctcccatggctgagcattcgagcctgtgggggcaggtagaaagccaggttaggaggggtcttgtgagccggctgtggggatgtagggcagggagtcctgacaagagttgtaagcggggggataggatcagacctgtgttctgaaaagattacttttgctgccgcaggggaatgcattaaacaggctctaatctggacgcaacaagcacaggctgtggcagcccacaggagagatgatggcacctgcattacctgtgccaggctccctttctagtagttgtggctctttggggttctgggataatgtgagagaagtctaatctggtaggcagtacttgcagacgattcatccttgaattgcctgg

SEQ ID NO: 11723 - DNA, 1457 bp, Homo sapiens
cctggtgcacccgtgggccttttaagaggttcttctctgaagacccttcatcttccttatcacaagtttaagtgctgcatggcatttgatactcttgacagccaagatacatttcagtagtaaggttgctttcctgattattaccttaaagtgaacatttaacctggaattcatttactttatcttagaaaaatagaaaatgatagctttgaaattagcacttatttctgtactgttgtgtcccaccctcctcaaaaggacacgttcaagtggcttccagtgttaaaatggtgagtgatgtgatgttgaaatgtttcacctgagttctgagcttttccatccgtataatcataggtacgaaggtcagggtaggagtcagactgaggagaacctggattgtagcaggagtagctccagagagtcgctcttccataaaatgagatgttgaccttccagggtgtccccttctgcagatctaacagtggctttctgtcgtctcccagcttcccgtggaggatgacattgacctcagtgatgtggagcttgatgacttagggaaagatgagttgtgagagccacaacagaggcttcagaccattttcttttcttgggagccagtggatttttccagcagtgaagggacattctctacactcagatgactctaccagtggccttttaaccaagaagtagtacttgattggtcatttgaaaacactgcaacagtgaacttttgcatctcaagaaaacattgaaaaattctatgaattgttgtagccggtgaattgagtcgtattctgtcacataatattttgaagaaaacttggctgtcgaaacatttttctctctgactgctgcttgaatgttcttggaggctgtttcttatgtatgggttttttttaatgtgatcccttcatttgaatattaatggctttttccattaaagaataaaatattttggacaatgccgataaatgtatgaagttagtatccacatcataaattcagagtgatgtttagcagtaaatcaatattttgaagtgatacacagatgtctttcctccccacaaacttttttaaacaaaaaacaagacctcttttctttagatggtgccacctatgcccaccacaacagagattttacatggaaaccgggctcagtgagaactgatttcctgcccaatatttgtctttgggctgtctctagtgactaattattaaggaatctagctggttatacagttcaaggctttctatgttgttaatgaacctcaaaatagccgttaagacatgaaatacagcagcaggttaccaatgcgaacaggtagttcgcatttatgtaaaacattcagaaaatgaagttttgaatttgttggaacattcaaaggacttgagagcattttattgtaacttaaaaaaataaatacaactgtcactaacttttgtgagcaatttct

SEQ ID NO: 11724 - DNA, 2157 bp, Homo sapiens
tgttaaaactccctgattgataattgacctctgtgagtcattcctttgaaatctgtgcagtctggagaacagttttgttacattaaattacctataaggccagagtggtggctcacacctgtaatcccaacactttgggaggccaaggatcacttgaggccaggatttcaaaaccagcctggccaacatggtgaaaccccgtctctattaaaaatacaaatattagccgggtgtggtggtgtgtgcctgcagtcccagctactcaggaggctgaagtaggagaattgcttgaacccaggaggcagaggttgcagtgagctgagattgcacctgtgctctccagcctgggcaacagagtgagactgcttcaaaaaaaaaaaaaaaaaattacctataaggtggttttagaaactgtaaagattgtgttattttgcattaagtgttaattggattttatcctctgacctttttttaatagattagaggatttcctacaatcaagatatttcagaaaggcgagtctcctgtggattatgacggtgggcggacaagatccgacatcgtgtcccgggcccttgatttgttttctgataacgccccacctcctgagctgcttgaggtaaaccacttcaactgcttgtagtccagaaagcttttttagctgatggtgaggaatgttaaagcagtgtgacacactgttcattttatgcccttaaagatactctctttaaagtggtttctatactttgaaatggaaaaaaagtctgataaattgcttttcataacttttagcattagaataattacactgaacagaaatacgagcttcttaaagatagagtgtattcaatcactcttgcttatcattctcaaagtaatagaacatttatcaagtactaatcatgtaacaggcaccgttctggtgtctttgtatagttttgttttgttttgttttgttttcatttaattctcacatgaacactgagaggtagatactgtttttaatctccattttatatatggggaaattgaggcacagagcctcaagtgtgtataaacatataagacatataatacatgtaagtataatctatttaaacaagtaagtggcagagccaggctgtgtccaggcattgcgatttcagagatgtttgtatgtgtgctaatcaccccacctccaccaccacagcttccacaggcttaagaatcagtagcagaaaaatctcctcttagagaacatgcctccaggtgtttccatacgaggaagtagtcgtgggagaaatgttttcaatgaaagtgacggtgcgaaggtcttgtttgccagcttacctttaggtgttgtatcatgcagcctcctgattgtcccttgtcttttgggtcccacagattatcaacgaggacattgccaagaggacgtgtgaggagcaccagctctgtgttgtggctgtgctgccccatatccttgatactggtaagacagacggaaatgatttcccttagctgttctatgctagatgctctgagaatactttctaaatggattaattttatggactcctttatctttacctttaaaaaactttgtctatttaaatcaggagctgcaggcagaaattcttatctggaagttcttctgaagttggcagacaaatacaaaaagaaaatgtgggggtaagttactgagcttactgtctgagtgtcatctgaacagctgattataggctttcttgagagtggttcccccgtgtttttgtaagctgtgttctatgtttgctctgctatatgttttttttttttttccctcctgcctcagcctcccaagtagctgggattataggcgcccgccaccacacccagctaatttttgtatttttagtagggtcagggtttcaccatgttgtctaggctggtctcaaaactcctgacctcaagtgatccacctgcctccacctcccaaagtcctgggattacaggtgtaagccaccgcacccggcctgctctgctatatgtttttattcaggatgtgaaaactttatcatgggaggaaaagaaggaatgaagggctgtcagcacagcatgcatttttctcataggaatcatgttttacatggtgattggagtgccaggttagcaggcagacacataaggagtagtgca

SEQ ID NO: 11725 - DNA, 1346 bp, Homo sapiens
actttgtctatgaaagatgtaacataacatcctaggatgaagcagcagctgtacttgagtctgaattagaacagtgttgttcaggtggttttttgagccatgttgaggtttctctctaaaaatagctggtgacagcattcaggtacaggttatgtgttgtactgaatgtattgataattacttgaaagtaaaagactatttgccaagcaaaaattacagtgctgaggaatgtacccaatttgaatacaaccgttttcactattttattcactaaagaaaaaccctaaaactttgttaagatgtagcagtagtgttattatttaaaacaggaaaagtgttcttcttggcccaattgtttgatgtttaatgtcataaatgacagggcagaagtgatagttcaagtaagaaggatgtgattgagctgacagacgacagctttgataagaatgttctggacagtgaagatgtttggatggttgagttctatgctccttggtgtggacactgcaaaaagtaagtgccttctactaagtagtctgttcattcacagtgttttcagtacattcattagcttattttgaaagagctgaagtagataatagatcaccactaagatctcttccagcaaaactctgactctaagtgaatattaaacattgacattagcgccaagagcttccactctcctattgccaaagattaacaagggactggctcatgtctggatttaggggcagtggtggaatgggaagctcatgtgaagggtagcattgtatctttagtaaagccacacacaaaatgttttctaggtgtgacataattggggattgggcagaaatgcacagatcagttaaaaagtataggctaggcatggtggctcacacctgtaatcctagctctttgggaggccgaggcaggcggatcacttgaggtcaggactttgagaccagcctgggcaacatagcaaaaccccatgtctactaaaaatacaaaaaaattggctgggtgtggtggcgtgtgcctgtagtcccagctacttgggaggttgaggtgcaagaatctcttgattgtgggaggcagaggctacagtgagccaagctcacaccactgcgctccatcctggataatagaaggagactctgtcttaaaaaaaaaaagaaaagaaaagaaaggtgtttgggctgcaagttaaaatgcaagtatttggcctggtgaggtggatcacttgaggccaggagtttgagaccagcctgggcaacatggggaaaccctatctctactaaaaatgtagaaattaacagtgggtggtggcacacacctgtagtcccagctatgttggaggctga

SEQ ID NO: 11726 - DNA, 1265 bp, Homo sapiens
gagaaggctctgcagagccatgcgccctggacggaagaactttcaaaagtaattcaacaaaatagaaacttgtcgaattacattgcagacagcgcgtgcggagcaaatgtgtgtccacggaatattcgtcgggcacaagaggaattccctgtcagctcccaggaccgtgggtgccctgaggccgagtcacgctcccccgggataaagagggtgggggcgcacacaggcaaggaggaggcggggtgggggggtgcagaataaggaactaaggtaaaaacgcccagtactggactcccctccgagcagcaccccgagagggcccggaggagctgaggcggtgcgagccgagactgccagccccgcccccagcaggccccgccttccgctgctcgccaccgcccccgtgaaaaaaaaccaaaccggtaacctctacccggccgcctcccattggatatgtgagtgagcgatgtccgcccggaccaatgagccgcagccacggcttggcgagcgccttccggcccgcccccgcgcggccgcccctcggaccaccggactggcctggggcgggacgtgggcgcgggggcgcggcgtgcggcacgctgcagggctgaagcggcggcggcggtggggactgcacgtagcccggcgctcggcatggctctcctggtgctcggtaggtgcgggccagcggagggaggcgggcgagctggggtcggcctgaaaggtttcgaatctctaggccgttccccggcgggccgcggccgcaggcggccggaagtgggcctggcgggcgggaggcgcgggcctcggcgtccggaggagctgctaggttgccccggcggaggtgcgggtgcgcgggagactcgggcgcccgtggggaggggcttccgcagccgcggggggcgggagcctcgtgcgctggagccgggcgcggggtccagggccgggcgggagagccgcggagcccagccccggccggatcccggggagggggtctgtattcccggagagtcgcaggggagcttgttccgggctcttctcgaactcgtgcgtggggacggaggttggcgggcgtcctgcactgctgcttgtttctgccacctgctttatgcagctcctacttttaaaaactgaaatgttaagccgggcgcggtggctcacacctgtaatcccagcactttggaaggccgaagcgggtggatcatctgaggtcaggagttcgagaccagcctgaccaacatggcgaaaccccgtctctactaaaa

SEQ ID NO: 11727 - DNA, 1205 bp, Homo sapiens
aagcccattttgaggccattttgagccttactcttaagttctctatgaagaactacattgatttgttggctttcagaatcttttaggaaataaatcctctccaggacaaaaatgaacatgaatggagtggcattttgttccaagtcagaggtgggcacctataataaatgactagggttcactttctgggactgatgtttaattgtaacacagatacaacagggtggccttgttgtgtataatacggtattatacccgcatgtgctctagcaaggataccaaggcaagcatacatgtagctggcttgagtttgtaccaaaacagtccttcaactttgcactgtgccttaagtaattactaacaaaaggtactaggattagctgcaatctctactttcgatgaggaaatcccagtaagctttctgattcaagtacaatgctgccattttttaaagggccacaactatagaattaccactgttggaatttggtacaaaatatgttttgtctattgaaaacatacacggtaaatggtgttgttaggtaggttctgtccagttcttagggacttttttcacattatagcatttttaccctaaacatgatgttgagattattatatactgtattttcttctaaattaaccctaatgtttaaaaactcactttccccctttaattgaaggcattgttttgttagatgcagtaatgatgtttaccagagattattgtttcctatgcaaaataaattttcatattttgaattctgctgagtcttaaaactgtcaatcattaatatgactattttatgtaaggtatagtttttaaacaaactggttaatccttttagaactactgcttgggaccaacaggaagagaaacatggtatctaaagacaaaattattcattctgtagttgttaaaattacagatgtcatatttttaaacatgcaagttaatcttttttcatttgcagttataatctgaccattagcatcaatacaaattatatgatttttagtccaacaaatgttatatttagataacattagtactttatcactgcttaaagcaactcctttaagagcatacttaggtgacagggtctctgtttttccccctttgtaaggcaacaaacactcgagccatctcagacattctacacacatcatacttacttaatctgccagtgatcctgtaaagtaga

SEQ ID NO: 11728 - DNA, 1194 bp, Homo sapiens
ctttaagaagtgaccattatactgtgtatatatatataaacacacacacatatatatatatatatatagtactctaatactgcaagaaggttttttaaacttcccactttattttttatacacattaatcagatatcattacttgctgcagttgcaactatgcacttgtataaagccataatgttggagtttatatcactcattcctgtgtacctgatggaagttgcatgttcatgtttaagcagttactgtaacaagaagtttaaagttaattatatcagtttcctaatgcttcatgataggcaactttacccattttgaatgccttaatttaatttttttcaaagtctcagccctgtctgtattaaaaaacaaaaaaagcgtttaccagctcttaggatgtaaactagctttgtggaagataaatcgtgcactatttttacacataaatagttatatcaatgtcagcctattttgattaacaaatgtttttaaagtattattggttatagaaacaataatggatggtgttggaactaatatatccttgatgtctgtctattattcattcaactctttttacagacctcagtattagtctgtgactacaaaatattttatttgctttaaatttgctggctaccctagatgtgtttttattcctggtaaagacatttgtgattacattttcacacttaagattcaaaatttttcccaaatataaagaaaactaagacagactgtagatgcattttaaatatttaaatatgatcctcagacatgcagctgtgtgtggcagtattttagtaccgggttaagaaaactggcaactgggaagaagtggcctcaaaggcacttaatttgatttttattttttaaatgctgtcaaagttacagtttacgcaggacattcttgccgtattctcatgatcccagataagtgtgtgttttatactgcaacaatatgcagcaatggtaagcgtaaagttttttttttgtttttgtttttttttatattatgaagtcttttaacagtctctctttatataaatacacagagtttggtatgatatttaaatacatcatctggccaggcatggtggcttacgcctgtaatcctagcactttgggaggccaagacgggcggatcacctgaggtgaggagttcaagaccagcctgcccaacatagtgaa

SEQ ID NO: 11729 - DNA, 1161 bp, Homo sapiens
caatctctgtcaggtgctccaaagatgtgccttgtctgtgattcttcccccgatgtcccatatgtgacccctgcagcaggcgctatcccatggccatggtgacttcctcctgccgtcttttgcttggctgtatctcctttacctgtccttcaagtgaagtcaggtcccacccacctcttccccagagccttctctgatgccttgtttgcatactcttcattttcatctctcattttcaattaatcgataacaaattattctagaatgacttgagtcgtgtcgataagtaggcggtctgctccttgaggttgtagatctctcttgacttctacgtgcagccctgggtgcatagctggtatcgctcagtgccagtgacaatgtccctttccttccaggtatgtgagactctgtgaagtagtcgaccacgttttcccgttgctgaaaagaagccattcttcagactttccctgttcggataccttcagtaacttcaccttttggagagagccactgccaccttttgaaaaccaggacattcattctgcctcagcgtaaaatgtcccaagcagcctcttgccagcagtgcagagcctggttgtcacccattaaaggataggtctccccggagtgcacagctccacctgggagcctggcgcgtcatcattggcctgacagcagagagaattgagaagcatttctcccctgccccaccccggggctgacatttctaagcaagataggaagggagcactttctaggctaggagttgggtgcatttgtaccgtgaaaagcattcctcagttgtggcttaatgccagttacgacgctgcctttccggcctgctccagcaagtagctactggttcacgtgcagtttggggctgtgaaacctaggcagaaggcggctgtctgagggctgtccccgcctaggacagggtcaatcgaggaatgccagatgtgcacggtttttggcaaagtagggggcacatttccattatagcaatgttagtgccaccaccttctgaacacagtggggagggctgtgaaggctcatgtgacctggatctgaggtctctgatagaaatctggacgccaccgggtccaggcctggcctcagacttggccttgtggatgggccccttacagtatttgctgactagtc

SEQ ID NO: 11730 - DNA, 1160 bp, Homo sapiens
actatattcttttagatattatgtattgttttactctgattaggttactgtgataggcatttattcatattctttctataccactgtcattaatatattaaaaagatgtatgtgttagactatcgaaagggccttattctctctttctcatagactgaccttcttttggaatttctgagtcatttattttccttagctttttccactcaaattaagggcaagcgaaaaagtaataatttggcattctttaagcctacagaatgtgattctttcacttgtttattacactggctcgtggacagaacaatttgaaaagtgaaagaattattttggtaaaagattttgctttacttttcgaagcattatttttttaaagagtgttttactccaacgattgaaacattttcctatttaaatttcattgttagaatcacaggaggcaaaaaatggaacggttgaatgaaattttactctttctgtgaaagaaaatccacagagttgttgcctccgttgtagttggtgggccccgttagcattggatgcctttgccaaatggttcatgtggacacacaaaggcaaacagatctgccatcgatcgcagatttctgtagaaacacggatgtgcatgtgcagattcccttttgcaggtattaaaaataattaaaaatagtcctgcctgaggttgcagtgagccgagcttgcactactgcactccagcctgggtgacagagtaagactccatgtcaaaaaaaaaaaaaaaaaaaaaaaagtcctgccttaactaactcctctgcgcttgttcactagtaacctaaagaggctatattcattctttatgcaatgagggtatttttgagtgaattttaactgctctgaactaagtataagctcatgggcctgcaaaggttcagacggtttctcctttgcacccaggaggaactttggctgcgagaatggggggatgtatccctcatgcagttggcatccaggcagccctctgcagcagcacaccctgcaggcggagttttcagaggatgcaattttggatcccgaattttgatgtaccttaaacttccacatcactgcaccctgaaacagagcatgctttccagaaagtcacactctcagatctgtgtcaagttcaatgtgagccctggcaa

SEQ ID NO: 11731 - DNA, 1202 bp, Homo sapiens
tacagaaagtcaccctaagtagccatctttcttcatcagaaatatggaatgtgttctgtgatttgtgtattgatctattacagttggatttcttttgaatagaatgtcagcactctgtagttaaatgagtaatatataatgcctactgaaaagtaataggttgtaacatctttgaatattagttaaggaattttatataactttgtaactgaaacacatagaatttggcttcagggttagaaatgttcttaatgaattgcctttttaattcacagtgtttcttttttctatattgactgggtcataaattgaagaatctgttttcagctgatacatagcttatggggttacaaattatcttttatagttgatctgtaattaaaatgtgatttcagttagaattattaaagaccccagaaatctataaagaaaaatcaagacttgtttctatagttgattaattgtgctatttaatattctgttgacagtagtattgggatatggaaaaattgactataaatctgttgacatttagtacaacatactttattttctgtagctgcagcaaaaaattattcctgatcaggaccaactgatggcaatagcactagagtgcatctatacctgtgaacgaaatgatcaactctgtctttgctatgacctactagaatgtctgccagaaagaggatatgggtaagaatacacagtatgccagtcttattgtgtttttttattctaacagttaaaacaaaaacgttgcttccccaaatgcttaccttagagaattttgggaatgtgaaaaaaacataaggaagaaaataaaattatctgcaatcctattgcctaggataaacatttcttgtcctaccaatatatgggaagttctatattttgttcaactgtaattataattaaattctgaattttgtcaaacatgataatttcctattgaaaaacaaaaataccaccacgatctccacaaaaactactttttataagtcagtaggtagtaattgtgtttttaatgaagcatttttcatatttattggctaattatatttattctatgaattatttcttcttggcctttgcctatagtacttcttttaagtagtgaatgtacctaatttttaactgcttttatgtttaaatggaaacgtatataatatgcttttggattatttagttgtatgcaagtcaaa

SEQ ID NO: 11732 - DNA, 1149 bp, Homo sapiens
cttccatggattgaggaacaagctagagacagttctgttatcttttagttatatagtcactcaagctctaatttaagtataaaatcaggacgaatattgatgagcgagttgtgcatcatccttgagtacgtttctttaaagggctccagagaatagttatctaaacacatttgtattgatggtgcaactactattagtgcaagtcaggttaagagctgtgttgaatcctttctagacttgttgctgtaaaatcttaccttagttaacagatggcagcatagaaaatagcccccaacatagccaaggacacccagggaatgaaatggttaattacacttgggaaatactactatcactcaggaatcagtaagtctcagtctctggaacattgcaacaaatgaaggaattatcttgttagtgagactgaatgattttttttggtggtagggggtgggaatgtatgatttataaaacctgtactgacgtgtttttctgtgttttcttctcaaatccagcaattgggtcagatggtctttgttgtcaaagcagagaagtaaaggaatggcatgggtgtagagctactaaaggattaatgaaaggtatttgaacagcatctgcacttgtataaacttttgaggcaaggtattaatacgtgagggtttttttgttgttgtttgtttgtttttgagatggagtctcgcacgtcgcccgggctggagggcccgggctggagggcagtggtgccatctcggctcactgcaacctccacctcccgggttcaagcaattctcctaccgcagcttcccgagtagctgggattacaggcgcccaccaccatgcctggctaatttttgtacttttagtagagatgggtttcaccatgttggccaggctggttttgaactcctaacctcaggtgatctgcttgccttagcctcctaaagtgctgcctgcaggcgtgagccactatgcctggcccatgagtttttaaaaatagctttaagtcgaggatctgggaaggtgtttgatggtacaaatatacctataattcttcatttggtacatacctgtgtaattcagaaacaatgggaagatgacttcatggtaaatgaatcgtgtgtgtgatttatataaatctcaatgtatttt

SEQ ID NO: 11733 - DNA, 1209 bp, Homo sapiens
gggaggagaaaaatggaaggtaaatggagggagaggtgagttcaagggaggttttcttgtgtgttttactgtgagagtatgtttatatgctttgaaatgtctaatggaaatgaacttgtagacagggagtaatgaaaaatgtagaggggtagaagtgacagtttcaggagtaaagtaaaaaaatgaagaagctggccttaggcagcacagtttatccatagtgacaggagagaggcatgaatgcaggtaagctggtagatttgacattgtcagcatgaggaaggtcttttctgattgttttaatctctctctctctcttgttttttaaggaaaagatcttggtctggcatttgaaataccaccacatatgaaaaaccaagccctctttcctgcctgtgttttgaaggtaattaggaatctagttagaaaaaatttgctgtggttgtaagctgcttactcttcattattttgtatacgatggttttcaattagggtaggaattttaattttctgttttattcaatgctagaatgctgaactgaaatttaacttcggtgaagaggaatttaagtttccaccaaaagatggctttgttgctctttccaaggcaccggatggttacattgtcaaatcacagcactcaggtattatacctgcaagggtaaggatttctagaatagtgagaataattgatgagaactccagtaagtaaggcgtctcatagtgagttacatatactttccttgctggtttagtcacacatctttttttaacacagcagtaaaattcatttttaaaacctaattcataaactcttaagtatttggtttcagtgtaggcattttgggatcgcaatcataacggtaatgatatctaatatttatagaatgtgtgcttattcagtgccagggcaccacattaagtgctttacatggtttagtcttcacaacaaccctataaggtagtagttttcccattttacagacaacctaacgaatagggactttaagtgatttgcccaaggtcacagagcaaataagtggtagaactgaattcaaatctaagcagtctgacttccaagtttatactcttatccattgtatatctaatatttaaagtatatttcataacttgtttgtcacaaaacaagtgagtcatttttgtagacatatcaatcaattagaattattccaagtagatttttattgt

SEQ ID NO: 11734 - DNA, 1165 bp, Homo sapiens
ttgcagaaaactacaagtaaaaattcttagttactttgtcctgtagaccgtttagggtgtgtattccagattattagtactgttgcctgttcgaaggaaaaataacttcagctattgaaaaattgttgtcttctctgtagttatatccttctttcttaggaagcatttaagaaggacaagcttttgagagaaggggacagacagtaatacaggatttttggcttacaaaaatgactcattttacttagtttttgtagggacgtgaggaagagatggcatgatttctatgtgacagtgagggaactgaacctcagagaggttaacctgcccaaagtcataactctagttgtcgctacatagagtaaggtgttgaacttatctttggagtctaggctagcacactttgtgtttcatatcagtgtttgtgtgatttattaattattattataaaagttcatctcaatttggggtttcctcttcttaggtgattgtttgctctgccactttgcattctttcgatgtaaagaaactgtccgagaagataatgcattttcctacatgggttgacttaaaaggagaagactctgttccagatactgtacaccatgttgttgtcccagtaaatcccaaaactgacagactctgggaaaggcttggaaagagccacattagagtaagtggtttataatattaacatttatgtagaataaagcaatttataaactaggtcagccttgggctcttagtgatgcttaaggcaatcagttattgtatcaaagaaaagtccaatacatcgtaaacccttagacctttaaaaagcactgaataagtgatggactccatcttttgtttttctgtcttcgtaatattacttttgtgatcagcttccttgatacagtctttataagtaaataacatatatttatctaatttcagatacaatgatttccatttttagtagtattttagtaggagccctcatctgtgtcctcttgatgtactttgttctaaaaatcaatttcatgtggtcatcttgtcactttcttcactgtgattagatttgcctttatatagtaaggttatatttattataaatatacaatattttagaaaccacattttcattattattattacctttaaaagtggtcttagacctatagtt

SEQ ID NO: 11735 - DNA, 1090 bp, Homo sapiens
gttcctgaaaaattgtaagactcaggcctaactagttgtttccgagccaagggtgggtagaggtgttgggacagctgttagtgaggcctaattatttatttatattgaaataattgatttaacattttttaaagtcaaagttctggagataacttgcccagtagtacattttattgctgcaagcaaagtttaaagtgatataattgagccaaagtattgctgacaagttatttcaagcatgtcatttacattactttgttatttgtgtgtgatgcaggtggaagctataaaggccatgtggatattttggcacctactgttcaagagttggctgcccttgaaaaggaggcgcagacatctttcctgcatcttggctaccttcctaaccagctgttcagaaccttctgatttttacatttactgaataagatttgagtaatgaaagtctgtagtcttaaaactctaaaacagttgtactgcttccaagcagcagtatttatagtaacgtaagctattaatgctaactcttgcatgtcaagaaacattagtcttaggaattcttcaaaaaatggcatcccaatgaaaataaatttgatgactatattttcatgaaggtttgtgtcttattttaaagttatattgatatattttttctatttcttttttaagaacagtatgggcttatgaagtagaatttatgggtatgtgaatctggcagaggacttacgtggaaccactcgggaatattctaaaagtaggttttcagatggctaaggttgtctatgtgtatattgaagctagaggagagttggaacatgaagggaaattcgatgatcccaatgtagaagaactgcttggttagtttggaagcatggaagttttgagggagtcagtaaaggttctgtatctaaggactgatgactgatgtgatggtgccagtgaagatgtatcttctttttatgaaccttgctttccagatgatgcatacccatcaaagtagaactaatctgctgtccctacaggtcttaaaatcaaacttaaactcagggttttttttgttggttatttttttgtttgtttgtttgtttgt

SEQ ID NO: 11736 - DNA, 1424 bp, Homo sapiens
ctccaggccgaggagcaccagcttttgctggaaaaggaaaaattgcaggcaagacagcagcagttgctaaagaaaattgaacacgctcggacttgctagacgcttctcaaaactggacagtcactgccactttgcacattttgattttttttttaaacaaacattgtgttgacattaagaatgttggtttactttcaaatcggtcccctgtcgagttcggctctgggtgggcagtaggaccaccagtgtggggttctgctgggaccttggagagcctgcatcccaggatgctgggtggccctgcagcctcctccacctcacctccatgacagcgctaaacgttggtgacggttgggagcctctggggctgttgaagtcaccttgtgtgttccaagtttccaaacaacagaaagtcattccttctttttaaaatggtgcttaagttccagcagatgccacataaggggtttgccatttgatacccctggggaacatttctgtaaataccattgacacatccgccttttgtatacatcctgggtaatgagaggtggcttttgcggccagtattagactggaagttcatacctaagtactgtaataatacctcaatgtttgaggagcatgttttgtatacaaatatattgttaatctctgttatgtactgtactaattcttacactgcctgtatactttagtatgacgctgatacataactaaatttgatacttatattttcgtatgaaaatgagttgtgaaagttttgagtagatattactttatcactttttgaactaagaaacttttgtaaagaaatttactatatatatatgcctttttcctagcctgtttcttcctgttaatgtatttgttcatgtttggtgcatagaactgggtaaatgcaaagttctgtgtttaatttcttcaaaatgtatatatttagtgctgcatcttatagcactttgaaatacctcatgtttatgaaaataaatagcttaaaattaaatgatgcaactcaaccttttccttaatggcattacactctgtcccttaaggagcaaccataaataatccataacctatagagggaatttggtttccgtaaatagccctttttgcacctgtacaatcctggttggggggcatgagtcattgtccccacttaaggtggagggaactgagtttggggaaattaaggcagttctccaagattatgcagaatagagatgttattagcgactattgtgtgcattgtagcaatggcatttgataatttacagagcacttctgtatactgtggctccttagtggaattaagctgagacctcagatcagtccctttaaaagaaaagtaaaaatagccacagggttgtttaactcgcttgtattgggctttggtagtattcgtcccattggcagacagt

SEQ ID NO: 11737 - DNA, 1143 bp, Homo sapiens
cagaagatgtatatgtttacataatttaatacagattgatgttaatacttgtgtatttacataaccgtttccttcttgtcactgaaatatatggaccttaatttgtatcctgactgactcaacccagcagagcataaattgacttgagagccttacctttgatgtctgaaatgaaacccccttctccaaaggcaaaattcggagactttgatctttgctactggagtcctttaacaacatctataacgataaaaaattcctaattgtttgtggtagtattttaattctagatgtgttatctctctgggaagtatagtttatagaaacacaaaatatttgatttcctgtgtcggctcagctacaagaaacacaactgttatcttgacagaggaagagaggaatccaagaaaaatgcatgtggagaattaaacccaagtgtttcgaattcagcacaccccctctctgtcctcagactgcagtccacacgtgcaacttttctgtttgcacgtgttttattaatcagcatactccttttctgtttggatttatatccctctaatgttctcctttaatttcacatgaaaaaaaaatctcctgtatttttttcagttagtgggagagcagcagaaatagatagatgtgctgttgccactggactgatgaaggtggctgtcttggaactgggagacaggtcctcagaggtgcactcaggcaacaggacagccatctctctgcttcagccctctgcctacagggattagggaaatggagctctggctttgaagttatttgtgagtttagcaaccttccagttacctgcagagttctgggtgcacagccacccctcataagagccctgttctctgaagaccattcatatgagaacaaaggtctaggatactgcattagttaccagaaaactaggggaatttagagggaaaaaaaatccatgttttctatttcccaggtttttaaaaagtagctcttccccaaccccgttgctagcttgttgcaatataaaagccctggtgcacctgaatttactcctggccttactaatgattcataatgtgatcttgagaaatgtgtttaagctttctgagtcttaacctccttgtctctaaaatgggcaattaaaacaat

SEQ ID NO: 11738 - DNA, 1161 bp, Homo sapiens
attaggtgaaaatgcttataaatatattttgttagtaaagtattgcatttaagtattgtagtaatatctcttttaaatgatacatacctttataccaggatccatttcaaaggatgaggcttttttttttcgcatcccattaaggactttgaaaatcgtttgattttcagaaccccattggaaggctagaatagtataaactgaacatagaaaagccaccgttgatttacattagagtgggacaatttttttcacaggatttggtggattttctctccattgtatcctatgggtataggggatttcccattcagttaaaatattatttaaactgctttatataaaagtatgttaaatcatttataaactatgattaaatgatctgtaaagtcatttaaactgctttatataaaaatataagtcatttatatgctataattaaagaggaggatgttaatatttcaaaataagtatttatgagcccttctgtaattttctctcacttttaggagcttgcattcatcttcgggacccagaacttgctttggctattgaatcttgcttaaaagggcttctgcaggcctattgttgccataatcatgctgatgaaagggtccttcaggcactcatgaaaaggttttatttaccagggacctcacggccaccgataatagtttctgagtttcggaatgagatatatgatgtaagacacaggtaaggcattagtaattgaatatgtttctggctttgcttaatcatatgcaagattggaaagagttaaaacacttttaatgttaatcatatctttaccactgatttgtaaaatttcatcaagccactttaatttctgtctaggtattagttctgggcattagagaaacatagataaatactccctaccattgaagttcttatatgtgggagacattacagggaaacagatgtagtatggcttagaaattacaccagtgaggaaaatgatatgaccaatttaagagggaggggcctgaggaagaacattggcacccattacacacagttaaattctgaaggtgtttcacagaatccgtgaagagcagtaattgtgttctttgatgaccttaacaagtcttttcaagggagctcagtacccaaactggcttctttgctaactactggcta

SEQ ID NO: 11739 - DNA, 1590 bp, Homo sapiens
gacatgatataagttcatgatcttctgactacaaactgattctgatgaaagtcaggatccaggagctagcgtcttattgggtgtttcctattgcatggtttaacccaactcctcaacacctgaagtgtaattggcactggcacttcatcggtcacactggaatgagggcagagcaatggcacccactgcctgcctgtctaggaatccttgtccagaagcaggactctctctccccacctccctctctccaccctccccttcgctagcaatcttggtaaaattccaggttattgaggcatctacttgggaacattttagctaacagtttcttcagctcttctttatggttttgtataaccctatttagggcataaagtctgaaagctgaattatctcacaaaggattttaaaggagaattaaatctgatacaattttttttctctctttagtacgttttgccaacctatgaaatggccgtgaaaatgcctgaaaaagaaccaccacctccttacttacctgcctgaagaaattctgcctttgacaataaatcctataccagctttttgtttgtttatgttacagaatgctgcaattcagggctcttcaaacttgtttgatataaaatatgttgtcttttgtttaagcatttattttcaaacactaaggagctttttgacatctgttaaacgtctttttgtttttttgttaagtcttttacattttaatagtttttgaagacaatctaggttaagcaagagcaaagtgccattgtttgcctttaattggggggtgggaagggaaagagggtacttgccacatagtttcctttttaactgcactttctttatataatcgtttgcattttgttacttgctaccctgagtactttcaggaagactgacttaaatattcggggtgagtaagtagttgggtataagatctgaacttttcatctgcagaggcaagaaaaatatttgacattgtgacttgactgtggaagatgatggttgcatgtttctagtttgtatatgtttccatctttgtgataagatgatttaataaatctctttaaatacttagggttgtcattgtttttaatccgttacttttttttaagataaaccctgacattttccattacagtgtattcagagtgccagtgtttattttttttttaactttgagaatacagttggcccttcgtatccatgggttctgtatccatgggttctatatccatggagttaatcgactgtggattgaaaatatttggggggaaaaatggatagttggatctgtactgaacatgtacagactttttattcttgtcgttgttctctaaaaaatacactataacaatttatgtagcattcacattatattagatattataagtaatctagagatcattttaaaaatatgggaggatatgcatgggtcatatgcaaatactataccattttattataagggacttgagcaactgtggatttgggtatctggagggagaacctgcaaccagtcccccatagataccaagggacaactgcacaatgatgcacagttaattagaaatcattttcttaatc

SEQ ID NO: 11740 - DNA, 1729 bp, Homo sapiens
ctgtggggtcagggtggggctgaccacagccaaggccactgctttggggagggtctgcagcagagcccaaggagccgctgagctgagctggccccgtctacctgccctaggggtcattgccggaggcctcgtggggctcatctttgctgtgtgcctggtgggtttcatgctgtaccgcatgaagaagaaggacgaaggcagctactccttggaggagccgaaacaagccaacggcggggcctaccagaagcccaccaaacaggaggaattctatgcctgacgcgggagccatgcgccccctccgccctgccactcactaggcccccacttgcctcttccttgaagaactgcaggccctggcctcccctgccaccaggccacctccccagcattccagcccctctggtcgctcctgcccacggagtcgtggggtgtgctgggagctccactctgcttctctgacttctgcctggagacttagggcaccaggggtttctcgcataggacctttccaccacagccagcacctggcatcgcaccattctgactcggtttctccaaactgaagcagcctctccccaggtccagctctggaggggagggggatccgactgctttggacctaaatggcctcatgtggctggaagatcctgcgggtggggcttggggctcacacacctgtagcacttactggtaggaccaagcatcttgggggggtggccgctgagtggcaggggacaggagtccactttgtttcgtggggaggtctaatctagatatcgacttgtttttgcacatgtttcctctagttctttgttcatagcccagtagaccttgttacttctgaggtaagttaagtaagttgattcggtatccccccatcttgcttccctaatctatggtcgggagacagcatcagggttaagaagactttttttttttttttttaaactaggagaaccaaatctggaagccaaaatgtaggcttagtttgtgtgttgtctcttgagtttgtcgctcatgtgtgcaacagggtatggactatctgtctggtggccccgtttctggtggtctgttggcaggctggccagtccaggctgccgtggggccgccgcctctttcaagcagtcgtgcctgtgtccatgcgctcagggccatgctgaggcctgggccgctgccacgttggagaagcccgtgtgagaagtgaatgctgggactcagccttcagacagagaggactgtagggagggcggcaggggcctggagatcctcctgcagaccacgcccgtcctgcctgtggcgccgtctccaggggctgcttcctcctggaaattgacgaggggtgtcttgggcagagctggctctgagcgcctccatccaaggccaggttctccgttagctcctgtggccccaccctgggccctgggctggaatcaggaatattttccaaagagtgatagtcttttgcttttggcaaaactctacttaatccaatgggtttttccctgtacagtagattttccaaatgtaataaactttaatataaagtagtcctgtgaatgccactgccttcgcttcttgcctctgtgctgtgtgtgacgtgaccggacttttctgcaaacaccaacatgttgggaaacttggctcgaatctctgtgccttcgtctttcccatggggagggattctggttccagggtccctctgtgtatttgcttttttgttttggct

SEQ ID NO: 11741 - DNA, 2844 bp, Homo sapiens
acaaccccatagcacaacaggtttatagagatgtatatagaattatagtccttatttttttcctttgcgtgaaaccttttataacagattaacaatcaactgcataaatattattaatattttaaaaagagttaagttgtattttgataattcacaaactatcatgcaaataacgagtaagtagacaagaataaagtggtttgagatgaaaagaacctaacattatttacagtagatgtggttttaatacaattactgccctaaaatgtctctggcaatgtacagaaatattgtatatacttacatatgtaattgttgtaagagttaaatacaaaatcatggtgacacttccaattaagtgcactaaatgaaaagttaagtcacttattaacttttcagtttggtttgcaatgagaaagagtggaaatttgtattttgttttgcttatagaattacagacatgttgaggaagtgttgagctttattttgctttttcatagaggcagaaagtaggaaccagatagagatgaaaaggggccactgaaaagtgaatttgatagctcagcatttaagcatgattacatattcagatagctctttttgctttctataaatatatgcattgtgtgtgtagtaatagatgtaagtttacactttgaaaggaaatcttgtttcaatgtttattataaaagccttgctaatttagtagtgatgctttccttggttgtacaggtgtacatttgtaaaccttcatgctgtaaatggaatttgttttatctctttgggatacatttgcattttagtgtacatttacgtccctgccctctttgacctggcaatatagtgttgtataatgtaaatttatttctccaaatcgagagtgattttttaaaaattttttatctttatatggtttcagaagtatgaaccagctttctttttattattgtgagatcattttgttttataacatagttgttgactgttaatatggacctgctagaatttggatcactttcaattgaagtcagggtattgtgcataatagaaagtattggactgagatatttggttaccatggaggccaatgcttttttcatcttattaaatgtgatgtgacttttttctttgtacagaagagtactgtatttttgaatagcctactcccaagtaagagcaaatctgtatgataacattttttcctctggacataagacataacagtaacacgatgtacatttacaagcggccttatgtacatttcccaacaatctttttaaggcaaaattgtgaccatatgtgtataattaaaatcgtttttaatcctttgcctatgaaaatattttggaaaaaaacttgctgtgtatattcagtttctgaaagataaagaaagtgctttgtattttgttgaagtcagtattttgtataaacatttatgttgacccacttatgttcagtgctgaaaactaaaatgaacatgctattctgtcagctgaatatggaagagatctttttttactagagatctgcagaagaaacgcaatcttctgagcacaatatggaatctaaaggttttatcacttagttgttcatattatgaacctaaaaataatggcataaagtttggggatgccaggcatactttttcatgtttggtgttgagttattttacttttctaacccaacattccttggtgagaccattaaatccaaacacttgtcaccgttccttctcatagtcactctgggtcatcagcatgtcccagtcactgcagcaacgccttgtgtttgtttcatttttttaaaacccacacaaagccgctgtctcactttttcctactttaccaacctcagagtatttcggcccgtatcgaacttttgttctcagtatcagcccatggtttcaggatcaaagctgtcatgttggagattggtaatggctttcctgtctttgtacagttgaattcctagtcttccttcatccttgccctctgttggcacaggcattatctctgcaattttagaaaatgacaagtagagaatactacattgagaaactaaaccctcttcttggggtcctgatactcattcccatttgtcccagtgctgacaacccaatcttcccaatactttcaggcctgctctacaaaagtacctgttcttgtagaaattttacagtctgccattttgggtgcccaccccaatttttaccttttagtaagttggcatgaaattttggtaaaatctgaaaatcacatttcagaataaaacaattgggcaaaactacctaggctttactcttgagtgtctccttttgatagggattgtttctggaccagtttgtctaagtcctggctcttattggttcatatgaaataatgttaacttcacttctttgtatattatgtataaattagaaaatgaaaaatgtgtgaataacattgtatgaaataaacctggtcttgtgtttttctctagataaaatacccctctgtacctcagttataacttaagattgattgcccattcaggtttactccgacgtaaagaaaacaaacatttttaacacatgggtgctgttctggagccactgattcctctgatggtattaattccatgctttgattagtatttaggacctataactgcatacttcataggataaaacttttagcccgttttcacatgaactcgaggaggcagtgttgtctaaaggtaaacaatttaagttcagatgtggatttaaagtttaccttatttacacaccttgtgaacttttctaaaccttgagcccttagtctgtatcaagggataatactacttaactcattagttttaacagtg

SEQ ID NO: 11742 - DNA, 1124 bp, Homo sapiens
aattgtatattcctgcctcactgaatccctagctcataatgtgactttataagattgagtgaaaaactactatttaccagtagcagttctggctctcacatttattttatgccagtctcatgctaatacatactgtgcagtcatttctttttgaatttatatttttattttctataacatacctcgagacagtacagttatgtcataatcggtattacatttaattctcacagcaattctgcaaaacagctgtttcttaaatgaaaactaatttagagttagcggtacatgcccaaggtcacttagtaaaaatttgaaccattatgcacactctgctccccacccccacaccaccccagattcagagtagaaatgtttttatctaatgaaaaaaatcatactttacattgttgtttattatttctccccttttaaaatatagctggtgtattctcagcaggccttgctccagctgcatttgtgccaaatccatacattattagtgctgctcctccagggaccgatccgtatactgcagcaggattggctgcagcagctacattagcaggtaacatactatttgttcatctttattatggttgctttttaatgtatttagttttgggtgtaagctttatttttctctatttgggcaatttgaaattcctaagaaaaactgaaacattatccagaatgaactaaagtttccaggaagttagtactatttttcaactgtaatgctacagggaaaagcttaagcaataacttttcctcgtatacgtaattggcttacatttcagctttatagttttagaaatctatatagtcaaccatgaatctccattttaatgacaaaccccattacccgcagagacaatgcaaagtaaaattacttctcagaaaataaaatagaggtaggtggcctgcatacataggtcaggggtagaatagagtaagataaacagatacagtaattctgagaaaatatgtatctaaaatttcttgagcaatgctaaaatgtacaaacaaggtgggggacaaaaagtttggatcaagttggaaagaacgtactaaaaactgcccagcctgagactaccacccagaatctgaaataaaagccaaag

SEQ ID NO: 11743 - DNA, 1221 bp, Homo sapiens
ttggttacgttacttttatttttaattcaatttgtttttctgtgcccttcctatagctaagagaaattttgtaactattattgctattcttctgcttagccacttgaaaaacgtgaaatgatagaaccattggaaatatgtataatctgaaccatgttacaaaagtcaaatcatactaatttttaaacataatctgtaaaattaaaattgcttattcctggtagtgcttgatctgaaagtaactaaacaaaatcgtctacgcattaaagaaaattttaatctagtttgtggtgttaactgcttttccagcaccgctatagttaaggttgccttagcccttctgttataaatcactagtttgtacgcaattttttggcctttgataaattaattgactacgaaattaaataagattcaatgcttttattgtttacatgcactgtagtgtagtgttaggtcaccttatggtgccttttttttgtgttctattaaatattcagaatcaaacagattctttttcctcagggcactagagatgctgaaacagatggacctgagaaaggagatcaaaaaggcaaggcttctccatttgaggaggaccaaaacagagatcttaaacaaggagatgatgatgattctaaaataaatggcagaggtttgccaaatggaatggatgccgattgcaaagattttaagtaagattttaactttctcaagaagaaaagcgtatctttttagggattattactattagttgatgtgactgatttagacattttcatcatttaggtttatttcctttgaactttgtgttaatctggacaaattttagttttttactataaagaaaatttgtgattatgaaccattttaaaaaaataatcttcaaaccagcctctgaaacagtgcattctgttgaaggagtaatgttagaagctgtgcttacttttctggtaatataatagtctaaatttgaactttttcctctctgttaaattttagtgaactgtaggtttactctgatttttttttttcccctcttgggagtgcttttgagcacctttcagtggagttttcttccttctgagtatatatgccctgcctcccatttaacttttaagaggagacaaaattagcttaggagcagtaatctttcttaaaatatatgagtttgtgctaatacttaagattattcctgcaaatagcaaatagggaacatat

SEQ ID NO: 11744 - DNA, 1134 bp, Homo sapiens
cgtgcgccagggcagggcccgtgccttagacttctcccgacccccagagcgctggtacacaggtctaggcaccacacagtgctttggaaattctcagtgaatgatgtttaataaagcaaaaaatgtcaaggtgtctttcttggatataattcttcatgttcagagctagttttttgttttgttttgttttgttttttaatgaaacagtagttttaaaggaaatgcaaccactattgctccttggccctgtcctgcctggcagaagcattgagcgggtgggactaggacctcagacccttttctgatagacaccaaagccagccctgagggagcccccggctgatggtgcgggtggtttgcagccatcagtgttgagtgtctcagctcctggcccgtgccaggacctgtctgctctgtcctgcatctgatcacgtccctctccagctgtggcgccctgtcctgagcagcttcccctccaccagtgctagagtgagaggaaacaggtggttttggggtcgagagctgactccctcctcctccgtcttaacccaggctcagagggtcagctccctccccagggctctgagccagctctgggacagctccagcaccggctccacccatttgccttcccccttcacacccgcccctccttcccagcactcagccccgggccctgcatcccttgctgactgcagcggaaggtctcagtaggagtggggaggggatggggccaggtcttcctccgagaggtggctccagctctcctctgggctttgtcccctccctgccctttctgcaccctgatgctggctccctgcctcctgctccccacctgctttgggtcaagtgacataggagcagagggcacagcggggtaggtggccacaggggctggtgctctgcttggggtcactggcagaacctggcctgcccgttgtgtattcatccactgtggacgccacctcctcagtggtctggactctctggacaccatcacaaagacccccagatattgatgctccagtatctgtggcttgttcttcacccacaggactgcgactcatggccaatcaatgatccttgtcgcctgataaagcctgtgcctgtgacccattccagcctgtgttagtg

SEQ ID NO: 11745 - DNA, 1161 bp, Homo sapiens
agcactttgggaggtcgaggcgggcagatcacgaggtcaggagatcgagaccatcctgactaacgtggtgaaaccctgtctctactaaaaaatacaacaaaattagccgggcgtggtggtgtgcgcctgtagtcccagctactcaggaggctgaggcaggagaatggtgtgaatctgggagacggagcttgtagtgagccgagatcgtgccactgcacttcagcctgggtgacagagcgagactccgtctcaaaaaaaaaaaaaaaaaaaatacactttggtttgtgtataagtatgtatggaagaataaacaaactgaaaacagtagttgcttactggaggagacatggttgttggaaactgggtggtaagatttcctcgttgctatatactccttcatacctgctgcatgttgtaccatttgcttttattacctattaagaaaatataataaattttaaaaatgaaaacaaatacaataaatattatttgttttcttcttactaggcatatttgatgagaccttctataatattttttgatgaaatagatggattagctccagttcgctctagcagacaagatcagatccacaggtaatttttctttatctgattatcttgatttcttttttacgcattgacttggtagttagccttagcccttagctaagtgctatgaggcttacaaagaaatttaaaacaatctgtgtctgtgaggactacttctttctcttagtacaggggtcagcacaccacagcctgtgagccaaatccaggcctctgtgtgtttttgtaaatgaagttatattggaatacaaccatgttcattccttaagcattgcatgtggtttcttatgtgctacaatagtagagttcagcagctgtgatagagagaccgaatgcgttgcaaagtttaaaacatttactatgtgggcttttaattttttttttttttaatttattttagagacgagttcttgctctcttgcctaggctggttttcaactcctggcctcaaaccatcctccccagtcagcctcccaaagtgccgagattacaggcgtgagccactgtgtccagcctatctgaccttttacagaaaaagttttctcatcctaatttagcataattttttggtttttttttttagagtcagagt

SEQ ID NO: 11746 - DNA, 1498 bp, Homo sapiens
acttgagaggcagaggttgcaatgagctgagattgtgccactgcactccagcctaggcaacagagtgagagtctatctcaaaaaaacaaaaacaaaaacaaaaacaaaacaaaacaaagacaacgtagagccagtcagggtggcaagagcacctgtagtccccacaactcacgaggctgttctgtgtagtagctgtgttcttagtattcctgatgtgacagtcagcttgacctatggatattttagttaagataaaaacgaagaacaaaattacctaattcaagaaattacaggcttatccggtatatctatccatgtttatttcctctgatggtttcaggttgatttcaaaatacttaactaaaaacgtatttcaatttactgtttttaaaagacagttaccagtttaaaagacagttctgtaagtcaactatcaatgctcaggtaaatgtatatcttaattaagtttaacttacctctccagggggaacacacctgaaactagaggaacagcttatgtggtctatgaggacatctttgatgccaagaatgcatgtgatcacctatcgggattcaatgtttgtaacagataccttgtggttttgtactataatgccaacagggtaagtatagcaaagttctcattgtgtagtgatctcatttgagaattagtgtagaactggccgggcgcggtggctcatgcctgtaatcccagcattttgggaggccgaggtgggcggatcacgaggtcaggagatcgagaccatcctggctaacacggtgaaaccccgtctgtactaaaaatacaaaaaattagccgggcgtggtggcgggcgcctgtagtcccagctactcgggaggctgaggcaggagaatggcgtgaaccccagggggtggagcctgcagtgagccaagatcacgccactgcactccagcctgggcaacagagagactccgtctcaagagaattagtgtagaactgtactgtgatgatatatgtctactatgactttcttttttggctaatgctattgatgaaattcatttggctgtagattggtaatttaattttggtgcttaccacatttccaggcatttcagaagatggacacaaagaagaaggaggaacagttgaagcttctcaaggagaaatatggcatcaacacagatccaccaaaataaatgttttctacattttcatttggactaaatcccacgaatgacaactaccacctttttttcctttttaattaatactaaatattgtgatttcttatttgaggttcaaaatgacctgcttgaaactttgatacatattggaatacattatgttaataaacttgtagctttttgtgaaacacctcagtcttttctcttgaactttcccttcctgtttgataccaggaaaaaacagttgaagcttatcaagaattgtaggtgctcctagggattctgagtttcttgagaacaggatctctttacattcttaatgcctcca

SEQ ID NO: 11747 - DNA, 1319 bp, Homo sapiens
acttcttccggatgtagctctttaatgattttataaagaagaaagacttctgactctcctgtgtttattcaccagatttcctgggtcgtactgaaattccagtggcaaaaattcgaacagaacaggaaagcaaaggccctatgacccgccgactgctgctgcatgaggtccccaccggggaggtctgggtccgttttgacctgcagctttttgagcaaaaaactctcctgtaggggttctaaaggacagcaccagcgggacagcccacaaggctggggctggagaatgagagactgcgctctcttggggctgagggagcaccatgcagcttcacccctcacaaagccatgcacgctgggggctctgttttcctgcacactaaatagctagcaatctatgcaaacacctttcccataaagaaaccaaaccccatagtacagtgccttgtcctagtgttcacatgttcagctctgtttgtttagatgccaaggtttccattttcagggctataaaaagtattacttggaaatgaggcatcagaccaccagatgttaccgctcggttgaatgtgtccaccgtggagtggtttggtgacgctgtaaccattccacgccagtgacctctgctgggtcacagccactcaggaggggaagggtcaggatgagaggctgcagcctcgacacttggcgcggcctgatactgaaatagcgtctactcgtgcactgaataaaaacagaaacttgatcattttattcctgattagattttatcactctctgctaagacaatatagtctggagtataagtgggaaagcttgatttaaatactgtgaactctaataatgtggaaaatatttttcaactttaattttctgaagtataaattatttatgtaaattcattgtttttgcatatttcttaggacatgcatctttaagctttatcattgcccatatgtacagaaagagaataaagacatatgtttatggatggaacttcgtcaaagtctgactgatttactttctatatgaaagctgctttttttctttttaattttctcagccagatgaaaggctcttaaaaggtaccttcacaagttgcctataatgaaaccaagtttccttcctggtacgtgggaaaaccaaggacagagtgaggatgaggtcaggagacccagggcctcatcttgactctgccactaatttgctctgtgactttggtgaatctacctcgtgtttctggggctgggtttctttaatgggtgaaatggatgatctctgtgggagctactgaccctccttcagcttgcctcatcgagt

SEQ ID NO: 11748 - DNA, 1129 bp, Homo sapiens
ctgtgttcatggcacagatcactcacctgctcagtggagccgcaatggtctttgtaaagcaccccccaccccaccctgccccaccgtggccttcagaccagagctcccacattcttctccagcctccacatgaatgccaggccccaacctccctgctgcatctccagctgtgccaggccagcctgtggcctccaccccacagggggcctgtgctctgagccagctgcatctccaccttcctccccgccggccccctgcatctccaccttccttcccgccgggcccccccatgcagcctgccctcctgcctgggcctcccaccagcttcctggctgctatagttgcagctctttatgtgtttttttattcaggtttcccccattttgttatatactcctaaaaggtatgtttaaaacagcttttgctaatttagtgttattttaatggtactttaaaagcttgctgttgaaaaatcaatgattgatcatttcataacgcatatgatctcttaattggccaaagatgtcaatccggtttttctgcctgagttttgcttcccatcagcatctgcatatgttgctgtgcatcgtccgtgcgttcagtccttcccacatttgtcaattactttgtgccaggctctgtgctaggcttaactgagcctggactttggtatctgatgtttaaatgttgaccctgccatttagcagctctgagtggatcacactccagtcctttctaagcctcagtgtttctcatcagtaaaatggggagctacattatcaggtaattatgcagtttaaataatataatttacataagtctagcacatgcctaacacaaagtaagtatccagtaaatgttagctgctattaagtgctgcacaaataccatgtattattttattaatattactatttgctaggcaattgaggggttaatataaggatgatcgaaacagtccatgctctaccctggctcctgtctggcagaggagacagacattacacacgatttcagacccagcaggctgtgggctgctcataagcgagggatactggatgcagaggagggaagggatctgggaggtagatgtgggatcagacctgcatcttgaaggatgagtaggatg

SEQ ID NO: 11749 - DNA, 1101 bp, Homo sapiens
ctctaatacctgttcttcaaccatattggctactttgacataagaatttacttcttttcctggaatggaaaacactttaaaaaataataacaaacattattataaactaatatatgtgagagtacttagttgatacaaaaaggagttttagtagacagtattatactatatttgaaaatcaaggagaattttatgcaacttaaaatgtttacaaactgcagtgcaatctactgtttgtgaatgtcaaagtatcaggaaaagtgtatatacaatcacagagtcatatttcctcacaaagttatttacaaagagtgaaatatgtttttgtacctctcagtttcagttagaggcatattttgtgcaatatttatgttaatgtgcctatacattatgaatgaattatttcagtcatacattgcctaaatcataactttatgatgcttgggaaagaatcaacagttaaaacttcataaagttataatgtctgtgttccaaaatacatcacattattaggatgtagggagataagtatgtgtgctccctagggtggcaatttctagttactagaccacctctatttttagcatttggcatcctcatgatacttttataaatatgacattaataggaaagcaataatttcattttacagatagaataacagatttgcctgcattcactgaaagagtgcaaagactgggtccttgtgaattcaactgactctcccaaattgtattaattacctgttcttgccttttattttctgaacttgctgcttttgcattcttttgagttcaaagacagttactttaaatccatttttaaaccctcggggtagaaatcataccactgttaatcagccacattatttggtctaaggttttttctttataattctgaaactgagtttatctaatacattgatgaattatttcaaacgtatttttatagttcaaatcacttcacttttacactgataaatataaattactgggaatgaccttcagacagcgtttagcatctgtaaccaacctgaaaataatatgttcatcaggtacctatggattaaatcatatactggcgtatttaagctgaatgtca

SEQ ID NO: 11750 - DNA, 1113 bp, Homo sapiens
aaggaacaaaacactccttcctttgagagaggagggaaagaaagaagaatgaatagaatagaataggaggaagttaagagaaaagcagagaaacagagggagccaagcatgccaatttccttccctagtggagtaaacagaattacattgcaagctggaagagaaaaaagatttacagtaacattcctttttcatttgttccatgatatgtatttcatggatgtgtgaatacatttcttgagtacacattatttaccttctctaccagtgatgtgatgaggtttctttgaatggtgggttttcagtctgtcttaacagaaggctagtcacatagttgtctatcatgtataatttaaagtcagttagtagactaaggttatcttaagtcaccacgacacaaaactggtctgctgtttgaacagtaagtatgttatatacacagaaacagaaatcatagttaccattgccttttaaaaatttttggtggttttgtattcatagggacaagtggtagaaaacttaaaagcacaggccctttgttcctggactgcaaagaaagataaccacttgaacttctcaaaacatgacattattactgtcttggagcagcaagaaaattggtggtttggggaggtgcatggaggaagaggatggtttcccaaatcttatgtcaagatcattcctgggagtgaagtaaaacgggaagagtaagcatctttatgtgttttcatgagatgtggatgttggtattttcactaatgagtcagccatggtctgattgagtgtataataaaataacaattttatacttgagtttgaatatcagaaaggtaattctggccggccgtggtggctcacacctgtaatcccagcattttgggaagccaaggcaggcagatcacttgagcccaggggtttgagaccagcctgggtgacgtggtgaaaccctgtctctacaaaaaatacaaaaattagccgggcatggtggtacatgcctgtagtcccagctacttgggaggctaaggcaggagaatctcttgagcccaggaggcagaggttgcagtgagccaagatgacgccattgcactctagcctgggtgacagagtgatacc

SEQ ID NO: 11751 - DNA, 1217 bp, Homo sapiens
aacataatcataatattataaacattaaataaatttaaataaagattaagctataacagtattggtagagtaagaggctacagtgaaagagaggtcaatcttcatttcccatagccaaaagccagtaatgtctaaaattgaaaaaattcaagaaaaagcagtataaatatgttattcagaaatataaatggtgatatagaagaaaccaggaagaatggcaggtcaggagtgaaaatcagggcataaggagccatgagataggggaggattgttttccctcattagccatatataatgaatgctatttgtctttgtaaaatattttcatgtaacttggataaaattaaaattaaaaagacaacttgccagtcactggaaatagtagctgttaatttgtagaaaatgccttagctgtttagttagatgggcttaattctgaaaatgagaatactatacaatagttttcatctctttccattgtaaatgtgtgaatttctaagcactgttaatccttctttttatttccgtaggttgatgaaaaaaccgtaggagaacctggttggctttatggtagttttcaaggaaattttggctggtttccatgcaattatgtagaaaaaatgccatcaagtgaaaatgaaaaagctgtatctccaaagaaggccttacttcctcctacagtttctttatctgctacctcaacttcctctgagtaagtttttagctaacagtaaagtttatatagatctgcaaatgtgtaaatacctaatatataatggtgtcagcctactacttcatcatagtgtaatccgggttgtactcttcaagactactttttgttccagatttaatactgaaatttagtaagtgaaaacatgggtcagtagtttgttaataattatttcttttcccacaaattgtgtgtaagcacagtgtatataatatgtaagttgataaattggtagtacttcattaagttctaaacaaataaatatacttatatcaaagtgttatatttgcagaccactttcttcaaatcaaccagcatcagtgactgattatcaaaatgtatctttttcaaacctaactgtaaatacatcatggcagaaaaaatcagccttcactcgaactgtgtcccctggatctgtatcacctattcatggacaggtatgttgtctgttatttttgtgggctttattctttgaatttgctcctga

SEQ ID NO: 11752 - DNA, 1170 bp, Homo sapiens
tttgctgtgaatatttccctgttcttgggagcactaagaataaatggaaagctactttaactatagtttctattaattgagtattaactgtggaccagagtgtacaatggctttatatccatcacctcatttaatgtagcatgatgctcattgtatagatgaaaagcctgaggattcgattggtgaagcatctttcctaaagtagaatttcacttcaggtcctagtccttttgaatgcagaaccaaggcttacaaccatttcctctgatgctctttccagcatataatctgggaagtggaaataacaactgaatgttttctcttgtactggtctgcattgtgtatacatccttcgtattggtctagttacatcaatctgaccaaacagtaaatgacatgctggtaatgacatacgaacttctgcaaaatgtaaactgtctgatgtttgtttttcagattcaggggtcagtttacttcataaaaaatcattagaaaaggaagaattatgccaaagacttaaagaacagttagatgctcttgaaaaagaaactgcatctaagctgtcagaaatggattcttttaacaatcaactaaaggtatttatttttgatactatttatttttaggtaactgccttcttaccttcattattttgatttaatagaataaatagctaaagctattatatgtattacattttcataatttattttataatttcaactatacaagaatttcaagattgtttttaatgttctagttatatgacatagtgtcatataactaaacatatactttatcacagtttccaatttttgatgactatgtgctgtttgtcttggcatctatacatttccagaacaattgcctttgtcagtattacagaactgatctcagccagcgttatcctaggcaattttcaaaaatgagaaatatggaaaatttgaaatagtttaggtgttagtggctcttttaacacagtttttattttgtttccttgtgaagtgtaatttaattaacctttgttaaataatgcaataatcagtgaaatctagaacagaatctggcactataaactttgcacaaaaagcaagttaatgattcattgtttgccgcagtggcagagcagatgtccaaaacatagactgtctgcatatcattcaccacagt

SEQ ID NO: 11753 - DNA, 1669 bp, Homo sapiens
tgtcatgtgtctcgaaatcagcagccctccccatcccaatcccaggcagcttgtgtgtacaatcagcttctctagcaactctgtatctgttggcttcaagagaatattttgcctccacatatgtaccccttctcctttttttaaagatggatttaaaccaagatgcctccaggaaagaggacgaaatgagtatattcacagaggaatccaaaaaatacagtttgggggaaaatgcaataatttttgatgagatgggtgaaggacaagaagtgagttgtgtcaattattgtagatacaattttctgattaaatctggaaaaataaaaggcagcctgttttttctgcttttattgtattaacagctgaggtagctaaagttatttaaaataaaattaaatttatgatccaagtagcttatttttccctttaaatctcattgtaaatatatttgatttcttgtagaaattgatttccttctgtttaattttatgcttttattatactcttgatttttctaaatttgtgtgtgaaatataacattgattgaattgcagttacatttggttagtaatatttcattattttaataactgtgatgtcatgtatggatttactttggggttcaaatcaaaatgtcactgccagaaagagctgttccagctgatctagagcatactgccctagagtgtccctgggatcatctgaacagaagtgcacaggctacttgtacagagaaaaaattaatactcaaaggaaatcttcattttttagattgactttgggaatttgaattttcatcagtgcaaatataaatttctctatcctgctctgaggctaattggtaccatattttccctttgtgtcttgtgactctgccacatcccatctcatcctggcctctgagtcaagaacccagtgaactgactttctagttctagaagttccgctgcaaggccaggaaagcttgagaaaggtattgtggaagaagcaaaggtagacccccatcactcacctttgtctgcatccctgggcctgtgaatgatgacagcacctgacattctgcaccagctacctctgcctccatggcagagaaaaggccataagaacagtggaagaggagcatggactcagacttcaaggaagaagccatttccccaggtccttccttctgcatctcaccacccctagttacaaataactccattgaacagcatctattcagaaactatgccgaataaaaagattggtggaagggctcatgtggttagcaactatgaaacagaaataggacactcagttacaaacattatctcctttagtttttcagaaaatgcatccctgatttcattcatttccagcttgaaagccagccatattactctagtccctaccaaactgctctagaaggtcatttccattttgtttgtgatatttagacgcgcagacttcaggaagttcacctttaacttcagcattccagatgaagtttcctgactcagtgcttttgcataaggaactagaaaaaaaaagtaaggaaaattggagatgctaacatcctcccccatcccaactgcaccttaaaatatgcatgtcaccttcaaggttttataattgcactgtttgttttatgtatgtacagattaaaattattgctacatttgaggaaaat

SEQ ID NO: 11754 - DNA, 2533 bp, Homo sapiens
cttgcgaggttttcctctggcctttaactggcttctgaggctacagaactccaacccagagttcttcgggacctaaattttgcttaaggaaggcctttatcatgctgaaagcactcagacatgtctgtcctcacagcagaatgtagaagtcatatgaatgagggatcgtgcacggtagcgtcagcccgaattgacacgacaactctgaatgtgtggccctctatgaaagctggtgccagttttcatcactgttattaaatactagattgggaacctcattcagccgtattgcacagatgagcaattacagcagagaaaattcattagtgctcccactcatatccttatgtgtgagttggtgaaatttagcctgagcttgattcttaggtcttgagactcagtttccaacaccttcattattaatgttaagaatggccatataccacttcatttacgtaaaaggaataaaataagcaagttaagcttcagggtcctagaatttttctgatttctataatccttcagcagaatattaagaaataaagcatgatctgcaatggaaaggtttttttggcactaacttcatgcagaatttcacagacatctatgcattaatttaaattcttggtgcaaatgtgtgctttgtagttcaaccttattaaaaattcttcagccagttaggatttcaaaatacattagtgagagtaacagctagcagaataattacaatggctaaaacgtttttatagagaatcttgtttttcaaaaaagaataaaaagtttgaatagctattattaaagaaaagccatgtcttcaacatctgagtcaccaagaagtaacactttttaaacttgttagaaatccctggaggcatttcaaattcatcttctaacctacctaagcactttaaaatacagcctccttctgttcctctgttccccttcatgcctccttttgaattgatatctcagctgtcaatatttctttgacttcagcattgttattttatttctctatatcaatgtgtccttagttttcttagcctgttaatttaaaaatccagacttgggggtcattgtgttgctacccaagagaaaatgctacagttttatagattgcacatcattctttaaggcatacttttacctcaggaaacttactctagtatgttctcatatattgaattctcaactaagtaactatttctttatacctataaactagtacctaattcactgttagttaaatgagctatagataaggcagctaaatttctgaaagatagccagagtaagtaagcagccactgcaagctctgaatcagttttttaaaaaaaagaaaaaaaaaaaaaaggagctgtgccccattgaacaatgacaacatcacaaggggaagggagggattttgccaaaagttagaaaggtggagctgtaagccatgtgcttgttgcctttgacagtgacagtgcgcgtcttacaactaattccactaggcatgggaatgtcacctcctttgccactgtaccccatcaagcttactctgaatcaaaggttttgtaaaacttttgaaaatgaacttagctgcaaaatatagctaaccactttccattgcaagctttgcaaagtgaagagaggttcgtacttctcataattggtatttagcacaattgtaagatacagttttactgtttgtacatcgtttttttccattaaacttttctagagaagacaaaagcttacactggtgacatggataagtgagatggtgtctaacgagcagtgcaatattaggcggtgcaatagaggccctgttggcaagatgagttttgctggagagctggacagtgttggttagcttcctgcattgattgcccctgggcgttcttcccccttaactgtgaaagcagagtctataaatgaactctttgctcttacaaggtaatttacatattttctttctgttgaaataactgaaaatgttaaatctaccagtttatgtcttgtaaacagagtgtcatatgtatttaagttgtgtatttttataaagtaaagccaagtatcaaacaccggtctgtgggctgcatttatttgtggaaacactggtctttaatggaaaacatactaagctagatgccaatccagttcctcaccgactgtgaccctcagtaagacattcctgagaatggcccacccctctttcaggggagctactctgtcctcttcatcctactaacatggtctaagggggagacgttcaaaatgttcaaggtcttttttctttttttttttttttttttttgagatggagtctcactcttgtcacccaggctggagtgcagtggtgtgatctcagctcactgcaacctctacctcctgggttcaagcaattctcctgcctcagcctcccgattagctgggattacaggtgcccgccaccatacctggctaatttttgtatttttagtagatttttgtaattttagccatgttggccaggctggtctcgatctcctgacctcgtgatccacctgcc

SEQ ID NO: 11755 - DNA, 1186 bp, Homo sapiens
ctgggagtcagggtgggtcctttggacctcaaaggctgggtctccagggtcctgaagccaggagggcatcatattcctgaatcggggcaagcctgggaattcagtgacagtctcagaccacctgtctgttggtgctaaatcctgcagggccagcctagatgctataatttttaaattctgtttaccctcaagaactagaacttggggttcctttatatcccaatcccctggtaactcccacagctaatttagcttaacatatgagcccagtttagcaagccaatccagtcctctaagaatccgctatagtgaaggagacagcaccctggcagtgggattaacgaccagggtttgggcagtgaaggtcgccacagctggaactgcagagtggggagttgaggtcattgcctctgtagtctgtgagtactcaagagcctcccagttcacggactgttctagggacccctcccttcagctttaatgaaggtgacttttttcccccaggaaggtttgggtcaaatgctgagaaagacttagtctaggaaagcaagcatttctaaagaagattgggaagaggtcgggtggagcgttggcacccagtgtagtctgtcagtgaaaaactccggaggccttgtctatgttgccgcaggacgtggcccaagtcaatgaggagaacttgcctgtctacaaccgctgtgccctctatgctctgggcgcagcctacctgaacctcatcagtcagctcacaacagtgcctgccttctgccagcacatccatgaggttggtgttctcacgaccaagagctcagggggccctcaacttggggtttcctgggaacagcttttccttaattgcattagtcctgtacctacacttaggcagtgaagacagggttgaagtaagaaccactaatggtgagaagttactcgtggcatctttccctcctgtatgacttgacaaagcagggtggggttaggcacaggggttggggggggtcttctatacctgtttctaatactgtctgccccctccacttcctgcccctctgtctttcccctactcacgggagcacacccgcacacatgcctcagatcatgcagactacagctatgaaataccgcaaaagtgacctcagatcatgcagactacagctatgaaataccgcaaaagtgacctcagatcatg

SEQ ID NO: 11756 - DNA, 1176 bp, Homo sapiens
gaattcctgttgctactctgcttggtgcggagttgcagtggccccaagtgtctttcagagctgttgcttttaggatccccctcaagctgtgggttagggccagggcagggagggggtgctgcctggcactgtgccctgaagagggctgcttgcttcctttggtcgggagcacggcagagccaacattctggtgggaaccgagtttctagccaggcccctgttttggtcccgggaggtgagtaatctgagtttgtcattgcgtattctccacgctgcctgctctcagtgctggagactagagagcgaccctggagttgtcctctgggagtcctgcctgtttgccagggagcagctgaaacctccccgctcccaatcccgggggtggaaaaggtgtagtggaggaatggtctggagctgggatggcccttctggccatgccctgctgagccaggattaaggaaagtgtcagccgcctccttaccaggccctgtgctggggtcaggaggaccgggaggagagggaaggggtgagaggatggactctgctgttgtagtgtgagctctggaatctttacgttttggtaaaggcaggccagggtctttgaggatcgagttggggaaccttgcctctgtgtttccgagacccagctaaggtgggcctttggtgggtgacctgtctctgacccgaggcagcagagttttgggggagggagaaacaagcaaggagcagggaggacaaggacacaagatccctttgctggtggtgacttactcacttcccccaccagagggcctgggactcccgaaactcccgtaactggaaagctccctggctcagctccactggggggtgaggagggcggctccctcagccccagcctagcggcctccaaccctgtgcctgagaacatgagcagcggtctaaagcatcccctagtcccatttcacttcacagaccgatttggttgcacagccctagaattcaacagacaacaaaaatgctgaaattccttagaatacgcagagggaggaggtgactcaccaaggtgctaaaacattttattaaaaatatatattgttaaattaagtctgctgtctggacaatgactgtttgttttgttttcttgtagtggagtttaaaagagactattattttactctgatatattattattaa

SEQ ID NO: 11757 - DNA, 2011 bp, Homo sapiens
tgaggcccccaccatccacccctctgtgcacaaggcggctcccggcccctggaatgtgatgtttttggtcatctccaaaggctgcagttttatactgggaggctgatgacaccttttattataattattcttatggttctggttataattatgtttgttttaagattttctttaagaaaacaaaaacccaacacccttccctttaggtttcaaaccaaggtgcgggagcagggtgcttctgagttagcggtggctctggtgccctggctcccacccctcgggccaggtgggccactgggcatggtgacagctgggcggccagggagtccccaaggtctgccttctgggcttgtcactcttctcttctacttcccctcctcttgagtcgggtgtgtcagggctggagggaggaccggccgtctctctccttgtgtgtgtgattggagtggtgtgtatttcttttctagtacttggtctgatgatagctgtgctcttacctcgagtcagcagcacctggagccccaagtgctcaacactttgttctacttcctacaaggcaggcggcctggcgtcagtagtaggaagggatggcattgttggctccagggtgagggcccgacgggcaggtgcttgcctgggtagatggggtgtagatatgtggcatatagagatatatattttataatgggaggggggatggcacctcctgggactggtagagctgggaggtgtgtcggcaagcacatggccccaagtccacgtccctagaaagatggggcctacagtgataggcgctctataaatacatagatagggtcatgtttaagaaatattatggggtggggagtgggggaagcaggcttagtgtgctgagcctcggtccccactgcagacctaaaccccacaccaatcagtcaatctcacacgcatacacaggagcatatttctgtactgatgcataatgaatgcactcacacacacacacacacgccagggggctcccagcactcttctcccagggttcaggactttgtggagtcagcccgtgcagctatttacctctgttgccctgattgcaggtagactgtcaatcccagaagttgctaggtgctgaggcaggaaaaggaggaggtttcttttagcaggtgctctcctctagcaggtagtgttctatctcttttgcccctggtgatgtcaaaagattcttctgttagcaacctgtgatactgacctgcaactctaggcaccagtcaagtcagccctcaactccccctacctattctccccaactgaaatcaaattgacatccaggtctgtcttggccagggggcttccattggggaaaaaaaatgggacagtgaacctcacctattgaataaaccaaattagtaattagtgacaaaaccaaaccaaggctttggaccccctgctcattactcaggagtaaattcacacagctggtggccggtctcacccctttttggggtgcttggtcctggaccccaatctactgtctcctcgacagattggtgtttaagatcatgcccagttgcttcctgtcacctcttgacaggtggtgactgggctgctgtggggctggagcagcgaggaagggagcctctgccccctcagtggagtccctgtgctaactgtggtgctcacccagctcctccttgctcccgcggggctctgtccttcgggcctggagtccaccagcgccactccaggagggctgggggaggaggggctgcctcaggcagtccaaggtgctccctcccccgctggccaatgctaaggtcttcccggctcccagggtcaggacagagtcttctaaggctcaggctctcccaagccactgcttagtgacagttagcctttcccagcggcccaagctccaccggaactgggcctggtgctccaaccaaagggttggtgttgggacttgggaagagacttggtagccaagggcatggcaagcctgggggattcctgtgggccggcttgctcgagg

SEQ ID NO: 11758 - DNA, 1178 bp, Homo sapiens
cagctaattttttttttttttttgcattttttttttgtagagacgggtttcaccatgttgcccaggctggtcttgaactcctggtctcaaacattctaactgccttagccacccaaagtgttagcattacaggtgtgaaccaccacgcccagccaataaaattattatgtagtttttaaaatgtaagagtatttaatcatttacctggactcatatctacccaatttttgtctaatttaagcctgtgttgtgcctgcatatgaatgttgtatataatttttatcttcggatatagttggaaacattagcttatttgcctcaaagagatgacaggaattcagaaaatattgctggttctgctactgaatcctatagtaacaaaaattagtgcaattaagttgcaacattgcatatcagaagttttaatttctgtttgcttaaatggtaatgattaatcctaattggatgcctacattttcagaaagatgtgccggatggggtgaaagagctgtcagaaggttcagaagaaagcagtgatggtcagtcagattcccagagttctgagaacagcagcagcagcagtgatggtggcagcaacaaggagggaaaaaagagcaggtggaaaaggaaaggtaaatccacctgatccttcaataaagtactaaatgctgtaggacaaatgcccttgttagtagttcctcttttcccagactccaggtcagtcagtcactttcccttaccctctataacagtcctgtcaaggagagttttctgcaatgatggagatgtttatatctttactgtccagcacaacacagtagccagtagctacatgggcctattgaatacttgaaatatggttattatgaccaaggaatttaaaaaataaaaatgctttcttttttagagctgtttcaggttcacaataaaattgagaggaaggtacagagatttcccatgtacccctcccccgccacatgcacagccttccccactagccacattctccaccagagtgctatatttgttacagctgatgaacctacattggcacatcatcacccagagtccatggtttacgttagaatttactgttgggagagtacatcctatggctttgaacaaatgtataacgatgtgtattcaccattatagtatcaaacagaatagtttcattg

SEQ ID NO: 11759 - DNA, 1204 bp, Homo sapiens
tataaatattcagaagcctacttaataactttttaagtgatctcatgataggtttgaatacaagagacaatggcaatgtgttagtttcacaattaagattcagtctggtgcagcagtatacaatggaattattactgtttatttgaatctgtgtgtgtttgtgttcttttttctcattttacctctggacatttgtaaagcttgtgctaaatagaatgtttacaaaatatgtttgtaatacttctgtatttttcttgacttaaatgttagatactggatcagcattaaggaattactattttgtagatacatggaaatgatttttacatccattttctccatggcagcccctttctatattggtagacttcttatagtttataagatatgtttaagtcaaaggagtattgactaattaattttattttgagtgttacataggatattcagagacagaaattaattgttgtgttccttatcacatctcttctttgttttgcagtgggacttctcctcttgcatgcctgaatgcaatgcttcacacaaactccagaggtgaagagggcatcttctataaggttccaggtagaatgggagtatatactttgaaggtaaatattttgttggggagtcatttagaaagaaaaaacaggaagtgaccacatataaatatttgactcgtagggacagaattctgttcttgaagagcttattttcaggaagaggtaatattttgaaacctctacccaatacattttttaaaaactaatctataactaactataggtagatcagagaagtaactttattttttattcttgatgataatcttatctagaaagaacgaaattaaaatgacttatggccaggcgtggtggctcacgcctgtaatcccaacattttaggaggccgaggtgggcaaattgcctgagctcaggagtttgcgaccagcctgggcaacacagtgaaaccccacctctactaaaatgcaaaaaattagccagggcgtagcggtgtgtgcctgtagtcccagccactcaggaggctaaggcaagagaattgcttgaacccgggaggcggaggttgcagtgagccaaaatcacgccaccgcactccagcctgggcgacagagtgagactttgtctcaaaaaataaaataaaataaaataaaataaaaaataaataaaatgacttctagtgtttt

SEQ ID NO: 11760 - DNA, 1112 bp, Homo sapiens
agtcaactccgtgacgatactcattcctttattgtcaactgcattgattggaacagggctggggcctgcaagctgctggcagcacccagctgcaggtgcatttcagctcaacagaaaggcctccatccgaagccaaggggacagaggggaatgttttatatatatatttatatattacatatgtcccgtatagtcatatgtgtagagtgacaagaatgggccactgcattgttaattgttgtcctaaataaagaccatagcaacacacgagaatttggtcctaatcaaggcccttactttgtcaatcaaatatttgatacaccaaaaggaaaaggagagaaagagagacagagagactgagatccagccactcctggtggccctgttcccagcagatcttacactgagtgtagagtgtcccctgtggaggtaaacacgcacacaaacacgcacacacatacacacatacacaaaaccgcaggcaggagctcctcctccgaccatacctcgggcccagccctcggactgggggggctgatttgggtatattgtgctataagactgtgagggaggtgtgacaagacaatgcaaaggcgatgtgtccaagtgatgaatgaggtgatacgtgctgctttgtccacaaacgagaaagaggtcagtgggagaggctgctcaacgcagccctggaggtccccctgcgctcaggccacctggtgaatttctacacacaactcctgtcccagccacagtcgaacctctgatctgaatcctgagtctcaaataatctcttgggctctgatgaaaattgtgatttcctggaaggacaggagcaaatggcaagtgggtggctcaaccctctagtccagtaatgaagcagaaatgacagtgtcgctgagttaaatcagacccaagcttgatcctcagagcagaacttgaatgatgtaagaagggttcatttcctgaaggaaagagaataacccccgccaccacctcccacaccccccatttcaggcagatctgtcagtctcatggtttcaccccaacgacagcactcttcatattctaggaactggagactcacactattagggcactttgaaatcctaattcac

SEQ ID NO: 11761 - DNA, 1237 bp, Homo sapiens
ctgtatttccctaacctcccctttcgcctgcgtcatctcccctgcaggtgccagagtcctcagcggcctccaccttccaccacacatgcctccctggcctctgcttctctgcgccctgcaacagtggcggaccatgagtgacaaccatcacgtcaggctgcccatccaatagactcctgggatggggcagccaaccctggctcatctcatctgccgcttggtgcgtgtgcgtgtgcgtgcatgtgcgtgtgcgtgtgtgcaggggtgagaatctggcagatggtgcctctgcctgctcttcttcgcctcctttatttaattcatgttatttattcgcggagctctgttcgtgttggggagatgccctcgcctgagccgtctgggcctaccgtggtcactgcgtagcctctttttcttctgacttgagagctcccccagtcagatctcaggcttgtccccctgtcagctgcctccagaagggaaggtagccagtgcctgagaagacagtcccttttctacccaccgcactccataacctccatcttctcccacactgatggcgagcagcccctgagcactttctgggactgggagactgcttggtgttccctgaggacaagagacatcctgacagtgttgggcatctgctccccgtggacacagccccactctccactttctgagcctcagacaacctcattcagcctcttgggctccttttcaaggacattaataacctcaccaacatagctcatgcccttcagctttgacaagaactcacagcttcccaaactctgctttctgcccaccttggatgggaactgtggaccaagcaattaccatcgccttggaacctgcaggaaatggaacagcaattgagacaacttgaacagtcatcaacggaagtccctccactggattcctttgtttctgtcccctccgaggagtcattttggtcgacaggctctcaaggcaactccccattttcaagaggctgctcctgcctgcttcgatcatttctccctgcagctgcctagaccccgttcacagtgggaggagtcaatgtcattctacccctcgctaaacgaagatattaacatctattgctttttcccttcatctgtcacaggaaacagaagcccaggcacaatcttttccagctttgcctgttacccctgtttctgaattgcatctttaaggtattattttgttgaaaatagatcctttattcactagt

SEQ ID NO: 11762 - DNA, 1166 bp, Homo sapiens
ttttttttgagacagattttcgctgttgttgtccaggctggagtgcaatggtgcgatctcggctcaccacaacctctgccttccgggttcaagagattctcctgcctcagcctccctattagctgggattacaggcatgtgccaccacgcctggctaattttgtatttttagtagagatgggctttctccatgttggtcaggctggtctcgaactcccgacctcaggttatccacccgccttggccttcctaagtgctgagattacaggcgtgagccaccgcgcccagccttggtaaattattttgtgtgtgtgtgaaatactgggttgaatcacatgaattctcattttgtaggttaataatgacggcatattgacttcaggccagatcgccggatatcagctgagtgactcttacaagtccttctagatcctgaagtggattaggtgccgcagttgctgctcgtgttgaatccagaaccgtagccagacataggactggaggacgagcgaaagatgctgaccgagtctggagatcctaaggaggaggaagaagaagagggggaattagtgtttctacatcaggatcccctaacaacagtgagagagcaatgccagcagttggagaaatgtgtaaaggcccaggagtggctggagctctgtgatgagtgtgtatcctctcaatcacatacagaagaggattgcacggaggagctctttgactttttgcatgcaacggaccattgcgtggcccacaaactctttaacaacttgaaataaatgtgtggacttattccccacaggcttcatcacctgggcatcaggatatttccttatggttttggatatgccatttgtttcttatttctgtaactgtaagttcacatgaacctcatggattttggcttagtctggtagcttctgtgtaattcgcagtgatttcatcttaataaagttctgtgatctgcaatctgcaaaaaaaaagaaatgactgcatattggcaattacacatagtttaattgaataaaacacattcagaaaggtgcatggtacataaacacacggcttaaaaaagtattattatttgagacggagtttcacttttgttgtccaggctggaatgcaatggcccaatctcagctcactgcaacctctgcctccctggt

SEQ ID NO: 11763 - DNA, 1184 bp, Homo sapiens
cgtacgcccttgcgtgcgtctcaggcagcgcgcacgccggcgtgagagggcacggggaaaaggtggctctggccggggtggctcggtttcctggggctatgtaactgagctcgtcgacttaggggtccttcttcgctgccctcgccgcgtgctagcagggagtttccgctcgggagagagactgtcctcacgcccgctgcgcctcctcgacggcagagcaggcttgctcgcccgtgggagcgtcccggccgagaagccctgaggggggaggggaggccattttgtcccgaccgactccccggaaccgggcggacgggctgggagaggctgcggagccgcggtcgccgccctcggaggcactggacgccgccactgtcggggcttcctcaaagctgttcgtaggtcgcccgcgccgtctcgagcctttttcccacgcttccccggtcctccggcctgagaacgcccgagtgaggagttggccgtagtgagagggaccgatcccttggggccgccggcggcgagagcccgagccgctcctcccaatggcgaagaagacgtacgacctgcttttcaagctgctcctgatcggggattccggagtggggaagacctgcgtcctttttcgtttttcggatgatgccttcaatactacctttatttccaccataggtaagacctgtgggaggacggtgtacggtctcggtagctgcataccgtttattttactccagacatcttgcttcccgtaatatacgcctttgtttcagtgattccgattccaaacgacacatccaagttactgtttgaatcggcatcgagcttactggggcggggtcttcccatgatttccatccggtcttttgctttcgagtctcccactatgctcagtgccttctgttacaaaatatgcatcatttaaccatgttccagaaccttatttcttcaggcgactggactggctttttccacatttgcgtggaattagtagatgtgtgatatttttaaggtatttatttcagtggttgcgattgaagcagtactagctatttgggaaaggcctgaatttatactttggggcaaagaaaagattccatatggtgataacttagagtaaacttgagggtttctgagaagaataattaaggtaaattagaagggaagagtgagttgccctcattcactaa

SEQ ID NO: 11764 - DNA, 1974 bp, Homo sapiens
agttgccatccactaccccgttttctcttcttgctgcaaaataaaccactctgtccatttttaactctaaacagatatttttgtttctcatcttaactatccaagccacctattttatttgttctttcatctgtgactgcttgctgactttatcataattttcttcaaacaaaaaaatgtatagaaaaatcatgtctgtgagttcatttttaaatgtacttgctcagctcaactgcatttcagttgtattatagtccagttcttatcaacattaaaacctatagcaatcatttcaaatctattctgcaaattgtataagaataaagttagaattaacaattttattttgtacaacagtggaattttctgtcatggataatgtgcttgagtccctataatctatagacatgtgatagcaaaagaaacaaacaaaagccaggaaaacactcattttcgccttgaatatgtaaatgggattaattttgtcctgtgccttatgtggaaaggaacttctttggttttccttttttgttctggtggaagcatgtgcaggagacatatcatccaaacataaaccattaaaatgtttgtggtttgcttggctgtaattttcaaagtagttaattgaggacaaagggtaatgcagaagtgatagctttggtttgctgagtcttgttttaagtggccttgatatttaaaactattcctgccaccatttcttctccttggccacttcttccttgcgtctccctgcatgctgctttatttgcttctccctccccaaccacctcatggtatatttaagagtgaaagggacaaactagtaggtttgtcaagtttaatataaagcactgatgtaacttgctaggtaaacggaaagataagttctaactgcctactatccaatgtcagttaattggtgtcttcccccctcatttgctctcttccctaaaatgtgtcccagatgccttcatttgctgttttacttctatgttctgcttttcctcctctctttgttcccttcctgtctatccattgagtttatgaaatggaagagttaactgcatgcactagtgtttggagggtgttgtggtttgtctttctaattaggtgtatagcctattcactttcctagaataaatctcttaacctaaatttgagtagtctgcattttggcaactcctctagcagcttggtagcctagtacaggttgtttttttaaaaaaggaaaagcaggaaggaggagtgaattttattaacatgtttgccaaatgtattgagatttggcctctgaagaacactttttcagtgttaagtttctttaccttaagattcagaaatactttagaatattattaattttaagtcctgtctttacatccttttggaaaacttgtattaccatgggtttggaaaaaggacaacgaaaggcttttcatgtaaagataagatctttagctatctctaaccctgtccttttttcactgcattttttctagttttgcttcattgcttatcattaggatagggtaagtgaagtttgctatgctgctagcatcctaagatgatacctttgttgaaagaattgtgaatagcatgattcatttctagcagaggctgagtttaggacagcagcttccattgagaagtctttctgtgtcgtgaatagcattttaatgacctcttggctcacataagcaaacaacatagggacgtatctgctatgaaaatccacaaatttttcagatagtgccctaaaaacaattttatatgcctcactggttgttattcttaggttattcccacacttgactttatcattgtttactactagtaaaaagcagcattgccaaataatccctaattttccactaaaaatataatgaaatgatgttaagctttttgaaaagtttaggttaaacctactgttgttagattaatgtatttgttgcttccctttatctggaatgtggc

SEQ ID NO: 11765 - DNA, 1441 bp, Homo sapiens
aggcccaagatctgaactgcccagctggagctgcacagctggaatgctggtatgggggccccaggtacagcactccggaggagcaggtgctgcctgcaagaaggatctatgtcgagactgaggctgctcagcagccactgggtggatccaggggagatgcatgtggaaatgtggtcctctggggtcagacccctgcacgggacatcttgcctttgagtgtgcagagtacatggggaaggggctgggggcaccactgtgtacctgggcccagtaaggcatttgccgtgattcccacaacggggtcaaaagctggccttcagggtgacctaacaccacctcatgccctgctatagaccttcacaaacgacttccactgctgaagcctgtaggctctgtttagagacaagaagatggctggtaatttaagcaccgatttcccaagtgcccactctcctttgtgctctgttggcttttggcctaaagctgccccagagtgagggtgtagatgtctgtgtctgtgagatgcctttcccttccccctctgctccaccgtggttgaggggggtggggcctggccccgcacacaggtgagtcgtgtacaagcctaacccatggcacctcagaggctccacctgtgggtcctggttcatgggtgacaactttggaagagcacagctctgcaattgacccgacccacttatctagttaggaagccagacactgcccagatgactctagcaccctggcttctgctctgactttactgcagctagtcatccatccgtcaggtggcgttcagtctcagaatactgattccgtggaagagcaggttgatttaggtcagcttctccttgattctagaagcaagcggtagtcaaccacctccaattccgccaatctcttgcccccatcatttgtctctgacaatacttggtgtttttccctggttttctgtcactggcacaggagggtacagttgggagagtgcgttcctggagctcagtcctgcatttgttcacgtgcctcacagcaggcctttgtgcccttgaatctcaaacatggggatctgcttggtacccagagctctggtcattgtgtccaaccacacaccccaccccatccgtgtcctccatctcacccagaaccacagggtgcccactagtgtcagggcccaaagtgccagccttctcttctgccttacctagtctacctatttatttcctccactttttatcttaaaagtagctaagccatgctggtgcccatactccaagcaggctgcctcagctcagagaagtggtcagagagtagagcacagaacctgtgatgtggggacatttggttttcttgcagatcatttaatgaatcctcaaggactaatgaaataaatgctagactgctgaagatgagtacaagtggcattctgggtgccagctgcttt

SEQ ID NO: 11766 - DNA, 1221 bp, Homo sapiens
gtggtaagtatgtgttctaccttaaattttcagtattaccatgatacttttggaaagcttttgtcattgcttatttattgctcttaggcttttttgattagaattgatatgtacttaaaaattttttatttttatttatggaaaatttcaaaaatagaatagtatagtgaatagtaaagtagagagaatatttaggaaaaagtagagagaatagaccctaatgtacccattgctgaggctgaggcctcccgagtagctgagattacaggtgcccactatcacgcctggctaatttttatatttttagtagagacagggtttcactatgttggctgggctggtctctaactcctgacctcaagtgatcttcctgccttggcttcccgaagtgttaggattacaggcatgagccaccgtgctcgacccttctcaattattttaaaggaaatttctgatattatatgataaatacttcgctatatatctctaaatgataaaagcttcctttaaaaaaacaatcacaatgccagtattacaccaaaaatttaaccatttcttaatgttattgcatgttcatttgaactcttgattttggaaagaaagatatgcacatataattgaatggttggctttttgtgttcattgccaccttttcagtgtgtagagagatttcttttttcttactttaatggccttgctattaactctccctgccttgaatcccagctttttgtgttgccattttgcccatttgcacctaagtctccagtaaagaaatcagaagttggagtgtttgttgaagtggttgggtgggtaaatttggatcatcttacaacttaaccaatttatgagttgctgttaaagtgctccaaatgatggccagttgcttgcattgtctacaagttagttattttatagcattgttggctaaaagattgtatttttttttttttttttttgagacagaatttcgctattgttgcccaggctggagtgcaatggtgtgatctcggctcaccgcaacctctgcctcctgggttcaggcgattcttccgcctcagcctcccaagtagctgggattacaggcatgcgccaccacgcctggctaattttgtatttttagtagagatggggtttctccatgttggtcaggctggtctggaactcctgacacctcaggtgatctgcccgtcttggcctcccagagtgctgggattacag

SEQ ID NO: 11767 - DNA, 1126 bp, Homo sapiens
gagattgtgccactgcactccagccagagtgacagagcaagactccatctcaaaaaataataataaaaataaacaaatctgtttaaattactgttgcctttcagcattagactttgagtttaataactacaaattgagactgctcacaatattaactttttttgtaggttattttgttgtttagataacttgcctccctagaggagcattcaggagataaagacctagctacatgtaatgatatgatcatttcaaaaatgtgccaagaaagcaaaattcattattgaactctaaatttctgggtgtttttttttttaaagtagcattttctctgggtaaagggaaaggcaatgaatgattgccaacatgtaaactccctgctgcccgccttcccccagtcccctccatctaacataatacagtaaatttgtagccagttgtagaaaaagaaattgatatctttctgagtaaggtttcatgccctgtgactaagaataggtggaggaatcatggccaaatcaaatatgaattgtttagcttggtcctgttgcagttggctttctgtagtgttctgaaacaagaggacgattccattccttctcaggaacctagaaacaacaccgcttgagcaactggaatatgtttgctgcaagcagaatattttggggagaggaagagtagtttaattcaagtagtttaattgaacatattagtcattggtctgtctgggacgtgcagtgttcatagtagcaatgtatgtaccatttattttatctggttgtgtgtgatgtgtgtgtatgcctatttaatatgtacacatatattcactacatatgtatgtatgatatattcatatatacatgcagtctgcttgattatcagcaaaatggtcagcctttatcagatagtttcttcatgtggagttcatctgcatgtggcccttactctgaagcctcttcctgatctggagccacagtctgtctgtcttccagttcatctcagtcctcgagaaaggccctttaaatatgtcactttcccattttcctttaaccatgggttgtgtgagccagaaagagctttgagaaagatggctgcttccaccagggtggaggcttctaggtctgca

SEQ ID NO: 11768 - DNA, 2298 bp, Homo sapiens
tcccaccaacccctatgccaccctcctttttttaaattttcccaggtattagggaccctactgtctcttaactaactggccaagggacctcttttgtaacctggtaggggattcttttctgaaaacatgagccctccaagagcaccttgtaattctttatggaattgatttctaacctctactacctttttaaaactgtagtttttgactgtataaataggaactctctcgtttgtccaccttagatcccttttcctatcctgggagattgcctctcatcacccaattactggtgatttccccatcaccagtaagagatccgccagttcctaagctcccaggagtcaacacctgctcctaattgggtcctaagattaagagccaggaaaaaataatggaaaggaagattcactggaactcatggagagcatcattgtcccttgaatctctcttctgttactccctactcctactcctccccttccccactccttcacaggcaagagaaatatgtgttaaattcactcgtggtgtggacttcaattggcaagcccaggccctattggccctacaagaggtaagaaggcaccaaggcacaattgggtgagggctgagtgggagaaagaggcagcctagaattctccagtgctgactggagtgtcacatgctgaatctgacctctggaaaagaacaatgaggtaacctctgagggtttggaggctggattctgcgtggtgatagcagaattccctggcaaagttcagtctcattctgtgaatagtttcctacaatcctttgagccctcagagattaagtttagcaggtttccaaaaaaaagcagcccgtggcccttcatctgtgtccgtctttttctctttctgtctccaggcagcagaagcatttctagttcatctctttgaggacgcctatctcctcaccttacatgcaggccgagttactctcttcccaaaggatgtgcaactggcccggaggatccggggccttgaggagggactcggctgagctcctgcacccagtgtttctgtcagtctttcctgctcagccagggggtaagctcatcctctttcacaggactggggctggaatttctcaagtaatttcctttctccatccatagtcccttgtcacctcgccttccctttgttctctagtaaaggttgatctagttttgactgcctgggacaatgtggtttgtgcccttttgtgcaatgttagataaaagatatctttctattaaataataaccagatgaccctaatttcttttggttgttattgttgttgttttatttttataagacagggtctctgtcatcagtgttgccatcgtggctcactgcaactcctgccttggcctcccaaagtgttgagattacaagaatcagatgacctcattttgattaagagaaaactttctaataaactttctaataaaagagaacactttctaataaaaactttctcttttttgattaagagaaagttttcttacttttgaaaatggcttgttagtaagtgtgcttccttaatttcagggatgataccggggactctccagagccatgactagatccaatggattctgcgatgctgtctggactttgctgtctctgaacagtatgtgtgtgttgctttaaatatttttcttttttttgagaaggagaagactgcatgactttcctctgtaacagaggtaatatatgagacaatcaacaccgttccaaaggcctgaaaataattttcagataaagagactccaaggttgactttagtttgtgagttactcatgtgactatttgaggattttgaaaacatcagatttgctgtggtatgggagaaaaggctatgtacttattattttagctctttctgtaatatttacattttttaccatatgtacatttgtacttttattttacacataagggaaaaaataagaccactttgagcagttgcctggaaggctgggcatttccatcatatagacctctgcccttcagagtagcctcaccattagtggcagcatcatgtaactgagtggactgtgcttgtcaacggatgtgtagcttttcagaaacttaattggggatgaatagaaaacctgtaagctttgatgttctggttacttctagtaaattcctgtcaaaatcaattcagaaattctaacttggagaatttaacattttactcttgtaaatcatagaagatgtatcataacagttcagaattttaaagtacattttcgatgcttttatgggtatttttgtagtttctttgt

SEQ ID NO: 11769 - DNA, 1212 bp, Homo sapiens
ctgttaacaacatataagaatgcgtgctttttacatttgctttggacattgttctgtgtgctattatgaatagtgaaaaatgtaatctcattgttttcatttgcatttatttaattattaataaaggtgaacatcttttcatttgcctattagctatttatgtccctcctccccttgtgggttacctattcttatcctttgcctatttttttattgtagtatttttttgtcttttaggatttagaagcgctattacatataaatattaatccttggttatatgatacacacctgtcataccagtttttatttgtctttattaaaagtaatttgtggtatcttttgctgtatcataatttttcactattgtatagtctaaattactctgattttttatggtttccggctttggattatgataaaaagaaaagcctaactcaatcaaaggttataaacatatccttctatgtttttttctagcattttatacttttctctccttttctaatgtagaatgcaaatgtactgatgctacttctttgcttgccatgctagccagccctgccactgcactcagcatcttgtccatactcttggcacgccatgtcccaccaggccttgaaggattcagccgctgtccactttccaccctcatgcatccaatgcaccagccatcctgagtgcaccaagctagcttgcgccacacagcttctgtctggaacatccttgcctgacttcttccttgacccctggtgaactcctaagcaaccatccagactcacctccaaggcacttgtgagaagcagtcctccagcccagtcagtgtgaagtgcttccccaccctttctggtaccggcagcccttccagctccttgtctcctattgaaatgttggttgatgcatatccttccactaccaacttgtgagctccatgagagttggttgagtatctggcacccagtacagtaaccctgcctccatgatctgatttgcattttagcaagctcaatctgctaatagtgtggaggccggggaccaaccagaagtatccatgtaatggtgaggtcatagtccagtaaatgataagggcctgacttcagcaatgggtttggagaaagaggacagaggagaaattgatttagtaggtagaaccaacagtgttttgtttgagaagtttcctggacattcaatacatgagaaaataaaaacatt

SEQ ID NO: 11770 - DNA, 1227 bp, Homo sapiens
tcactgtgcttcgagccaactctaacaggcactttgagatgtgttcctcctgctgtagtcctttctgccttggcctcggcgggcttttctggggcccaggaagcccacactatgcacagagcccaatgcatagagccctggccagcccttcctctcactcctgcctccgctggctttgggaaagcccagactttagtgccctgccccctggctgactggccagttgcccagagcactttagcagatgtggtttcaaagtaaaggcctcctcccccaccccttaggccccgtggtgacatttcccaagtcagacagatgtcagcttcccagccatgcccaggacgtcctatctcccccaacccacctctggccctgtgtaggggcagggatgggggtggctgggactcctggtgcccctcgccagcttctcctgcgccccgcccacaccctcggggggtcacaggcccagaagggtagctgggcggggctcgaggctggtgccaggcgcgtgtaaatggttttgttttgcacgtttggtttgcgcagtagtttggtttgacttgtttgtgcatcctgtgaaaaataacggtgcttgtgtcactagcatagaatagcgacaggaatagatgtggtccttaggagacgctgcacttgacaccaaccagacagcacagggcaggggtggtggagggggctgggctcacaggcctctcttttccccgcctgcagtcttctgggctgcgggaggccctggccctttccccttcccctcccctccttgtctagtttcccacattccaaaagggggcctgggatgctagccccagagatgccagcccttcaggaagcaggtgtcctttcccctctctgcccctgatcactcccagcactccccttgccttcccctgtcttcacctgccaccacacacacacacacacacacacacacacacacacacgcacggcttcctataacttcttcctgctggacagagactcagcgctcctcctgtgtgactggcaagaggcctcatgcctgctgagagaggaggagtgggagaggggcttgccagacaccagagagggagaccccaggcccacaggacctggctgtcgaacccgcattgctgctcaggtgccgtgatctcccgtggtcggcaccaggcccttgccagctcatggcctcatcttctcccctgtccatccaggtgggccctccctgcttct

SEQ ID NO: 11771 - DNA, 1286 bp, Homo sapiens
gatcatggagtcaggagatcgagaccatcctggctaacacggtgaaaccccgtctctactaaaaatacaaaaattacccaggcgtggtggcgggcgcctgtagtcccagctactgaggaggctgaggcaggagaatagcgtgaacccgggaggcggagcttgcagtgagccaagatcacgccactgcacttcagcctggacgacagagtgagactccatctcaaaaaacagacaaacaaaaaagtcagcccctgcacatctctgtagtgcttttcatgtattcaaaccacttccgtatatgacctctcacttagtcctcatgacaatggagcacttattattcttcccattttacagatgaggaaactaagacccagaaagttcaggtcctctgaccccagaagtgtctgtgatgaccctcccaaccttggctatctaccccacctgtggagaggaggtctggggtgacatctattgtagatcccacctgagagtttaaccaatgagaagacttactttcctggtaggcagcctgctttgttttgcacaggaagatagattttttttctcatctttcttataaacaacctcatgcacattctgtgtttgagccaagactagtcacccattgggggctaaccgtgcagtgtgagctgcgtccacaccctcacttctcccttcactccccctttcctcactcaggggctgagaggacagaggtggtcagccggggagcagaggtggcgaaggggctcatggcaagtggcagccattggaacaggggtgaggacccaggcctgggaaagccaccagggatgggggaaaccatgacgccgcctcctggtgcagtgcacaccatctctatccctgtcagccctcactgggtcatgggccttgggcagatgtcaaagagcccagcagcagcggtggtggccagctgggcagagcatccttgcttgggctaggaaagctttaccttctctgagtgcctccgcctgagagatgtgtgacccgtggcaccagggaaccacgtcttggagtggtccactgtaggccatgcgcttcatccacccccagtccctacataggccctacccttgcccgggagcttctagatagaaatcagaaagagattcaaggagccaaatgagcggtcagcccccaccatgcactccttgccccgtgcagagctccagccagcttcgtcaccagccccactggctcctggttggaacgaaagggtctctggttgcactgaatgcagctctcaaactggtcttgtactt

SEQ ID NO: 11772 - DNA, 1322 bp, Homo sapiens
aagccctgcctggcctgcctggcccaccactttcctctctctcccaccctccaggaaggattcgcaccccctgaggacgatgagattgaagagcatcaacaagaagaccaggacgagtactgagggcggccgcagccctggctgactgcacagcttccccgtgcctccctccctgctccactcccacattatagtcctttcctaacacggtcggccgggtgctttgtgtcagtgctgcagcactggggagccaggcgaggggggcttgggggcatggggccggaaagcaggcagaagcccgtcctgggtggtgctggcccagttggtgggacccctgtccacacccaccctatttatttccgttgtctctctgctgtgtcgcccaacacttcccagggtgctgctgccacccgccccagccagccacctgctcctgacagccagcagctgtgtatttgacaaagtcattggtatatttttacttactggattctccttgcactttacctgttcttttccagagctgacagcacgggctccggcgcagtgtgcctggcttggcttcccttccccatggctgggggctggggtaggactcacccattctaatttattttgtcttttggcttctcagtagctaaggggaaggctgatgtcaggagagggagagggggctgaggaggtagtgctgtaggcccagggggtcagggaaagggaggggggcatgtgagggatggaaatgacctcctggcaccaggctcacccacccaaggccccctgccccagcactgaatcccagcgctgccctgaggcccccagccactccctccagcagcctggttcaccacacaaactctgcctggaccccattgtctgtctgcttcccacctgccctccccaccccctgcccctcgggcaccagcctgcatatgtgttcacttttatttaaataaacttgtgtggtaaaagtacatgccatgtgtccctcaactgagccacagtccaggtccagtgctttccacctcccatgcaccgctctctccggaggtgatagcggcagcacagcctcactgtcaccctcccacaggcctggaaaccaccaccagctctgggctcagagcccagctccagcctagccccaatgcccaacactggtggtagggctctgagggcaggtaggggccccaaccccccgtcactgaggaggaactaggtctgggcccgtggccatgacaagggacagccggtgaagcggctgtggggcaccgtggtggcctggccaagaggtgcttcgtttcagtctcctttgggtcagggggact

SEQ ID NO: 11773 - DNA, 1193 bp, Homo sapiens
acagatcctgggctggtgacaaggcctacctcttactaggactttagggacttctcctggcttaatttttttttccctgtagccccctggataccatctattaccatcgggagctcctttgctattctctggatggacttcgtgtagatctgctgacgatcacttcctgccatgggcttcgagaagatcgagagccccgtctagagcagctatttcctgataccagcacccctcgaccattccgtttcgcaggcaagagggtgagtggaaatagcataaaggtagttctttggcttttctctagcaccaggtactgtttatagctaaagactatgttatctctaggcatcttggacatggcctccgcccgcagcgtgcggcaagggtgatggcccctgctccacttgcagattcagccagctggaaatccagcggctattcctgcctcatccatgacaccccccatatactgtcaaagtagaactacagggtaactgacttaatgtctgctctcctctctacctcagatattcttcttaagcagtagagtacacccaggggagactccatctagctttgtcttcaatggctttctggacttcatcctccgacctgatgatccccgggcccaaaccctccgtcgcctcttcgtctttaagctgattcccatgttgaaccccgatggtgtggtccggggacactaccggtaagtggcttccccagcctgtctggactgttcccatttcccctcatgccctgcatctcagtgaaattctgtcagccttctggcttctgtgttcccagtcctcttgcaccctaataaaggcaagcccatctcatcttcctgagaaagcatgagatcatatctagtggcactcccagaaaggaaccaaactaggatgactgcaggcccatctgggtggaggcagctaccctgaggaagctccttagggttctatggtaagggtgacagcagatcaaagagaggccctgtcttcaattctttctttcctaacatagcttcagcctctcatttgataagtcagtctcctacggtctccttttcatctacactagtgtctccttcactggcccagtcctctagaacctgcttcagtccttgttttcctacagcacagactcacgtggagtgaatctgaaccgtcagtacctgaagcctgatgccgtcctgc

SEQ ID NO: 11774 - DNA, 1214 bp, Homo sapiens
ggttgggagtaggggtctttgaatgaggtagaacatgttggactagagtcttaaaatcattcccatccctttctttatatagctgggtctataatttaaaggagaagagatggctttgtgtgaatgatacggctacacacagcatttagcagtgttgacaggagaaagtaccgtcatgcttttttcattctcctgttttgtctagtgttgcccagctcctggagtcagggaatttgcataagtagcattttgcaggtagacaaaagtcttcaggttcctcaactgataaaatgagattaagtgtgtagagcagtgcctggcacatagtaaatgttcagtaaatgttaactattgttttattacacagacacattaataaattccagcttcctatacaaaggcaccagtgttagaggtttaggataccaagaggataagtgatgcccctggtctcccaactaggcttaaagaacctggcctggccatggaggaggctggcaaacccagatttcagtggcagtgggtacagacctggtatgttgaatgaatcaggcagtagacaggagcccagcttgtgtgaggaggctgggccagaactagtaggagctggggatggagcgaggctgcctgcaggacgatggttcaggggctgctgctgccgtctcctgtcctggcttcggggctctgagtggaagagatacaagcagataaaagggcaaataagtggggcactatgaggcagccttcactgacctgctggcttccgtggtcaaaagatgccagttttcaagcttgtcatcagacccacatccctctcctgaagtaactattaatataagatgggtagaaagacctactatttattacagttatccattctccaccagccttcatcctgctagtttttttttttttttttttttttaaaggtttccactctgtcatccaggctgaagaagtgcacaatggcacgatcatggctcaccgagcctcagcctcctaggctcaggtgatcctcccacctagcctcctgagcagctggcactataggtgcccgccaccatgctcagctaattttttttttgttttgtttttgagacagagtctcgctttgttgcccaggctggagtgtggtggtgcgatcttggttcactgcaacctccgcctcccgggttcaagcgattctcctgcctcaggctcccgagtagctggga

SEQ ID NO: 11775 - DNA, 1511 bp, Homo sapiens
atcatttcatctacaaatagttcaatatctatgcaaaaggaatctttaaaaaacatgatcataataacgtcatacactaaaaaaattaataattccctaatacaagtgtccaggcaatgtttaaaatttcccaatttttttttttttttttttttttttttctgttcatttgaatcttgctctaaacagggttcacacattgcatttggttgataagtctcttaatctgtggaccttgtaacctatttgaaaacaggtcatttttcctgtatctagtatcccatagtctgcacttacttggttacactcctgtagtgttacttagcgtattctttttttccctttatattattttctataaatggatagatttagagttgttcaattcagatgtgatatttttggcaggaatacttcatggtagtatacttctgtcacaatggcccaggattttgatgcacatagaacagctgtgtgtgactggggctctggaatggaagtgcttctggaagtctaacctcacagatgactgagttgtaggaatgtgatccctaagactgtgctattttgacaggagtagacactcgggagctgaccaagaagttgcgggaacaggggtctctgctggggaagctggtccagaatggaacagaaccttcatccctgccattcttggaccccaatgcccgccccctggtaccagaggtctccattaaggtacagaggtagagtgggagagtgttgcaagctctagcacagtagttatattctgcccacaattggggggtgaacacaggagagaatcaaaggaggctttgaaggtaggagttggtgcaggcatatcttatacccactgagcacagctgccaactgttgccctttattcgtctatttctcagactccacgggtattcaatacagggggtgcccctcggatccttgctttggactgtggcctcaagtataatcagatccgatgcctctgccagcgtggggctgaggtcactgtggtaccctgggaccatgcactagacagccaaggtgagtagctggggcctgttcagggcctcagacaagcagcttgggtggaagatctatcccttggtccaattgctaaaagtcagtaggagttgcagtgaagaagatagacattgggacttaacactctcatgggctgggggggctgcaggtgtgtctcctgtaattgaaatactgattttgatgtcatcttttctgcccactccagagtatgagggtctcttcttaagtaatgggcctggtgaccctgcctcctatcccagtgtcgtatccacactgagccgtgttttatctgagcctaatccccgacctgtctttgggatctgcctgggacaccagctattggccttagccattggggccaagacttacaagatgaggtgggacttgtggggagcagaaggggcccatacttgtggcatgaggggtggggtgtctcaggaatgagaagagagttggtgtttattcgtgtt

SEQ ID NO: 11776 - DNA, 1099 bp, Homo sapiens
gggtcttaaggagaagggctaaggttgcagggaggaaatgaaccagatttggggaatgtagagaaagatgtagtaagaaatagaagtcaattattaggggccaagagtacagggagggaaagaagaggagaatgctactctaaggctgtttgcaattttgcttcttcagcagaggctgagatgccattcttgtccttttaggcaattaaggccctgaaggaggaaaacatccagacgttgctgatcaaccccaatattgccacagtgcagacctcccaggggctggccgacaaggtctattttcttcccataacacctcattatgtaacccaggtatgactggggcaaggctggaatgaaaagaggactgggcaggggggcccagtggtcactgtgggttattaaactttgattgcctctctacccacaaggttctgatgcctgtaactcccctctccatcctcaggtgatacgtaatgaacgccccgatggtgtgttactgacttttgggggccagactgctctgaactgtggtgtggagctgaccaaggccggggtgctggctcggtatggggtccgggtcctgggcacaccagtggagaccattgagctgaccgaggatcgacgggcctttgctgccagaatggcagagatcggagagcatgtggccccgagcgaggcagcaaattctcttgaacaggttggaggggtgtttgggtaaaggaagaatggtggtgttttttttggtagtgttattttcttttttttttttttttttttgagacggagtttcgctcttgttgcgcaggctggagtacagtggcgtgatctcggctcatcataacctccacctcccagattcaagcgactctcctgcctcagcttcctgagtagctgggattactggcatgcgccaccatgcccagctaattttgtatttttagtagagacggggtttctccatgttggtcaggctgatctcgaactcctgacctcaggtgatccacccccccgaccctcggcctcccaaattgctggggttacaggcgtgagccactatgcccagccatgttattttctttatatctttttttatgtg

SEQ ID NO: 11777 - DNA, 1162 bp, Homo sapiens
ttcctgagacaagagcagctacttacgctcaggcttttagatgggctggcagtagcttccgtctgtctaccccctttctatcaggagttggagactccaacagataagcggatttttgtggtggcagctgctttgtgggctggttattcagtggaccgcctgtatgagctcacacgcatcgaccgctggttcctgcaccgaatgaagcgtatcatcgcacatgcccagctgctagaacaacaccgtggacagcctttgccgccagacctgctgcaacaggccaagtgtcttggcttctcagacaaacagattgcccttgcagttctgaggtcagaggtggcaatgagagcttccggctgggaaatgtggggcagaacctttgtatcagtgagggacccttgggagggaggaaggagagtgtgggagagctttagaggcttctgaccttggttccaaggatatttcctctcatctgtgccctggggtctcaaccctctatcagtctgtaccctactctctgggcctgtgtttcagaccctttttctattttagcacagagctggctgttcgcaagctgcgtcaggaactggggatctgtccagcagtgaaacagattgacacagttgcagctgagtggccagcccagacaaattacctatacctaacgtattggggcaccacccatgacctcacctttcgaacacctcatgtcctagtccttggctctggcgtctaccgtattggctctagcgttgaatttgactggtgtgctgtaggctgcatccagcagctccgaaaggtcagagagttcattttctttccactttccttgctattctgttcatctctagcaattgcttggcactaatcctggcatttcctattaattgccgtcccttactttggtcatagagctttggggtgggggtccttttaggccatctctcatgccccacacggtatatgaatctcttccccaacactttgtacctccttccctcccaaggcaggggtcctgtacagctctttcagaggaagctgtgctggcagtctctgaagtaggggctttggcttagtttctccacgattttctccacgattttcctcccacctgactgctaagtacccttcccctccctcttgcagatgggatataagacca

SEQ ID NO: 11778 - DNA, 1108 bp, Homo sapiens
gtgggttacccggaggctggatgatgcttgggggaaagtgtgaacaactcagctaagctccctgcctcctgtagtctgctcgccaattctgccagaccgtggggtacccctgtgtggtgcgcccctcctatgtgctgagcggtgctgctatgaatgtggcctacacggatggagacctggagcgcttcctgagcagcgcagcagccgtctccaaagagcatcccgtggtcatctccaagttcatccaggaggctaaggtgggaggctgcagacagtgaagtctctgagggcatgctgccagccctggaggagacttccttctctggtccagcagaatcataggcaccagggctgggaacagtgggctatgtggggctcgttaaaggaagagacaatcctagagtaagtgagagaagaaagtggccctatgtcccactgtctgtgtccccccgctaggagattgacgtggatgccgtggcctctgatggtgtggtggcagccatcgccatctctgagcatgtggagaatgcaggtgtgcattcaggtgatgcgacgctggtgacccccccacaagatatcactgccaaaaccctggagcggatcaaagccattgtgcatgctgtgggccaggagctacaggtcacaggacccttcaatctgcagctcattgccaaggtaataaggctaaaggaaagaactaaagggccacagctcttgcatgttctgtgctggccacagtgccatgaagccctgcactgtctcctgccttcatccaagtaggcagggaagctggagggaaagggctgtagctagagctcatggtgttggggcttatgacagtcagtgaccctgaaccctgctcagtctgatcccccagagctgaggacggagaggaagagtctaggcctatagatagtgtcagcaaggccaacctgcagaaggcctgaccagtcttctctgccccaggatgaccagctgaaagttattgaatgcaacgtacgtgtctctcgctccttccccttcgtttccaagacactgggtgtggacctagtagccttggccacgcgggtcatcatgggggaagaagtggaacctgtggggctaatga

SEQ ID NO: 11779 - DNA, 1117 bp, Homo sapiens
gaactcctgatctcaggtgatctgcccacctcggcctcccaaagtgctaggattacaggcgtgagccaccatgtccagctcacccttcctatttctgaatcttcctgtaatcttgctgcttccattttctcccaggattgattgatgtccatgtgcacctgcgggaaccaggtgggacacataaggaggactttgcttcaggcacagccgctgccctggctgggggtatcaccatggtgtgtgccatgcctaatacccggccccccatcattgacgcccctgctctggccctggcccagaaggtgagccactgcactcttcctggtattggagacccatatgcccctaccagccacccttgcttccctgagcccttttccttctgccccgccctatgggcccaggccactggtgccaggctagcctgtgtgggcatgggtgccagtgagccttacctctgtgtatcctctccagctggcagaggctggcgcccggtgcgactttgcgctattccttggggcctcgtctgaaaatgcaggaaccttgggcaccgtggccgggtctgcagccgggctgaagctttacctcaatgagaccttctctgagctgcggctggacagcgtggtccagtggatggaggtagggagtgtgcatgtggcaggaggccaccacccagtgtctcctggcttgtgggcccctgcctaagtgggctggtagcagtgaggattcaggggagctcctggggactctgggctctgatgagcacagtcagagattctgcacactccttcatcagttctttctgctcccagcatttcgagacatggccctcccacctccccattgtggctcacgcagagcagcaaaccgtggctgctgtcctcatggtggctcagctcactcagcgctcagtgcacatatgtcacgtggcacggaaggaggaggtaagagtacacctgagatcctgctgtccctgttgctttcccagtaacaccaaaggtcagggtagtccttaggggcaggagacagcaggaggagagtctggagacagcaggaggagggtctcgagccagcacccttgcaggtctacatcatcattttttgagcagggatgttg

SEQ ID NO: 11780 - DNA, 1147 bp, Homo sapiens
tgtagccactcctaccccaaggcactaatggggaccccatctgctttgcagtgctttggtcagttcatcctcactccccacatcatgacccgggccaagaagaagatggtggtgatgcacccgatgccccgtgtcaacgagataaggtggtgcagcatcagagtcagagactgcctcggggctggtggacgggaggagacttagtcctggacaagccatccatgggctgcacgataacacttcctttttttttttttttttttttgcagcgtggaagtggactcggatccccgcgcagcctacttccgccaggctgagaacggcatgtacatccgcatggctctgttagccaccgtgctgggccgtttctagggcctggcttcctcagcctcttctctttaggcccagctgctgggcaaggaattccagtgcctcctacgggggcagcacacttagatattcctggacatccagatagctcacatgtgctgaccacacttcaggctctggactggagctctctggcatgggggtggggcctcagatgctggggcccagtctgccccatcttcattcctgcaccttaaacctgtacagtcatttttctactgacttaataaacagccgagctgtcccttgatgctgagtgtagtagaacagagctttcttttagaaaattgagcagattcccaaattataagagcagcctcaccaggcagggctctggctagggctgcgtgcccacactcggcattttcacactcgtgactctttgggactcggcaggagcgtgttaactctgtgctctctgagtcctgtgtcgtgctgatgccagcgcttacctgggggctctggctggtgtccagccctccttcctcaattcagttgactcaaagacctgacagagagttctgccctcttcctgacactgggagaacactcatcagggtaaaaggaaggctgagcactgcggcctgtctgaggccaggcctggactcttcctcactctttctggttagtcctcctccagtggctaaggctgccattgcattctcaaaaccaccctggagttcttcagccactgtcactattaggagcccctcctatttcccatccctgggagcctctgcctgacattggacagagg

SEQ ID NO: 11781 - DNA, 1399 bp, Homo sapiens
gagcatctctctcttgttttctgttctcttcacaggtacgtttcagcccaaacctggactcctatggatggctggtatctggggggcagtcagggctggttcgaatccattttgtccgtggactcgcctccccactgggccaccgtatgcagcttgaaagccgagcccacttcaatgctatgttccaaccatcctcccccactagacggcctggcttctctccaaccagccatcgccttctgcccactccctagccttggcccacaccagatccttggagtgaagtcggtcaagaacaaatggcccctatgcacagagccataggaactgggggccttccctggacagtgatcatgccaggcctggacctttaggcctgcctccccaggactccttagatcccactctttctacagacttctgtgatcacagccccctgcgggcaggggggctctccctccaccaactctcaaggctcctcagcctaagactatggctcatgagaaacactcaggcctgacctaggcttgggagtcaaactgctcatattgagcatattgttaagtgggtaaagccaagtaaaggtactgggtgtttttgtgaccacttgtgaatgggtgtatggagaactgaaaagggtatctgcatgaaggctcctgtctgactattccaggatccaatattactgccttctgaaacttcctctttagggtaaccatcatgtatgcccacgagggtgatagtaattcgtgagactgaagttgcttagagtacttctttgaccaaggaataccacagacaccctaccgatagaacagtggctcagatcttacttgctcctgcttacgaagtattcccaatcactggtcatctgaccctacttgaacactcctgaacagtcatgttttttaaaatcttcctttatatcaagtcagagagtatacttctataaatttcactcatggatgttaggaaatctagtcatcttccctgtgattgccctgttaagtatttaaccatagctatcatgtgtttcccaaatcttctctagattaaatatcttcagttacttcaaccattcttttacacgtcatgatttttgatccttcatgatactgtcacattgttgactcattagaatgtttacctacttcagttctatgtataggaggtgtttagaacccaagtactgtaatgtattgttatatctcatcttgttagagtcctcttgtgggatgctgcagactcacagtgactatgatactgcctcctaagcaaggacacaccccagtgatgagaaataggcaaaccatggtcttgaaatgcctaggagtataggctggggtttggagggaaatagttggatgacctcaggaaatagaaaaaaacaggcagctgc

SEQ ID NO: 11782 - DNA, 1099 bp, Homo sapiens
tcatactggctctgggtggagcgcccattcagtcctcattacctttcattaattcctttcttcatcccatctttgatttttctctagatttagctcgatcacagcacatccagagcgctgggatgtgtccttcttcacggggggaccgctctgggctctggactggtgcccagtgccagagggggcaggagcctcgcaatatgtggctcttttctccagccctgacatgaatgagacacacccactgagccagcttcattcgggtcctgggctgctccagctctggggccttgggaccttgcagcaagaaagctggtgaggtggggttggacactgccatgggagggtggttgaggacagcaggatggggtctggacaggatagggggaagggcttggattgggctgagacaaggggagcttacctctggcagccctgcgtcccttcttcctacccaccatccccacatgctctctctctccagtcctggcaacagggcccactttgtctatgggattgcttgtgacaacggctgcatctgggacctcaagttctgccccagtggagcatgggaacttccaggcacccctcggaaggtacttcccagtcaactgtgggatggccctaggactcaaagccaggacaaagaggccctgggaattcttagagttgaaggaacgaaggttggagtgtagtggatggagtttttccagcaacttcatacagtatttcagggactagaacctcaaaggttttctgtgagtcagctgaaggcagcaagcctcagcataccttttaccctttaggctcctctcctgccccggttgggtctcttggctctggcctgctcagacgggaaagtactgctattcagtctaccccatccggaggccctgctggctcagcaacccccaggtgagtagcacagcaaggagaatggggctgctgtagtggtggtcacagcatagcagggcctgtctgtctccctggaaactcctctgggccagtctctcttagcacaaagccttactcagccacacacacaccctgcattgtgactcaggtttgttcttgagccctctctcttttgcagtcttac

SEQ ID NO: 11783 - DNA, 1193 bp, Homo sapiens
ggcccggctcttcactcaccctcgcgaacagccacggccacagcagccatcgccctcagtcctaggctccgcccgccgtggtcacggagccgccccgctgcctcgctccgcggctgcagggtccacagcgccacctgggctggaggctgagccgcagaagcgaagcgcgcagccccaatcggactacaatttccgacgggccccgaggccccgccccgcactacgggttgcaatgagggccaactccactttgggctccctatccggacaggtggctcttgccctttagactacagttcccagcatgcccaggcgattgcgtcccagaaccgacgtcccaccgccttcccacatcggatcgcagggctcccaaaatggcgagtgaggctgcggggactcgctgagcagcggagggggagcgtgcagagccgctgcggccctcacagtccggagcccggccgtgccgtgccgtagggaacatgcacttttccattcccgaaaccgagtcccgcagcggggacagcggcggctccgcctacgtggtgaggagcggccggagccgagccgggccgggcaggggcggggataacgggcccgagccatctcggagcggcctctgaggcctgaccgccacccttcgggcctggtcctgggccgccgactcccgacggcctctctgggagcttatctcatgtgtgtgattcgtgcagtggtcgcccgagctcctgtaggcccttaggccgggtcgcttccccgagctaggccgcagctgccctggtgggcgtcactggcctcttgggcagtgagactgcaacacaagcgtccgaatttcccccggactggctcttcagctttgggacttggccctggcgaaaacaagcgaactatccctcgggagattagcgcgttactccggcgagttgccaggcaacttccggccagggttctcaggggggttgcgcagaccgcaaccctaaaatgcttgactacttttgtgtcctcaggcctataacattcacgtgaatggagtcctgcactgtcgggtgcgctacagccagctcctggggctgcacgagcaggtgggactagcacccctgccttgagacagcttcaagcccttccctacacgtggacatcagtgtctccctttacccgctcttcttgttcccgtaggctgtagttcccctttaatc

SEQ ID NO: 11784 - DNA, 1248 bp, Homo sapiens
ccattcctctcctaccaccctgactcagcaagccagccctcttgtgggactgtagattcctggcaaggtgttcaaaccctgtggctgagctacccccatccctttcttagctgctggatcagtgcctggcaccagacacttctggggatggtacagggtgtgacaacatgacctgcatcatcatttgcttcaagccccgaaacacagcagagctccagccagagagtggcaagcgaaaactagaggaggtgctctctactgagggggctgaagaaaatggcaacagcgacaagaagaagaaggccaagcgagactagcagtcatccagacccctgcccacctagactgttttctgagccctccggacctgagactgagttttgtctttttcctttagccttagcagtgggtatgaggtgtgcagggggagctgggtggcttcactccgcccattccaaagagggctctccctccacactgcagccgggagcctctgctgtccttcccagccgcctctgctcctcgggctcatcaccggttctgtgcctgtgctctgttgtgttggagggaaggactggcggttctggtttttactctgtgaactttatttaaggacattcttttttattggcggctccatggccctcggccgcttgcacccgctctctgttgtacactttcaatcaacactttttcagactaaaggccaaaacctaatcgtacgcatcgtgtccttttttttctgctgccgtggcccccgacttggtcccatctgtagcatgtggcgagcccccatgtgagtgtgtgcgtgtgctcgtgtgtgtcctgcgcgtgtataggagagcccagagcgagctgctggtaggccggcctggcgggcgtcgcggctgcccctcgccccctcctgcagccagaaatgatctagttcccccagggacaggttgggaccggtctggctggcctgaagcctggagtcgggcaggacgcctcctgcgctgctccctggccggctccccgctgccgctgattggcttgctccccgcctcgtcacaatcacttcccggtcacgccattgaggctcccgccgcggccgcttcccacggactacgcgtcccgtgcgtctctgcggcggcggaagcggaagcgagtacggaggtaccagctggtctccgtaggggggtagggggctccatgaatggaagcggcggcggcggcgggagcggcctgagctgggcgccggggccaggg

SEQ ID NO: 11785 - DNA, 1248 bp, Homo sapiens; identical to SEQ ID NO: 11784

SEQ ID NO: 11786 - DNA, 1197 bp, Homo sapiens
gggactacaggcgcccgccaccgtgcctggctaattttttgtatttttagtagagacggggtttcaccttgttagccaggatggtctcgatctcctgacctcatgatccacccgcctcggcctcccaaagtgctgggattacaggcgtgagccaccgcgcccggccaacctggctaatttttatgtttttagtagagatggggtttcaccacgttggccaggctggtctcgaactcctggcctcaagtgatccacccgcctcggcctcccaaagtgctgggattacaggggtgagccaccacacccacccacctagattgtttctaaggttctttccacttctagaattctatcatccaagtacatgaaataaatatacagtgaacagtcaaaaataagcccagaatatgtgtacattataagaggtgaataaagaaatcatgggatttggatgtttaaacataatgaggctgaggctgtgtgggcacagagccctaaaaaggtcggaagaagaaaacctcagcaagggctaaagatttgtttagacagaagagaagctgaaagacaggtggggagattcaagagcccaagctgaagaatccagaacgtgaatcaattcagctttatacatttgcagatgagcccttctgactgagtgttccttcgaccccctacatctcaccagctgtttgacactctgggctgcagagcgcgtggcatagtaatgagcgatcagcagcatcgtcttgaactcctcatgggctggagagtttgcctcactggacttcaccaggttttcacactagaggagggagacagcacagcctggctcaggggtcagaggagtgccagggccatagagtggtctctgatagccacctggcagaggaaggtaaaatacatctgagaataaaggtttatgtgcatcaaagaagagatgaggacaaggacagacggagcagccctttcgcttcctcaccaggttgaagaggacatctcgaagatcagcccagctatgataggcctcggcacagttggttccaggagagctcaccatgtcagtgaagatccttttgtagatattgaagttctagaggtagagggaagaaggggatctgagaagggcatagctagaagagaaagtcactggaagtggggccaaagggaggagaaacaggctttgtgtgtagaaatggg

SEQ ID NO: 11787 - DNA, 1101 bp, Homo sapiens
tgcttaggagtttgtcatcttgatcctagtttctgagtccttaaactaggtattacggatggtactcttctaattctggattttgaaggcactttttgcgacagtagatcatagtgggaagaattgtacattggtgcctctggtgaattttgggcatttgatcattttgggggaggaaccaagacaacctggaagtgaagtgaaaggaacataggaaggtagaaagatgtggcatattacctgagaaaaagtaggagactttcaggttgtgttgaagtagggtgggtgattggaacagaattgcactaggatggatttatgttgataatcatccatccaagctggttttcctaaatctattactatattggatctttttccttcttatctttgctgaagtagaattccctcttttcatctctaacaatccctacacatagcccagttatgttgctgaatttaccagtaattcttttttgtttctctcttggaaatagggaaactttgtggctggaaaatacaaatgtcttctatgtcagaaagaatttgtgtcagagagtggtgtcaagtatcacatcaactccgtccatgctgaggtgaggtttttgtaatcctgtgggcctgatatgtaagccacaagagaggtagactttgtccctattgttatggactaaggctgtcaaggaaagtatctctaaagtggttaccagagccattagagttaaaatattctctaaacttagatatataattgtatttttctgtgaaagtatttgaagtcactgtgaggggtgggcggggtggcttatgcctctaatcccagcactttgggaggccaaggcaggaggatcacttgaacccaggagtttgaggctgcagtgagctggttgcgctactgcactccagcctaggcaacagagatcctgactcaaaaaaaaaaaaaaaatcactgtgactgtaagcatccttgaactctttttttttttttttttagacggagtctcgctctgttgcccaatctggagggctcactgcaacctccacctctcgggttcaagcaatactccctgagtagctgagattacaggcacctgccaccat

SEQ ID NO: 11788 - DNA, 1179 bp, Homo sapiens
caaacctgagcataaatatagaaaataagtaggcattttgtcagacagagaagtagactatgagaaggtgatcagtatggtcagacacttcaaatttaatatttgtgacagctaataaaaatccaaaagacctgggttattttcttgacctgttctttgcctgtggtattaccccgaagctgggatgggggtatttgggagtgggatggactagcagtcatggaatggaaagatgatggggcattttacttgtgataaatatttgtcattctttaggttttctttgtcacctacttccataagagtgttttataatcactggtttttatactctgatgttaggccatgagacaggctgttaacattttgacaagagataacaacttgacattgacagatcaaagtcttcagcttctcagatccttggattgtgccccaagatggtattggagtgctgctgatgtggctgtgttgctttagttcagcctgtttattctttgttgtcctaagattgcaaatgttcagtaggtgattgagggattcagtaggtgatagtgcctgtgaggtatgccaccctggagagggctctgtgattttgtgttgaaatcggaatttgttgtcattgacatctttttcttttaggtgatgaaatttattgagaaggcccagaacatgtccaagtaagtgatgtcagtaacacccatttattactctgtagctgacatatttctaggcttcatggaggatctgggataccatcagcctctgaaagaatatagattgagatgaaaccattaggagtgaaaaaaaaattggcaaatcattaagatgctttagaatatagagctaaatttaatatcatttcatcctcaattactttgatccccaatttacatggcttcttaggagctcttttgagactttgtcccaattcagttgtccacctgccttctcttgggaaaccatgcttgttgtcattaaagtatctgaaatacctttctaattcttatttaaatgaatatagtctacatggttcagagaaaattttttaatttacagagtgtcagaataggaaatatttgttcttatggccattacccagttagctgttgttcaaggtttactttttttaaaaaagataatttattgttttataaaaattcaaaccatgcatgatat

SEQ ID NO: 11789 - DNA, 1478 bp, Homo sapiens
catgtatcagtatgttcttttttattgctgagtgatattccattattgtggatgttccacagtttgtttatccattccccagtggactgatatttgggtagattttagctattatgagtaaagcaactataaacgtttccaaatagatctttgtgtagacgtatgttttcatttctcttggttaaaaatacctacaagtgggaccttattttagctactatgagggaggtattctttctacttataaagaaactacattttgggcagcatgatagagcatgcttctaggagacatttcctttttgagggaagtgagtacttaagtttcttagaagtaatgtactgttttctgatggatgggtgacgggctctaatcagtttgtctaatgaaagagttgaaaaagaattgcccttttttccttgcagttacagaggaaagccatgaagagccagcattccagaattttatgcaagaatcgatggcacaatactggaagagaaacaataaataggagactttagcacacttcacttgtttctagaagtccagaattttggacctccacgtgaaagaactgttcttacctctgaactgggggctcccataagggataattttcctcagagtagcaaagtttctcttattagagaaatcttgtgactcagatgaagtcagggatagaagacccttggacctggcaggttaatgctgattattccttggcctttcccttgtatttatgcaaggaaggatatactgagctgatactcttccaagcctacaacttcaagttttatcatttgaactcaagtacttttgctgctgaggaatggaatcaaaagaacgtagtctcctggtgaccacctcagatctctattattaggctagatgtatagcctctactcccccagcttcttgctcttgaccctgcactgtaagttgcccttctattagcagccaaggaaaagggaaacatgagcttatccagaacggtggcagagtctccttggcaatcaaccaacgttgctatgaaatatgcctcacactgtatagctcattataggacgtcaggtttgttgaaaaaagtgggcaagacatgattaatgaatcagaatcctgtttcattggtgacttggataaagactttttaattttaactttgttctaagactgcttgtcatgatttcaaattagaaaattatataattgcaaacagcttcacttctcctgttcaacagaggcttaaggccagatgtccaaacttgtctcaataaggaggtgatattttactaaagtttcccacgtgcacatactgactaaatacagagctaggcccagtttgtattgtactctgaacttaatgcaaagtctccttggtgattttcgcaaagtccgtggatttgggtcagaggcacatttcatacataacagcccttataaacgtttgccctgcctccacattttacagtatcttaaa

SEQ ID NO: 11790 - DNA, 1238 bp, Homo sapiens
aacccatctctgggaagtagaggtttagtgtctattactcttccagacagcgtggtccacttggttcttgctgctctctttctggagtccagctcccagtctgtccttgcttacctcctacaagagtggacattaattgggtgaaaacattgttttccatttttgtccctagttttctttcttaatgtgaatatttcttcattggttgaatatgacttgtggcataccaaggatgctgctgattagctagtggccctatagccattttctccagtctgccctggctcctgggatggaggaactgagtttgcaaatcagctccatcttcatatcaaggaatagtaaaataagagaaaggtgagggcttatggtctgatatgtattttttataaaaatggcgatgatacttaataattttctgccacaatttttttttctccctccatagtgaaacaaagagtcctcttcgtggaaaagaaaaaaatacgctccctttaaacggtggattgaaaatgactttgatttataaagagaagactgagggcggggatactgattcagaaatcctgtagcgtgtaataaaagaagaggaaatggcatggaatcactgcctcctgtgatttgaaggccattgtgaaggaaaacaatgcagtgaaagaaagttcttcatattaggacagatatcattgcatcacatttatttatctttctgggtatttttatagcccttaataaaaaatattaaaatagcctgtgctattgtgtcttagtgatgtttttccccactatttgatgttttaaaaatcaaccacattactaaaaaataaccattgttccatgtaataaatgtttccataacaacacttatgtaagagtttccagcctgctccctctgtactcagagaaaaggcagagtaacattccagagtgatcttgaagaaactcccatgtaataacagagatggcaagggggaccaggaatgacaaaaagaggagccttgtaacacaaaccaagagaacctctatttctgatttgtgcttatataattaggaaaaatgccacaggcctatattttcaaacccagatcaccaaagcagtatctaggattttctgggacagctttggattcctttattccctagatttttctttccttttaaaataaaagaaggtatagtgtttcaataaagccactgctaagacttctggggcatggtggtaccacacagctaactag

SEQ ID NO: 11791 - DNA, 1169 bp, Homo sapiens
tgtcttgtagcttggaccaggcccttgtctttgtcctgaaaaaaggcagccggacctaagtgcagatatctcataggaattggcagccaggagggtgcacgtacaggccctttgaatattcctgagagatgtcacagtagtgaactgcatgcatctcctcggaaaaatccggagggctttgcctcagcagagaaggcaaatccaacccaagatgcatgaacaataaataacaactgttctgagttagcttgaaagctcccagttgcactttgtttcaagttgtttgtgctaaccacaattttttttctccccttctttcccaccagggcttatttcaaaacctttgtccctcagttccaggaggcagcatttgccaatggaaagctctaggaaacaccagtcttgagaggtggccagccagactgcctgtccacatgcgtgtcagcacatacagccgcttcctggaagccgcctggaatgtcttcacggcagcgttttgctcacacagcagcttttgcacgccccaggcagccccgactgctgaaatccaacttgagctggctggtggtccctggatcctagagcccttcacttcgggttactccctctttcttgcctctatttcttagttggaagaaataaactcacaaattatggtgcagtaattttccggggaaagtaaagcctcaggaatgcccacgcctttcttccaaagcctttgtctctgagacctcttaagttctaagattaaatgcccctcgctgttcttcctctgaaactagtgtcttccctctgtgcgtgcatgtgtgtgtttcatacccaagcatttcctatctggggcagtccttcacggcgagaaggagttacctgagtcaatgtgaccaacctgctgggtttcagccactcatccagcctgacctaaggctgttgctcaataacaaatggcctctagcacacacagccccacccgctgccatccatacccctccagccccctgtgtggacaccttgttcccaggccagccccacacagtaggcagtcattaaagtttggtgagtgcaccaacggctctgtccttccggctctcccctctccatcccctctgggcctctgcagcactgtgtgaattatacacaaagacaaagcttgggtgtcatggtttatcaga

SEQ ID NO: 11792 - DNA, 1188 bp, Homo sapiens
accaagacaatcctgaaaaaaaaatggaggatactagccctaccaaatataaagacttattaaaaagctctagtctgttattggctcagggataagtaaaatagactaacagaatagactgtggtgctcagaaacagtggaaccgtaaggaaaggatgaactgttgaggaaataccactgggttgtttggttattcatatggagaaactacccaaaagatgaacagccttttccatgtattgttgtgctgtaagtgccatgcacatatttcctatatgtggaaagggttggaaagtactaccttaagaggccatggaagattatatttgtatggtttgtatggttgctttaacaaaagtataagttacataggctggaatacttaggcaagtgatggtcattgtttagtaaaaggtaagagggcaagaaaggaactgaaatttgatgtagatgtgctatattctataaatctgtaaattttgttcttaattgctgtatttctgtcctttaaaggtttgctctgtgatttgctatggtctgatccagataaggatgtgcaaggctggggagaaaatgatcgtggtgtttcctttacttttggagctgatgtagtcagtaaatttctgaatcgtcatgatttagatttgatttgtcgagctcatcaggtatgaaatataaaactcttaagctttttcttttttctttcttttttttgggggcagacggaggggcagacagattcttgttctgtcacccaggctggagtgcaatggcgcaatctctgctcactgcaacctgtgcctcccgggttcaggcagttcttgtgcctcagcctcccaagtagctgggacgatagccgtgtgccaccacacctggactcttaaacatttattatttgttaacttcacataagccctctcattttgttttgaggaaacatatccaagaaagctaaatgagttgtacaaggaaagcagtaggagaggtggcagagccagttcctggatctcacacttaacaatctagtgatttgttaaccttttatcaccctaaaagaggaaatgtttagaaatattttggggctgggcatggtggctcacatctataatcccagcactttggcaagctgagatgggtggattgcttaagtacaggagtttgagaccagcctgggcaacaaaatgagat

SEQ ID NO: 11793 - DNA, 2532 bp, Homo sapiens
catagatcttctgactcttaaaccagtgttcttttcctcacaacagagatacactaagttcaaaaagttttttacttaaatctaaggattggatagttgatagagttagtgtacttttgttattaaaatatgagtggaatgacaaagttcagacatttgcacactttaagaaatgtttatggaactttgctattctacatttttattgcatttttgcagtttatgccatttattgaaaatcacaattgtaacaattttcttaacttctgtacatgaaaaaataacattatttgttaataatttactttaagatattgaaaccatctgaaaagaaagctaaataccagtatggtggactgaattctggacgtcctgtcactccacctcgaacagctaatccgccgaagaaaaggtgaagaaaggaattctgtaaagaaaccatcagatttgttaaggacatacttcataatatataagtgtgcactgtaaaaccatccagccatttgacaccctttatgatgtcacacctttaacttaaggagacgggtaaaggatcttaaatttttttctaatagaaagatgtgctacactgtattgtaataagtatactctgttatagtcaacaaagttaaatccaaattcaaaattatccattaaagttacatcttcatgtatcacaatttttaaagttgaaaagcatcccagttaaactagatgtgatagttaaaccagatgaaagcatgatgatccatctgtgtaatgtggttttagtgttgcttggttgtttaattattttgagcttgttttgtttttgtttgttttcactagaataatggcaaatacttctaatttttttccctaaacatttttaaaagtgaaatatgggaagagctttacagacattcaccaactattattttcccttgtttatctacttagatatctgtttaatcttactaagaaaactttcgcctcattacattaaaaaggaattttagagattgattgttttaaaaaaaaatacgcacattgtccaatccagtgattttaatcatacagtttgactgggcaaactttacagctgatagtgaatattttgctttatacaggaattgacactgatttggatttgtgcactctaatttttaacttattgatgctctattgtgcagtagcatttcatttaagataaggctcatatagtattacccaactagttggtaatgtgattatgtggtaccttggctttaggttttcattcgcacggaacaccttttggcatgcttaacttcctggtaacaccttcacctgcattggttttctttttcttttttctttctttttttttttttttttttttttgagttgttgtttgtttttagatccacagtacatgagaatccttttttgacaagccttggaaagctgacactgtctctttttcctccctctatacgaaggatgtatttaaatgaatgctggtcagtgggacattttgtcaactatgggtattgggtgcttaactgtctaatattgccatgtgaatgttgtatacgattgtaaggcttatgtcactaaagatttttattctgattttttcataatcaaaggtcatatgatactgtatagacaagctttgtagtgaagtatagtagcaataatttctgtacctgatcaagtttattgcagcctttcttttcctatttcttttttttaagggttagtattaacaaatggcaatgagtagaaaagttaacatgaagattttagaaggagagaacttacaggacacagatttgtgattctttgactgtgacactattggatgtgattctaaaagcttttattgagcattgtcaaatttgtaagcttcatagggatggacatcatatctataatgcccttctatatgtgctaccatagatgtgacatttttgaccttaatatcgtctttgaaaatgttaaattgagaaacctgttaacttacattttatgaattggcacattgtattacttactgcaagagatatttcattttcagcacagtgcaaaagttctttaaaatgcatatgtctttttttctaattccgttttgttttaaagcacattttaaatgtagttttctcatttagtaaaagttgtctaattgatatgaagcctgactgattttttttttccttacagtgagacatttaagcacacattttattcacatagatactatgtccttgacatattgaaatgattcttttctgaaagtattcatgatctgcatatgatgtattaggttaggtcacaaaggttttatctgaggtgatttaaataacttcctgattggagtgtgtaagctgagcgatttctaataaaattttagttgtacacttttagtagtcatagtgaagcaggtctagaaaataagcctttggcagggaaaaagggcaatgttgattaatctcagtattaaaccacattaatctgtatcccattgtctggcttttgtaaattcatccaggtcaagactaagtatgttgg

SEQ ID NO: 11794 - DNA, 1174 bp, Homo sapiens
aagctatttgttgactcaaattgaagttaatgcacgtttataaaggtaaaaacttttgaggctcttttcttgacaactaagctagaatttgtggaaaaattaggagagataaaggagagttggctgcttagatatggacttacggattcatagatttttgggtatgaatctctttggttggggagtgaaggcttcgcttaggttggacctgtcaggaggggcggcctgtttctgagaagtggaaacagcattgaggcttcttggacctgttaggagagtaccaagaacatactaggttttcctatttgctgccttttttccataggggtgggagacgggggacatagaattacgagtttctcttcccattggagggatttctttttgaagtagtgagaagtaaatcacccaatagcttctctcttccccccttttaaaatgtcttttgtgggctggtgggcatttgtatttgttcattaacgatgttttagtatttgcaatactaaataaaaacattgtttttctttttttccaggaaagtccccagaggaaaaaaaggaaatcagaagctgtaggaatgagtaaccagactgacttattggctcttggcacagcagttggtagcattttattatacagcacagtaaaaggagagttacacagtaaattaatagtaagtgtgtgtatattttatttaaaagtgatgtgacagggaagctgattattagagattattaaaaaaaaaacacttcaaggtatgtgatgggatctgtgcagtagggacagttttcagtctcatctacgtttaaataactgaatagtaatatttgataaaagctataatagttaacagcagtccttattatgggtcagagtatgaagacttattgactaggtttaaaataaggaagggttacaggaactctaaggaatcatagatagcagctgtggaaagcagctccccacctcttgacctaggggaataaaggaggcagttgaaattactgctaacactgagatcttttaggggcaagtgttgtgctgctgttgctgtctcttgaagagtggccccatgggcatgggatcgagacttcaaactgagaaggaggctccagctgcctggtgctagtgtctctgatggagatgatgagattggttctcctagggttggata

SEQ ID NO: 11795 - DNA, 1052 bp, Homo sapiens
tgatctgcctgcctcggcctcccaaagtgttgggattacaggcgtgagccaccgcgcccagccgaaacaaggtttttttaaaatttaaattttattatatacaccaactatgtatccacaaaaaagaaagttaccttttaaaaaacaaaacagattttgacacagggtctctctctgtcgcccaggctggactgcagtgacgccatcatagctcattgcagccttgacctcccaggctcaagcgatgtctcacctcagcctcctgagtagctgggagtataggcgcttgccaccaggcctagctcaaaaaagattttcttaataaaaaagtttttactatgtgatgattatggtaattttgatttctagcctacatccagcatttagtccacttactgtatttgactgtggagatttagtattatatttttggaggaggaaaaagctttcactcagggcttacggaatatttggtgctgtgatgatgccttaatattgtggtttcgactcactgagagtaaaatgaggacctacaattccttggctgtgtctgagcacccaaagtatgccttttaaaatggatagaattaagtgaatctttaattcaagaatgtaagaaacaaaggtgcggagtggtagggtcatgggagttagaaggaacatctaaattttcagtattttcagatggatttttttaaaaagtgggagaattatagcacaaataaccttatttgcttagaattgaattgaacagttacttcatcgtggagctctcctttccgatatgtatcacatatggcttgttttgataatatatactattaatttttgtccctgctttgaatctgctctcctaactgagatttaactttctctagcatttcacaggacatgcaacgccagtttcgtcactgatgttcactaccatcagacctcctaatgagagccagccctttgatggaattacaggtctttatttcttatctggagcagtacatgaccggttacttaatgtctggtatgtagttcttttggatttgggaggtagcatt

SEQ ID NO: 11796 - DNA, 1052 bp, Homo sapiens; identical to SEQ ID NO: 11795

SEQ ID NO: 11797 - DNA, 1100 bp, Homo sapiens
ttataatgttaattctccccaaattgacctacagattcaacgcagacgcattcaaaatcttaggctttttttgagaaattgacagactgattctaaaattcaaatggaaataacaaatgacaataggcaaaatcattttgaaaaagaagaaaatcattggaagactaagattgatttcaagacctattatcaagcggcactaatcatgacagtgtggtattagtgtcaggatagacagacagatcaatagaaaaaaacagaatgttactcattgtttaaatctgccacaaatgcattattgctttctcttttctcaagcaaccatgttatatggtagtgacatggatgcttccgttgttttgatctttagtcactttactagttttcaaaagatgacaaagctattgggaatctcatgtgctgatctccatgcctccttaggtgtttgcctttttaggaagaaaattaaatctgtcttgctatctaacttgctggttttgttatctaggcaggtccgatcagaaaacaaagaaaagagtgcagtgatgtcatttacagttaccgatgaacctgtctatattgacttaactttgtcagaaaacaaagaagaggtaaatggctcgatttttgagaatttgtttttgggtttcacagatgttatttttacagtcaaggttttgatgatttaatgacttgagaaatagagaggacctgagggagtaacaacaaactgtaacaaattttagactgttcaaaggaacttaaatcactgtaataatctcttatgggggaagggaaaagtttgtacaggacggtagtaaattcaggaattcattatgtgaattaagaaaagttgttcaggtggattttgttactaggagtatgtatatatgattctttaatcagatgaaattgttggtgatagctcctaactaaggtgtgtgtgtgtgtgtgtgtgtgtatttctttttttatctctttttttcttttttcatttttttgagacggagtttcgctcttgttgcccaggctggagtgcaatggcacggtcgcgactaaccacgacctctgcctcccgggttcaagcaactctcctgcct

SEQ ID NO: 11798 - DNA, 1114 bp, Homo sapiens
ctatttttttgcatctttcccgatattgattaattacatgggcatatagaattatgtatcactttaaatctttattggtttgctgcatctgactcccccgatcctatttaatatcgtgtcaggacatacagatgcattttgttaatcaacagtgctacctttgacttgcttatggaaaggacaataggagagttaagagtagaaccatttactattttgagcagactgtttcttaaaaggatgatgaactgatacgttttctttaaaacctgttacgtttaaaaattctgttgaactttaaaaaataaatgtgaaaaattcaagcagttcatagctgaggaaagtaaaccttggtacccaatgtcttcagaattaccatttttcttaactgccgtcagtctgagtggtgatcgtggttaacaattgagtgtggaagtcttccatactttttaatattttataaaaatgcacaagtagtcatttatttttcattttgttcttattcccagttgctttgtttgacactcttttttttttctttcctctcatcttcccctttaaaaaaaatatattttcaggctttaaactccagagaacctcatatgtgtttagtaagagatatttcaaactgctgggcccccaaagtagaaacagctataacaaaggtgagcacattacaaatttgaagttttaagaaaaagaatatttctttgggtgaatggaactgttacttagtattatgattaaactgagttttttattctttaatatctttattctcttgtcttataaattttgtgggattatggttttagatgtcaagattgtactcctgatttgttgagtgaatgaatgaatagaagactagcagttgaagaccttggatgtggttcttccctgcccaccatgcatgatcatctgggccaggaagaatgtagggataaatatcaatatcagatttatcagtagatagtttttatcaatctcagtacttaaaagagcattactttgctgagaggaatgctgtatttcagggtgtaataaaaccgtcatggggctagaatataataccacaaaagcataggagcatcatcatggtgctccattttgcata

SEQ ID NO: 11799 - DNA, 2096 bp, Homo sapiens
taagaatgagaccttcatgaatgctttccttgttggtatttcgactaggataattgggatgaagatgaggaggagagtgaaagtgaaaaagatgaggacgttgaagaggaagatgaggatgccgaaggaaaagatgaagaaaatggcgaggacagagatacagcaagtgaaaaagaattaaatggagattctgatttagatcctgaaaatgaaagtgaagaagaatgaagacagcaaagcaagccggtcaaactatataaactctggctcaccttgcccagtggtgagggctgcctctgtgccaggatgccaaggaccgctgcacatttccaaattcacagcagtggatcccatgccactttgctgtcctgagcaccccagacttgactgtgtaaataagagtgtttcattcaaatgttaataaactttacacagtatatagacacattttctgcaatgtactgacatcagtgtccaatatatggtatatttttataatataatatcctagtatgattggttatatcaagaattgacaagtgcagataaagacctttcccataggagttcaagaactggactgttgtgaagaagtcagctcttatctcaggttggtatctttcatcaaatccagatgcaaagcagcactagtgaaaatttttttaatttagtacatttaatttggtacattttcataaaatatgaagggataactacaaactggagtaaaaatgatggtaattaaaaaaaatcctcagtatccctagcttgtctattaactgtgataatctgacttgagtcagattgaatatttggagtgcttccccagaataaccacttatttttgaagctatcatgtgaagtatttttttaaaacaaaacaaaaattatggtcattaaaaaactagagaattagccatattaaggatttttcttgactgcaaattacttctaaagaatcatcagtgtatagattagaagtgctcattacctgcaacttttaaaaaaaattcagttatagctgcttttgaagaggtttccatttttatttaaattactaatggatcaaagaacaattgtttattttttctctttggttttagatattaatgataaccttgttggaattttttttccaaagaaaatatttttataattaaataatttaatgtttttcttccttttcattacctactcttggcagtgttagggtatctgtttacctttaaaatgataagtctcactcaagattttttatgtatgtataaatattttggtgtgctacaaaagcctttgcaaattatcagtagtagtttttttttttttttttttttttttaaagaatgagccgatattggcttagtgctcactaggggacatgcacatggaagctcacctctaagaaagggctgggcagatggatttattttttcccacctgtgaatatgtaaaacaaaaccattatctttgagggagtttttaataccaatgacagaacagagatttgtgtgctcatcttaagagccagagccatataagcatcttgggaaagcaagtttgaaccagctgctggtgtaatgtacagttatatttgtctataaatggagctgtttatggcaatttaataccattctctttgtaaagtgaataaatattcatctttacccagtgcttgtcttgtggtatatgtagaggaatacagccacatgtttgggcttgtggtgtgaaggtttttaaaaagcagttttgctcccctggcattaaataggtaaatgctttcaaagcttgtggataacctagaatttgcaacgaagtgaaagaaccaagacatttgtgttagtctagtgtcagctatagccagttgattcttcatgcattcccacttggctgggttgtgacttcacaacccagggctgtagtgacagtaaagaaagaggcctgtgctgataatttcagtcctttactggtaaccaacacttggcttatgagtccggtttcccttatacctgactctgcctaaagaagtaaatgatgacaaccatatggtaatttctaattatttttttggtttagaaaaatctggagttaaattagtg

SEQ ID NO: 11800 - DNA, 1503 bp, Homo sapiens
gcgttccttctatcaaggggagaagaatttttattttaccggacagagtgtcattccaccttgcaagtctgaactcagggtccttgtggtcaaattgctctctatactgtattggaccctgttcagccctgcaatgtgcctactcatatatttgtacagtcttgttaagtggtattttataatcaccattgtaatctttgtgctgcaagagagaatatttggtggactggagatcatagaacttgcatgttaccgacttttacacaaacagccacatttaaattcaaagaaaaatgagtaagattataaggtttgccatgtgaaaacctagagcatattttggaaatgttctaaacctttctaagctcagatgcatttttgcatgactatgtcgaatatttcttactgccatcattatttgttaaagatattttgcacttaattttgtgggaaaaatattgctacaattttttttaatctctgaatgtaatttcgatactgtgtacatagcagggagtgatcggggtgaaataacttgggccagaatattattaaacaatcatcaggcttttagcgacaaggaacacacacatttttcttaaaggcccaatcctaacagactccccgtaccagaggcagatctggaactcgtcaacaacagcccggatcacatgctgttactggactgcccaggtcacctcattgaggtgagcgctgtccctccaggtactcaggcaggtggtgcccaggctccctcccttggcgtccttcttcctgcgccaaacccatctcatccttaagatcagaaaatggaaccccctttgtcgtgaaaccgatcaagcattttgacaggaagcccttcattattcataacattgtatgctgaccaagacgtcagaagaccacctgtgcccttttctctcgtggaagataaaacctggactcagggagcaaccacaggctctccactttgaaactttagtttgaattttaaaagataggaagtaatacagtttaagttcctttctcacactcagtattgcatgcttagtgctggttttcttacaacattttggcaggtgtagctttttctgttaaaaatggtatacatgaagtcacatacttttttaaaggaacactcagaacattctgtcattccagtcagaaactgtcttttgaaatatttctttacaacctaccaaaaaaggaaggttgttttttctacatgtgcttgggtatctaacatctaccattaaaacaacaaatggcttgcagacagggcagtaatggtttatcctaaattactcaaccccttgtagccttgacaaattttaccttaaaaccaaaatgaaacacaaaaattaatccttaataatgatagcaagtgatctttctttttagttttagccttcctttttcaatagtaatatttaaacccacttttgaccaattgtttgcccaaatattcttgtcatttggagtcagtggaaaatccagcacacc

SEQ ID NO: 11801 - DNA, 1147 bp, Homo sapiens
tgatggtttttataataggataggattaaaataggtgaggaagagtttaatggtcttttataatcacagaaggatttggcagatgactgtagccttgataagtacttgaaaagaattgaattggtgctcttctgatgggcttgtttttattttttgagatgttattatacctggtagtaaaatagctttttttacctaaagaggtagtatatatttctgtagtttaaatggatatttttagtattctgtatgactcatatttttaatcgtacccttgtaccctttaaacatttaatttatggattttaagaattcatcaataataattacatatgttatccttaccactattaatacatattccactttctaatgccaacacatttggaaaactttcatttaagcatcttaaatgacattttttttttttctgttttctttaagccataaggatgagtttaccattattcctgtactggttggagctctgagtgagtcaaaagaacaggaattcggaaaactcttcagtaaatatctagcggatcctagtaatctctttgtggtttcttctgatttctgccattggggtaagttctagattttaacatatcatggtagatgttatatacttctggttaaaggtatcttttcattctaagctctgattttcagttttttatcactttccttggaaagttttacttctggcagcagtgtttaaaagtgaataaaaaatcttttgatcctttaaaaaggatcagattacaatagtggattatgggtacatttccaaaggcgactggtataattggattcacactgtgaaggcatccttgtttagacacttatttagtgggagttaagatcttttaacctcatttccaagtaggtgtgtatggtagattctctgaagttagttttggtggataaatccaatgttctttagagtatagaagagcactgtgtgctgtgccagtccttttccacatttccttttttgtaattagtcttttttttttttcccctttggtgcttagtttttactcacaattgccatcagtttaaagctaccctccaaagattataaaatattggctattaagcactgtggtcatcattggtaatgtttttataagggtaaggactc

SEQ ID NO: 11802 - DNA, 1188 bp, Homo sapiens
cttaaaggccatccaacaaagacagaaataaggaattgaacttaactgaggagcaagtcattattaggtgtattagtttgctagggctgtcataacaaaataccacagattaggtggtttaaacaacacaaatttattttttaacaattctggaagcttgaaattcaatatcaagtttctgtcagggttgggccccttctgacatgatcatatctctgtgcaggcatacttctggtgtctctttttcctataaggacaccagactcattggatgaggtccccactctaatggcctcatttgaacttaatcgcctctttgaagaccttatctctaaatagcactacagtctgtgctactggggattggttcttcaacatgtgaattttggaggggaacacagttcagccattaacagttggtaattaagaaggaaaacaagtgatttgtaagaattacttttttctcttttatttaataaggtttgtgtagaagtgcaattgttacgtgtttttttgttgtgtatctcctagccggagaattttcatccttgggccttctcatcatgtgcccctctctcgatgtgcactttccagtgtggatatatataggacacctctgtatgaccttcgtattgaccaaaagagtaagtatatagaaatattatagctttcaaatagctaatgttcttttaacaggacttgtaaattaatttaaaaacttatgaatatcataagtaatatctcaatatttaaaataaaaattgttataactaatctgcataaaacagcaaaaaaagaaactcttccatatccctaaaaggcaactagtgttttttagctagctacagaaatctgtcagatctgccagtgtgcagattgtagtggttacattaatattcagaaaaatgccatgtactcagtgtaccaggagacaaaaaattagtacccataccaatttcataaagattctgggcgtgttaatttacttccatgtaacgccacttttctcactgtaaatagataatgctgataatatctttattttctttcaaatgatttttatgggaaaaaatgagcctttaattatgaaactctgaaagaaaggtgctatataaatgataaatatattttatttttaaacatgcctacaattttggttgatttatttttttccataggcgtccagag

SEQ ID NO: 11803 - DNA, 1242 bp, Homo sapiens
gagattcctcggcgggtaggcagcggtgctgggcatgctcagtgggcaggacccgttagagtggcgagtaaggaagcgttggctcttctccgggtctgccttccccggttcaggccccggccctgggcttttgtgtgcgcgtagctgcagccgccactgcctcctcgcggggctgcccgaccccagatgccgtcaggcctgtccggtttccgccgttaacctcgccgcgcggccgggaggaggagcggggcggggccggcggcgggcggccgggctggagggccctgccgggggtgggggtgggtgcggggagccccgcggggggtggggggcgggggcgggcgcggagtcacgggggtggggtcactcgcggtggctcggggaggccagctgggaggggagggggccgtgggggcggctcggcggaaccagccccggctgggcagcagcggggacgccgggggccggggccagggctttccgggcttcggtgaggccgccgtgggccccatcttccggcggtcgccggagtttgtggtgattgttgctgccgccgccaccgccccggctgccatctcctcctcctgggccgccgcctcctcctcttcctcctcctcctgggccgggctgatcccctccccgctgccgcctcctcctgggctgggcccgcggtgtctcgtcccctcgcggagccgctcctgccgccgccgccgccgcctcctcattcatcctcgtgcaccataggcggcacaggcaccaagatgtccaaccgagtggtctgccgagaagccagtcacgccgggagctggtacacagcctcaggtagggccccaggccgccggcccgcccgccgccgtcgccgcctggccccacgcccggccggccgaggtcggcggcccggccccgcggcggcggcgggcggggaagagggcgcggacgggccgccgggcgcggaccgcgtggggagggagcgagccgaggccggcctcgccgcctcccccacccgggcggcgggcatcccgcgccggcagcccggggccggccggcctcacgctctccggagttgggcgagagggagagttgccgcctcggcagcctgcgccctccctcaggaccaggctcgaggaaggaacgtgctcccggaccccagccgacttgtcgccgcctctggcttgcaggaagcgtgcggccggccgctgccacccccgggaaggacggtgtgcccggcgccgagccccgctt

SEQ ID NO: 11804 - DNA, 1435 bp, Homo sapiens
tgaaatatatatgatgaaaagaattgagaagttctaaattaagacatttcagttaagctcataaaatttcattgttttcatttaaaagattaacgttattgatacttggataactggctaatcatattaaaggactatgtggttccagctcaacttttaatatattgtctcctttaaaactatcatggttataattctattgggaaagacttttagataacaaagatttcaaatgttaaaagagataaaagtcaggttaatactatcttaaacactgagtcagaaaatcattactgtatagaagttgctttcctgatcaagtctgaacttcagctagtgctagagaactattttctatgacttaactctaaccaagttttattttaagctgtttctttgatagaagggccatgaaaatagagtaatgatatagtaggagataagggattggtttggtctttttcaataaagatagaagttgctgaagttttctgaattaataatgacttagattgtgaccttttagattcggtgttgagctctgtgttgtattacttcctaaaagataatgcttaaacattaagcattagtgtgctcttcatgttaatatggcagagttttgtaaactaaattaaaacttactgatatattggactttgagccaagggaaagaatgagtactatctttccagatatcttaagggtaaaagcttattctaagacagtctgtccattgagaatattagatttctgacttgcaaatatgtttgtactccagaagaattagaggaaaagcagatactagaattctaatttaattacatatacagccgtctttgtttatagtgtagaattctttatattttgtacaaaaactaattcttttggtaaaatgaaccatttacagttcggttttggactctgagtcaaaggattttcctttaaatgcttgtctcaattttagtctggtcttttgtacttttcttcagaagaaatgaattaaagggtacagttgcataaagtgggtttttatcctaatgtattggaaataaatgataaactttattttgtctttacttttttactttaaaactttttgatattttaggggttggagtctgataatgaaggagttgtgtgtattggactcttagtaacaattataaacgcttaacaaaatatagaaagcaatgattgggtggctctgcagagcaatcaaaacaaggtagaaactgcaaagtcctataatggaagagattcaggctgggtgtggtggctcatgcctgtttgggaggccagtatgggagaatcgcttacactcaggaattcaagaccagcctggggaatatagggagaccctgtttctgccaaaaaaaaaaaaaaaaaaaaaactaaactaaaaattagccaggtttggtggcctacacctgtagtc

SEQ ID NO: 11805 - DNA, 1809 bp, Homo sapiens
ctttgttatgattttgccccttttaggctggatcagtgcatgtaagaattcgacgagatgccaatgaacaaatggttcttgctcatgtgaccaacaggctgtacactctagtgtctactctaactgttcaaattttcaaggatgactggattaggcctgccttattgtctgggcctgttgcagccaatgtcctaaacttttcagatcatcacgtaatcccaatgcctcttttaaagggtactgatgatttgaacccagttacatcaactccagctaaacctagtagtccacctccagaattttcatttaacactcctgggaaaaatgtgaacccagttattcttctaaacacacaaacaaggccttatggttttggtctcaatcatggacacacaccttacagcagcatgcttaatcaaggacttggagttccaggaattggagcaactcaaggattgaggactggttttacaaatataccaagtagatatggaactaataatagaattggacaaccaagaccatgatagactctaacttatttttataaggaatattgactccttggcttccaatttatttagtaatccaactttgcattgactgtttaatcatttactctaaatgttagataatagtagtcttgttcacatttcatgaaacctatgaaactatatttttgtaaaatgtatttgtgacagtgaaatcctcgtaaatgttaaaggctttaaataggcttcctttagaaaatgtgtttctttaaatttggattttggtatctttggttttgtagttgactgcagtgtgatgtgaccttacctttataagagccacttgatggagtagatctgtcacattactaagatacgatatttctttttttttccgagacggagtcttgctctgccactgtgcccggccaatacattattattaacttaaggctgtactttattaaggcttccttagtttttgttttgttttgttttttgagatggagtctcactctgtcgcccaggctggaatgcagtggcatgatctcagctcactgcaacctctgcctcctgagttcaaatgattctcctgcctcagcctcccgagtagctgggattacaggcacctgccaccacgcccagctaatttttgtatttttagtaaagacgggggatttcaccatgttggccaggctggtcttgaactcctgacctcatgatccacccaccttagcctcccaaagtgctgggattaggtgtgagccaccgcacctggccgatattttctttaatgaaatttataaatatgcttcttgaataatacacattttgggaaagggaaaaatgtctgttcaaaaagtaaaagtctcttttatagcttttccaaacttaattgctaaatttttctttgaggttctcctgaattatgtcttacaaactaaaagcaaaaatttttagcagaaattttggaatacattctatctagcacaatttgaatttttaattatcaagatttttgttaaagtttctctcctttaaaaattttagtacatttgtaaatagtccatggttctcagtgttttattttgattaagtgactacccaacttttggtgatatgcagtgaaagaatcccaattttctatgttacatttaatcaaatactgacataatgaatttatctttcctgacacattttcattcattggctttttaatttcttattttattaacaaaatatatcagatatattaccaaaacacatggagttccatacataatatggaatttgatgtcttttcaagttgcacaaagaa

SEQ ID NO: 11806 - DNA, 1211 bp, Homo sapiens
tttgtgtgtaggctgggaattcttgctgaaggaattggagaaaacctgttgctgcaaaattttacatgttccagatggaaagggaagtctaagcgctttttaaaacaatttttttttgtatttaattaagcaattgcagttatctgggatttttgggtcagaattttaaattctgtttgattctccatattccagtgaataaaatacaaaagcattgtgtttttaagattgtgtcgatattcacctaaaaacttgtgccaaaagcacctggattggtaattatatttcacttaaagggtaaatttgacaatatcttgataatcaaaagtgcaatttttttcttcaaaatgttttctccagcatcacagatcctgcagatatatatttatatttatacatatatatttatgaaataattcttactcacaaaatatatttctgataaacattaagatattaaatctgatgcacaaactttttaatttggccattaatcttttttatttaaaaatttaaatttgtttttaaaattgtatatagtttttaaaatctcacacatgcttcgatacttccttgttaagaattcttaataactactaaaactgatttttaatagttgctgatatatatttggtttgtttgggtatacttttcaaaaccatttttgaatgtccaaacatctgatttaaagtttctgtttatctttctgaccaaaggagcaagaggtataatggatatggcattcattaaaatctttactatgtacaaaaacagtaatatttacagcatcagtaaatatttttaagtggtacttctaaatcataaaagttggggaaagagacctttaaaatcttgtggtgttgaacaatgttatatgaagtagaaaaaataaaatacttcccagttgtgtgttttgttttacagcaccatgtcctgtattacttgatattttaacaagtatcaggtactctctaacaaatgtacagtttttgctaagggaaatattaagaaatttttatcagtgaaatatttgttgcaaataatttcataggtttttagatacacctgtagttaatattactttgtaaagtaggtaaatcattttatttatgtccataaaatatcaaatgtctgttaactattagcaaattattgtattatcctttctggtctcacctggaagagtttcctgctgtcctcagtatgataac

SEQ ID NO: 11807 - DNA, 1150 bp, Homo sapiens
ttgttgcaaatgtgcttgaagatactgttaaggatcttgaagaacttggggcaaatccttgtttaacaaactctaagagtgaaaagacaaaggaaaagcaccaggagcaacacaacattccttttccatgtttattagctggaggtttattaacatataaatctcctgctacctcacccattagtagtaattctcacaggtcactggatggtttaagcagaactcagggtgaaagtatatcagaacaagggtcaactgacaatgaatcctgcactaattcagaactaaattctcctctggtaaggaggactttaccggttttgcttctttatagcatcaaggaatctgatgagaaagcaggaaagatcttttcacagatgaacaatattatgagtaaaagtttgcatgatgatggttttactgttccacagattattgaaatggagctggatagtcaggagcagttgttattgcaggatcctcctgtgacttacattcagcaatttgcagatgcagcagccaaccttacctctccggattctgagaagtggaactctgtgtttcccaagcctgggactttggttcagtgcttgaggctgccaaagtttgcagaggaggagaatctttgtatagactcaataactccttgtgctgacggaattcatttgttggtaggactgcggacatgccctgttgaatccttgagtgcaataaatcaagtagaggccttgaataatttaaataaattaaactctgcactatgtaatagacggaaaggtgagctggaatcaaatcttgctgtagtgaatggtgcaaatattagtgtaatccaacatgaatcaccagcagatgtacagactcctttaataattcagcctgagcagaggaatgttagtggtggatatttagtgctttataaaatgaattatgccactcggatagtgactttagaagaggagccaataaaaatacaacatatcaaagatccccaggacacaattacctcgctcattttgcttccacccgatatattggataatcgagaggatgactgtgaggaacctattgaggacatgcagttaacctcaaagaatggttttgagagagaaaaaacgtctgacatttctactcttggacacctggtaataac

SEQ ID NO: 11808 - DNA, 1235 bp, Homo sapiens
aatgtctctttaggttaatctatttctccctgttattttaaacatttcttaaatgaagttgtgtgtgttttttttgggtttctggtattgacatgcacatcattgtgctactggcaaagtattaagtattgcattgaagttgaacagtgaaacttttcataaattgctaacctaatatagagctatcattttctagccaggaggtatttttgatcattacacgagctcacacattcactgacacagccatctgacacatccagctccataggcaagaaatgtaatttacttaagtgctaaatattttcgtctccaagtatgtaacagatttctacatacaaggagtaaatacattgcagaataaatagaatataattatctactgattactagaaaagaggaaagtgtatttaggcatgcgtattttaatattatacaatacatttaaataggaaagtttactgttttctttcttgtaataggacactctgttcctgcagttttgcagagcacatttcatgcccaggcctgtgaagagctctttaaacacttgtgcatcagtggaaccccaaagatacggttacatactggtcttcttcttgttcaactgtgtggtggtgaaaggtggtggggtcaatttctttctaatgtccttcaggaattgtacaattcggaacagcttctcatctttccacaggataggtaggtcagaaaatgttggaggtatttgttattaatgatgtgtacttttcacagttactggttagcttttgaaatctttgaaatgtggatactaagttgtgaatatgaagcagatctcagagtttgtgaaatgaccagtgaagggcaccagcactgtgtatcgaagaagataataagtgataattagagtctactctttagttttctaattgaacttgtggacttcatagatctgtgtttataagtatttctattagattatgttgctttatatgctaaatgtgtttgtttgtggctaataaaattctctcattcactaagtgcttgatttcttgttaataacattagaaaatgtaaccagtagttagaaaaaaaactaattttagcttcatacctccagatacaaatcttgctttcccagtctgaaatatggtatgttttaagaaagcaaatattctatcattactctgttaaatttctatgtaaattattttaaaaattgaacaatcgaattgattcttattcttttcttt

SEQ ID NO: 11809 - DNA, 1354 bp, Homo sapiens
aaacaagtttgtagtctttctataacatgaaattatgattattccgccagattttgaagtaactcgaattaatattttgtacttgatgttatattagttttctttaccttcaagcttttacaaattatgtttaggatgttacggtaatatttatgttgttagatttgacttaataacttaatatattatctacattgaatgtctgtagaatttcacttttctgaaactctgttacatatctgatactttactccaaataggaagtaaggtatattggtcagtttagcttttaatattcttacttttgaaacttacagtgtatctaaaaattttgctctttagaagttgtaatatggagtggatattttcattacataaatctatactgaaaaaattttcattaagtaaacattgatttaaacactatacatttttgtgtgcagcactttaaggatttaattcgtttacgtcggacagcagaatggtcccgttctaatttagacacagaagttacaacagcaaaagaaagtcctgagatagaaccacttccatttactctggcccatgagcgttgtatctcagtagtccagaaacttgttctgtttcttctctccatggactttacatgtcatgcagatctcttattgtttgtttgtaaggtatgtaaactataagtgtagacttacagggttggccgggcgcagtggctcatgcctgtaatcccagcactttgggagactgaggtgggtggattatctgagtctaggagttccagactagtgtgggcaatgtggcaaaaccccgtctctacaaaaaaaaaaaaaaaaaagtgacttataggttaattaaaaactagcaaaggatgatgtttttagtcaattttcattaagagaaatgatgcctcttttggttttgcttttttgcagttagtttttttattgtgtcttaaaagatgaaaaaaattcttttcaaatttttccttaaggaaatctgatttatattttaatttatttaaaacttgagggtttgaaatgtaagtaatgtggatatgtttatctccaacctgcctttcttatattaattaaaataggaaatacacaagtaagtgtcaaattatattaaagaaggacttttgactgggtgtggtgcttcacacctgtaatcccaacacttcgggaggcggaggggcggatcacaagttgaagagattgagaccatcatggccaacatggtgaaaacccgtccttactaaaaatacaaaaattagctgggtgtggtggcatgcacctgtagtcccagttactcgggaggctgaggcaggagaattgcttgaacctgggggcgatgaggttgc

SEQ ID NO: 11810 - DNA, 1266 bp, Homo sapiens
ttgtcattgctcaactaagaatcttcaaagggatctttaacccctagagggatctttaaccccctaaaagcataaaggtctgtttaatcggtgtgatgttatagcagtagcaaccattgaaaattacttttgtatttaagtatattgatagtcgcgataaatgcaaggctttagaaaggctttgggttgttaaagtgcatgaatattggagctagcctgctttattattaacatcagtggtatgctgcttactgggtggggaaatcactttgcctcattttcttcatatataacataaggataataaggataatctttgtataaggttgtttttatgaataagcgtgttaatgtatgtacagtaattaaaataactctttgtacatgttatgtgtttactggatacttgtctctagcatttgaaagtaatggagtgagtcctagcattccttacgggggtgggaactcatttgcctcagattcttttatagttagtagagcatttattctgtcagtgactaaactggaggaaaaaaatgtgctgtaatacattttcgaaatctgtataaattattaaaacaggactatccccttacatacaggagaattactggctccagtagccgcagaagccatggaggaaggaacagtgggtgatgatgtaggtgcgacagctggtgactctgatgactcccttcaacagtcctcagttcagttgctggaaactatagatgaacctttgacacatgacataacaggtaaagttttacattatgtttcttctttattctattaaatggaaacatgtttcaaaataaagaatgttagagaaaaataaagttgatttttatatttttctattagttctttggccttataaactagatccattattttcctggtaaatacattttatcttggttctcattacaacaaaatgctataatttcataatatcctaattatgttgatatagtgtgatttggcaacgatgaagaaaatgcaatgtagaaaacatgtaaaaatacaaagtgatgaagacagcagttttaaaagctcttattctttaagatccagcatgtgatttttttggtgtatttttttcttactttttctttttttttcctttttaaaaagtatctttataaattagcatgtataatcctttatcatctccataccccttacttttcaaaagtctgttttgggtactaatctgtatatgtcagatgctgcagtcattttcaaccatttgtcattccttaa

SEQ ID NO: 11811 - DNA, 1143 bp, Homo sapiens
tagtttaaaaacaatcaatggaatagtataaagaaaacttacatttttattaatgtagctactcataattatcatacaataatgagaactacatttaagtatacagaagtatagttatagatcaccaacatttcagacagccatctaaacttcatccgagctgtgttcattgcagagtctacttgtatgttagcctacttttttttaaaggagaatcacctgtaataatttatggtggtacagttctttggtccataagagattttattagggatgctactttcagtttctaaacatataaggtatttttagattttggcagaaagtgaggagaaaattactggaccattcttataaatcattaaaattataaggggatttgggaaatttaaagggtggatagaatatttattttgtagttctgtttgggtttagataatgtaaataacgtgtcattcagccaagaggcaaaaataaaccacagttttttttccattcttttaagccaataagcagtacatggtatgattattggggtgctgattatgggacctacaattacaacccttacattggaggtctgggaattcctgtagcaaagccaccagcaaacacggagaagaacggatcacagacagttagcgtttcagtctctcagggtaagtgtatgtttatattttaagacatatgctattcttaaaacaagtctgtcatttatgtatactttgtcccttgagaagttgagcctgggtgtatgccagtgggtttagtatcacagctgtgccgtgagtaccattcagagctgtttctttgtagtcactttagaggaacttctatctttttggttctctgtcagaataacacctagcaagtgttgtatgggattggcaatgattttaatgaactgtgctgtattttaattgttgactttaatagtaaacttgtattttatttataaagagaatgaaactacattaaataagtattatttttgcagtttttttttttttttgagatggagtcttgttctgttgcccaggctggggtgcagtgatgtgatcccatctcaccgcaaccgctgcctcccaggtcgaggggcttctcttgcctcagcctcttgagtagctgggagtataggtgcat

SEQ ID NO: 11812 - DNA, 1108 bp, Homo sapiens
ccagcactttgagaggccgaggtgggcagatcccttgagggcaggaattttagaccagcctggccaacatggtgaaaaaaatacaaaaattagccggctgtgttgacgcatgcctataataccagtttttccagtatctgttactgttttcagttgccagttttgtagagtgtgaggatttttagtaaattgtattgaagtagaaatgcctatggtttggaaagtacaacatactgagagtgataacatgtcatttcaggtgttgtgggctgagctttaaaccttatcctaaaatgttactgattcttaatgcgttagttgtatttaatggagaattccttttatttgcatgttttgaagacactggttaaggagcggatttaaagaaatagtgtcttgtttttaaatttattcttttgacttagttcttcataaacattgtttttctgaaaaatattttccctttctcttttctgcatagcatcaataactagctttctcacagtgttagcttggtatcccaatactttgctccggacatggtgccttgtgcttcatagcctaacactcatgacaaacatgcagcttaattgtaagttcataaatttattcatttaaatctctgacatatactttagtgttctactattggattcttaaaacagagttttccaaggagtggtatacttgtcaaagtggttgagttggccagatgtggtggctcacgcctgtaaacccagcactttgggaggccagcacgggtggatcacttgaggtcaggagctcgagagcagcctggccaacatggtgaaaccttatctctactaaaaatacaaaagttagtgggcgcctgtagtcccagctacttgggagggtgacgcacgaaaatcacttgaacctggaaggcgaagtttgcagtgagcttagatcacgccactgcacaccagcctaggtgacagagtgagactctgtctccaataaaagtgactgagttttttcttctaacatgtctcttctgaattagttcttatatatcctttgtgcttgtttactttgataatatagtctcatatgtctcgttggatgttcaaatcatattttttacctt

SEQ ID NO: 11813 - DNA, 1222 bp, Homo sapiens
aatgaaattgtaggaaccagattattttactttcttgtccatttcccattttgaaatgcagatattagaacagtttcttatgtcttttatatagcagtgtataattatcatttttgtaaacatttgttgaatgtgtatatttctctattagaaaatacaaaggtactttaaatggttcaaattttaaatgaaattggtgtctaaatgcatattaagagaaaagataataatggatgaagacacatgctttaaaaaattctctgagttcagggagatggtttttttattcaggtaagatttcttatgtattttggcagacattttgtatttagcgtatttaaggctgtcagtttacaaaaattaactaggaaggaatattacatgcattgagtttagttcttattcacaggaatatataaagtcataatatgcatatttcattttttagggctctcttgctacttgccagttatctgagccattattgtggttcattttgagagtattggatactagtgatgccttgaaagcatttcatgatatgggtaagataatatttcaataactatcatttaagtgtagttatgtgatagtatgttacattttcatttttgtagtcttttgtggaagtttacttttgatgttgaaccatctgtcctgagatcgatttcatttcatattctttataaatttaggtggtgttcagctcatatgcaataatatggttactagtacaagggctattgtgaacactgcaagaagtatggtatcaactattatgaaatttcttgactctggtccaaataaagctgttgacagcacattgaaaacaagaatactagcttctgagcctgacaatgctgaagggattcataactttgcacccctcggtaagaaaagtgttactaaatcttacttatgtgaaattatctagtttattagctggtatgaaacaaaattagttgaagtcagttgatgatgttatatatcactattttaattacaaacagtttattttagaggtagtggatatctcgacattctacttatgagagggaatgctttgtttgtttgtttgtttgtttgtttgttttgagacggagttttgctcttattgcccaagcaggagtgcaatggcgtgatctcagctcactgcaacctctgcctcctgggttcaagcgattcctgcctcagcctcccgagtagctgggattacaggcac

SEQ ID NO: 11814 - DNA, 1153 bp, Homo sapiens
tagagacaggtttcaccacgttgcctaggctggtctggaattcctgggctcaaatgatctcttctcttagtttcccaaagttctgagattatcagcatgaccttggccttgttatatatttttaatatgctttttctcataatttttattttaagataaccacaccaatattgactaaagttaacgggagttcgttatgctaggtattcattatgtgcaaaccgtttagtactaattttttctaaccctggacacgtttcttacacttttatctcctttggtattcatatattttaagataaaatcatttctttcctccttaaaaaaaaaaaacttaactactagacccccagagacatttgttctttagctactgatttgatatgttaaaataaacttattcatattttctgtttcctttttatctttcaaaataaaaagctgcatataaatcttgcatttaactttttaaatattttgtcttgccaggttctttgtgaactatttcagacatctcctcaaagagggaaccttccaacatctgggaacatttcagggtttatacgaagattatttttacagttgatgctggaagatgagaaagtgacaatgtttcttcagtctccatgtccagtgagtatttaacacttaatcattggctgtgtatacatgtattttacaattttgtatcagagcctgcagttacctcctatgttctaacttcgagtatagcaaagtgaaactagcacagcctttatacctaatgacagaacttgacaatttcaggatagcgctctccctcatgcctaggaataacataattttaccttagcctgagaagtatagtttgatttgtggaaaaaaatgaaaaaaggtacagagtgataatgcaaaagttgaccaacaaatcatggcaactatgccatatctaaattaattatatcttgtaggatttattgagtattttattcttagatgcttttgagattattttataacaatatgtattccaaaaagttacttcctgatttctttgatttcttgattttcagctgtacaaaggtagaattaatgctactagccacgtcatccagcatccaatgtatggagcaggccacaaattccgtactcttcatttgccagtctcaacaac

SEQ ID NO: 11815 - DNA, 1124 bp, Homo sapiens
aactaccttaggaaagaatgtttactgaatgtttattttattttattttttttttactatagagtgaggggttgttaacaaagaatatatattggtcattcttacaactactatttaaagtcagcaacttttcactgaatttgatagattttatgtttggccatatcttcatgctcacatttgatttctgaagacctcctacatacacttcaataaaagttaaatggacatactccctcttttttgatttactggtacatttttaaaataataaatctgccataaaatgcattatatctggagacttgcacttgtatggatgaatttattacattcaacatatttaattttatgccttctaattctaagatgcagaaaaaaataaatgaacatgattttattctatgccaacatttgggcctctgaatgtatctgttatttgaatttaagtatttgaaaaggaatggtcaatttgaaagtcattctaaactgattttttttttctaaagggctccttttttcctggactatgtggttttatgactaaagtcacatgtatgtattaaacattgaggctctgtagaggagagaggatgtacctctctggtgctgttacagtacattctgtacctgccatacaggctcattttcatgcaaattcttcctagagccaaataaataaagacttaggtgaattagtatgtcttgtttctaaacccctttgccatggtgtgaaatgctatttctataaagaattgaacactttcaagacttaagcatgggaaaacaaagcatgtttttccaagaccagttgccgcaggggaaaggctaaggtgattctttgacagtatttttataaaataaaagtggcggctgtgcgcggtggctcacgcctgtaatcccagcactttgggaggccaaggcaggcgggtctcctgatgtcaggagttcgagacaagcctggccaatgcgatgaaatcatgtctctataaaaatacaaaaattagccaggcatggtggtaggtgcctgtaatcccagctactcaggaggctgaggcaggaactggagctgacgcctgaatctggagctgaccaggagaagccgtattctgaaaggcgagttg

SEQ ID NO: 11816 - DNA, 1164 bp, Homo sapiens
cttggacttgctcccttttttactattttttgaaattttccatttaaaaaattaattttgtaaaaattttaaacagtttccaagttaccaaaaagttgcaagaacagtgcaactgtcttttgcatcccgaagttttggagagtaagttgccaacatggtgcttcatcatcctcaaatatgagaacgacattctcctacataacccagtatgcataataacatcaggaaattaacattgacttttcactaccgtctaatcctcataagagaggcctgtgaaaactagtcaactggcaaaaaaagaaaatttgagtactgcattgtagaaaaaagatcatgataattctcagttgagagtaggtataagtgtataataccagaaaaatatgtacacttaatgtaaactgaatggcaaatgaagaggcaggagaaaatgatcatgataatggggctgctgtccacatgcttctctagcaatcccacaatgtgtcttcattcgctttgatgctgaatacatgagctcttctatgacgaatcatttgaccactggatagctccagctttgagtttgcagttggccctggtaccttgtctcaaagtcagctattttggtcttgttggtctgcttcttgatgtagcttctgagagtttagttattcagtaccattgtagaaatttcagtacatcagagggattctttcatgtatgtgggttgcagctgcccactgcactgtatagatggtctcacatgagtgaatgtccagccttattgctctgttgctgaagagtgagagaacttgctctctgtgatcaaataggctactttttcctttcattttattcctgagcaaataatcctacatagagttcttcatgtaatttttctctgatttatattataaagtgccatggtcaaagtggcattatgttgtgaaatagataagctaaagaacagttcttcatagaagaagtaaaaaggcttatcaataaggctagctctttgaaagaactattataggaaattaaaactttttctggtaagtttttaatgtacatgtttatgtaaatgtggattaggtttaaagttttttgaacatttaaagaaattcgagaaaaaattcacacatcctatcaccttatcaaaatgacttaagttctttgttg

SEQ ID NO: 11817 - DNA, 1104 bp, Homo sapiens
ggttttgagtcaactgcccacccgctttccagtccactgtggccagaaggtgaggtcacccatagtatcacttttaccaaaaggtaacctgtctgattacaatagttatcatctgttctaagactaatgattgatttgtccagattgttttaaaaagtaaatctgccctgctgaaatggtaatctaggaaaaacaacacatttcaagggagttggcaggtcagcagaccagaggcattgcctttttcatggtagaagaaggaagagaggaaatacgcaattcctctcgaacgaagctcccgctccgaacccatagactcgttccacccacactcgattggtcaaagcaagtcacatggccaagcccagagtcaaggggacacgcaaaatccactatacccacaggaagccatgacaagatgtgtgtgtggaggggggcagggtggggggaagaactagaaagaactatgcatatattatacgatttaccatgtttattatttattctcggatgaataaaatgttaggggagaaagtcaaattggtgagagaatcattcttaacaaaactatatccaccaccttctctctcctataaagactaacgaaagtgcttttcattaaatttctacagttaccaaaaccaaaacaacaacaaaaaaaaactctttggaccagaaagcatgtacctaaccgaatcacaaaaggtcagtacagtatttttgactgacgaataaaggcaaaaatataaatcaaaagattttgtttgggggaggattacgccgtaaccttctaaagtaaagcagatgcgcgctccagccagctcctccatggaatgtaagctgaaagcgtgggaggaagagctcttggtttctgctggatctgagtgaagcagttgcactcatgagatgcacctgtagccattaaggggtgttggttaaacaaggagcccagctggtgggtgcctgtgcttccaggcctcgttagggaagagcactcaatcccacacaagaagcccagataccatcaacacaggaacgaccaccgccctttcacctgctctccggatgcttttctttctctcgccaaagctttctaaatctgtt

SEQ ID NO: 11818 - DNA, 1726 bp, Homo sapiens
ccaagatggcgggcaccatggtgatcgtggtggtggtcgtggtgggcgaggtggtcgtggaggccgaggtggtcgtgcaggccagggaggaggctggggaggaagagggagccagaattatcaccaagggggtcaatttgaacagcatttccagcatggaggttatcagtataatcattctggatttggacagggaagacattacactagttgaggctaccgaaccttacattttgctagagctcaagtaatagaaacttagtttcagaatcctgaattcagcacctattttgaattaatgtgagaccacaggtggcaggcagattcctgcttggcataagcatttgtaggtcttcattcaattctgttagatttttttattggacttacataatgccgtttatttgagaaacacataacatctctcctttctatgaaaaattttttaaaaggtggttaaaattgcctttaattgcccagtagactaattccacagtcagaacatgcaaacttttttgaagaaattacttgaataagtagttttcatgttttcaatatgcagttttgaaaatgaggattcacctagacttttttagatttactactaggaaaccttcctcatatgaataaccatttatatgtgttttgcttaaagtattccaatgcctattttccaagcacagttctgccccccggttgacttttatgccacgtgtgcttcatgatggaacttttaggtcagttcctattaaatgagctcttttgcagatagcacattcagtagccttattttgttgatggaatactgtatcatatgctcaactctgaaaaccttgaacacggccaaaatccataaagattataaaagcaaactaagttgtgaagctatagtacatgtaggcatttagttaagtatagcaattcaaactgacctgcatccatccaaaacaaattcctccttcaaccttatttttacttgaaatttgctagaagaaatagcaaaccgaaatttgttttatgcatgagttaataccactggctcagcaaatacaagttagtttgctttaagcaggtaactttttttgtaatggaagaaatgcactacaaagttaagacagatttttgctaagtgcaggaggccctttattattgctgcagaaaacaaaagcctggctgagttgatgttttacattctcccttactgaaatctacatgacatgatgcttcttgctgggtttttgtacatgtaaacattgtcaagctgtgaaagaaaatggctggaggtgtgctttgtgtgaaaggtgagcaataaagtatctgttaagttctctctttggtttgagttttattttagctactgaattattctggactcttgcgtcaagctgatgagctaaggcttttgttcccaaagattcttgagtatttccttaaaacctaattttagtgaaaggtgacttttatcctaaaaccttaaataaatggaaaaatggctctttccaggttttccttttataataatatagctagaaaccgtcaccactcatctctggccactgggtgtagctgttgctacacatactaggcaaaaatgtttttagggtttttttgttatttgcttctccattcttcctaagattgggggactttttttaaaaaaggaagtaactgaaaatataaatatgtttatcaaaagagaaattgtatttcctttctactaaattgg

SEQ ID NO: 11819 - DNA, 1478 bp, Homo sapiens
attttatttactcagaagttgcctctccattactgttaacttgtttagtaatttatataattgcagtacttttaagtgttggacactgggattcaggttgtatacaaagtagtagctgacgaaaaatatgtatatttttgtgaaatgtatcaagccctaaagttcattttagagaaaggcccagaaaaacgtatctgtgtttaaaaacaaaggacaggtcattcgtcaatttgaatcatttttacttttgccactacaaactttttaattggcaatatccatcatccaactggatcttcatgtcagtgtcagggatgccaggttgacaaagtatttaacagatcctttcagtttttgttttgtttttttaattctaaaaaaaacaaatgttaggccaaacagatccctagatcccactcattgattctggcggtattcctaaagtggtgcttagggggtcagaattttctggatctttgctaatccaagctttagatttaatttaaccaggaccacatgcttgtcatctctctgatgcaaattttcaaaatcattttaatttagattctaatgtctgcctgggtttttaacaggctgtgaaccagtgagtgccttgttaatgtagaatgatttttcccccctgggtgggtgttagttagctcctctctgaaaatgtctcagagaatggtattttaattgacttgtagagagctgctaaatttgttattatcagcaatcagaaagtctttggtctaccacacatctccctccctactatctcttcattgtttggctgaagtttgcctcttgtgagaaaacaatacaactccccttctccacacactttttttccagcccagattaataggtatcccctaccctaatcccaactctatgatctaataccttttttaggaggaaccacttctttttaatattgaaatctgctggttactttatgttttctcaagttcagttgactagagctgaccacagggtgtcatcaattcagattcctaaataaccctttctctccacacccagtcctccagctggtgagccctgggccagattgtttgatcttcaggtattttaaattttagttacatcaattaatgtaaattaatccaaatgctaatttttgtggtgcaagaagtttcttatgtaaattcagggtatggataagctaattaagatatccatctttggtggctctaagtgtattatttgtttttaaataaagtgtacaaatatagataacatgctataggtgtctcatgaattggaatatttgtcagatttgggatctagctgtggctttacagtaatcagttaaattaacatagtctgatttggggcttttgggggaggagttgtagaggggtgcagagaaataaaaggatattagacaaagtatacatgagtccaaaattaatgaaccagtcttaattactgattgtgaggaaggagaagtttat

SEQ ID NO: 11820 - DNA, 2164 bp, Homo sapiens
aaagagtatggttaacttcacgcagctgcttttgcagaagcactaataaaaacaaatattttgtaccctagaagtcctctattaatccctgtaagaatctcctggaaacctggatgaaagagtttaatgccaaatattggctaaaaagttctgtctttctctctccctattcctcccccattgtttaattgagatatacatgttttaatgggcagtggatcagtattgtttctggggaaatccacaccttaaaaggccaggcttccccagcccaacttacctgtgacccacctacatgtgttcaccttttgggattctgaagaccctgctatctagacctagtctcctgtcataaagacattatttctatagtggtttatgtctctcttactctttgtcccaaatgacagagaccaatctagaaattggaaataaattattaacgtccaactttccaccaaaaaacatataaataggctcttagattttaaaaatattaaatctatagatattttaaccaattaaaacaatttctacatattccattccccacattttccatcgtcataacaatgatgcttctcatgatacgtacatctactccttgaaaaagtattctggtggtggtgtggctaatgattgacaaatatttctgtaaaatttctgcctgtttgcctctagaattctgcattatacaggcaaattttctttaaagctagagacttgtgctaaatttgcctgattttcatacagatatgctgtagtaatacagctaccttttcatttcatctttgtgctttggttaacaagcaggctcaagagactgctttgtgtaattaaatgaattgacctaaacatgagctgtcaggtgaatacttaatatttccatgcagatacagaattccatattgtgttcagtaaatttcttttggttcttcacagtgaagaaagaatgtttctaacctaacatttgtagaaggatactggaaaattccttccaggaaggaaggaaggaagatgccattacttggtgtatttatgatggatgaccacaaagctattgttctaccagttattaattaccttctaagatcttcagttactgctttattaatgtcactgaaattctaaaaaccaggacattcttcccccgttcattttatgcttcatggttgaaatttttctgtcagtgagtggaaaataaccatgagatacatagactgtagcgcaaatggaactgttgaaagttccttagaaagccagtgctgtggcattggagactacggagagagtcttctctaccagcactgcatgatctcagcctagaaatgagccaaagctgtcttccaaccagagtagcatatacatgtgtctgacttttcccctagcctgttgaacattcaatgaaaattcacagaatgaacaaattcaatgtttaaacagccattgaaatgctttcatagtgcttcatttgtaaatattttgtttgaaatgtattggaatagtatgaaaattagcgggaggtttggatccctgccttattttcatatgctgtggatacatctctgggagcttgcagcacccttctcaaaactcaactgtcatatggagctcatttgctactcaaaccatagacagattatttaacaaaagtgatataatgaccttcagtatttttctattgaacaagtttaacaacttttgccattaaacaaatacttagttatgcaaaatatttcgcttttataatcattttagttatgactaaaacgggggaaattgagctgcatcactgatgatgaactttgtgagaaattttttttttaatctgactttcattccttcagtattcttgctataaatttcttttggagataatgatgaagatttatttgaaaatgtctaaaatgtatgtatattttataaatatatattatatatattgtaagaatatatataatatataaactatatatatatatatatatatatatatatatatatatatataaaccataggtgcattttactgttttgtattttcatttttggaggtagtatacacagcagataatgatgagtatgatgagtgttgtgctgtttgcttttgcagtataatatatagttctaagtgtttaaattactgtatatacaatattcatta

SEQ ID NO: 11821 - DNA, 1180 bp, Homo sapiens
cggccggcccccgcgcccaggaggctgctccctgctgactggggtgtgggcgggagcggcggagggaggaggaggcgctgcttgccgccgctgttgcctccgctgctgggcgccggggcagctccccgggtatctgcggccgccatggacgagcaggcgggtcccggcgtcttcttcagcaacaaccacccgggcgccggcggtgccaaggggctcgggcctctggcggaggctgccgcggccggcgacggggcggctgcggcgggggcggcccgagcccagtacagtctcccggggatcctgcacttcctgcagcacgagtgggcccgcttcgaggtggagagagcccagtgggaggtggagcgggcggagctgcaggtaaagaccctcccggcctggccgtcttcatcccgcctctttgctcccttccgccccgccccggacccttctccccctcccccagccttctcgcgtcccctccccctttgctgccgcccatcccacccggagccccgtccccttcttctcttcgccttttgcctttcgctgaccccacctcgaccctgttctcactcccgctcctggtgcgttgtttaccctccccacgcctgttcgtccgccccatcccactcttaactcccagactcatttcaactctctggccatcctgcatctcagggctgccctctcggtttactaattgggctggcagtagttttgagagacgcggagcaaatcgtccgctgccctggtgtgccccttcctaggtctagagacagtctccgcagaacgtgccggctttggcccctctcttcaaggaaggtgatcaagaagacaacagaagttgtgtcaggccttgagtcgaggcgagaagttgacgttgggcaaaagtgttattcatatatcagatccctttttttatatatgtaaatgtctgttctccactttcttccgaccccccggccccctcccacgtttcttttaggtatttccaattaatgcattttgaatgaaggacctagatgatcgcagtcagagagaatggttaagaggtggttcctgttctcagaatctgaaacttcccaagggttaattttatgttcagtgttttgggagattttcttgtgctttaaaaggaactaaagggactttgaagttagttacattgccttgcataatc

SEQ ID NO: 11822 - DNA, 1174 bp, Homo sapiens
ggggtggattgggaaataaattggaggtagagaaaagtttgaccttctctagattctgggtccaaattggtatattttagcatagcttcagtgaggtgtgataagaaaagggcagggttttactggtgctcttgtgtaatttctctgagcttttcataattaactgccttatgggcatttttgtccatgcccgtgaggagacaggtaatcatgtggtctcttcacctgatgccattgtctccctgttggcaagtcccatctgggcctctatgggggactgcatcattggccactggattttgtataggggctttattatggagttattataatcaaggggaacttaaagtagtggtgcttgtccaagatggtaatgctcctgttctgtcaaagatggaactgtgaaatagaatttgtttaaagatgtgttgttcattcaacagaagtttcttgagggcccattataaggctaaattatacttccacccgaacagtttaattgacattgcactatccggcgcacgattgatcatgtctcttggagaagtaatatctagacagatccaaatggaatgtggtaattgtagatctttgtgatgcttatgtggatttctctgacatctatacaagttattaatattgaaaacaagtactcctgtaaatcagtgattaaaaaaaatacttctgtgggaattagaattgatccacttgtatctgttttctactttctagctccatatcagatttcacttgaaaaaaagtctactctgctgtagacaatatgtttggatttaaaatgaaatgtctgaaacgatggagacctgtttgcatcagtggggcgggtcattcaatataaaactttaaaaaacaatacggaatcaaaagtttattaagcacccaatatagaattggcactgtgctgggcatcaggtttatggtaggaacaaataaaatggtccctgttgtcatggagtttcatggggatgaccgactttaaataaataattacatgaacaggccaagcacagtggctcatgcctgttatcccagcactttgggaggctgaggcggatggatcacttgaggtcaggagttcgagaccagcctggccaacatggtgaaaccccatctgtactaaaaatacaaaaattagcaggtgtcgtggcatgcacct

SEQ ID NO: 11823 - DNA, 1133 bp, Homo sapiens
ggtttggggtacgagtgagcctgtcacccaggtggcaagcatagtactcagtagatagattttcagcccttgttcccctcctcctgtctcccctctagtagtcaccagtgtttgttcccataagtatgttcacgtgtacccagtgtttagctctaagtgagatgtacatgtggtatttggttttgtccctgcattaattcacttaggataatggcctccagctatgtctacgttgctgaaaaggacgtgatttcatttttttttatggctgtgtagtagtttgtagtgtatctcaggtgattctgatgcatggttgatgcatatactttgtaaaacactgcctaggtgttccctgcctagagaattaatgagagctctattccgtcacctcaagcattaatgtaaatattaaataactttaatatgatagcatttctttaatcttaataaccataaaagggcaaaaatctgatttctttatgttcaaggggttttgcgaccacaagcttcatgatgtcttaattgccccaggaacagcagatctaacagctgatgtggacttcagttatttgcgaagaatggcacagggaaaagtagcctctctgggcccaataaaacaacacacatttttaaaaaatatgggtattgatgtccggctgaaggtaaggtttattttatttcactgttattaagtactttcatagtatttcaaaaattactttaaatagtatgttcacctggccttaatgctcttgtagttagccaatccttggtattccagtcttttcaggtagtataggatttagtaactagtctggtaagttttatgcatctccatgggaggtagcattaagacttccaaatagtgtttttgtttgttaagaaaactgcgtttatgggtatgaattttctaactgttcttctgagaacacctaaaccttactgtagatcaaaccccctgaggatatttgttaaaaatgcaaatccttaggtttgtttcacaccaatctacatttttaataagtactctatgattctcaggcaggtaatcagaagtcacattttgagtgctgttttattggaatatttgagagtcattagtattgctgcatgtaactaggaatcctgtcttc

SEQ ID NO: 11824 - DNA, 1897 bp, Homo sapiens
cctagggttcagtcagtaatttctgctttttagcagggccagtgcagggtcagttaatgctacagttactgtatagcaaacagtatccttttttctccttcccctagcctattgggctttgcagatatctggagtgttttaaagtcaattattttaagcagtttgaggggatgtgtaggagtggagcatgaaacagtttataaggctggggctgtattatcagcacagcaaattaaagaatgaaagaagtacttctttttacatttcagctccagcagccagctatttaaaaaatatttttaaatatcttccccaaagtttaagatgtgggaccatctacttgtaagaaacagtggcttatttcttcatttctcagtaatcattgtaaacctttttttttttcttctccactctaacaaaagtaaaagaacaaaacttttgctgaggtcttggactccactacttgttagttatgttggcctggacagatggcaggtctgtcggcagttcctcagtctgtaaaatgaagattatcattcttgcctctccctttgtcacagtgttgtcgtgaagatcagatatgtatgaatgcagtcaaataaactaaaaactaggaaagtgttaactatcgttgcccaccgaatttgaggtagcaaaaaaaaaaaagaatgttctggtacatgaacagactgagaaggcctttcgacatccctgaagctagtctcctgtctagactaaaaatatccttgaaagaatagtagcaaacagtatgcagtactcctgtgttctaagttcttttatgttttagtttaccctcacagcagccatagtgttaagtcattatgagcttcatcttaaagataagaaaactgaggcaaggggagattaacttactgccaaatttcaaacagttagtagtatttgagaccagtagtatggctctaatcttacccttagccctcccaaccattatgctgtactatctacccataaatacctccaggaaacattcccctcttggtaatttgtccttctatagaagcttcaaagattaaatcaaattaattttcaaaaaaaatttttttttagaaatgttattttccctgtgatagaggatgacttcccagtttcaccaaagtctgtttatatcaacacacacaaaatggaataattctgagtcactaggcaatcaatctactgtggttttactatgtaaggtgaaaattaactggaacgatgtttgtttgctatacttacatagtcaaactttacaagccatgaaattaattgcactctttgtatttgttgttaaatgcctaagaagttttctaaaaattttgtaaaggcactgtcagagaatctggagttgaatgattattccagatactgtataacctgcataactttttgtctttaagtcgtgtttgtaaaagaagtaattgctagaaacatttgataatgtacaaagtagtctataatgactgttcagtacatttttaatatttttttggttatatccaactttttgtaaatatactggaagcttgataataaaatgtatttcctatcaccatacttttccatgtgaaaacctgagcctatttctagtataagtatccaaagaaaagtttgacctggttgtgttattttaccagaccttggtaaaagaactattttggaaacagtatttgtaaatggaactaatgctatatttaaaaacactgatttttttttaacctgccaaaaataaaaaaaagctcattttataattttctactaaatttgagttgattatctggaggtctcatttcttgtaaagtataactttttcagaaactaccaccaaattatccaactgttatactaccagaaggctttaaaaagttaaaaacctaat

SEQ ID NO: 11825 - DNA, 1872 bp, Homo sapiens
tatacataccagatttgatgctgcatatagggtatggaattgcacatccatctcataggaattgtaaatggtttgaataagaggaaagtaatttttgttgcattataaaatgtctagtagcatcataagtttttttgagagaagcatctttttatttcccatattcctggttattttcatcattgctttgaattgaatttttatatctatttttatatgtaactctttttttacctcatgtttttgtttgttttgcacatttctcataccacaggtattgaagcccctgggtgataatttgatggaggaaaacataaggcagtctgtaacaaactctatcaaagcaggcctgactgaccaggtgtctcatcatgccagattaaagacagactgacagttcatctcctcacggactccactctctttttttttcatgcttgctgtacaatgagaactcaaataaaaataaaccaaagtttacaatcaactgtagaagtagtttagtgtaactggcttcacagatggctgccacagagtgtgaagattgtttgttagttttaagcattcttttaatggctcctaagacatgcagatggactgaggagcattggttaatcatgcacctttgtgccatgtttaactcttttatttctttttacttaatctaatgttagtgaatttgtcttatgtaaaaggatatttcagggaaatattttcagaaatctatttagagtctctttaacacagtgtcccattgaaattttaatttttagagaatttatgaatcactgtttcaagaaccagattggaaagacaatgaagcctttattgagccactacattaaaagtatatattgctttactgccttcaataccagtattacatcaatgcatgtatcagaaacttcacagaaattacatggcaactcttgtagctaagaaagtaattctgaggtgtacatttgtcttgcctttttaaatttataaacttgccctaaaaggagatgcatatctgggaaactgaactgtctttttgcagtttagccttcatgtatataaaatatgccattaattttattggggaagaaattccatccaaaaatgttgcctacagctatgagttaagagtgtctgtacagtgtgtagcttttattttctaaaatcacagatagggcatgtatatgacttataaatatataaatacgattttgtattaaaagttttgtagtttatggcaaaatctggtcctgtggtaggctaaataagtactgtccctgtgaaaggaatgtttgtggctcatgtcagtgtgtgaatgcatagacaatttgaagtttttgatatatttgtgatatttatcttgagcactgcaatctcaccccccccccgcccaccaagggaattcaatgggaatgtttattgtgactttgtcctctgttgcattttaaagttatttcctgtaatttattttcagtacataattaaaaatttgttgtatatataaaatgaaacttgtgattcttttttaaggaatttttcaagtatgtattccacttcataaaccacatttgtttatagtgaaaagagcatgagcaggaaacaccccagttgagagctctaaggcattgtacctcaaaactaagcttgtaaaaagttacttttctgtgtctgtctctataagggaaaacctatgattagcctagttgtagatggggattgttaatttctttctctctctttttttttttttggtggtatatgtaaggctagcattttttcagtacttttgtggtcttctttgtgaacaccgattaaagtacctagttttgtttgtttcttttttgagacggagtctctctctgtcacccaggctgg

SEQ ID NO: 11826 - DNA, 1799 bp, Homo sapiens
cagcacgttgggaggctgaagcgggaggatcacgaggtcaggagatcgagaccatcctggctaacacagtgaaaccctgtctctactaaaaatacaaaaaatcagctgggcatggtggcgggcgcctatagtcccagctactcgggagaatggtgtgaacccgggaggcggagcttgcagtgagccgagattgcgccactgcactccagcctgggtgacagagcgggactccatctcaaaaataaatagcttctctcgccaggcatcctcgtggaagtgacatcgtctttaaaccctgcgtggcaatccctgacgcaccgccgtgatgcccagggaagacagggcgacctggaagtccaactacttccttaagatcatccaactattggatgattatccaaaatgtttcatcgtgggagcagacaatgtgggctccaagcagatgcagcagatccgcatgtcccttcgcgggaaggtcgtggtgctgatgggcaagaacaccatgatgcgcaaggccatccgagggcacctggaaaacaacccagctctggagaaactgctgcctcatatctgggggaatgtgggctttgtgttcaccaaggaggacctcactgagatcagggacatgttgctggccaataaggtgccagctgctgcccgtgctggtgccattgccccatgtgaagtcactgtgccagcccagaacactggtctcgggcccgagaagacctcctttttccaggctttaggtatcaccactaaaatctccaggggcaccattgaaatcctgagtgatgtgcagctgatcaagactggagacaaagtgggagccagcgaagccacgctgctgaacatgctcaacatctcccccttctcctttgggctggtcatccagcaggtattcgacaatggcagcatctacaaccctgaagtgcttgataaaacagaggaaactctgcattctcgcttcctggagggtgtccgcaatgttgccagtgtctgtctgcagactggctacccaactgttgcatcagtaccccattctatcatcaacgggtacaaacgagtcctggccttgtctgtggagacggattacaccttcccacttgctgaaaatgtcaaggccttcttggctgatccatctgcctttgtggctgctgcccctgtggctgctgacaccacagctgctcctgctgctgctgcagccccagctaaggttgaagccaaggaagagtcggaggagtcggacgaggatatgggatttggtctctttgactaatcaccaaaaagcaaccaacttagccagctttatttgcaaaacaaggaaataaaggcttacttctttaaaaaataaataaataaataaataaataaataataaataaataaataaataaataaatagataaataaataaaaagttttctactcacactgaagtgacgaagtccagagaaggtggagagctgtgagcagccagagcgagggctgcaggatggtcagcggcagcctctgctttcctccactccacagacactactcctgtctcttaacttgcccatgggctggagctgtgctaattttgctcttaaatattattagaggtcttaacatcttcctcggggatcccactgaaaagtaataacatcagaacacattattacagtttcagatacatcttaaaatatatactgtatctaaaattttacattttggatgaataaacactctcattaatcaaataaaccaattaataagaactaatatatatttcttttttctttttctttttctttttc

SEQ ID NO: 11827 - DNA, 1844 bp, Homo sapiens
gtctcactctgtcacccaggctagagtgcacaatcttggcttgctgcaacctccacctcccaggttcatgcagttctcctgcctcagcctcctgagtagctgggactacaggcgtgcaccaccacacccagctaatttttgtatttttagtagaggcggggtttcacttcattagccaggctggtctcgaactcctgacttcaggtgagccaccgcatctggccaattttacttctttatattcctgctttatattcaccatatttcttatatttagtataaaaaggtgaagtaatttactctgatacttcaaggtgatcttgaaagtttgatgaagtgaaatattaactgttttttactttttacagatggttccaatccctatacattgaagctttgcttttctacatcatcccatttataagaagagaagagcatgttagaatttatgttcacctttattacaatttcaaagctacacttcattaaaaaaaaatctaaaatggttgatctcatgttgccttgcttactttaagatcctgttctgtaataaacatattttgccttgagtaaatttgttgtaagcttaaatattgaattgttttcattttaagatagaatatcataatgtagactatctacagcttcattgtagattatacagatatatgatttctaaccttattactggaatttttcttccacagtaaaaatatatttgcattcttaatgctaattatctgcaagtattttttcattgtgtaagagattaatgcaggtgaaagtattgcattttaatatagaattcctattatatgtttagatgtttaagtatgttgcagttactcatattaaacataacttgtatatttattattttaatgaagtttgagaataacgttacatatgttgaattttaagtactacagatttaactgattttatatttctgaaaggctaacagacatggatacacgtgtacagtatgcattcaaacttatttaaattggtgtatttttttttaagtcactgtccatttgtattgacatgcctctgtttctagtccagtttggagattttataaagttataacaatgagttaatgtgttcattttcatttgttgcatgtgacttaaatacagctagtatttggcattgagattttaatagaggttataattaacagttcctcttatagataataatctgggatccatgggtgggcttcagagaatctgtgtaccccctaaaattgtatgtagaattttggatatttacatttttattttttaactcttggatccatcagtaatatgtatttttctatatggtacaagatttaaggatctaattttatttttattccaaacagatagctatttgtctcaataccatttattaaacattctttctcccactggatctgttttttttttctttttaagataatagattttatacataggcaagtaagatttaaggaccaaacatggtattaagagactatagcacgattgttaccaagttcacagcttttttacaatagaaaaactgatgtggccattttgttttcatctttaaaagaagggagaatatgtgtcatctacctagaataactgatatcagtagttgacaatatcagttttgtaatcctgacacttttaaacaaatttgtaaatgaaagttccatttagatcttttgtaaagactttattttaaattttaatataaaaaatccttttagaaataaggcaggcatttacaattttagagctgtttaataggaagtttagatggaaactaaacacacattaacatttatttcccctcattttgatggcagt

SEQ ID NO: 11828 - DNA, 1195 bp, Homo sapiens
aattatctatcttaaatgataaattttaaaaaatatttaaaaatctttgtcctttttattagagacattaatgtcaacttgagaatattttaatgtaactgagggcacatctgaaacaacagctgtaatattgttattttagacaagagttagggtcgtatcactcagattttgcttagcgatacctgctttttagttttatgatgataaaacgtgttaaaatgggcacgtttttatgttaaagttttctaatatgagaatatatttaatagattttctttctaattgatgtctaaactacaagagtgattgattataacccaaactaaatcctctatttaaatagctctatgtatgcctttttttggttaagatttatgcaagcaaaatatattagcattctgagactacttgctgctttttatctaacaaagtacttttgtatgtcttttctttacaatctttagcgtgtctaaacaacattcagttgttccaagtcaaatatttgagctggaggatggtaccagcagctacaaagattttgcaatgagcaaaaataatcgctttacaagtgctggccaagcatctaagaatataatccagccaccctcctgtgttttgcattattataatgttccattgtgtgtcacagaagagaccttcacaaaggtaggcactgaaatacaaatgtgtatagaatgttgctatttcctattttaaaatctgttttagcttcattttgaagtcgttttgctcattcttttgcttttgatgttattactattttatttacttggtactggatagtttattctttgaccattgtacttttctggcctccattcctcattgggcttcgttgatttgtggctcaatccttttgagagttggaattagaatgaggtcatcttaatcctgcattcagaaagttatttaaagacatatcgtgtctttaaatctcacccataacaaaattttctctatccatattgtttcccctaacttagaaaatgctaagtaggaactgtaagaaatgcttcagataagaaatgattttgtggaactctactccctaccttaagtactagataaatcctggtcaactctgagaatatatattttagttaacaaatctgtggttttattgtacagcactaagttacttaatatagtttatagaattttactgttttta

SEQ ID NO: 11829 - DNA, 1581 bp, Homo sapiens
aagatggtacccttgtataaatttaagttgtcatgtgtttaatgaattaatactgctaagtgagtatcctcaagttatagtgggactagataaccaattaaacaagaacaaaagatgatacaaatctactacgttacaggaaagataagtatattatcttcatgttgaggaaaaatttttgattggaactttttgttcatttgtactagttgagattttgattttatggaggttaatgagtatcaaatatacttccagttgtagcatgccctatgtatctgctaaattttctttctgagattttcttgaagttgaaatattattaaataacatctttgtacttcttactgagatagaatgctcccttttaagaaattaaaaattttaaaacaaacatttattttattctcatatccttttgctaacttgtgaattgcgatttggtttgggattaaaaaaaatgtttactttttaagcaggtttgaatttactgaaagatgcaattcaacttagacttaaattttttttgttttttttgagatggagtctcactctgtcgcccaggctggagtgcagtggcgcgatcttggctcactgcagcctccacctcccggattcaagccgttcttctgcctcagcctccagagtagctgggattacagacacgtgccaccatgcctggctaatttttctatttttagtagagatggggtttcaccatgttggccaggctggtctcgaactcctgacctcaaatgaccctcccactttgacctcccaaagtgcagggattacaggcgtgagccaccgcgttcggccttagacttaaaatttttttaactagaaattattttctcttgctaggaggcaggtggaagtcatcataaagtttctgtttcacccgtcgtccatgttcgaggactctgtgaatctgtggtggaagcagacctcgtggaagcgctggaaaaatttgggacaatatggtaaggatgatagggacttcatgtagattgaaaactgtggtagaataatccttgcttgcttgttacaagccttgatgtttagcatagtaaatattgtttgtatatataaacaaagtagtatctattgtttgcctatgactgtatttctttggaacgttttaagcctactatttttaaccttcctgggtgatgcatgagtgtatttttgtggagctatgatcacttctcactccccagcaaagttgtataaagaaattatgtgtgcttttcatctgattttcaaatgagtccgtgagtcctgttcaaacactctttaaaccattgagttgattacatgcttcatcttcagagtttcaagtagtgatgcttaaatattgatttttttgttgttcttgattttggaatatttaggaattaattggcaactaaaagtaagcagattaagggtaggcattatttgtttaggtgcatattgctgtgagttcttttgttcatgtgcatattgctgagttctttttattttttgagacagggtctctctctgttgcccaagctggagtgtagtggcacattgatggctcactggagcctccacctc

SEQ ID NO: 11830 - DNA, 2112 bp, Homo sapiens
tcaattgacactaattggatccaaacctaatgtttttctttttagtcgttccccatcaggaagtcctcgcagaagtgcaagtcctgaaagaatggactgaagctctcaagttcaccctttagggaaaagttattttgtttacattattataagggatttgtgatgtctgtaaagtgtaacctaggaaagataattcaaccatctaatcaaaatggatctggattactatgtaaattcacagcagtaagataatataaattttgttgaatgtattaacatcatatggtctgaaaatgtgggtttttatttggcacatttaaataaaatgtttctaactagatttttgatttgtgttcaatattaacacttcttaatttgatatatttgagagtcagacattataattgttaaccttattcatacatacctacattcagaattgaaaggtgttggttaagtcttgaacatcactattctatgcataaaacttggccaggatcttaagggactttgaaaattccatcttacccttgtagctctgggtaagatgacctgagtcccttatgatacagcctgaatgcatcatgacagatccttaagttagctaatccgtttgaagttggtgttagtaggtattgtatgatcagtggtgaagcaagtaggaccactgatgtgtctaaatgagcatgacaggaactaaacgaaactgattaaatgtatgagaaatagaaacatttctggatgatctttatactaattgcagctttcaggctactaggtggcatagtgttaattaggactccccaagatatggggagttctactctcaatggtcttgtttctttgctttctacattagttaaccagttttataccaaaaaatgcatgtttgaggaattgtctgaaattgggacaaaacaccttcatgtaaaccagctttgcaaaattttccagcccagatactcttcatctattcaaatggattgtcttattctgagcaaagacctgttgttaatcttcaagctaggttttgcagttcccaaccacaacattcttctattttgccaggctggtgcaaagtaattaaagatgtcaatcagaaatgtcaatgagactaaagtggttttgtaaatctcagctatatttagcaacactccatgtagctaatattttttggtagcatctggtagaccttagaatgttacatagccagtaggttctttattcaaattttaagtatcttaagaatagtagggcagtaacagttacttttgagagttttctggtcaagcttttaccaggcattctctagccttggtacaaaaaaaaaaaaacctgctggttgcgcagatacctaggcttgtccattttatgcatttcagcaaagtcattggatactattgcaacttgggaatactggtctgcatcaagtttattcggtagtttgaccgctagtatgttggaagttatttggattgtttttggaattttgactggctgaattatggttggtataaagttatgtgtataactggcaggcttatttatctgttgcacttggttagctttaattgttctgtattatttaaagataagtttactcaacaataaatctgcagagattgaacaaataatcctgatacttaatttttggaagtgggagctctcagccaaaagtaggaggcattaatcctgtagctttaggatgggcagctagtagcgtcctagaaatgagtatagaaaggataaaaaggtgtggaggaggggtaggggcaaaaatggttttaaacaaattccagccttgtggggaaaagggctgtttgggccaatacctcttaggtcatgtgcaacttggcacccgttactgatagatgcatttcaaaataagctttggtgcatccccccacttgttttctgtgattgggattgccaaattgattgtcactgattggaagtgctgctccagactcattccttctaaactagcctagcactgatgagtaatcagtcagtttttatttttaatttttaaaatttttttgcttggtgcggtggctcgcgcctgtaatcccccagctacttgggagtctgaggcgggagaatcacttgaac

SEQ ID NO: 11831 - DNA, 1094 bp, Homo sapiens
ggaggacgagagccggcgcagccctgctctcctggcccggcccctaccgaggccctcccgccgccgacgccgctgccgctgcgggcccgcgcgctcccggtgcgcccggggctgccgggactcatgggtggggccgggccaggttccgccccacgcctcggtgtatcctaccacgcgtttctgcttgtgttcgggagggtcaccccgcattatttagaacgttaagaattttgtcaaaagtctagtttctcagggatttgcggactttcaccagttttacgactaagttttgtcttggatagagggcattaaatgtgctttacccaatcttgaggatggcccgttttaaggcaaataagtaattgaaacttgggccagattttgcgtaacgtgcattcttctatttgcgtttttaaacagaaaccaaggtgtatgttggtaacctgggaactggcgctggcaaaggagagttagaaagggctttcagttattatggtcctttaagaactgtatggattgcgagaaatcctccaggatttgcctttgtggaattcgaagatcctagagatgcagaagatgcagtacgaggactggatggaaagtaagtaagatgttatgaatcttctgttcattaaaatatactgtggctagataatgaacttagtgctaaatttggattctgaagtctggaagagaccttaaatagctggtcatagtgttaaatgctaaaggcacacgaaggttaaagaagatagcggagatggagttagggcttggtaaagaccgccaaagtttgttgggggggaaggagtggttggaaagagtgagtggttggaaagagttctttttaaatctataagtcctgaatatatttttaactttagaattttgttaatttgcttttattagggtgatttgtggctcccgagtgagggttgaactatcgacaggcatgcctcggagatcacgttttgatagaccacctgcccgacgtccctttgatccaaatgatagatgctatgagtgtggcgaaaagggacattatgcttatgattgtcatcgttacagccggcgaagaagaagcaggtatttat

SEQ ID NO: 11832 - DNA, 1171 bp, Homo sapiens
tgggtttcaccatgttggccaggctggtctcgaactcctgacctcaaatgatccacctacctcggcctcccaaagtgctaggattacagacgtgagccactgcgcgtggcctctctgcaagattctgacttcaattcttttggatgtatacttagaagtggggttgctggatcatatggtagttctatttttagttttttgaggaatctctatcctgtttttcatagtggctgcatcattttacattcccaccaacaacgtgcagggttccaagttctccacatccttgccaacacttattatcttttgtcatgaactctgtttcataatttgatcccactgttatggaaagaagcattttgaaagtttatagagagaattttgttctgaatatgaataagtttcagaatctgaaagtgtttttgtggtttattggtagaagtagaaaacatgagattttaaaattttttatttaaacttgtaaattattatcactcacaaaagaaattattcctctgtgtcatcccaccagaaataaaattgacaaattattattttgtttccttttcagaattaaaattttagagatgtttagtgctcataatctccagtctgtgttctctcggctcattgaacctccacacaccgattctcttcgtgcctcaaaaatacgattacgagacttaggagcattaactccagatgaaagattgacccctcttgggtatcatttggcctctctgcccgtggatgtgagaattggcaaactaatgttgtttgggtctatcttccgctgtttggatcctgctctcaccattgctgccagtttggcttttaagtctccgtttgtaagtaaacaacattcatctaaactggagtctctaagaggaccataggtctctaaggggaccatgggggaaatcaagggcatgtgagccccctaaaaatttgcttgtatgttagctgtgaatttttagggcacatctgcatgggagggagaaggtcaaaaataaatttctgaaaagacaaaaacaaataaaacaaacaaaaggattttttagggagcaatgtcatccaatcctcaaagagatccaccctccaattaaagactgagaactagagatataacttattaaaagtaatccaggccaagcgcggtggcttatgcctg

SEQ ID NO: 11833 - DNA, 1196 bp, Homo sapiens
tccacgacaaagcacttctcaacatatccctaaactccctccaaaaacttacaaaagggagcacacacacccatccatgcacagagatggaccaccactgttggagaatgcccattcttcctgagttcctctgtactgggatgtatattttcctagccccaaatccattgctggcaatggatgcactgaatgtgccagcactgaggagttaaaatgagaactccaaacactaacgactcttcttcaagatgcagtataagacaatgaattttaacctagatgtaattatacaatggaaatggtattccagtttagaatatggaaagaccgacctagaggaattggacaactgattgcacctgaaaatcataaagggactttttctggccaataggcaggagtcctctttttgtgaagtgatcttttgtgaagtgatcattaaagggatggaaaacacagtctagtgtccagcaggcccacatgacagtttttgtaattcaaattatgcacttttaaaaaaaaaaacttaaacagggatcttaatatcttcctttgttttcctttgctttactcttctactttagaatattttcttaaaaatcactcaaaggactgtgaggaaaggctgtggtacctgaccttgttgaaatcaaggcccggcactgtactacaggcctgtttacagattattacggtgaactgaatgggtaccgaggcttcaccaaagaggtacttttttgttgttgttgttgttttaggaataattgtaccaattttaagagcattccccccacctgtccccacacacccaaacaaaatgtggtggtgttgccttcaaaaaagagaagttttgtgtcattaacatgacagaagaactttttaaaaaaaaataactgtcaactattctatttgcatttaggagactgttcatctatgctagattgtcattttccctccttctcccacagaagtttactggtagtccatgtcatggctcgtagctatccctctaaccataccatggaaatgcaggcacccaatgtgaaaaggagcacttgctgggcatcactgacaccgctcatgttttacacatagttgagtaatcagcatatctagaattatcttgcattgcctaaatcatatgtatatagtgaatgttatataatatacctggcaggtctgttttaatttaattg

SEQ ID NO: 11834 - DNA, 1954 bp, Homo sapiens
ggcgggtcatgaaaacagttactgagaattgttgtgctttgacagttaactctagaaagaaagaacactaccactgcaacattaatggatgcttgaagctgtacaaaagctgcagtaacctgtcttcagttactttgtaatttattgtggcatgagataagatggggaaaattttgttttaagtggtatggatatatttagcatattgaaccacacaagtgcttaattcattgttatgtaatctttgtacatataggcagtattttttctgtgaaacttcatattgctgaagacatacactaagaatttatgtagataatgtacttttatgagatgtacaagtaagtgtcttatctgtacagatgtaaatgttgatgaaaatgcaattggggttaatattttaagaattctttagtatattcttgggtgtggctatattacaaaatgggatgctggcaatgaaacaatacatttaacactattgtatttttattatatgtaatttagtaatatgaatataaatcttgtaacttttaaaattgtaatggaggctgtaatcattttataatctttttaattttaatgcaagtacactggtgtttatatttgcacaaagtattgatatgtgatgtattaagtcacaaaagtaagctgtgacattgtctataagcatttggctccacaaatgtatttggattgttttctatgtgaagcaaaccaattataattaaccacatgttgtagtaactggtctttttatatttaagcagaatcctgtaagattgcttgtctttgcttaaaaacaatacctttgaacatttttgaatcacagaatagcggtaccatgatagaatactgcaattgtggtcagaattacagtatgcacaaagaattaattagcattattaaagagtcctcactaaacatttcatatgatcacactgaagaactgtaacattccatagagtgaagtggttcaaatttctcttggaatttttacttttgttggccttattttatgatccttttcatatttcttttgacttagagtattaatacatggccaaaataatttagttactacctcatacaaacaatataatggttactacacatcacaggaacttagttttggtttaagtcatttttgattgcttttttccaatggaatatgtatataccaggttttagcaaaatgcacacttttggctctttttggtatatgttctttatattttaatgtgagtatatacactaagaacaaactaaattgtgatttatgatcttcatttattttaatgataatggttttaaaatatgttcctgattgtacatattgtaaaataaacatgttttttaacatgctgttgtatagtagcttgtcatctggtttaatctgtatatagtaacactaaaatatattaagaggggaaagctttatttgttttgtagttaaattcttaagtattgaattttggtccctcaaatcatgatttttatttgatatggggtttcagtttcatgaagcattaatatttccacacaggagaaaagggcatcttttgcagaaacttcgacttcctgataagaaaagtcaaacattcatagttttctggttagaggcaggggtccacaaactacagtcctcagaccaatccagcctactgcctgttcttgtaaataaagttttaatggagcacaacaccacgtattcactcacatgctgtctatgctgctttggtgctacaatatttgagttgagtggcttctgaaacactatatggtctgaaaagcctaaaattcttactttgctgaccctttacagaaaaaatgtgctagtgcctgggttagagaaagtaaggaagcattgggaaatgcagttctggaggtaaggaaggggaagattaagagggaagaactggattggggatcaagagaggcaccatttccatat

SEQ ID NO: 11835 - DNA, 1155 bp, Homo sapiens
ttgcatatattattcagaaaaattccaagaaaaacactcaaataataaaatacttaaatcaggactatgaactcgtgaaatccttctttttaagaatgtatagcaatacagatttatttgggggtctgggacttatcttttaaaaataatatgtattatatatattaatgtatcatggtgtgtcatatactactattgtgctaaatattttattttgtactattaggatctgcaactggaatatggacaaggacaccaaggtggttactttttaggtgcaaacaagtaagtaaagttcttttaaaacttaatttaaattcaagaattattaagttgcctttaatattatattttaatatttaaggtagaaaattgtattaggctggtagatatattttacaatatgcatttcacctttttccattgcttccttgctcattatttagttaatagttgtcctaatgggaagcatcaacataatttttttatatcaagctacattgctgatcttgtatgttagagaaaaccacatgtattgccactgaaggcagatacatgttttagcactttatttctaaaactgatctgtttatttcttataaaacttgctttggtacatctctaagatgggttggtcactaaaaacagctggaattattcatacaacttagaaatcttaactttttagctataaggtttttttaaagtaagatagcagttaaaatgtgtgtctgaattcttaaaagttaccaatctatgcagtaaataaattcaacagttatttaatgcctcttctacaccaggcactgtctaattgatagaggcacagaggtttaaaaggcagcttacaaacattaacaatttaaattgttcatttgccaggtatgatgggagacagaattttgctattccccttagagtctcattttctaagtttgtggataaattatgataaaaactaatttataagggaatataatttaaattaccaaaatcttccagcagtgcatatattattttaatagtcagaacaagttaaaattccttttttttttttttttttgaggcagagtgtcactctgttgcccaggctgcagtgcagtggcgtgaacttggcccacttcaacctccgcctcccgggttcaagtgattctc

SEQ ID NO: 11836 - DNA, 1597 bp, Homo sapiens
ttagctatccttcctagagatagctagcaaggacagctaatcaactctttcaacatttcaagattaaaggatgaggataccacctgggttttaatacggagatggctcaagccctttccactgccatgtaaaagatttttagatcacatgtgttgatcattacagtgatgagatggtattaaaatgcttgacaaattggtctccatggcagtgcttgtagtcccagctactcagagaggctgaggcaggaggataaagtgagcccaggagttcgagtccagcctgggcagcaaagcgagctcctgtctctaaaacaaaatacagacttgacaaacacctactgaaggcaatatgatcattacttacagaaaggacaggatcagagctaggagagtgaaggactagatttatgaagcttcagtcccttctttacgggcactgaagagaaacagttcaagtcctccagttgtcccataggctttgtcatataagaatggataatttgctacaagctcgaaatggcaaaaccaattacctaatgttgctactgtactgactaatcatcttactcatgaaactatctacaccttgcagagaactttaagaaaaccactgggcatggtgggtcgtgcctataatctcagaattttggaagaccaaggtgggggcatcccttgaagccaggagtttgagaccagcctaggcaacacagcaagatactgtctctacataaaacaaaaaataagaaaagttagccaggcatggtggctatgcctgtagtcctagctacttgggaggctgaggcaggaggatccttgcagtgagcactccagcctgggtgatggagcgagaccctgtctcaagaaagaaagaaagaagggaagaaaggaagaaaggaaggaaggaaggaagaaaggaagaaaggaaggaaggaagaaggaaggaaggaagaaaaagaaagaaagaaagaaagaaagaaagaaagaaagaaagaaagaaagaaagaaagaaaaaccttgcagtatacattttcataagcccaaaagttacttccttccatttattgcaaggctataagaacccaaatgtctgcctgttatgattttaaccagcacttttctacaagtgagtatgttcaagaacccctaaaaagactgtaataatcagatatcaagcacctatatgaggtagcaggaggaagaaagaggcagtacaaacaacaatccacacataatccagtaatgcaagctctgaaattccaacacttcatttcaactgcttcccccaaaattccataccatgttcttgcttttggataaagtcagtgacaagaaacgagatggtcatacagcagcagcaaaaatataatcaggaaatataatgactttgtaatatccctgtgcgaaagaaataaacctgagtagtgagaggaacatgggtcttggattaggatatagaacaatgtttaaaccctggttggccaggtataagctatgtaataaccttgggcaattcacctaattcctctgagtcttaatttcctcatttcttatatgtggtaattgtgcctaattgagaagatgcacaatagaaattc

SEQ ID NO: 11837 - DNA, 1202 bp, Homo sapiens
tgatgttgtaaaaataggggaaatttgaccgtggggacaattgtcaccattttaatgatttgtgaagtttattaacttattttaaattaagatagctataaaagtctttatagaagttaatatgtgtcaacatgatgagatgttatggagttttttgttttgaaattttctttcttttttttttttttttttgagacagactcttgctctgttgcccagactagagtgcagtggtgcaatctcagctcactgcaccctccacctccggggttcacatgattcttgtgcctcagcctcccaaatagctgggattacaggagcgcatcatcatgcctggctaattttttgtggtgttagtagagacggggtttcaccatgttggccatgctggtctccaactcctgacctcaggtgatctgcctctcttggcccctcaaagttctggaagtacaggcacgagccacttcacctagccagaatttttctcatcttttgtaagtcttatgtgggatggtttttctaatcagaaattacttctcaagcagtttacttaaaaatattccatattttattttattttatagatgatagtatttctgctgcaagtacttctgatgttcaagatcgcctgtcagctcttgagtcacgagttcagcaacaagaagatgaaatcactgtgctaaaggcggctttggctgatgttttgaggcgtcttgcaatctctgaagatcatgtggcctcagtgaaaaaatcagtctcaagtaaaggtaattgtgttgtaaagttaaaaagagtcttgctttttgcaatattttctttgaaagttgaagctggaaatataaaactagtttcttatgtggattacttgtgattatagtttgttttccatttcgtttttttaattcccaaaaagttctgaaagtttattctttattatttaaaataaagaatttttgtgtaatccactgattatactcacaggttttttatgttacagtatttgtgtgaagttagtatcttccaactagatgataagtttactcagggcaggaactgaatcatcgttttgtgtctctcatttcatattgaacataggtggtaggcactcatgtgttcttaaaattctgttgtcaatacagaaacataattaaaatcatcatagtttaaatagctttattctgaaccctctgtggttgttagca

SEQ ID NO: 11838 - DNA, 1141 bp, Homo sapiens
aatgaggaaactaagatcttaacatactgaaagagtcaggttacgctagggataatggcaggatatgagttttccttttttttggtggaggggtgggggtgggcggcaacagggtctctgtggcccaggctggagtgcagtggcacgatcactgctcactgtagccttgacctgacctcctgggctcaagtgattctcccacctcagactcccaagtagctggaactacaggcacaggccaccatgcctggctaattttttttattttctgtcgagatggggtctcactattgcccgcactactctcaaactcctggactgaagtgatcctcccaccttggcctcctgaagggctaggattacacgtgtgagcactctgcccgtccaggacatgagttttctagttctagttcagtcttcttcattgtaccttcctaattccttaagtatccatgaaaaatctgttaacaacttgaaaactgtgtttatttaaaaccttgactctttttctgttaagatatggttatcgaggaaaggactgtagagctaatgtttaccttcttccgaccgggaaaatagtttatttcattgcatcagtagtagtactatttaattatgaggagagaactcagcgacactacctgggccatacagactgtgtgaaatggttggtatcatttaacattggttcatttttgttctttcaggccctcattttgtattttttaaatttgggttttattgaaagtgatttcttgtggaaagctcagaatgtaaaaatattatgggtcatctgttgaatatattttaaaaagaaaaaaaggactttcggcctccaaaatggtggtgtggtatcagcagcaacaaaacacatcctccataaatcatgattggaacctcttctgctttctcatgtcgtacagtccttctcttctctggtctgtagtgtgaaacatatatgggacagactggacattttcaggtttctgaaagtgattattggttactcgatatttattgaggatttgtcctatgtagataaattttatacttgaagctttattcttttgggaagaaagaaatctagctgaataaggatcataagtatgccgtaggatgtcatactacaaatgtgagaact

SEQ ID NO: 11839 - DNA, 1156 bp, Homo sapiens
aataaaacatgtaatttcattccatctttaaagctttagaaatctagaggaaaaattcagtaggaatacgactgatgtaactgaagggcttatgttaagttttttggtcttaattgtgtttgtaggattattttagaaaattcaatagcatttataattgctataattgcattataactctttacagtacaagggttgatctctgtgtagatcaagctgtacgttgtaagagaagaatgtaaaatgcattgaagctgggtttatatgagccagaaatggacttctccctctgacaggcatttaaaaagattcaaagtgatagaatggctttaaaaagtctgtgtaatatttgccatactcttaaataacatcacattactctccaactcctctcttaacagttttgttttgagtaagcttcaagcttttagcttgttgggcagaaagatgatgtgatgtttaacttaacattttgaaagaagtagatttgattgtacttaaaaggaatataagttgtcagaaaacctcaaactttaaaaaacataaatgaagatatagattgacttccagttattcagagtaatttaacattgaaacatagggaagttgcatgaaaatgaaatatatcaattttgattcttcatagtaaggtttaccagatgaagtcttgtggttttcctcctactggcgatttctcgatctcctttccaggactttaaatgttggtgttcttcagagttttattccacatgctccactgatactatatgctgctcccatggcctcattttctatctgctgagtcccgtatcagttatctccagcccagatctctaacaggtttaactcatatttctagttgcatcctagacatctttatttgaatgtcctctaccacaaatgaaaatcaccatgttcaaatctgtacataatcatctttcctagcccccaaccaccagtttcatcccttagtgattgactccgcatttcacctagctacctaagctagaaacttggacatcattcatggctctttttacctcacttctcacatccaggtagtcaggaagttctctaaacaccgtgtcccaaatatctgcattatagcactttctagtacaagcgactgcaaaacaattgaaattaacttaatctg

SEQ ID NO: 11840 - DNA, 1392 bp, Homo sapiens
tgataaagttcaggtaacaggatgggcagtgatggagaatcactgttgattgagattttggtttccatgtgatttgttttcttcaatagtcttattttcagtctctcaaatacagccaacttaaagttttagtttggtgtttattgaaaattaaccaaacttaatactaggagaagactgaatcattaatgatgtctcacaaattactgtgtacctaagtggtgtgatgtaaatactggaaacaaaaacagcagttgcattgattttgaaaacaaacccccttgttatctgaacatgttttcttcaggaacaaccagaggtatcacaaacactgttactcatctactggctcagactgtactacttttttttttttttttcctgaaaaagaaaccagaaaaaaatgtactcttactgagataccctctcaccccaaatgtgtaatggaaaatttttaattaagaaaaacttcagttttgccaagtgcaatggtgttgccttctttaaaaaatgccgttttcttacactaccagtggatgtccagacatgctcttagtctactagagaggtgctgccttttctaagtcataatgaggaacagtcccttaatttcttgtgtgcaactctgttttatcctagaactaagagagcattggtttgttaaagagctttcaatgtatattaaaaccttcaatactcagaaatgatggattcctccaaggagtcctttactagcctaaacattctcaaatgtttgagattcaagtgaatggaaggaaaaccacatgcctttaaaactaaactgtaataattacctggctaatttcagctaagccttcatcataatttgttccctcagtaataggagaaatataaatacagtaagtttagattattgaattggtgcttgaaatttattggttttgttgtaattttatacagattatatgagggataagatactcatcaaattgcaaattcttttttttacagaagtgtgggtaacagtcacagcagttttttttaccaacagcatacttaacagacttgctgtgtagcagtttttttctggtggagttgctgtaagtcttgtaagtctaatgtggctatcctactcttttgggcaatgcatgtattatgcattggaaaggtattttttttaagttctgttggctagctatggttttcagtacatttcctactttaagagtaattactgacaaatatgtatttcctatatgtttatactttgattataaaaaagtattttgttttgattttttaacttgctgcattgttttgatactttctatttttttggtcaaatcatgtttagaaactttggatgagttaagaagtcttaagtatgcaggcgtttacgtgattgtgcca

SEQ ID NO: 11841 - DNA, 1871 bp, Homo sapiens
atgggactacaggtgcataccaccacacctggctaattttagttattctgtagagacagggttttgccatgttgcccaggctggtcttgaactcctgggctcaagccatctgcctgtctcggcctcccaaagtgctgggattacaggtgtgagccaccgcgcccagcctctcctgcctgcacttcttttagctactgattacctttgccttttaaaaaatgcaccaatgctccagttaagcaatatgtgataaatgtcttagacatttggaatcttttgcatgcatgcttcctgaggcagcattttggagaatgactttggatttacaagctttagctacatttataggaacttctactagcattccatggattagtgcttttcccactgtcatgtgttgatgaattacttaccgagtagacaaatttgttattttttaagagtaaaattgtaaaatatttttcttctcaaccatgcccttgttaattcttgctttcaagaaagctgatggtgtgcccgtctacctgaaacgaggcctgcctgaccaaatgctttaccggaccaccatggcgctgactgtgggagggaccatctactgcctgatcgccctctacatggcttcgcagcccaaaaacaaatgagttaggctgcagaggactggtttgttttttggcataaaccctttgaagttcctttttcattgttaaattaaaatttttttttttacttggatggcttaacatttttgcaagaaaaataggaagatatgaagatgatgttttggtttgtttatgaaatgcatatggcttgtcagagctcattcgacagttaaagccattgtttaaagaaatggtgctttgctctgtgtttgtgctcctgatttccctggaggttctggatgaaggctgaacacaggcttgttaatgtcagtctgtgctgaggacctcagggacttgaggttgcatttttgagcatggggtgcaggagcctttctggatttggatgtggctatggaaagaacacagaagccaaggtcatgtgcatgaaatgaggagtttgagttagtcacctcggggattttttccattttgcagtaaaatgttaaattaatgtagcctgcctctatttgttgggcaggtaatttcaaagggttatttgcctcatctcctatctttagtgaaatcttatgtgtaattattccaccgtgggaacagagaatacctgtttagtgttgcactttagactggtgtctgttttgttaatgcagctgtgccacaaattctcctttatcttttaaaaatgttatagctttaaattttgatttattttgactgtggaataaatacatgaatgaaaaattttaagtttgaagttctttgaatgacctttcagagtaatttcagaacaccagcagcatcttaaacctgagtctaatttctttcttgttaattaggcaccagataatctttataaaatggttcttaaaagtctagtaataggagtcttaatggcatattgatgattaccacatggttttttataaaaacctgcctgccccttagtgaaaggtacctgtaactcacagttcatttagacactaatttcctttgctgtcatgattggtagacttcacttaccctatattaattttgaaaaaaggtggaattttattatatatgaaggaatagtttgtatcttaccatagcacagaacagtgacctcttgctcaggataagatgtggtgatttgaaaatactcaatagtagccttgcagtgatatctctctctctctctctctgcaaatctaaattttattctctggtatttcctccaagtttttattttgaaaattttcagactacagaaggact

SEQ ID NO: 11842 - DNA, 1113 bp, Homo sapiens
aatgagattttagtagaaatctgtttcatgttgaatcctcacaggaaggggttgctacagttaatgatatattgggggaaaaatgtaactgagttttacaatttgggcttaaaaagtagtcaaaacttgctttgctgtaatagtcaaactctgcagctgactttttattttttgagccaatttgaataaatgttttactccatgacatgttataacagagcttccctttccttcttttttaccccctgcacaggctattttttttcttgatttcatgataacgacctgtttatagtaaattggcttgtcaattattatatcttatagagtgaaaattctttttatttgatgtttgattctcattcagaaacttgtttttgcctcttcttttacagttttttatttactatccaaatgtgttttttaaaacgttaaaaaaacaaaccaaaacagatacttaattcttccttattgtgtttgtggtttattcagtgctgttgggacattcgccagagccctggattgcagcagttctgtgaggcagcctagtttgcatatgagtgctgctgcagcttcccgagacatcaccttggtaagacatggtttgaaattttgtgggtatttatccttctgttacttgtttaattttaaagccattgtggcaatactgtagaccgggagcttttgggctcttagccttcctgactgctaggttgatttggcttggttacttggttgactgggttatgataacactcgtctgtgagttgagagttttttgtgtctgttcattagaaagaggggctgtttttttttttttctttctttttatatttggagatggagtcttgctctgtcaccaggctggagtgcagtggcatgatctcagctcactgcaacctccgcctcctgggttcaagtgattctcgtgcctcagcctcctgagtagttgggattacaggcacgtgccaccacacccagctaatttttgtatttttggtagagacggggtttcaccatgttggccaggttggtctcaaacttctgaccttgtgatccacccgcctcggccttccgaagtgctgggattacaggcatgagccaccacacccg

SEQ ID NO: 11843 - DNA, 2470 bp, Homo sapiens
tccgggaccgctcgtttagcgagaacggcgatcgcagccagcacctcctgcacctgcagcagcagcagaaggggggcggcggctcccagatcaactccacgcgctacaagaccgagctgtgccggcccttcgaggagagcggcacgtgcaagtacggcgaaaagtgccagttcgcgcatggcttccacgagctgcgcagcctgactcgccatccgaagtacaagaccgagctgtgccgcacctttcataccatcggcttctgcccctatgggccgcgctgccacttcatccacaacgcggacgagcggcggcccgcgccgtcggggggcgcctccggggacctgcgtgcctttggcacgcgcgatgcgttgcacctgggcttcccgcgggagccgcggcccaagttgcaccacagcctcagcttctcgggcttcccgtcgggccaccatcagcccccgggcggcctcgagtcgccgctgctgctcgacagccccacgtcgcgcacgccgccgccgccctcctgctcttcggcctcgtcctgctcctcctccgcctcctcctgttcctcggcctccgcggcctccacgccctcgggcgccccgacatgctgcgcctccgcggcggccgcggctgcggccgctctgctgtacggcaccgggggcgccgaggacctgctggcgccgggggccccgtgcgcggcctgctcgtcggcctcgtgcgccaacaacgccttcgccttcggtccggagctcagcagcctcatcacgccgctcgccatccagacccacaactttgccgccgtggccgccgccgcctactaccgcagtcagcagcagcagcagcagcagggcctggcgccccccgcgcagccgccggcgccgcccagcgcgaccctccccgccggggccgccgcacctccctcgccgcccttcagcttccagctgccgcgccgcctgtccgactcgcccgtgttcgacgcgccccccagccccccggactcgctgtcggaccgcgacagctacctaagcggctccctgagctccggcagcctcagcggctctgagtctcccagcctcgaccctggccgccgcctgccaatcttcagccgcctctccatctccgacgactgaggcaagagggcgccagtgaggaggaagggaaggcggttcagagatgttggaggacacccctcgccatctcgcccttgctgggggcacgggagtggggggggtgacatgggccctaggcagactgcaagcccgaccgagcacttggactcgaactctgtgccgggaggggcccccacccctcctttttcggtttcctcttgtctttttttttttatttttattacgaagtttcattctttttgagcaaaaaagtcgaactttttctgttgaacaaaatattcacaacagggcagttgtgatacgaatagaacaaaaaaaaaaaaaaaacacttaaactttgttaggactccgatgagtttgggacttcaggaaaaatcaacccagcaccagcagctaccaaccaccattccatctcttcacttgaacagcattagttaagtccagatgtgggaacccttctcttggaagaagttcctaattgtgtctcagaccggtgtaaacaaaccagccagccgccaccttgctaaacctataagctttttaaaatccaatatattctgccaagaatatgccttgatagttagccctcagcccataggtgttttttgttttttaacagaattatatatgtctgggggtgaaaaaacccttgcattccaaaggtccatactggttacttggtttcattgccaccacttagtggatgttcagtttagaaccattttgtctgctccctctggaagccttgcgcagagcttactttgtaattgttggagaataactgctgaatttttagctgttttgagttgattcgcaccactgcaccacaactcaatatgaaaactatttaacttatttattatcttgtgaaaagtatacaatgaaaattttgttcatactgtatttatcaagtatgatgaaaagcaatagatatatattcttttattatgttaaattatgattgccattattaatcggcaaaatgtggagtgtatgttcttttcacagtaatatatgccttttgtaacttcacttggttattttattgtaaatgagtacaaaattcttaatttaagagattgtatgtaatatttatttcattaatttctttccttgtttacgtaaattttgaaagattgcatgatttcttgacagaaatcgatcttgatgctgtggaagtagtttgaggaacatcctatgagttttcttagaatgtataaaggttgtagcccatccaacttcaaagaaaaaaatgaccacatactttgcaatcaggctgaaatgtggcatgcttttctaattccaactttataaactagcaaaaaagtgtttgcttattc

SEQ ID NO: 11844 - DNA, 2702 bp, Homo sapiens
gaggcagttaactcttccaagaacagaagcggcatgttgaagaaaatctgggggattgggatgggggtatgtgtggatttttcctccactaaatctgcaggaaacatgttgaacataaattcaaaaattttatcccattcatgcctcccctacttctgtgagtccagtcgtctgtcactccttacagagaaacttttcttcagttcactcattcagggcagcctattttattgctgctactgtaggaagtgaggcgactccgttgcagatttactctgtccccaggtgcaggccacctgcaggcctgaatgagcctttttcatcccccagggcctctaatgccctgccatagccgccctgcattctctgtgaaatgactacagagagttggattttagcacatacacatgatccctcccctctccccttttctggctttatgtaggggctggattagttggcaaacagcccatttggtcagatttgtgaattttgttccattttagcaaagcagaaatatgttccaaatgttggatcctgggagaattcaggatcaactttgcacaaataatttatttttattgtctgcatgtgttaagtcctgcagtgacctacacattccatcctaattattcaaagagccattgagcatttcccctaccccccaaaaagtatgctaatgctaggaaacctgattttgccacccagtgaaagtatatccgtcctcttagctgtgaggaggaacctggggaaaggagagtcagagaaaatgacttattctgtgcctacattgtttacctatcgcttggtggcagtaacaagtgtctcacttaaaatgccattaaacacatttatcagctgggcgcggtgtttcacacctgtaatcccagcatgttgggaggctgaggcgggtggatcacaaggtcaggagttcaagaccagcctggtcaagatggtgaaacccccgtctctacaaaaaatgcaaaaaaaattagctgggcgtggtggtgggcgcctgtaatcccagccactcgggaggctgaggcagagaattgcttgaacccgggaagcggaggttgcagtgagccgagatcgcaccactgcactccagcctgggcgacagagtgagactcgtctcaaacactcaaacacacacacacacacacactctcactctctctctctctctctcacatcctttgcagtgattttaatctagaaaccttaatgattttcttccttttcaagcccagcccagccctcttcctcacacatccagcaggtggcgctcttgcaaacgttttgctgctggtccagtttttcactggctcaccatttttcatttataatttcagaataagtgttacccactaatagttatcttgagaatcatagctttggaagggtagtagcttcatccgcattcatttttcatcctactgatctgaaaaaaacatttcatagtatgtaaatttgctccagattttagggtctgtaaaaaaaaaaaagtactcaggtaaatgatcacttagagtaatttcattgatgtttcacagagtctgaaggggcgggttagaggagagtgagtttacaatcatttcctactgcagaaaagctcatatttcaaatgtaattcatcgctcttcgagagaaaaccatctaacactaaaaatgcagctgtaagccaggcatgatggtgcacacttgtaatcccagctactcaggaggctgaggtgggaggatcgcccaggagttcatgcctgtgaaaggccactgcactccagcctgagtaacacagcaagaccccatcactaaaagaaaggaatttaagaacaaaaaagcagccatactggaagtataggaaaggggctttgtaggaagaggcaggaaagaagttaactcagtgtccaaagttttgtcctaaagagaacaggaaattccctgggtggttttgcaaccactcggccccaaatgtggtttttgtgatcctgaattaattacctagttaggaaactgtgtagcccacacctgatggaaagctgccaacctaacactttttgttctaagacctagctggtgagaagtgagggacttggtaaaataaatgtggtgataaccacagaaaaataataatgaaactggcccaacaaagcccagctcattggaaatggccagcacttctttttttctccatttaaaatgaaataaaagcagctacattagacattttatactagcaggtactctgtacacaagcatgtcccgtaacatgtccacatgttatctccagaatcctaatctgcaaagtgggtgttctcacagctgttgactgggactcaccccagatttggacgttgtttcaaacagatgtttccactggttctgtatctgaaatcttgttactaacctaataggagtgcctagggaagtggctgtttcacagtttggtgagatgtttggggtcatctcaccaaagaacaaaccagaccacagttgcccaggtatgtcaaggggtcagtgtagggtaggtgctaaaagtgaaactggtccctctgaggtcacctgctcttggctgtgagtcctagggtccaggacttgggtgcccccacagctctgcactcatgattctgtggctctctgtccatctggccacagttcagaagccaggctttctccacccttacgcttttgtcaatttggtt

SEQ ID NO: 11845 - DNA, 1198 bp, Homo sapiens
actctaattatgtaaatgataagctttgagaagaggatcctgtacgaaagcccatttccctgttttgctagtagttttttcttatgatgcacatttgggagataagaagtgaacgtagaaaaaaaaaagaaaaaaggaaaactatccccttgattgtggagtctcacttcatatacataattttgtttttgaaatggagtctcactgtgtcacccaggctggagtgcagtggcgtgatcttggctcactgcaacctccgcctcctaggttcaagtgattctcccacctcagcctcccgagtagctggaattacaggcatgcgccaccacatcggctagttttttgtattagtagagatgaggttttactgtattggccaggctggtcttgaactcctgacctcacgtgatccatccgcctcggcctcccaaagtgctgggattacaggcattagtcaccgcacccggccatatacataattatttcatgagaaaaatgtttgaaggaggagtgcttcactacctaaatgtgaaatctttcatgtgtaataattgttgtttcagtgatatgggagaaccaaatcgtcatccaagcatgtttctcttacttttggtgttggagagactctacgcttccccgatggatggtacttcttctgctctcagcatgggaccttttgttcccttcattatgaggtagtgtcatgctgtgtagaaattgtctaggttggcgtgggagttttacgggaatattttatcttcttcttatttcagaaactattttatatatatcatatatattttatatatatatattatttgtttgtttgtttgttttttgagacggagtctcgctctgtcgcctgggttggagtgcagtggcgcgatctcggctcactgcaagctccccctcccaggttcacgccattcttctgcctcagcctccggagtagctggggctacaggcacccgccaccacgcctggataattttttgtatttttagtagagatggggtttcactgtgttagccagaatggtctcgatctcctgaccttgtgatccgcccacctcattctcccaaagtgctgggattacaggcatgagccaccgcgcccggccatattatatatttttttatatatgtaaacctattgtatatattaaaaactattatatatataactattatatatatta

SEQ ID NO: 11846 - DNA, 1240 bp, Homo sapiens
ctctttagtgccttgatcacaagaatttttggagttaaaagggcaaaggatgaacattccaaaacaaataggtaagctccatttaaggctaactttactttttttaaaaaatacaatattgtcctggccaaaaacaaattttgaaattgtgcctactgttatagattcatctagagcataaaactataaaaatactgtaatgaattaacctatgctgccaagttataaacccttgggcaaaaatatcaactgtttaataagtggacctttcaaagcaacaaaaatttagcaaggtagcaaggggtgaaatgtagagcttgtttctccatgcaaaagctagtgttttttttgtttttttttttttaattgcatcttctttaagtagtcctgaaatgtcttaactttacttgtatatattatcctagcttgtataatatctttaattttataggtggaagtttaaatgtttatgatcctctcattagaacatctctcacattacctttgcattaaactcttgtactaagaggagcacctatatgtgttaaccacaagaaataaacagtgctttttacttttggtctttagttttatgtttaacctctaatttgtttttgtctttaaaaaacagcttttttgttatgcctgaaaagaaacctgtggaaccattttgattttgggtagtttttagataaaaatgcacaagatctgtttgtttttaaagaagaaaagctttgaatagttgttttttagcacttaagaggatttaatggtaatctaattgacttgcagttgttaacactagatgtcactgttgctgcacatttaattacttccttaactttatttaggatccagtttggcccagtggtctttctcttgaggatctagagttatattcaaagccctattcccttcttccctaaaaaagtcattatgcttcatatttaagttttaagctaatgtttattgaaatgcatttttgtgtgatggaactaaatcttaggaattaaaaaaatatgaaatcattttgtgatgtactagtgataattctaatgaaacctactatggtatttccgaattatcatttaaattgcttcttgtcaccctgtaacattcaccagatatttaaaaggaaggtaactggctgtaagtataaatcccttgagcatgttcaggcaataccagagagctttttaattttttttttaactgagtattttttaaataaataaaacat

SEQ ID NO: 11847 - DNA, 1134 bp, Homo sapiens
ccagaggatctggttgaaaattttgtggtaggcctcattttgagagagatgaaaatgattactaaaatacagtttaaaatgtgttttctttgaatatgtgtaatccctataaacatagaacataaattatagtaaactataaacttatattctctttgttggaaatcttgagttgtatagtatgaaatatctgtgagaccatgatcaaccttttcctgaatattttgagtgtggatgcaaacccatgtatcaaaatttattttgcagacaagacacatgctttaaacactgcagttgttagaaatgaaatctttagatcttaagacccataataaagaggaaagtaggtgaaaagtatgagacatgttttagtttcacccccactcaatataaggatatttattatttactaacagtgtaaatgtgcatcaatagtttgtacttttaactttgatacctaattccgaatatttgattatatatgccttttaggtgcccaaatgtgagtctgcaaaagctgccagaacagtggctatggagtgttttagaggaaattaaatgcagtgatccttcatctaaactctgtgctacaaggcgcagtgctggaattcctttctacatacaggtatttatctgtaggaccctagctgtttgtttatatttgtcttttgatgatagtgtatcctaacctgtttgacgtgtgagtgagcgtattacacataaaggacatttctgtcttttcagcaccatagcatttgtggctttgttttaatgtggggatggtgtgttcctgtgacaagatctgttcttggaacaaaccctctaaaaggtcaatcttgtaatataaacagagggtggtataaatttctgtctgtgtattaagtaggcagacatcactgtggcacagtcattgctcacttccaggaagtgcacatgttaccccaccaccccactgtatttttttttaaaaatagtcttcctttcatctcaagaccttcaatactctctgtaggcaaccagtgttaacattttcttttcaattctcctataaaacgtccatccataaaataatcatgatcataatagtagctgacatttattagtggttatttcacctcattaactccttccctg

SEQ ID NO: 11848 - DNA, 1107 bp, Homo sapiens
tcagcttaaaagttaattctattcaaaaccttagtcaacaatgaattgtccgttttgttttctttaaaataaataatctggccggccacagtggttcatgcctgtagttaacagctactcgggaggctgatgcagaaggactccttggggcccaagagttggagactgtagtgcacagtgatcacacctgtgaatagccactgtacttaagccgaggcaacatagcaagaccctgtctctacaaaaaattaaaaaattaggtgggtttggtgacatacacttacagtcctagctgctcaggaggctaaggtgggagtattactgtaacctcaaactccttgagcctaggagttcgaggttacagtgagctatgattgtgccactgcactccagcctgggtgataaagcaagaccagaccctgtttttttttttttaaaaaaagtcatatttgttatttgtctaatcttgtgtggagaaagacagcatgtaggaaagccactgggtgacattctggcaaattccatggttctgtcttgaagtgaagcctagtagtttttcaggaggtcctttgcaccacatcttgcattgtcattaacaattttatgtctctaaaaggtaatacgggttattttttaatgggtatggagtttccatttgggaagatgaaaagttctctaaatgcatgatggtgatggttgtacaaaagtatgaatgtacttatgccacttaattgtacatttaaaaagggttacaatgataaatattatgtatattttaccacaataaaaaagaaaaaaaattttaaaagaaggaaaaaaggtaattatttcacctagacctatgtgtgtgagtgttgtcgctttgtgtgattttctgttggagttgaataacatgagctataacagaaaacatactgaggtttgtgaatgtgacataggaaggcagttctagtgtagcagttaaagatggtcaactctggagccagactgcttggcttcatgttctggttccattgctttcttgctgtctgaccttggataagtttcttagcctttcttggcctcagttttccaattgtgaagtagagataatgatcgtacttattt

SEQ ID NO: 11849 - DNA, 1099 bp, Homo sapiens
ggctgacgtcctagcctctgaaaccagcaggctctttgtgttccttttttaatctttactagtgagaaacagccactctaaaatatgcagagaggttcagtgtttacttttagagaagtaatagtctgtagccactgatgtgcttatttctccacctgattttatttcctgatttgctgcctgattccctttctaggtgttagggaaaaagcaaaaatgttagcaggtaaataatgatttgtttatgttaacgataagagaattatgcttacttgaaatgattgacaaaagggcaaatcatattaaataatgattattttagaataggaactttaatttgtgttagaaatgagtttaaaatgtgatttttatttattgaaataaaatgttaattggaaacatgaaaattagcagctgataattatagtagtcattgcataatacagtaatggtctttgttattgtgctttcaggacaagagcaatctttcccatccttagggtcttgtaatagcaggggggctctgggagctttgatggcatgtctgcgaatagctagagctcatggacatcttcagtctgcaactgatacctgggagaacctcgtgtctgatgcaagaataaagcaaggcttaattcatcagcattgccaagtaagtaaagaaaattacctggatttgtacatgcagtagatccctttcatgtagcagttcaatatagaggcccctacattgtatcctgaactgttttagggagttcataaagagaatgagtagaaaccctagtctcccaactaaactttcagtaggccctttcttcaagctactgaaagtttagttgaggatgtaagaaaacttacataaaacaactggaaactcttagaactgacaatacagatacaagcatgccatcatgtgcccttaaatacataaggactcgcttggaaggctcagaagagactgatcagagcaggtggtgcttgattaggaaagtgatagatatgattagaaaagaggaagccttggagcagcatacaaaatggagggacccaaatgagcaaggtctggaggatgattaagaacattgcttatcaggggtgg

SEQ ID NO: 11850 - DNA, 1193 bp, Homo sapiens
tattatttttgagacaaagtctcgctttgtcacccaggctggagtgtagtggcatgagcacagctcattgcagtctcactcctgagctcaagcaatcctcccacctcagcttcccaagtagctgggactgtaggtgtgtgtcaccacacccagctaaatttttaaattttttatagagatggggtttcactatattgcctaggctgatcttgaactgctttctggattattttttacaaggtaaaaagaatcatatacaaatttgagatctgttttggctttacttgtagttttttgttcttgtaaatttaataattgaaatttgtggtcattctgtgtatttaatatttttaaagtctaaattgttataaaatgaaatttcttttactaatcagtttacaataatggctcatggctcatttttcttcaggattaaagagccaacgctggaaatgtttctgtctagaatcttagcatcctggactaattcagccatacaagtccttgaatcaagttccccgagcctaacggacagcctgaatgggaattcaagtatagttgggagacttttggaatatgtctatacccattgggaacatccattggatgctctgagacaccaaaccaaaatcatgttcaaaaaccttctccaaatgcaccggctcactgtggaaggtgcagatttcgtccctgatcctttctttgtggaattgactgagagtcttttacgattggaatggcatattaaaggaaagtacacgtgccttggttgtttggtagagtgcataggagttgaacatattttggctatagataaaactattccatctcaaatcttagaggtgatgggagaccagtcattggtaccttatgcaagtgacctcttggaaaccatgtttagaaatcataagagtcatttgaaatcccagactgctgagagttcttggattgaccagtggcatgagacttgggtttctcctctcctttttatattgtgtgaaggaaacttggatcaaaaatcttacgtgattgattattacttgccaaaattattaagttacagccctgaaagcttacagtacatggtaaagattcttcagacttctattgatgctaaaactggtaagaaaaatgcatttttgttttagtagtttctaattatgatgcttaaatgtaggtagctatgcagatac

SEQ ID NO: 11851 - DNA, 1113 bp, Homo sapiens
aacgatgctgccaacagccgcctcatcataacgcaagttaggcgggattatttgaaaggtatgtcacaatgcttgacctttacgtcacattaatgcctctgcagatttttcttgtaacgcccttcgaatacttggataaaggagtccatttagcaaattacctgcttatcaagagccttttgtggtagctgagagacataaattactgtacatgcatttataatacagcttgaatatgaatgtacttgtcatttgaccacttagtccagtttccattccatttaacacaagatgggttttcttaagatgaatcacagctcttcagacatgcaaaatttgtgttccagaacgagagaaagtacaggctttcaagtgcgttaaaattcacagcacaagtcattttgctttggaaattaacatactttagagcatctgaaacaattcccagcagttgtttcttgcatattgtgttggttgtgtgtgagataccaaatcagttaaattgagtgttaaatgtgtgggattgtgcaccaaatgattataatattgatttttaaaacttaatctaatacttttttaatagttcataataccaacagcaataaaatacagtgtttgtttgaagtttggagttttcaaattaatgttaagagaatgacacctgaaagatgtggacatgactttggggaggattgggattggggtgggggccactggtttgatagaggctgtttatgagttttgaaggggatgaattgggatgtggaggtcttatgaatgatctcccaaggggcactatgacgaatctcttaaatttagctaagtagctttccactttaagatttacatttgaatttgagtgaatacagtgatactgcagttttgccagtacaacaaaacccacttaggagatcttcaagaaaggttgaaaaagctctggaaatgtaaccttattgcttcctatctctgtaataatggtattattcctcactgcatgttctggttttgttttgggtttttttttgttttgttttttttttttgtttttgttttttttgagatagggtctcattctgttgcccaggctagagtacagtggtgggatcgcggctc

SEQ ID NO: 11852 - DNA, 1196 bp, Homo sapiens
ttagaattataggctatattctctttagtgctattgtgctgaaatgttaaccattgtaaccacccacttatagattaaagattgctttaaaatgaatcttttgctcccctcaatctaaattatacctctggtttatttggactttaacacacattttgcgatttattttgaaactagtatcgtcttttcataaattcagaagagctgtttctcatttttattacaaagaaaataatgtatcaacttaagaaagctggtatgagaaatcattttaagaggaaaccccttcaggcaccatccattcagattaaggtgtagtttccaaacctgtagctttgtctttaaaatatttgaagaattatgtcagtgtgtctctctatagagtggtaacagtgggttggtattaaaaagcaaaaatatttgggtttaggtctttgtttcaggattttttccatccttttggcatttcagaataatgtcatctcattttttttgtctgttttctctcataggggcatatgatattttcctgaatgcaaaagagcaaaacattgtgtttaatgctgaaacctacagcaatctcattaaattactgatgtcagaagattattttacacaagcaatggaagtgaaagcattgtaagtgttagtccatttattaaacctcttgtttaaaaaagaatattggctgccattagccaataattataatagtaatgtgctgtgtagtaaaattgcttgattggcctcagctacccataaaaatcatatgaaatggttaactaactttatcaggttttttcaccttcaaaaaaaaacacctttactggccatatacagtgcagtacattttgcttactaagttatattccatcacaattcatttaagatatccatgcacagaaaagtaattttattatattctgttccttgttcaacatctaaatccatgtaccttttgtggtgggagcagcctgagaaaacaaagacaccatggactttgaacttagaccaagatttgaatcttacttaaaagttctgtgaccttgggaaaattacctgctatctctgatccttagttcttcttccgtatgatgagtgtatgataatattacttaatattaaagatttcttctatgtgttgaagaaggtagagtgaagtagagaaaacataggtactgaacacatcttatttg

SEQ ID NO: 11853 - DNA, 1099 bp, Homo sapiens
ttttccttcttacattgtaaaatatgaaatcagaaattagtaacaattagggaactttttacataagtgcttaattgaaaacatgttttgaaatcagtcacttctctttgcagcatttattctggtcaaattttttgtgtacaagtccatcattgctctataatagcagtgttgtattataatcactgtttggggtgccagaaatgttgggcacattgcttaattgtttcaagtttctttatacttataatttcaaggatagtttcttgaaatttactgtttcacagagggggatgaagaaaggaggagttaatttttttatcattgtatctcacagtgtttcttttctgccttttagacaaacgaattgctgagtaattttcttatactgtgattcagaaaataattgaactgaacttaccgatcttttcttactttattctaagttctctatctctgtgcttctacattttatttggtaggtataattgaaatcctcaaaggaatgcaagaattgggagtacatcctgatcaggaaacatatacagattatgtgattccatgctttgatagtgtaaactcagcacgagccattttgcaggtgagtacaagtgtggttttaatttaataattgaagaggatatctttcctccttaatgtttagtgttgacacacaaaaaagtcattgaactgaggactcaaaatggtcaaatctgtatacaattttctttttttcttttttttgagatggagtttctctctcattgcccaggcaggagtgcaatggcacaatcttggctcactgcaacctttgcctcctgggttcaagcaattcttctgcctcagcctcccgagtagctgggattacaggcatgcgccaccatggctagctaattttgtatttttagtagagacagggtttctccatgttggtcgggctggactcaaactcccgacctcaggtgatccacctgcctcagcctctcatagtgttgggattacaggcatcagccaccgcgcctggccctgtatacaattttctaaagctttgtaaaaatattagttggtataacatttatagtggttaaactttcaaaac

SEQ ID NO: 11854 - DNA, 1223 bp, Homo sapiens
cctgttttttaaaagaagtcgtaaacctttaggtggtatttttccctagttttttgaatctggatattttatttagctttaatacttaaataaaaacactctaactttgtcttctaatttctggaactctctatagactctggagaaggtggagaagtccgagcttcaccttatggaccgtgatttactgcaaattatttttagcttcagtaaagctgggtatcctcagtatgtctcagaaattttggaaaaagttacatgtgaaagaagatatattccaggtagttttaaaaaaatctatttacatgatttttataaaaatctgaattgctattcttacatgatggaaaggacattttctaacaatgggcattgtgggagttgaacatagaactcttaaagtcagttaaataagcccaaaaacatgagttaatgaacacatggggatgatttgatttgcaggtgttttattgttatttaggcagttatatgcttttgatgtttgcaattcttattttgtcttcagtattggaacattggttgcagtgtaaaaatattgttcagtttattaacaaaagatgtctttgttttcttcccagatgcaatgaacctcattttacttttagtcactgaaaaattggaagatgtagcgttgcaaattttactagcatgccccgtatcaaaggaagatggcccaagtgtctttggcagtttctttttacaacactgtgtgactatgaatacggtattctgtccacttttactttgtagacaatgtaattggcagtgaaataagattctttaaagtataggaacatttataagattagaccagttgtaaacatcataacaatgttcttgtgttgcaagatttttgggtagaaagaggatgcggggtttaaaatgctcatctcagaagtggtagaatatttgcagcaggtcaaacggtggggtgtttgccaatccagctaatgtggtgacttttttcccacagcctgtggagaagctaacagactactgtaagaagttaaaggaagtccagatgcactcctttcctctgcagttcaccctccattgtgctttactcgccaataaaactggtactacattcttaaagttaaagccaagtaaggaagttttgctgaggtagctttgtgatcttttatgatatctctttcagatttggcaaaagccttaatgaaggctgtgaaggaggaaggttt

SEQ ID NO: 11855 - DNA, 32124 bp, Homo sapiens
ttctaaagtatattagtataccttcctaccttgatttattgaacaagatgactcactgttttgaatattctcattgtccagtcttctgtaaacttacatgtcgaaccctagactcaccttgtaaattaaatcagaatgaaattattaatgaagttttatttcttgttttttcctttctcctagaacagtggtctcaacgtggctgcacatacaagtcaccagagaggcttttaaaagatgatatctgtgtcccatccctagggattctgatttaattggtctgattattcttacgcgctagggctgagaaaccactgttctgtaggatgtaggggaggaaatttcttgggcttttgttgttgctcccgtaaattaggataatactaaaaaaaatacttgaggtaggagttactagactatagagggaatattgtacatacattttctgtcaaatttaaacatttaacacctgcattttttatttcagatttattgctaaacatgggtgcatttttggataaacccaaaactgaaaaacataatgctcatggtgctgggaatggtttacgttatggcctgagcagcatgcaaggatggagagtggaaatggaagatgcacacacagctgttgtaggtattcctcacggcttggaagactggtcattttttgcagtttatgatggtcatgctggatcccgagtggcaaattactgctcaacacatttattagaacacatcactactaacgaagactttagggcagctggaaaatcaggatctgctcttgagctttcagtggaaaatgttaagaatggtatcagaactggatttttgaaaattgatgaatacatgcgtaacttttcagacctcagaaacgggatggacaggagtggttcaactgcagtgggagttatgatttcacctaagcatatctactttatcaactgtggtgattcacgtgctgttctgtataggaatggacaagtctgcttttctacccaggatcacaaaccttgcaatccaagggaaaaggagcgaatccaaaatgcaggaggcagcgtgatgatacaacgtgttaatggttcattagcagtatctcgtgctctgggggactatgattacaagtgtgttgatggcaagggcccaacagaacaacttgtttctccagagcctgaggtttatgaaattttaagagcagaagaggatgaatttatcatcttggcttgtgatgggatctgggatgttatgagtaatgaggagctctgtgaatatgttaaatctaggcttgaggtatctgatgacctggaaaatgtgtgcaattgggtagtggacacttgtttacacaaggtatgtaaacttttttgtcattaaaataacatgttaattttgaaaagttacggtaggtaaagttaagctaacttaaaattttaaaacttttaatattttcacagaagctgtatattttgaagtactttaccagaaatgaaaccattgttttctttgccatccttgtttgtcccagccttctaatttgaaaattaagcttgataaatttgaggcatttgttgtcatttaagtacttcatagcttgttgctgtagcaaaagcatttacacagagtgactttttcttgacattggcagtaaccatcttatgcctgattatgaagcagcttgataaaatatgtatatagtagaattctgtactagatattactaaaagatcaagagccatgtgaaatattggaagatgtactagatgcctagcctgtataaaatttagtcctgagcctcctagcagtgaagacaaaaactgaaataaaaatatgggttgtatatttctcattgtcttctaaaagcagctcttatctggcaatacaatctaaaaaggatttacatgtggctctctaagtaatacatgacttggatagtatcttttgtagaagataaaattcttttcatatagatgtttttattatttctgattaaaaaccaaaggcttctataaaacataatcttgtgaaaaattcctgtggaacactaaagtttatttagatttgtaattttgtatgaatcattgcttgatacagtaatagaaaaaaagtccagagtaatagataattggcaatcctttgaatatctttaaaatactcagttgtttcaagtgggtttttgacagcatctatatataattcaattaaaatttgagttatctggccagtgtctggagtgtgtaagtatttgactgaaaagataccaaggtaaaactgacctttagttacatgaaataaataaagggtttgacttatttattctgtctagattagaaccactgtatctccctactccaaaatgtactgtggaaggtatgggcataaccagaaagtttttcagaaaggatctctgggtctctggaaatgcccagattttggttaaataccgatttctttttaatagaatggaaagaggcagttttaaaaacagaagatttaaaggccgttcttgtcagtggacagcctttttctgaaaggattttaatgatggtacctctagctcctctgatttttatttttaacacactgtatctttttacttctggatgagttaagtaaagaagtattgatggttgtcagtgatcaaatagtaagtgggtctaaaattatgtatttgtctttgaactctaaatgaagcaattctgacctgtagatttttgagacaagcataggcatatgtttgttgcctgactagctaatgaaaacagcattttccccaattataaaaaaaaggtatatacttactattggaaaaaaaatccagatgatgaagaaaatatagagaaacacccaaaattttgccatccaccctaagtcagctactttcattgttgtggtgtatattgttccagtcttttctgcctgcctgtgagtgtgtgtatttttataaaaccgagatgattatacttgttattctacagcctgccttttccaacaatatattgtagagagatctccatgcctataagtattgatctgtatcatttttcttggctgcgtagtattttattgaaagaatgaggttgtgagggaatagccaaaaaatctattaggtctgtaatttggactaaggaaagaagtttgtgttagtagattaactcacttatccattgaaaggatgctagtttttgagaattttgactcgacccttctgaatgaggtttaaatatttctggtggtatatcttcacttgctagcttttatcaatttagagtgattaaatgttcatgttgatggtgttaaaagattctagatggcatcctagaatctcagaaatgaggaatgataataacagacaagaagttggggcccatgattcattcaatgttaatggaagctgaccatcatagttccttctaatggagctgcattcaaattgaaatcagtttggaggtttgaattgaaacaaaacagacttaaaattatttttgaacctttgaaagttacttatggaaaccttcatttctgtttaacttcgtaattttgtctttccatttatttgtattgtaaaagcaagggttagcaataagatcaaatataattactttgaatttactcagaaaaattgtaagttaaaaattcatggaaagcacttagcgattgcacagtagttacctgctgtaagaggagaggaaacattaataagtagatgtttccctgataagagatttaaatgaagtcctagttttttctaacacctccatcacttgtcatactttcataatttataagcacttttatcttaactcattaaatcttgggaggttatcataatcataatcgtggtagtattagtaaattattgctttctgtaagccaaacactattctaaatactttacatattttaactcatgtaattttcacaaccatatgaggtagttaagatgacgaggtcaggagatcgagaccatcctggctaacgcagtgaaaccccgtctctattaaaaaatagaaaaaatcggccgggcgttgtggtgggcgcttgtagtcccagctactcaggaggctgaggcaggagaatgacttgaacccgggaggcagagcttgcagtgagccgagatcacgccactgcactccagtctgggtgacagagcgagactccgtctcaaaaaaaaaaaaaaaaaaaaaaaaaagataagcatttttcagggttgccagttaatattaatctgtaagtgttgtatgactgtggtcaggtattatcctatttaaattaggtatttaactcgaggggagaatgggagctaagaaagcaaccctcccattttatttgcaatgctggcatttatggtgtttactgccaactaatttcgggttgcttaaaatatgtaactgccacgtgcatagcttttcataacttgtaaatgatacatacttattaatcctcatagtaactttctgaggtgaacaaaataaaaagtttttttaatttgcaagtaaggaaatggaggttgtttgatattaaaagatatccataagtcatatacttggtgagtattgaggctgagactagttttctgactcaagtttagtatttttgttaacaatatttcccagaagggcctgataaaataaagaagagtgggtgtgggtgtgggtgtgggtgtgtgtgtgtgtgtgtgtgtgtgtaagtgtctgtctgtttcggttttcatggtctgagaaatttttccccaagggaaacattaagactaaattttttttgtaacaaatacagagatgtttgaagtaaagtgattccccttgatgtttctgctttccagtctcatctcacttagggaaccactgctcatggtttgctgtatatctttccaaatggttctctgtgattattgatagaaatgtataaacgtaaaataggattttttctttttttgtattttatagaaaaagatcatgctatgtttgttactttgtcacctgttttgtttttcttaaattataaaagtcggtattcttttaaattgttcttttaaaacattatttgattttccaaaatttcatttatataccatctaccagaagcctatttattttaaaacatgagatagtacctcatagttggataaaattgagggaaattatcattttccaaaggcaacatcattctatattaatttatataacatagaaaatgtaaccccctcaataattgtttagttctaaactcaggagaattgcttgaacctgggatgcagaggttgcagtgagctgagatcgcgccattgcactccagcctgggcgacagagtgagactccgtgtcaaaaaaacaaaaacaaacaaaaaactgtatcagattgttttctgtttaagtttagatgcccttatttatggcaggggcactggcgtctttgatctggtactatgattattaagagtgttaactgctgtgctgttgtaaaaagtaaaaagaacatgtaataatcaatttttatatgcagagctaatttctttagttatccaaactggatttagaaaaaaaaatgttttatttatggacttagtgaaaactttatactgattatacaaggatgttttgtctctaaaaaacaatggcacaaaggaaaggaccttttctgttgctgtataacagctactgaaacatattcatacttggtgtttaggggaaagccatctttacatagaaatagaagcaagccaggcaaggtggctaagaagcaacatcactgaaatcacacatgcctgagatgtaaatataaattatttcccttaaatgtctttggagaaccataaatttattggaactctctttcaattaattttccaaaagtatttatattttataacttacaaaaatcgaatggaaattagataaggaaatgttccacaatgctcatgttgttgttaccaaaaactcaaaagggttaaaagaaattagatttctaaaagtgtaaggtgttaattccgtttatgcataaaattgctttataaagtgtaattatgcttgattctttttttgttgttgtgttttagaaagggtgtctcactgtgttgcccgggctagtctcaaactcctggccttaaatgatcctcctgcctcagcctcccaaactgcggggattacaggcagccaccatgcccagctgtttgattcttgaatatccatggtgtactttaaaattatttttaattaaaaatttttgcttgaactgcccttatgacatttatacaagtatattcatataaccaaacacatacagtatttctaatataaaagttttggtgggtttcattaaggaatgaattaatttggccaatttggaaatggtttttccagataaccgggaatctaatgaaatactcaagttggttccttgttccaaagcacaacaatctgtgacaagttaatttattttgaagtcttctgaagacccaaccttcactgccttcaaactttactcccattgaattaggaggtgaaggcagaagttattcaaggccacctgtcttttgggctgtgtcatgtaggttctgaaaggcataagtctgaaccgagccatgcctgcctagattctagtcataataactgaaaagactagaaagggtgtggtcttggtttctttcacttgagttggcaaatttggcaaacactatcagacaaaatagcctaccacctccactgactttgttttttagagtgaacagaaaaagaaagtttgaaaaaaatcgttattccaagaacagtttcatctgctcctgctcttagaaactcagttaaagtaatatacctttagaaaaagtaatgagaacgtatttttaattgattgcacataatctcatggtactagagtagtatatatgatatgctttttttttttttgagagagagtcttgctctgttgcccaggctagagtgcagtggtgtcatcacggctcactgcaatctccacttcccaggcttaagcgatccttccaccttagcctcccgagtagctgggacctgggactacaggtgtgtgccactaagcccagttaatttttgtgttttttgaagagacaaggttttgccatgatgcccaggctggtctggaactcttgggctaaaatagtctgctcaccgaggcctcccgaagtgctgggattatagccatgagtcacagtgcctggctttatgctttttttttttttttttttggagacagtctcactctgttgcccaggctggagtacagtggtgcaatctcagctcactgcaacctccacctcccgggttcaagtgattctcctgcctcagcctcctgagtagctggtattacaggtgcgcgccaccacgcctggataatttttgtatatttgtgtagagatggggtttcaccatgttagtcaggctggtcttgaacccctcaccttgtgatctgccctcctcagcctcccaaagtgctgggattacaggcgtgagccaccgtgcccagtgtatgcttcctttttaacataggtaatttgtgatggtgtggttaaaagggagaaataaaatatgtccttaaattagctattttagccactttataaagattctgaaactacttgcgactatatagcaatctgatgtcttttcttttaaaagttatcacatgactacagttggatctcagttgtccagttacagtcccccctgttactgtgccctctgaatagtttcttgtattaatagttgtggggctgggcgcggtggctcatgcctataatcccagcactttgggaggctgaggtgggtggatcacctgaggtcagaagttcaagaccagcctggtcaacatggtgaaaccccatctctactaaatataaaaaaattagccgggcctggtggccgtcacctgtaatgccagctactcaggaggctgaggcaggagaattgcttgaacctgggaggcggaggttgcagtgagccaagattgcgccattgtgctccagcctgggcaacaagagcgaaactttgtctcaaatagtaataataataattgtttagtttagtattttgggtattctgccgaataacaattttcagctatgttaaattcatggagtcgtagcattgctctgaggcagtttaaaagctaagctggaaaacatttgcatatgtgtttgggaggatccattgtggacttaagccagtttgggaatagacaatcttgagtgggaaatagtttagaagatttaatatgtattgaagatatcttcatttctcagactggaatggctgtgggtaataatagttcaccagaattaaaaatacagaaatgcttacagatatacccatacctagacaccttgtttcttcaagttgtgtttttagtaattcattggaataaaaatgaatgtgttaaacataaacgttctggatgattaaataaactataattgcttaaagtattttgaagtaaataatagttgattgtagaaatacaattttttttcttttttttctttaatacacagggaagtcgagataacatgagtattgtactagtttgcttttcaaatgctcccaaggtctcagatgaagcggtgaaaaaagattcagagttggataagcacttggaatcacgggttgaaggtaagacaaatgctttttaaaaatatagacaggccaggcacggtagctcatgcctgtaatcctagcacttttgtcgcctgggcgacacaccaaggctctgtctcaaaaaaaaaaaaatttagagagggaaagtattctttttgtttatcaaatgattattttaaaatttcctggtcaggcgcagtggctcacacctgtaatcccagcactttggcaggctgaggcgggcagatcatgaggtcagatcgacaccatcctggctacacggtgaaaccccgtctctgctaaaaatacagaaaattagccgggcatggtggcacacacctgtagtcccagctactcgggaggctgaggcaggagcattgcttgaatctgggaggtggaggttgcagtgagccgagattgcaccactgcactccagcctgggcaacagagtgagactccgtctccaaaaaaaaaaaaaaaaaattccataggacaaacaagtatttcaaaacaagtccttgaaaaaacacatctatctgtctaaaatttactgtcttggaccaatttctggggattgattgacagggagaagacaaatatgtctgtttcaccaccaaagagaaacataatttgaaggtagttcgttagagcttgctggtttattttttctttctttttctttccctgcgtacattcctagtagtaagtggagaatccagtgaaatttcccctaacagtgtcatgaaaacaagtactcttaattccgctaatactaattctcccttttcgggttaattatcattggaattcattacggtatcctttcccttttattgatagagttaacattagtgtttcaaaagattattttacatatttttttaaacttcatttggcaataaatttttttttttttttttttgagatagggtcttgctctgttgcctaggctggagtacagtggcatgatctcggctcactacagcctcaactccctgggctcaagtgatcctctcacctcagcctctcccaagtagctggaactacaggcacgtgccaccacagctggctagttttctttattttttgtaaagatgaggtctcactgtgttgcccagggtggtctcaaactcctggactcaagcagtcctcccacattggcctaccaaagtgctgggattacaggcatgagccagcacagccagcctaataattttaaacatacagaaaagttgcagaagtattacaggatctcccatgtacatgtagtgtcctttacctagattccttatttgtttatgtaataccacgtttggcttatctctatatatactttctgtaacattctcattttctgtctccctccttccttccttccctctccacctctctctcctcttattcccctgccccccatattactaacctttttcctgagccaaatcaattgaaagttgcaaatatgatatatcagtactacttaataaaacgaagattacatgacactacataactgtagtatatccataaaaattaggaaattgacccagcacggtggctcacacctataatcccagcactttgggaggctgaggtgcacggctcacgaggtcaagagttggagaccagcctggccaacatggtgaaatcccatctgtactaaaaatacaaaaattagtcgggcgtggtggcaggtgcctgtaatcccagctactccggaggctgaggcgggagaactgcttgaacctggaaggtggagattgcagtgagccgagatcatgccactgtactctagcctggatgacagagcaagactccatctcgggaaaaaaaaattaagaaattaacgttgatacaatattactttgtaatccacagatcccatttaaatttccctaattatcccagtaatgtcatatgtaggtccaggatgcagtctagagcatgtgtgctgcatttagctgtcatgcctctttagtctccctcaatggaaaaagttccatagtcttttttatttctgttgaccttgacatttttcaagagtacaggtttgtggaatgtgcagcttgggttggctgatgtttcctcttgataagatttaggttatacattggcaggaatactgtggaagtgattctagattcttctcagtgcatcacaatcagggaggcatgtgatgttgatttataatgttaacatcttttgtgacttgcttgggttgttgtctttcaggttacttaattaataattatgttatacctaataagtatttaataaatatgttatacttattcataagtattctatggggaggcactttgagattgttaataacctattgctcattaagattttagcagatagttttagcatccatttgcgatttttgcctgaagaatgatagccaactggtgattttctgattctgtcttttttttttttttttttttttttatgatggagtttcgctgttgttgcccaggctggagtgcaatggcatgatcttggcttaccgcagtctctgcctccggggttcaagtgattctcctgcctcacccttctgagtagctgggattacaggcatgtgccaccacacccggccaattttgtatgtttagtagagagggggtttctccatgttggtcaggctgatctcgaactttctgacctcaggtgatccgcccgccttggcctcccaaagtgctgggattacaggcgtgaatcaccgcgcctggtttagtcattctttttatatgtattagcattttactgcaaggaaaaatgttcttttctgcctgtttgtttatatgagcacagactcacggattcctgttctattcattgtattatcaactgtttcaggcaatgagagcctcttaaaacttgttgtagcgtctttttgtcctgcctgcagctatacagtactacaggatttattatagttttctcccttttcatatttataactctcttctacagaaagaaacctgtcctctactgtcaacccaacaaatctgtcacggctaactctcatgcatatgccttcctcactccaaattgcccatcccagttcaccctatagccatcctaaagctatgcttactgtggttaggcatgaatatcccattctggatcaatttgtggccactatttccccctccactccctgaaagatttgttttgcttagctaagcaaatccaatcgtgttggacaaaattattcaggaacatgagaagggagaagctagtctgtttatctttaacataattgctgatatgtttgagtttaaatctgccgtctttcgtgtttcatctatttttttttatcctccattcttgccttcttttagatgtattccagttcatcctaggatttgcttattagttacacattctttaaaaaattccgtttagtaggccagtcatggtggctcacgcctgtaatcccagcactttgggagaccgaggcgggcagatcacgaggtctggagattgagaccatcctggctaacacggtgaaaacctgtaactactaaaaatacaaaaagaaattagctgggcgtggtggtgggcgcctgtagtcccagctactcaggaggctgaggcaggagaatggtgtgaacctgggaggtggagcttgcagtgagccaagatcctgccactgcactccaggctgggcgacagagcaagactccgtttccaaaaaaaaaaaaaaaaaaaattccatttagtaaaaaggaaaaaatttagtggttaccctgagaaaatgaaaatttttcagtcttaaggccctttttttttttttttttcttttccactttcaaccctgagaagctaagtatcataatcttaatataaccttttggttttatatatgctgtttttaagatatgaaattactttttataaagttagattgtcaatcttttttcttttctttgtgggaggactttgatatcataccaagctcttccactcaaggttacatagttacctgtattttctcctaacacttttatgttttgattcttttttttttttttggagaaaatacatttgaatgatataacttacgatgatggtataatagttcgttgaatttggccattttgtatatagtataatagctttgttgaatttggtcattttgtatatagtaggccacagtaattggtgagagttttgaagtgtgaagatgtgtgatttctaatatgtaattacaattaaaagtataaaaccaagaagagagtcttttgcaaatttggagaatggggatttatcttttctgtctctacaactatctagctatgcaccctaaacaatgtgcttaaagttttttttgcacctacaatttcctcagccctaaattaatcttgtttttaggtctcaatgcttttgagtttcaatgagtcctgctttgagggtgatgaaaacgtgagaaacatgtaagaacacattgaagattatgtcagatgcggtcatattcctattgataatatcattaagaggagctgtttttataggagttaatatttaatgataaattgtagtatattggggttgcagattgctgactatagtttatcagaaggtgggaggaattctcttagtttccttcttcctcattcataaagaaactgggtagtttttattttaggaagagctctctagtttggtcagctggctgttatgtgaacttatccaacttgcttaacccctcaaggcaccagtttctttattggaaactaaagataaaaacaccaaccatagagttttttgttttttgagacagagtctcgcactgtcacccaggctggaatgcagtggcgcgatctcggctcactgcaagcttagctgcccgggttcacaccattcttctgcctcagcctccgaagtagctgggactacagatgcccgccaccatgcctggctaattttttgtatttttagtagagatggggtttcactgtattagctcaatctcgtgacctcgtgatctgcccgcctcggcctcccaaagtgctgggattacaggcgtgagccactgcgcccgaccccatagagtttttttttttcttaaataaattgttacaaaaaaagcttattgatgacacttgttaaagatggtaaggcagatattttttcgggggtggggggggcatggcagtagatatagggaccactatgatagaatcttgcagtggcagaaagaaattaaactcaacttggggtcccataaagataagtggaatttataactaaggagctgagtgcttgaagggagtgtcagtggatggaaaattattactaagaggaagcatcaacataaggggtttctggctaaactgacttgatagcatggcaggccaggctaaaatatccagagtggtcctatatcaagtgtgtgggggttttcagtaaactgactgagcaggattctcattcagcctggtttctacaaggacagagagggagcctaaagttctcctagtcagaaagaactcaagagtcttgctgaaggtttggtccaagcaaagagtttttgtcaaaataaatgagaattatgtttgttaagcacctattatggtgcctagcacgtaagtcctcagcaaactgtaactttatatgaactcttaacttctgtaatagccacattttaatttcttaaaggtgtggtcaattcagtttaacatgagttaataatttaatattaattttcttctgcatagttagtaactttctaaagtatatattatataggagagataacaaatatgtaatatgatctctagggcctgtagcaaatagttattattaatcaggagacaaaattgttagctaggcagccactacaaatcaatttaagttggtacttaaaatgtaacttcacagtagcttacacctataattcttgggatgccgaggcagaaggattgcttgagactaggagttcaagaccagcctcggcatcatagagctacaaaaaagttttaaagattagctgagcatggtggtgcacacctgtagttccagctacttgaagactgaagcaggaggatcacttgagtccaggagtttggtgttacagtgagctatgatggcaccactgcactccagcctgggccacagagtaagaacatgtctttaagaaaaaaaaaaaagtaactttttatttgtaaagcagtgttcttcaggagcattatgtttcttctggggttttaaatcatgtaatatgacattaaattttgtggtaaatacattctggtgtacttggtaaatctgtgtgtatgcttttaatgatgactggtcaggtgggaaaggaataatattaaaataaacagggaatagtagttcacctgaattgatgaattatatatttaatgattgctttctacatacaggtttactcagtgtttattgaacatgtgtcactgaggatatagcagaaaaagaaatctcatagaatttgtattctagtaaaaacctatttttttttaatagagaaataaaatagagtaagtagagagcaacaaggaatattggttagaaatgtctctgtgaggaaggatgtttgagcagccgtgcttggagagagaatatctgagggaagaacattccaggcaatgacaacagcaaagactaggagggaatgttcttagtgagtgcagctgggttagaataagccagtagaaaactagaggaaaattaagaggtttgtaggaggcatatcatgtgaggactttggactttgacttgtgggaattcattggaagattttgagtacaagagtgatttgttcttttttccaaaggatctctcttagttgctgtatggagaagagattgtataaaagggacaagagaagccaaaataccgattagaaattatgcattaatgcatggtagtggtaaattggactagagtagaggggtgtaaaaatgtctggtgacatttttggtgtcatagctgagggggtgccactggcatctagtgaatggaggccagggatgctgcttaatattccacagcacacaggacagcccccacaacaaaaaaattgtctggtgtaaaatgtcggtgttgttgatgttgagaagccttatactataagacacagatttaaggtagaaaacttacagtcctgctttcatgaagcttgcagtctatgacccaataaacatcgtgtatgtgggagtatatagcattatggtatacagtacatgtcatgcatatgggagtgtattgcagtgtacctactcagacttaggtcagagaaggatttgagaatgtgacatataaaattgaaacctcaaggatgaaaataggcattcatagctgggcgtggtggctcaggcctctaatcccagcattttgagaggctgaggtgggtggatcacgaggtcaggaattcaagaccagcctggccaacatggtgaaaccccatctctactaaaatacaaaaattagctgggtgtggtggcacatgcctgtaatcccagctacttgggaggctgaggcaggagaatcgcttgaaccagggagtcagaggttgcagtgagctgagatagtgccactgcactccagtgtctcaaaaaaaaaaaaagggacattcaccatacagaggggttggattagagtgaaaagtgttcccaaaccaacgaaaagagtatgtgaagatctagaagtagaagtctttgaatggatcctttggagatgagggaggcgggcagagttgaaagagtagtggaagtcaacgtaagggtcttgtgaggcatggtaaacagttgttttgaaagtaaggcctgggctgggtgtggtggctcatgcctgtaatcccagcactttgggaggccgaggtgggtggatcacctgaggttgggagtttgagatcagcctgaccaacatggagaaaccccatctctactaaaaatacaaaattagccaggcatggtagcacatgcctgtaatcccagctactcgggaggctgaggcaggagaattgcttgaacccaggaggcagaggttgcagtgagccaagatcacgccattgcactccagcctgggcaacaagagtgaaactccgtctcaaaaaaaaaaaaaaagctgtagaatgtaactatttcaggtaagtatcaacttgtaaaaatgatttttaatttctcccctttttcttataattcttatctagctaaacttttattatcctttagtaatggcattcataacttttatattgtttttacttaatattagatcagaagtatttttccatatagctgttactgtattcatcaagacacctatttcgtaatttttagtgattataaaccatttcactcaatggctacaccaaagtttttaactgtcctcttgttggtgaacatttagtttgttccagtttttgctttttatgaataatgctggaatgaacatacatatgcaaataactgttttttcttttttccccctgcatagcaatgtttcagtcaataagtagctttttgtattacttcttaaaaattttttgtgtgttgatggtaattttttttaatatattttaaaataggtactaccaaatagtatctcttgtttcacttcttggtgagtactggcttatcacattaatttaggaactttttttaaaaaacctacagagattatggagaagtctggcgaggaaggaatgcctgatcttgcccatgtcatgcgcatcttgtctgcagaaaatatcccaaatttgcctcctgggggaggtcttgctggcaagtaagtagaacaaaaagctaattttgagttcgttcataattagtaattaaataatttggggtaaaaaaacttaaatcagaagtacatcaattatctagaggtgaaatgggttagtgtttcttatactagagaagaactcttaaaacttcaaccaaaaacgattttttaaaaggaattatctatcatactctttgagtatgaaggtccttctttccttgctaaggagtacaaatggattgtgcaaaatcagattctgagagtaaagtgtagaaggtatgttcttgacaagtatagagtgtaccagttacttttttagtgtggtcaggatgaaatattgagatattcacaagcttaaaattctgtgtaatttaataaaactaaagcatgttttttttttttaggcgtaatgttattgaagctgtttatagtagactgaatccacatagagaaagtgatggggtaagttttattttatttcataagcatttgaagtaatttcacaatataaatactaaatatgaatacattcacattaacgaagtctataataaattatagtctgtagtaaattactactgcttttcattttaaagtgtcagttaaagtttaagaaaatgtattgaaatgaaggtagagataaaattttgttttgtagatagttttgttgtcactttctgggcatcaaatgaccttttttgtttgggctgtctttatttcttctctatatgtctgcttttccttcttctcctttaaaccttaattttgaggcaagaatgctcttttaaatatctcaatttctcctccagcaggctgctgccatcaccagaagttagtgatagtgagtgagttgttattttaataactagacctttcagtacccctgtatgcccacttggaatacccgaggatagtttttttctaatattattgttgtattatgggtacatgagtgttgagctgagataaccatttctgttgtaccttgctgtacttcatcagagcaagactctatgcccttaccttttattttgcttttcttcgaaatgtcagtgagctgccagctgcccctctatattgttttgttttgttttagtactattaccaggagacagaagtgtcctttttttttttttaaatccaagttagttcaaataagtatttttctcttgggttttcaagtttttatgtctaaaaataaattatttaatttttaatatatatgcttcaaagctttaagggaaccaaacagaaatgaaactgattgggaggaagagtccacctccagtctccagctcctcttggcagattgagagagagagtatccattggctagaaatcatatgtcatctcaattgcattatttgctaggattcattgttgcacagcaatataatatgatttcttttccttaacagtaaaagttatcctggcaaaaaggaaaatttaataattaatataattttagtgagtcatataaaagtgatgctatatattgctaattataatttatatcttggtctagagcagtgattctgagtctttttttgtggcaggttcctcagagtattaagaattgtacccaaggccgggcacggtggctcatgcctgtaatcccagcagtttgggaggccgaggcgggcggatcacctgaggttgggagttcgagaccagcctgaccaacatggagaaaccccgtctctactaaacatacgatattaactgggcatggtggcgcatgtctgtaatcccagctactcgggaggctgaggcaggagaatcgcttgaacccgggaggcggaggttgtggtgagccgagatcatgccattgcactccaccctgggcaacaagagcgaaactccgtctcaaaaaaaaaaaaaaattgacccaaagctgagaaaattaatttaaaaatccaaatattttatgtgatccatcagagaaccctcaaagaaatgagtataggatgttgacatatgactaaaaggatggtggtaatttggaaggttgagagaagagaatcttaactcttcagctagattatagattcttcagggcatccactaccttgattagaggaaataagccctcagaagacagttattgattcattattagccatagaagtactcccatttcctcaggtgtttcaaagtgtcaaccctcatgtgtaatctttaaaaatacatatatatatatatatataccttgctggattttggggtccttcatagtctatttttactccaaacaaggttttctgtttaacatataccaaggataacttttaaattttttaaaaagaaaaaatgattacacatagtagctacataaacagggaataaataggcaacggaactatgaaactggggggaaatgctcaatatataaaccttaccttaaatagattattatttggctatagaaatgggatatatgtacttaattacctttatacataaatgttctatcaacatcagcagatcaaacactgacagtgtgttgtatagtggattcacagagggagaagactagaaaacgtaagacgtgaccccacctgtgtgtctagtgcagcttacactgtagttataaacacaccttaaatgatcaaaatatttcgtatagcttggtaacaaataaatgacaaaatccagaatgtgaccattgccatgtgacttggacagtgattgctgtaaaagttcagctgcttaagcagggggaaagtcagcttcttagagaaaagatagtatttgaagaatgatttgaatggtagaaatgacatgaggatgatgacctttcaagtggactagagaggcaaggacaaagtataagatatcttcaaaagaaaggacatcttttttggctaaagcagagaactgttgtggtgaaaaataagaatttaggttgcagaggtacttgctaagagaccagccttttgaacatcattttagggtaatggaccaccttatgtttagagcataagaatgatagattcaaaaaaatatctgtggtattttaatctgttagaaacatttaccatattagattaaagagatgcaggcagtcaggtagttgtgaaataattacagagaccaaatggtaactgtagacttattatcattacatagatatgtggattaaaggaactttccttgtttactgtgaaaactgactttacagcctagaattttaaatggggaaatattatatgcctttcacaataatcactaacttagaaaaatgttgaactataattgcaagtagcagaaatgtgctgaaaaataccgcagaaggagagagaatgaagaaaatacagacgtgattaaattctgagctcttaacttgacccactgtagcaaaaagctagccgcaaaggtgctccataaatgcttcttaacagtgtggatgatgtcgccgggagctggatgttaacttgcggggtgggaaagatgaaagtatgctagaattacagaagaggagaaagttggaaggtattataaaaattaagtttttttaaataacaaaaattatttttgtttagatatttaaacaaagaattctagccagagttaaatcagagggtttctttagactcctgaatgtctgctttatgtcggagagaattgttctgttgtaaatgattataagtagtaccactagaaatagggattcattcatttttcttataattaagacatcttttaaataaatatttttcagaaagtagagttgagtataagtcataaattaagtaattttaatatatattcagaaaggttactatttaggggaaacttcttaagttctttactaaatttgttttttagtatgtgttccatactaaactaactttttagaatgtgttccatcttcttaccacaaacaatattgatattttcccaacttttaaaatacaaatttgtaacaaagggtttagccagggattcttagtctagggattcacgaatccccagaaatcttttggaaaatttccagaaaaagcaaaactacattttgctgtaagttgtctttatattagacagggctctgggatcatactccttccctttttctaaaatgctagtttgtgttttataattagaatataaattctgtgagatctgggacttgatctgattcatttgtgtctatagtccaagcacaatcctggcatacggtgaaagctcagtaaatattttttgaataggaaatatttgtatttattcatttctagtaattttcttaaggctgtccttaagtcatatatttaaaaattaatttgaggttactaattggtatgaaagtctgtatttatagagttttatactttcatgcaaaaagttcttcccttgaaaaagactcataatgcttttgaattagtatgccactgatcaagtagttgcacaagttggtaattttccaagggtaaagttgagcaggggggtgacctgtatttacccagctcctacttgtgccaggccccttatttatacacacacagagtcataggtaatcttctcagcacccttcttttacacatgagacttacagagatgaggtagtttgcacaggtcacaaagctaaataaatcatgcagccagaatttgaattagtctgactcctattctctttacattattccatgtggcctctttaaggtagagattatgtatgtctgtaccccacctgtgtctaccatgcaggaaaaatcatttcccattcttttgtaaatatcatgtttatcagtcttaagatactctattttattgattgagacagggtctcattctttgtcccaggctggagtgctatggcaccatcatggctctctgtagcctcaacctcccaggctcaagcgatcctcccagctcagcctcctgagtagctgggattacaggcacacagcaccacactcggctaattttttgtattttttgtagggatagggtctcgcttcattgccagggctagtcttgaactcctgggctcaagttatcttcctacctcagcctcccaaagttctgggattacagacgtgagccactgcatccaaccacaagataatctgtttttaatggtaaatattttataaagttgttgaaaggaatgagttaagcccaattccttgtcagttatttttcacttaaatacacatatttatcttaatccaaaaacggtttaaggcattttgatcttagagaagggaaggaaaaacaggatagattagtctctttttgagcccaaaagaatctctgtattgttttcagattattaaattttgcatgcatttttctgttttactttaaacggataaatgcaatacccatagctgcttttacatttttatatcacagtttttagaactatgtgaatattagttttttcatatttactttttattcacttgtcaaagcattgctatggagaagacctatactgtttgaaaatgcaggccgggcgcggtggctcatgcctgtaatgccagcactttgggagggcgaggcaggaggatcacgaggtcaggagatcaagaccatcctggctaacatggtgaaaccccgtctctactaaaaatacaaaaaaaacaaaattagccaggcgtggtggtgggcgcctgtagtctcagctactcgggaggttggggcaggagaatggtgtgaacctgggaggtggagcttgcggtgagccaagattgcaccactgcactccagcctgggcaacagagtgggactctgtctaaaaaaaaaaaaaaaaaaaaaaaaaaaaaagagagagagagagaaaatgcactaacattagtcactatgtttttaaggtatgattgacataacacttacctttgctatgtggtcttgaccattcaaatgacactgtctaaaattattcattaaatttgacatgattcttcaagtaacatgtaatttattagagtcttcattagtcatcaattgtatcacattttgtcatactggagaatttttagtttaaaaatttttttgtctgacaagcagcacgtaggacttcataagaaacatttttactagtgtttactttttctctactgttataagtagtcattttaagaattttggttatgggccgggcacagtggctcacgcctgtaatcccaacactttgggaggccgaggtgggcggatcacaaggtcaggagattgagaccatcctggctaacatggtgataccctgcctctactaaaaatacaaaaaattagccgggcgtggtggcgggcgcctgtagtcccagctactcgggaggctgaggcaggagaatggcgtgaacccgggaggcagagctttcagtgagctgaaatcgtgccactgcactccagcctgggtgacagagcaagactccgtctccaaaaaaaaaaaaaaaaaaaagaattttggttatgagagctgtgtttcaaaagataaatattgctgcaaataaatattagctggttaaattttattttttaaaatgtgcttagttcccttccccctcctattactactctctgcttgatttatctaatttctatgtcttatttggtgtaagttagtattttcatcatgagagattcgacttttaagctatgttagtctagctgatagtaaaagcttaaaaactagggtggatgggagatgtcctgaattctcatctcagtaattgccttcaatttactttacagaataattgtaaacatcccagctgatatgatagtttaatcaacataactagtgttctatagttttattaattttactatattaaggaaatataaacttcaatatgaaataacctgtggtgttctataataatttcaccaatatttctttagtaagagtcttacctgtatgaggtacttcctatgcaaaaaaggtcactcgccataatgtattcaacagagcgcaaagatagacattgatgttaattatacctgtgcacaaatcagagccctgccatttactaagattgtcaccgtgacaaataacttaaatctctctgagctttagtttcatcacttataaaaatgataactggaatccttactttgtagggtacctgtgaggattcagtaagattatgtatataaagttcttagcacaaatattatttttccttccttagatggtaggaggacatagaatggaatatgaaattgtctttactctaaaagagtttgcagtctaagtggagagtcttgtgaaccgttgcaaggtagagttaattgctataatagatgtgtaaaaataggtgtgctatatcaactgtacgagttcagataaagaaagtgcaggaacctagataataggtttctcttctaatattaatgaaagcccatgagagagttacataacagtgtttggaaaaatcaaatataatggctgcggaagaggtttcagtcctctattgtctatccagagtgatgagaaaatgtaatttgccataagataaaatgacttttaagtgtggtcattagctaaagttcttctcaatttagtgattctgtaatgtcagccattgcaaatccgtgtctacttgatttattggtttggttttcttttgctttttatttttttatttttcattttttgagacggagtctcaccctgtcaccgaggctgtaatgcagtggtgcaatctcggctcactgtaacctctgccttccaggttcaagcgattctcctgcctcaccctcccaagtagctgggactacaggcatgcaccaccacgcctggctaatttttctatttttagttgagatgggtttcaccatgttgatcaggctagtctcaaactcctgaactaaagtgatccacctacctcggcctccaaaagtactgggattacaggcatgagccaccgtgcctggctatggtttggttttagtatgtctttttttttttttttttgagagagagtcttgctctgtcgcccaggctggagtgcagtggtgccatctcagctcactgcaagctccgtctcccaggttcacgccattctcctgcctcagcctcctaagtagctgggacgacaggtgcccgccaccacgcccagctaactttttgtatttttagtagagacagggtttcactgtgttagccaggatggtgtccatctcttgacctcatgatctgcctgcctcagcctcccaaagtgctgggattacagacctgagccactgcgcccgacctagtatatcttttaaaaagcaacttctcttccccaactgtcactactatagcaattcacagaaatacaggtgattaataatgtaagtgtcagttggaaagcgagaggtactttatctgttgaacttgccaaaattgacccaaatacgacaaatggaacaacctttcatccaaccttattaataagtccacctccaaattgagtcatgccatttagtctatatcagtgattctcaaccctggctgtatatcagaattacctgtcaggctttaaaagaacaacccaaatccactgaatctgtgtattttgaaatggaactttggcatgtgtgcaattttaaaagctccacaggtaattccaatgtggagcaagggttgataatcactttatgtgtaaatctttgaagcagattttgttttaatgtcctgtaatttttttttaataaaatggtaggtttttatcttttttttttttttttttttttttggtttgggggttttcgggggaagagggttgtaggccctgcattaaaaggtctttgtgatataccgtaaagtagaaaatttcctcttaaagactgacaaggtttatcattagagtatacttatcacatgttgttccatctcaacccttcctgaatagattaaaatgggaaactttttatttatttatttatttatttatttatttatttatttatgaatgaatgaatgaatgaatgacagggtcttcctccattgcccaggctggagtgtagaggcatgaacatggcttactgtaatctcaacctcctgggctcaagtgatcctcccaccttagcttcccaagtagctgggaccagaggtgtgtgctgccacacctaattttttaaatttttgttttgtagagacggggtctccccgtgttgctcaggctggtctcaaactcctgggctcaagtgatcctttgaccttggcctcccaaagtgctgggattacaggcatgagccaccagccctggatgagaaactttatttagggaaacatgttttaagtccacataataaattttgcaattaaatgacagctaatatgcttgttgtggaaaattggaaaattcaaagaaaataaagtatctagaactccctacccattatcattatattgctgtatttcctttctttccaggtatttttacatatgctaacatgaacagatacacagacgtatatgtatccaaaaagcatgggccatacacagtatcatcttttttttttttttttggagatggagtcttgctctgtcgcctaggctggagtgcagtgggtgtgatcttggctcactgcaacctccacctcctgagttcaagcaattctcctgcctcagcctcccgagtagctgagattactgatgcacacacaccatacctggctaatttttgtatttttagtagagatggggtttcaccatgttggtcaggctgatctcgaactgctgacctcaggtgatccacccatctcagcctcccaaagtgctgcgattacaggcatgagctactgtgcccggcccagtatcatccattttttgccatgaggatacttccccgccccatccccaccaccaccccgtctgaggcaggaaaacaagcactttttttttctttttcttttctttttttttttttttttgagatagagtctcactttgtcacccaggctggagtgcagtggtgcgatctcgggtcactgcaacctccgccctccgagttcaagcgattctcctgcctcagcctcccggagtagctgggattgcaggcacttgccactgcgtgctgctaattttttgtatttttagtagagatagggtttcaccatcttggccaggctggtcttgaattcctgacctcgtgatccacccgcctcagcctaacaagcccttttttttttttttttttttaagagggtctcactctgtcgttcagactggtgttcattggtatggtcatgggtcactgaagcctcaacctcctcgacttagctcaacctctcgcctcagttccccaagtagttgggactatgggcgtgttccttttaaacattttttgtagagatagggtctcattgtgtttcccaggctggcctagaactcctgacctcaaggaatcctcctacccgtctcccaaagtggtgaaattgcatacacgagtcactgctcctggccaatgagggcaactttttaaaaaataacattcatctgctctcatttttctaataaaacattgccatttattatatggctttattagtgttatctttgttgcaaaagtatatgtaatagtctctaaagatggttaagagtttgtgtcacatcaactgtatcaataacctattttgtattttattttcccaatattttaagatgaaaacttccaaatgtatttaaaaaggggatatgatatgttggaacagctgtatattgtctctctagattcaacaactgttaacattttgccatagttgctttatttttctttttatatctactgttttttttctttctttgactgaaccctttgagagaaaattgcagacatcatattttacctgtaaacatttaagcatgcagctcttaagaatgaagatatttttcagccaggcacggtagctcacacctgtaatcccagcactttgggaggccgatgcaggcagatcacctgaggttgggagttcgagaccagcctgaccaacatggagaaaccctgtctctactaaaaatacaaaattagccgggcatggtgtcacatgcctgtaatcccagctactcgggaggctgaggcaggagaatcgcttaaatcctcgaggtggaggttgtggtgagccgagaacatgccattgccctccagcctgggcaacaagagtgaaactccatcccaaaaaaaaaaaaagaacgaagacatttttctgtataaccataataccattattatacctaagaaaattcatttttttaaatttatttttaatttttgtgggtacactgtaggtgtataaaaaaataaattgtataatattgaatatcaagtttaaatttccctagttgtcactagagtgactattgtaattgttattttgaatcccagtctaatcaagtttatcaatcaagcacattaaacaagtctttaatcagtcaagcccctcacctgtttttttccccttgaaactgactttgaagaatctgagccagttttttacaatacgtcctgcattctgaattcatatgattgttttctcatgtgtgctctaacttgatcctctattcccttttttcctgtaaactgggaattagcattattagattcattctaaacattttttggcacgaatacaggacatgactgtactttataatgcatcatatcaagaggcacatactgtaaagatatctttattttagtctgtcggcttaactgtgatcagcttggatgattagagcttgttctgtacagtattaagtagttactattgtagaaacctgtagattttccaaaattcactaaaatatgaaaggattgagtagtttattattcatactgagaatacttaatttatttttatctagagatgtttttatcaaaataagagcaaaaagtaaatacaatttttatccgtaaaaactctaaaatctttcaaaaatctgtttaaatctatatagttttatgttttgtatttcctacttatttagcagaaatgatgaagaaactgttctgatggcctgcttttctgtccttttcctactgctttaaacattgattttcttttgtactaaatcatatagccaaatattgtttaagtaagtcagttttaggaaatgcttgtgttgctgttgaattataaaagctgagtaaatttcagattaaactttaaatgactgtgaaataagacataaactagttaatggtaatttgcttaaaatgacttgagattattattggaagtttttattaattgatacaggtaagaattgatatttaataaaatgttctcatgcttagactatattacttttcggtagagaaattagtattttgctgtaatgtgttatgaaatacatgtgatatcctagtttgtctactgacactggggtcttgaatcttaaaaaaaggcctccgatgaagcagaggaaagtggatcacagggaaaattggtggaagctctcaggcaaatgagaattaatcataggggaaactaccgacaacttctggaggagatgctgactagttacaggctagctaaagtagagggagaagaaagccctgctgaaccagctgccacagctacttcttcgaacagtgatgctggaaacccagtgacaatgcaggaaagccatactgaatcagaaagtggtcttgctgaattagacagctctaatgaagatgcagggacaaagatgagtggtgaaaaaatatgactttcctttttggtaatatttttgtgatctttgatggtttttaacctaggaagtgtaatgtatgcatttatataactgttttgttatttgaatcttggaaaactagttttattatattcagatagccttgttttttaaaaaggcctttgcatacacctttatgagatagtgtaaaattgactatttatagtactatggatttaatgaaattatatgtcatttcacattgtatgccagaaattaggctaccaattatgaattaaagtcagtagttaaattaatactagatagaattagaaattttgattagagagattatgctatattatggaaaaacttgttaatgtagaattatactgcttcatattattttacctattagtacactcatagttagctttgtaataaatttatgttttctttaataattttagttcttcaaagaatggctgatgctggcctgtaatttttctttcaaggatgataatttgtgtgttgtttgatttgtttatattttacatctctgtagttttatttttagaagttgtgagatattggatgtgtggctatttttcctttctctgtattctttatgaaacataacttttgaaaaacctatgtattattcatacagctttggtttgtatattctgtatagcctaactacacacatcaaaatgtatgtcaaccaagtgtttagaatgaaattataagtgtttaagtccaaataaagcatgtgatgtggaataatctatgcatgttgtacttatttttgaattaattttttaaaaacaaccaagtttggtatattggaagaatacccattagaaattcatttgtatttatataacatttagaacacttttggcttaccttttttcattaacaaaaaggaaaagtttaatattaaaatatatgtgttgcatacttaaatctattctttttcttatccatcttttgtggtacaaaatattaatctttggacattatgggcacacattagacatgtgagaaaattgccacagtgagcattttaaagattgcagaattgtccattttgttacaaatttttgttagttattaagaaattgaacaattatgggctatttttaaaatagtggcagatgagagtttttgtttaaagggatttttaaattatagatttgtcacatagggaaaaatattttttaaaaattattttataactgtagaacattaacttttcgtctttacgtttatatttatatcatgtgtctaaagttgctttaagttaccataaattgaaacttcggaatctttggatgttatagctgatgttttgatgtatttttccaatgccagaatatttttaagtgctttgagaaaggaaggcatttgatggagaggggaggaaaataacccaacccagttatctatccatattagatacacgtgtacacacacaatatgcaatacacaacatctctctgtaaaagtacccttttcagacaaagaaaggaaggtaatttgttcatcaattttgttttcttttgaaattcaatccaatctggaagtggcataggtaaataataatattcttccttttctcttcctgtagggtgctggagatctagaagacccatggtagccttaaaaaccttctaaaatgcttttgattctgaaaattgggggaaaaaacttttaatcacaattttcttcaatacaaggggaaaatattcttgcggattcccaacgttttgtgatatgagcagaaaatcattagcatttcccatcatttgttcatatttgtgttttctgacagttgccacttgtagcattgcctgtactacagtattttttgccaacctcaggcatactcgttacatctgtattgaactttcggccctagaaaccagtggagttatttcaccacaaatcaacaatgtgcctgaggtgcatgggaaatatagttagctatactctgaaaatacattatgttttttttctttaaacaaaacacacaacatgtaagcatgtaagagtaaagaattgtatgatatgttccttttttcagttcaccaagttggaagccttttgcagctctgtggcttggaatttcatttga

SEQ ID NO: 11856 - DNA, 1114 bp, Homo sapiens
atgaagagtaaagtatttatctgaaagaagtttctgggttaggagaagtaatgaatgtatccatttgtacatggtttacatgttgtggatgctttgtaaacattttcctgtatgtttaaattgtgtttcagcaggatgtaattgcccttgtgtgtagttaaaatgagtcatcatctggtcctttgtgaaatggaattcatggtattttctgtaacgttttcctgaagctgtttctggagagccacacatttaaatacagacagctttcctgatcatttgatttattgtgcacctgatttttggtctaaaaggaattattgccacaatatattttatttattctttagattttagccttgtaagttaaagtgctttacatgatgatgtgaaaagctgtttgtccctttactgggtttggggggttgttaaaagatagggaatgaagaatgcaaaatggtttatcgttcaaactgtccactctgatccaaccctgtactgatagtacttcccagtatgatattgtgatgtttcatacaatgcagtgaacataaccaacttgttacctaaataaagaattgataaaaacagtgtgacatattactatttggtatgattcagtttttaatgttattttaaacttcttatatggttggcatatttctgaaaatttaattccaaagaggaattaaccaaactgtacaggacaatattaaccccttctgtactctagaaatatttatactccttttaaaaaaacctgcctttggccgggtgcattggctcacacctgtaatcccagcactttgggaggccaaggcgggtggatcacgaggtcaagagatcgtgaccatcctggccaacacggtgaaaccctgcctctactaaaaatacaaagattagctgggcatggtggtgcttgcctgtaatcccagctgcttgggaggctgaggcagaagaattgcttgaacccaggaggcggaggttgcagtgagctaagatcgcgccactgcactccagcctggcgacagagcgagactccgtctcaaaaaaaaaaaaaaagaaaaaaaaaaacttttccggcagggggcagggtgggggttactggtgcttgaaa

SEQ ID NO: 11857 - DNA, 2342 bp, Homo sapiens
ataagctcctataagccataatttacttttaaacattttatttttttcaaaacatttgagaacctttcttaaagcagttacattcaagctacagaaatatcgaagaattaatgattgttcaccaagcagcatgctgtacatgaagctattacaaatgcttacaatcccactgaaatgccagtgtcttcatctcttcataaaggtgcctaacacgaggtatacagtatgttcagtacactggaatagcatgctcgattggaaacaaagcatctatctctgaaagctgtttggcgatgaaggagattcttcgtgttgtgttcaaagatgagtccctctcccttgtccagaaaaatgccacttgtatcaactttactgcctttgtcggcagaattggtacttaaccttattctcattttagcgggaaggcccgaaatcatattatgtagatttaacagtgttgattctccaaaattcagaaccacgataaagattctgtcgatgccatccagctctcttgtgtacacaacatagtggctgtcattcctcaaatggcaaaaccagcccctgttgaggagtagctcattggcatgaagtagacttaaatcttgatataacttcaaagccgatctgggctgagtcttttggacctatttttttaaaaaagtatttacgtaagtgtttgattctaagaattgtttgtaagtatttttaatatattgtaaggagttatttacccaaaacacttgctccaattttgccccttataattgccaaattgtaagcatcaataagtaggtaagaacaatttatataaaaactgatagaaatgacaaattcggggtttcggcttgtctgggagtcaataagtacgcacagtgctctgctacattgtagagtttctgtagagatcaaatttgactccactttaggagtcccaaagcaaatgtccatgtctaagatgaatatttaacttgcatagtcattctgtgctatattgtaactgccagatggccagaaagaaggcaacagtggactcagacttctgaggaatttgggtttgttcccctttgtagactaatgtgtaggttgctgttgtgcgaagatcgtgtaactttagcagacatgtatttcttgcacagctaatagaagacaaagttgaaaaaaaggatgcaaaataaaaagctgcctaaggtgaaagttagaaattgtagacttttttttaccataatagtatgtgttcattaaagatgatttgggtttattttacagctatataaaacataatttgatgatgtacttctaacctttcaagcattttctgttattgactatataatatagcctccataaatgtttttaatgacaatattctgttgaacggttgtaccatactcagccatgccctttcattttgacgatagtgtttctaatattttgtatttttattcccctccccccatttttgtattacttaagatagattatcagaaagacagttactttgtcaaagagtatgggcacttgatacataatgccaaattattcttcataagagctgttgccaaatcagtgataatgttcatttaattgtattcttgccagccatgtttactggggtgatagttgttattgtggttgttattgttctttaggggtaggttcccaatatgtggtctttaaataattatctaatggtgtttaaaaagatgtttattctgtttgtcaggtacaaagatatttatgatacatgtatgacttgtctaagttattaacattttctctagccttaggtaatgcatgaaagcacatgtttcagtgccactcacataagaagtgcccggtaagtgttagctattattgtctacttgagttactactttctaaaagtatgttgaagtctttttctgtaattgcagatttgttgattttgcatttgagtattttctatattttgaagctgttagatgcgtagtcatgatttttggtggaatgttttatcaatttttgaaaattgcctttgtctcatataatgcttttcatattgaactatattttgtctgctattaaatacttccaagcctgatttttgtaattttattttttattcaattacaagaatacatactataaaaaggttttcttcaacacctttccatagcttcacagttcccctcagagacaggcactatatgttcttttgtttttaatgtatcatatgtttgcataggcacagaatgtatcatttcatatgtttatatatttttctttacacagttggtgatatgttaccattctatactttattgaatacctgtttgaaatggtctcatatcaatgtatat

SEQ ID NO: 11858 - DNA, 1196 bp, Homo sapiens
atttcattatacattttataacatcaaagcaaaacatggcataatttcaggcactgaatcatcatccaactgagttgtaattaaggataagaacatcattaagttttaggtaatgcttgcaattgtaagtaagcagtgcctttctattcttctggaaaatgtcatttagggggtttcaacaattctcctaaatctagactgtaagtgccatgcttgaatttttttttggatgcgtgcccaacaataaataatccacaatgatctgaggacagcacttccacccaagaacttaatcagattaatgatgtatttgttttataaaaatgaagtacattaagcctgagaatacctaatttacatactaaatggttgctagggaccaaaaatactagtggtttttataaaatcgaggttacaaaattgtccattgtcttgaaatctgttagtaaatagcagtgaaatgcaaaataataaaccaatgttaattagtagtatttacgtatgtaaattcattagatggtgtactgttgttcaaaagaacctaacgatgctcatatttgaaaacatacgtgccccagagacaatgatgccattatatgaagttggaaataacagcaaacttacttataatgttttctaattgacttgacctcaaattgtgattaacatgctactctgatattttcatttagggtcctagtttaatatatgcaaacataaacagtaaattagcagtctaggtttctgccattttttgttggaaacctattagcaacctttatctaaaaatgggaggagagctttcacaaaatagctgaatttcaccaatccctaaatcagaggaatttacagcatctctggatgtttcttctggattgtcacagacacatacacacacacacaaagctgcttcattcattcaacatacttgtgttaattgatcttggggagacaatattgaataagacaaagtcactaccttctttgctaaggacattgccaagtaagcagataattaccatacagtaggacaatattacaattagggcataaatggagagcttaggtcagattgtcaatgaaagctttattttagaatgaaatcaaacatcagtccaaatatcctaaatgagttaatattgaaagacaaaaatttgttacttttagaagcaacaaattcctacagaagagcaaac

SEQ ID NO: 11859 - DNA, 1174 bp, Homo sapiens
tacaaaaagggatagttgtgcttgcaggaggggtagtgtctccatctcctgatgccagggagaaggaggcaggctgctggggtgacggagagcaccctcaactaggtcacactgcactccctctgtgcctcagtttccacttctgttagatggctgatatgatctctgccctgccagttggattggggcttccaaaatatcaactactgcaaaagaagaggttgtggccactgtgactcatatacatgtacatgaacgtatctgaagttttcagggctgatactgatgtgaggcaacccatgcaggcaacccggaggaactgtgtccctcactctgagacagtgagaacggactgagccggaaagctgatggccgtgagaggagcaggtttgaaaatcactgaatgaagtcatgttgtacagagggggcgggggtgcatactgtgggacggaggtgagtcacagtgcataagtgttggggagtcaccttgaacttgggccagaagagtagaaatattgagacttgggtttatctgcctcacatcaggtacatcaagttctggatggctgcccactggccagagacatgaggtggacggctcccttttgctgccctgggaaggccttctgctggcttcggccccactgagcaaagtctgcttgttcactggagttcacacagactccttgccaggcctgcccagaatcctgtctcctctgacttcctgtgctcttgcataatatttccttgctccctgaatggctggccccagtgcaggagcagctcactcacactgctggaccgagggcaggatgtagagggagggcagggatctgcaaacgtcacccaggggtgctctgggctctgagggtggagggcaagaggggcagagccccctcaaattctttggaagattatagcacaaggggagttgggaaggccctgggaccatgtgcacacacatctatctccatgaattgtctctcctgtaaaattatttttaaagttgctaagttgttttcttctgattataaaaaatatacatgttccccataaaaagtcatagtaaaagaaggcatggagataaaaataaaaatcaccaaaattccatcacccagagataaccactgttaactctttggtgaacatacttttctctatatcatgaatattg

SEQ ID NO: 11860 - DNA, 4199 bp, Homo sapiens
tttttggacacatatgagcgtggatattttgttgttttgtttttccttttttttttttttttttttaataaacagtgccatgaaagaacatggatattttggacgttagttaagcacttcttccggtaaaatgcgcaactcatcattgtctaatttgtattttgtaggaagggagtgaacaggcaccactaatgagtgaagatgaactgattaacataatagatggtgttttgagagatgatgacaagaacaatgatggatacattgactatgctgaatttgcaaaatcactgcagtagatgttatttggccatctcctggttatatacaaatgtgacccgtgataatgtgattgaacactttagtaatgcaaaataactcatttccaactactgctgcagcattttggtaaaaacctgtagcgattcgttacactggggtgagaagagataagagaaatgaaagagaagagaaatgggacatctaatagtccctaagtgctattaaataccttattggacaagggcttgcttcaagcatctgtattagtctgtattaatgctgctgataaagacgtacccgagactgggaagaaaaagaggtttacttggacttacagttccacatggctggggaggcctcagaatcatggcgggaggtgaaaggcacttcttacatggcagcaagagaaaatgaggaagaagcaaaagtggaaacccctgataagccatcagatcttgtgaaacttattcactatcacaagaatagcatgggaaagactggcccccatgattcaattacctccccttgggtctctcccacaacacgtgggaattctggtagatacaatttcaagttgagatttgggtggggacatagccaaaccatatcattctacccctggcccctccaaatctcatgtcctcactattcaaaaccaatcatgccttcctaacagtcccccaaagtcttaactcttttcagcattaacgcaaaaatccacagtccaaagtctcatctgagacaaggcaagtcccttccacctatgagcctgtaaaatcaaaagcaagctagttacttcctagataccaacaggggtacaggtattgattaaagacggctgttccaaatgggagaaattggccaaaataaaggggttacagggcccatgcaagtccgaaatccagcagggctgtcaaattttaaagttccagaataatctcctttgactccaggtctcacatccaggtcatactgatgcaagaagtgggttcccatggtcttgggcagctctgcccctgtggctttgtagggtacagcctccctcctggctgctttcacggctgttgttcagtgcctgcggcttttccaggtgcacggtgcaagctgttggtggatctaccattctggggtctggaggacggtggccctcttctcacagctccactaggcagtgccccagtagggactctgtgtgggggctcccacaccacatttcccttctgcactgccctagcagaggttctctcccctgccgctgagagggcctctcccctgcagcaaacgtttgcctgggcattgaggcatttccatacatcttctgaaaactaggcggaggtttccaaatctcaattcttgacttctgtgcacctgcaggcttaacagcacatagaagctgccaaggcttggggcttccactctgaagccacagcccgagctgtatgttggcccctttcagccatggctggagtggctgggacacaagacaccaagtccctaggctgcacacacatgtcaggggctgccctgacatggcctggagacattttccccatggtgttggggattaacattaggctccttgctacttatgcaaatttctgcagctggcttgaatttctccccagaaaatgggtttttcttttctattgcatagtcaggctgcaaatttccaaacttttatgctttgcttcccttatttataagggaatgcctttaaaagcacccaagtcacctgttgaacactttgctgcttagaaatttcttccgctagttaacctaaatcatctctctcaagttcaaagttccacaaatccctatggaaggggcaaaatgctgccagtctctttgctaaaacataacaagagtcacctttactccagttcccaacaagttcctcatcttcatctgaggccacctcagcctggactttgttgtccatattgctatcagcatttggggcaaagccattcaacaagtctgtaggaagttccaaactttcccacattttcctgttttcttctgagccctccaaactgttccagcctctgcctgttacccagttccaaagtcacttccacattttgggtatttcttcagcaggtcccaatctactggtaccaatttactgtattagtccgttttcacgctgctgataaagacatacccgagactgggaagaaaaagtggtttaattggacttaaagttccacatggctggggaggcctcagaatcatggtgggaggcaaaagacacttcttacattgtggcaagaaaaaatgaggaagaagcaaaagcagaaacccctgataaactgatcagatctcatgagacttattcactgtcacgagaatagcacgggaaagactggcccccatgattcaattacctccccctgggtctgtcccacaacacgtgggaattctgggagatacaattcaagttgagatttgtggggggacacaaccaaaccatatcagcatcctttcaagaatattagataattggagctgagtactcaggaacttgactgtagtagaatactgctagtttcttaattttaattcacatcacctgaaaagtaaaacaacaggctttgccaagtggatgcttttcagtaacagtgaagtggagtgaataccaaatgtttgccctggtggttcctatctcttcaggcaaacatggtcagtattctgtaaagttcccctggcctaaatgattacttgctctgggcaagtggatatttattaggctatttcaaagccacagcataagaatgtcagcctagccacagagtctgagattctgagttcagcctagccacagagtctaagattctgtatcctctgacattttggaaatgatacactactggcttaagtgatgactctttcagattttcagtattttatacaactactgccacatccttatactttattgcttttctgtcttcttcaacctgggagagaccctgaatttgagtgtgttctctaatcaatagtggtttagctttcttttctatttcactcgtttctagggttttttatttgcagtttaggaactattaggaatgtcaggactttatcagcaggggtaaaactaccacctggcctagcctaagtaggaagtgaaaagataattcaccaaacaatgattaatcagatagaagttctagtcaagagggatattgttgaagttacctcttttagcctagatacatggattcttttcaaatcaggaaagattagaaaaggaacccaaaaaaccctttaacagtgtgaatctttatagtatttgaaaatgagaagaagcagcagattgtaatttggtttattggatgtgatggacgttctgtaatagaaaacctgaaacgatgattgaatgggaaaaagagactacaaaatttgtcgtaggatgtatacagacttattttctttattacagtattataagaaaacatatgtatttgtaaaaatggtttcctgtgtcaagtatttgtgcagtcagagctgacttgtaaactattcttgtaatagctcattattttgaaagatttatatatgatgaattctggatatatgaccaataaaactgatgaagcaaaacctcgagcagttgattttgttcacatcagcttctcctgccacatgcagggtgtgtttactacaaatgttcacatgtgcctgctcttatcatagttcctgtgactatcttcggctataccctgctccttttgcaggagtcaattctcagaattcaaagttactttccccttttaggcattttttcttctgaatgaaatcacttttggatcttcattctctggtcaaatttaaattatgacaccattctctaggagactgcatagcgttttcccctggtctggcgactgttttttaatttgatagcattattg

SEQ ID NO: 11861 - DNA, 1180 bp, Homo sapiens
tccctctgctccttgttccctctctcggggagaccacaggtcctgtcgggcccggcgggggaagctgatctcctgttgtattccctctctgggcatggccatccacccgggtgcccaagccagaattgggcatcattctcacttgcttcactcctttacccacccacatcgaatcccttgcaaagttgtcttggatacgttcattctccagtcccatccccctgccctacctagttcaggccaccttttcttctctggactacctcggtgtcttcctgatgatccctgcatctcttcttcatcctctgtagtttgttctatacagagaggctacagccatggtcttaaaacagaaatctgatcatgtgaccagaagcgtccccccattcccttatcaccctttggtggattctcattgctcttccaagctcttgaacggggcttgcaaagcccttcatgacctgtcttcctttaactttagattcatttgtctcgactgtactgtgtcttcaaccatactgaatcttttttggttcttagatcagaacaagttccttctgggcttacatgttccttcagtatgttcgctatgtctgaggcactgtcctttggttgaaataatccttcttatcctttatgtgttatttcaggtgtcagttggggatttcgtggtaccccatgggtgtctgcctgccggtctctcttttctaccaggttgtaatctgtgtgagaggagtttgtcgaggtcatagtactatcttcagtaccttgtgctgttagtacggtcattaaatgtataaatgcagcatgggtgctccttgggctccctagatgaacaaatagatcaagttattaatattaaatgcctgctttttcagaaccaattctcaaccctcagtccgtgtagaggtttctttagcttaggaagttggttattttcttgccttcattccaggaccatgacaggggtaagtgacaaagtactggtcagtttttctttggcattggctgtgggtacaggatgtctggatgttggtgagtttggctgctttgggtttgaattcttaaccaagggccccttgagggagaagctgctactagctgctggcaggaaggctggccccaaacttagtgctgataggactgatgacacaccaggaagaaagggttgggccaggtc

SEQ ID NO: 11862 - DNA, 1265 bp, Homo sapiens
gcttcccctgcctgagagagacctgaggaggggacagagcccagcccctctcctgtggctgagcaggcctctgtgtccatgacacctgtcttccgggcctgggggctgtgggtgtatgtcctccctactggcttccccggcccctgctgcatgatgctcttggaactcttctccaaggagtcagtcccccaggcctatcaggggatccttttgtatctgcactttgggttttagtttcaaagctccatcaggtacagcttgcatttcaggatgtgtggaaagctcgggtgagggctgccctggttcatcatagctccaccttcctcggaaggagtgggctgttggagaccccccatccatggcacactagctcagcactgcatttcccgagatgattcccaagacagctggtgcctcctggctttcctgtgccaggccaaggggcaccacagaggaccctggatcctttgcctcttcttggttgaaggatctctatgtatgtgtgtatataaatatagttttttatctatatatataaaatagagatctattttttttctggaattctgttagaaaagtaaagaaaaagcaaatgctgttggtttatctcagggtgcccaaagtggttatagtcaatttttggtactaggaaaggcacccaatgcatttcctgacttttaagcatttccttgttggaagcagcagagggccaggccaagttgctgacagtgactttgcaggttgaataaagaaacccttggaggggaagcaggcttgtctgaagcagcatgtatattcactgggcatgtagctcccacaccagccttgagccaggccctggacaggaggggctgttgcaggatgagggaggccagagaaggcatcgaagccaagacctgggcccacctggggagggatgtgggaaaggaaggatgggagggaggaccctctgggaaaatgtggatttgagctggtgagagtgttgctaaggctgggctaaagcctggagagggtaggaggaggcaagaggggtccaggcagggctgatcctggcctctgacctgtccagggcgacccctgaagcccctgctgcctctgggcattgctgggagaggccaaggcaggactcacgtctgaacagagatcccctcgggcattgctgatgggccaccttcagctgcagggaagaagcctaggagaggaggcatgggagggacctgggccttgttcagattggccacctctgctgagaagtccataccagt

SEQ ID NO: 11863 - DNA, 1320 bp, Homo sapiens
atttacaatattgtcttgtaatccagcagacttaaaattcaagtctaaactaagagccaagaatgctcttttttatattggcctatctaaagcgttaatttggctcttactaataaacctgaatagttatggttaatgaagttccagcctgggcaataaactagcttccctctgtacttaatggtaattctgaggaaagagaggaatggaaagagtactcagtaattgagtaaatgtgattttttttttttttttttttttttggtcttttgctattgactcattttttgtgtacttcttctttttcagagtttgtacaaatgatgacagcaaagtgaagaccttgtacagaatgtgttaaatttcttgtacaaaattgtttatttgccttttctttgtttgtaacttatctgtaaaaggtttctccctactgtcaaaaaaatatgcatgtatagtaattaggacttcattcctccatgttttcttcccttatcttactgtcattgtcctaaaaccttattttagaaaattgatcaagtaacatgttgcatgtggcttactctggatatatctaagcccttctgcacatctaaacttagatggagttggtcaaatgagggaacatctgggttatgccttttttaaagtagttttctttaggaactgtcagcatgttgttgttgaagtgtggagttgtaactctgcgtggactatggacagtcaacaatatgtacttaaaagttgcactattgcaaaacgggtgtattatccaggtactcgtacactatttttttgtactgctggtcctgtaccagaaacattttcttttattgttacttgctttttaaactttgtttagccacttaaaatctgcttatggcacaatttgcctcaaaatccattccaagttgtatatttgttttccaataaaaaaattacaatttacccaatggttgctctgcatctgagtcatttaactgttgaagtctaataattttgaaaataaaatatggcattggtttctgcttggtatagtctagataattttttctcgtgtggggaagcatatggagatgggtggcagaaatagtgaaggtgggaaaggaaggagaaaaggattggaaaagtgagaaaagagggagagaagcacagaaaataagaggaacaaaataaggggtgtaactaaggagagattgaagaggaaggccgaaaagatggggatctatgggggctggcttagtgtagtcaccttttgggggccaccatcatgcgtgcccacaacattcctccaccaccatgtgtgtcgtactgtgctactgt

SEQ ID NO: 11864 - DNA, 1411 bp, Homo sapiens
gatttagacatagtggctaactctaaacacagtatacagaaacagtttaattactctgtagaaatacgtatttgggtaccagtagtcttatttttgttttgtgagtgtaggttaggtctgtaattttgaattatgttccacagagcagcttcagtgacagaggagccagtcatttggggatttggttcttttcctctgtaaacctaggataattttacttaggtcagcatgaaagtacagtggtatgattggtcaaagatatatttgaaatattatcataaggtatcataaagattggttaatctttaggagtcaaagtcacatttcaattgctacctccattggtatttttccgttaaaagtttttgggtttttctgagacgtggggtcttacagtttggccaggctgaagtgcagtggctgttcactggcacgatcccaccactgagtaggctttaagagttaatacgtttcatttaggttacattttattattaatctgtgtatttggattgtggtctttctttcaaacagaattcaaagaagctttttcactatttgacaaagatggtgatggaactataacaacaaaggaattgggaactgtaatgagatctcttgggcagaatcccacagaagcagagttacaggacatgattaatgaagtagatgctgatggtaagtcttcaattttgtggggctgggaggggttgaagaagtgatacttagatgtttccactaaacctttgctgtttgcttatatgtttccactaaagctttgatgtttccactaaaccatttcaggtaatggcacaattgacttccctgaatttctgacaatgatggcaagaaaaatgaaagacacagacagtgaagaagaaattagagaagcattccgtgtgtttgataaggtacgtcaaggactggatatgttaaattttgaggatgaaatgaagataccaggactcattatgaagacttgtgtttttttggttgtttttttttttttttttttttttttttttgatgatttaccaacatattttaattaccaagcaaaagctttttaagaattcagtatagactttctaatatatgtattgcgttcatcttgtcaaaggaggtgtcacttgactttgggactaggaaataatgatttcaatgtaggacattttgcttggctcttaatgacatttgtaggtcaactgtgtagatttgtatgcatttctaaagtatgtttttcccccaatgtgaaatttagtagtaaacttaataaatttccattccaactctcaagtctgtaatttgactcagaaactatactaaattttttgctaggatggcaatggctatattagtgctgcagaacttcgccatgtgatgacaaaccttggagagaagttaacagatg

SEQ ID NO: 11865 - DNA, 1201 bp, Homo sapiens
ttagcaagtgccaggcacttaggcagtagtctatagctgaaaaataaaacattcagaaccactttttaaggttttgtgtccttgtaactttaggcattattattacaatataacttagctgggacatgagagttaatagatccacattttaaagtagattttttttttaattttctagaatgtgtctgtgaaaactacaagctggccgtaaactgctttgtgaataataatcgtcaatgccagtgtacttcagttggtgcacaaaatactgtcatttgctcaaagcgtgagtaaaatatcctaattacctgtaagctttattttgacttaatacttctttaattgatgtgccttgagttggaaagagttttattggcttaaatctgaatcatgttacaaagtaagtgtgggaacacataaatttcaaataatctttgaccctggaactttagagttaattttttttttcccgtaatcatgaaatcagttatttttcagtttggcattaaggtttctttttcagtggctgccaaatgtttggtgatgaaggcagaaatgaatggctcaaaacttgggagaagagcaaaacctgaaggggccctccagaacaatgatgggctttatgatcctgactgcgatgagagcgggctctttaaggccaagcagtgcaacggcacctccatgtgctggtgtgtgaacactgctggggtcagaagaacagacaaggacactgaaataacctgctctgagcgagtgagaacctagtgagtggggctgcctatactacttgttttcatgctgttcagattcatttaattaaatttatttttgattatgtaatatgatttcatggtttagaattcagaagatatgagtgtccagtgaaaagcttccttctcattccagtccccctcgctacccattggacctccacagaattgatgttattgattattctataaccttccagagatagttgatgaatttgttatatatctgttttattatttttacataaatgatagcatactaggtataatttttcttttatatctttacttaacattattcagtatttcattgttgcattagtagtaaatgtatgtaatttaacctatgtatttgcttattgattgtgttttaaaagtgagatatgcttgttttagggattgtttaatgaaaaggcacagaaacccactca

SEQ ID NO: 11866 - DNA, 1152 bp, Homo sapiens
gaaagtaaatcaattttttctagcattaaaaatagtatgcatttaataaaaatcttattcttaatgatctagcttacctccaacttgccctagtcactttggcgatcttgtctctaaatagaaccttgaaaacacttaaatgtgtgtttccttgcaatataactttttctttttttatttaaataagtcttataaatgtgggaaaaaattatcttgtgttcctttaatttcatttttatttaatactattttcagaatgaacaaaagattgaaaaattatttagaatttttttctgtgctttttcctgtttcagataaaggagatgggtgagatgcatagggaactcaatgcataactatataatttgaagattatagaagaagggaaatagcaaatggacacaaattacaaatgtgtgtgcgtgggacgaagacatctttgaaggtcatgagtttgttagtttaacatcatatatttgtaatagtgaaacctgtactcaaaatataagcagcttgaaactggctttaccaatcttgaaatttgaccacaagtgtcttatatatgcagatctaatgtaaaatccagaacttggactccatcgttaaaattatttatgtgtaacattcaaatgtgtgcattaaatatgcttccacagtaaaatctgaaaaactgatttgtgattgaaagctgcctttctatttacttgagtcttgtacatacatacttttttatgagctatgaaataaaacattttaaactgaatttcttaactttgacatttcaaatttcttcttctttttcttttcttttttttttttttttgagatggagtcccactctgttgccaggctggagtgcagtggcacaatctcggctcactgcaacttctgcctcctaggttcaagcgattcttctgcctcagcctcccgagtagctgactacaggcgcccaccaccattcctggctaatttttgtatttttagtagagacaaagtttcaccatattggccacgctagtctcgaactcctgacctcacgatccacccacctctacctcccatagtgctggggttacaggcgtgagccaccgcgcccggcctctttttttctttttgttttgttttttctttttttttttgagacaggatctt

SEQ ID NO: 11867 - DNA, 1106 bp, Homo sapiens
tgaattaatgctgaaatgagttaaggctttgggggactgttgggaatgcatgattggttttgaaatgtgaggacatgagatttgggaggggtcatggcagaatgatatggtttggctatgtccccacctaaatcccatcttgaattcccatgtattgtgggagggacctggtgggagatagttgaatcatggggatggatctttcccatgctgttgtgatagtgaataagcctcatgagatctgatggttttaaaaacggaagtctacctgcacaagctctttctttgcctgctgccatccatgtaagacatgacttgttcctccttgccttctgccatgattgtgagacctccccagccatgtggaactataagtccagtaagcctctttttcttcccagtctcgggtatgtctttatcagcagcatgaagtccagctaatacagtgcttgaacatgtaatatctcaaatctgtaatgtactttttttttttttaaggagcaaagaatctgcagagtgttgtgcttagtaaaatgaattttgaatcttttgtaaaagatcttcttctggttcgtcagtatagagttgaagtttataagaatagagctggaaataaggcatccaaggagaatgattggtatttggcatataaggtaattatcttcctttttaatttacttatttttttaagagtagaaaaataaaaatgtgaagaatttaattgtgttttagtattttaagtagattgtgatagtagaatggtttgagacactttaatagcaattagcatgtggtttttaaaaagttgcagtttggctggtcgcagtggctcatgcttgtaatcccagtattttgggaggctgaggcaggtaggttgcctgagcccaggagttcaagaccagcctgcccaacgtggtaaagccccatctctactgaagataaaaaaatttaaaaaaattagctggggctattggcacacacctgtggtcccagctaatcaagaggatgaggttagaggatcacttgagcccaggaggttgaggttacagtttaactttcagaggccaaggcaggaggattgcttgagtccaggagtttgagaccac

SEQ ID NO: 11868 - DNA, 1136 bp, Homo sapiens
tatggaatggccaggaatatagactggccagggccaccggaatctgtgctaacgggaaagggctaacagagcctgacagtgagccaggggtctgcacaatggagaactctccactggtactgaccaggaacctgtgttgccctttgacctaggcaaaatagacagctgcctgtgtggtagatagtgaaaatcagaaaagactccagtgccccctcaatgtagttctcctttgtgcctgatatcccctcatcagcagttctcacctttgagttttaatggattcaaatggatatgtttctggagagggggagggtatcacacgtgaagacccttctcttcagcactgtatttctcccatgatagaagggcccttagcccccacccctgctgcccccaaggcctagagcgtggtaggggcagggtgcctcagtgggacagatgtgtagaagtccaaccttcttgacttccttgctttgctgtgagcatcacagcagtgcgcgaaggagggggcaggcaggggaaaggggtaggcttgtgtgaatggctgctgtgaattttaattcaattcagtctggctggcttactgaatcaatgttgggaaaacatagcgctctcctgggaggagaggtgtttggtataaatagaaggtattatcattaagaggcaattaggggacgtcatgtcgctcaatacagcgcaaggcagcagccagagccccagccgtgggctgcagagctacaaggaactgctttcatttacttgtccctggagaaaaagactttcctccattccagggctctctctggtcccttagccccttctctgctggataaattgagccaccttattctcaggggttgctcgatggggtcgtaaccacaccagtgaactaaccatagaaaggggttaccattctccactcaaactctgagcaagagcattgccttccctcacataccaccttactctttctaaacagctttattgaggtacaacttacatagcatacaatttacccatttaaagtatatgatttgtccaggggcggtgactcgcgcctgtaatttcagcactttgggaggctgaggcaggcagatcacctgaggtcagaagtttaagaccagcctggccaacat

SEQ ID NO: 11869 - DNA, 1136 bp, Homo sapiens
agtcacttgaacccaaaaggaggagattcctcctggacaaaataaaactttctgtccatatatagaagatcgtaagtggcactggctcagcacaaggcttcaggttcctcaatttggaacattgaacagatcaggttctgagtcctctgcaggatcttgaagacagaattgactattctcagttgacccctgggcttccctcgggacaggctttatagcctcacccgcttaatgcatccctgaagcctctcaggcacacagcatctcacagcagtgctattgagggtggactgtctgtgggtatgggaattccatatgggtgggtatgatggatccctcctgcaactggccactaacacagaatatagagagctggcttatggaattaacgaagacctcatagaaaagtgaaaattgggatgaaatgccaacatagcgctgggtgctgagatacgatcagtgaactcaaatttgtggctggtttgagctgggcactctccctcttcagctgcccagagctcccacctaccagaacccactctcaggaaaggcctgctgtcagccagtaacttccatctttgatatcagtggaagttacttgacccttctcctgtgggtgtctgcactcccaatgcagaatggaaggcattggtcccaagttgaggaccatcagccctcaactagcatgttagggataatcttttggggcaggaggattgccctggtgtccttaaaattcttccctttctctgtctgagtcaggctggacttggagaaccctgagatctgggctgtgaaacgtctcagggattactttccactttcggatgaaataaacaaatatagagaagtgtcatctcctccaccactataaaaatggggagccacccagccccccagggctcatctgacagctgtaaacaccaccagctgaaacccaggtggtgtgctcagctttctgttgaaagaggcactttagaatgagaccttctcaaggtcaaaggccttgagtccagactgggaaagagcccaatgtgcggtgtgatttcaggggctgggaaggaagcctcctctccccaccaccaaacttgaaaaaaaaaatagttctaatctgatccttgggctgtgtttaaaat

SEQ ID NO: 11870 - DNA, 1105 bp, Homo sapiens
acgaagggtcatatcagattctgagagtgacattggtggctctgatgtggaatttaagccagacactaaggaggaaggaagcagtgatgaaataagcagtggagtgggggatagtgagagtgaaggcctgaacagccctgtcaaagttgctcgaaagcggaagagaatggtgactggaaatggctctcttaaaaggaaaagctctaggaaggaaacgccctcagccaccaaacaagcaactagcatttcatcagaaaccaagaatactttgagagctttctctgcccctcaaaattctgaatcccaagcccacgttagtggaggtggtgatgacagtagtcgccctactgtttggtatcatgaaactttagaatggcttaaggaggaaaagagaagagatgagcacaggaggaggcctgatcaccccgattttgatgcatctacactctatgtgcctgaggatttcctcaattcttgtactcctgggatgaggaagtggtggcagattaagtctcagaactttgatcttgtcatctgttacaaggtggggaaattttatgagctgtaccacatggatgctcttattggagtcagtgaactggggctggtattcatgaaaggcaactgggcccattctggctttcctgaaattgcatttggccgttattcagattccctggtgcagaagggctataaagtagcacgagtggaacagactgagactccagaaatgatggaggcacgatgtagaaagatggcacatatatccaagtatgatagagtggtgaggagggagatctgtaggatcattaccaagggtacacagacttacagtgtgctggaaggtgatccctctgagaactacagtaagtatcttcttagcctcaaagaaaaagaggaagattcttctggccatactcgtgcatatggtgtgtgctttgttgatacttcactgggaaagtttttcataggtcagttttcagatgatcgccattgttcgagatttaggactctagtggcacactatcccccagtacaagttttatttgaaaaaggaaatctctcaaaggaaactaaaacaattctaaagagttcattgtcctgt

SEQ ID NO: 11871 - DNA, 1168 bp, Homo sapiens
ggctactcagtaaaattcataatgttgggtctcccctgaagagtcagaaccacccagacagcagggctataatgtatgaagaaactacatacagcaagaagaagattattgattttctttctgctctggaaggattcaaagtaatgtgtaaaattatagggatcatggaagaagttgctgatggttttaagtctaaaatccttaagcaggtcatctctctgcagacaaaaaatcctgaaggtcgttttcctgatttgactgtagaattgaaccgatgggatacagcctttgaccatgaaaaggctcgaaagactggacttattactcccaaagcaggctttgactctgattatgaccaagctcttgctgacataagagaaaatgaacagagcctcctggaatacctagagaaacagcgcaacagaattggctgtaggaccatagtctattgggggattggtaggaaccgttaccagctggaaattcctgagaatttcaccactcgcaatttgccagaagaatacgagttgaaatctaccaagaagggctgtaaacgatactggaccaaaactattgaaaagaagttggctaatctcataaatgctgaagaacggagggatgtatcattgaaggactgcatgcggcgactgttctataactttgataaaaattacaaggactggcagtctgctgtagagtgtatcgcagtgttgggtaagactttgaacaagcttgttctcaggctttgataagtagtgctgtttgccagctgtatattatccctaaaaataagtaataaggtatatatggtacatattttgacatgcatatacatatttgcatcctgactaggctgcccacagcaatttaagttacttgaaactcgcttttatcttagtagccctttggcctttcttcagtttttttttttttttttttttttttgagacatggtcttgctctgttgcccaggctagaatatggtgacacaaccatggctactgcagcctcgacctcccaggcttaagtgatctttccacctcagcctcccaagtagctgagattacagatatgcaccaccatgcatggctaatatttaaatgtttgtagagagatggggtctcactgtgttgccaggactggtcttgaactcctgggctcaagtgat

SEQ ID NO: 11872 - DNA, 1098 bp, Homo sapiens
aagaactgcatagtctctctctcttttttttttttttgagatggagtttccctcttgttgcccaagctggagtgcaatggcacgatcttggctcactgcaacctctgcttccaggttcaagtgattctcctgcctcagcctctcgagtagctgggattacaggcgcatgccatcacgcccagctaattttttgtatttttagtagaagcggggtttcaccatgttaggctggtctcttaactcctgacctcaggtgatctgcttgcctcggcctcccaaagtgctgggattacaggcgtgagccaccgtgcccggccaataattgcatagtctcttaatgagatttaatcttttataccaatatgtgtagctcatgatagctatataacctagaagatgaatttatgtaatatgatttgcaaaatgagtattcatttgtgatttttttttttttaaggtgaaagtacattttttgttgaattaagtgaaactgccagcatactcatgcatgcaacagcacattctctggtgcttgtggatgaattaggtaagacattaaacttctcatttgaagactatctatcttaaaaacatttgtacaaataactatttttatagaagattatctgaagtacatttaaacaatatgaatgtttttagagcacgcactcaccattgtggcacagaccgatagttggagataaaaggtgatattgtgaaaggtttttgattacccattaattattaggccttacactgtttagttgtaataaaacatttgttatactacggggatgagaacactaataggaggactcaggaagtttatgaccttgagcgatactgtattttctttaaaagaaacctcactccccatgggctgctaagcagactcgtgtagctaaacaaggcctatttatagaatgcttttagacgtggatgtactaaccgatgttgcttttctgtcctagcatttttgttttaattccttttttgttttaattcctttgagttacttccttatgcatattttactttaacaggaagaggtactgcaacatttgatgggacggcaatagcaaatgcagttgttaaaga

SEQ ID NO: 11873 - DNA, 1100 bp, Homo sapiens
ggtcatagtaatatataaacagaatggaatgttttgcattaatgacatgtttgagaaaagtaatttaagcttttgctttttagatgtcatacttgtaacaccacagatcgaaatgccatatgtgtgaactgcattaagaagtgccatcagggacatgatgtagagtttattagacatgataggtatgtagcacacttgcttgatatattacccaattactttccccctcacttttctaatatttgggtttcattttgctttaggtttttctgtgactgtggtgctggaacactgtctaatccttgtacattagctggtgagcctacacatgatacagatacactatatgactctgctccacctatagaatctaatacattgcagcacaactgaattccttccctaaagaaaaagtcctgccattgtaacatcataacttaaaacacttttttggaagaagatttaaaatatttgcccatgctacaggaagagactgtattaaaaatggatacacaaggtcagttgacactatgaagctcaagctaccaaaaagaaagtggcaatatattgactcaggatctcaaagctgggtgttttagcattactgtgtaaagacttgaagggacagaagtgaagaaaataagctgcaattttgtacagataccaacttctgaaaagctggtgtttttacaactagcattgaatgcagtccaatttgcagtagtaatcttcaatagacaagcagctttgttgctgcctttatggacatgggtaccaattgcttttgtaatatggtaaaaatgtgagctagcacttctgcgttccttttgattttttttttttaacatgtattcagattgagaaatatgattttaatgctttaatctcatgtagtttgtttttaatttcaagcaaaatcttactgtacttgaatgtgccctgttttgttagcacacctagacttgctgtaactgtactcatgtcccagtatgtacgttctttctatgaaagagaaaacactaatcttaaattatatccagcaatgtttctggtatcctttaagaaaagttaagactattatttccttcccttccctgtgc

SEQ ID NO: 11874 - DNA, 1157 bp, Homo sapiens
agtttaagaatctaaagtattacattgataattgtttcctttgttgcagaactgtaagagtaaatgggtccagtaattggaatgactccagataagagagctgaaaccccaggagctgaaaagattgcaggattaagccagatttacaaaatgggaagcttgcctgaagctgttgatgctgccaggccgaaggccactctagtggacagtgagtcagcagatgatgaactcacaaacttgaactggcttcatgaaagcactaatcttctaacaaacttcagcctcggaagtgagggtcttccaattgttagtccattgtatgacatagagggagatgatgtgccatcctttggaccagcttgctaccagaacccagaaaaaaaatcagcgacttcaaagcccccatactcctttagtcttctcatttatatggccattgagcactctccaaataaatgtttgcctgtcaaagaaatttatagctggattctggaccattttccatattttgctactgcaccaacaggctggaagaattctgttcgacataatctgtccctgaataaatgttttcagaaagtggaaagaagccatggcaaggtcagtgtttatgaacattgctatatttggtgaggtggggggactaattaacatggagcccttaaaatatctggaaatcggggagacaataagtagtcaagtcaaattacttcagctgaactgaattatattcatttgttttcacttgagatgttttaaaatttcttaaatattgatataaatttagcagaattatgttttgtccactataggtacctagattagtctttttattattttagttctttgtttctagtttctgtagtgttcctataactatcagcatttgattctttattcaatatgataatctctgccttataatcaaagtatagaccatttaaattaatgaaattgatatggttgggtttaaatctatcaccttgctatttatttgattttcttttccacttttcctgccttttgtgggatgaggtgttcttcacttttggttttggtgttttggtgcttttttttttttttttttttttttgtgagacagtctcgatctgtcacccagcctggagtacagtggcgcgatctctgctcactgcaac

SEQ ID NO: 11875 - DNA, 1202 bp, Homo sapiens
attaacattctgtgtagggaggggaggcttattcaattcttctgacctcagaactggcagaaggtcagatgtgactacagaactctaggtgaaaaatcaggtagggttcaaattaagtagaactgcccttgccggaatagtgatcttcaaaaaacccttgcttttaggggagggaagcggggaaggaaaggaatgagggaggaaatattcctttctagcattcattttgcttagatcactccattgtgagtttgaccattttggagtcaaatgagcagacttccaaggagttgaccagtttgtgactagtctggtcacctttccagttacaggatcatattaactgtgtaaatgaattcatgggtagatgatttgtgcagatctgaatttaagaacatttcctttttctgtgggaatcacaagagtttatccactaaaaaaagatatgtaaaaaagatactttccagcacataaataaaggctggaattttacaacctgatgtatatattagacagttctaggatgttagttcccttcattccagagctatgcttgtgatacagccccttttcttataaagtcagttagaaggacttccttaacaatgactattataatgtcttacttaaaatacagttttgtattctgtcaatgcaaatataagacaggttgagccttaatcatgtaacaaaatattttgtagattacatattgatttttcaaaaattaaaaatgtatttcaaactattcttactgtgctgtgaatttatatcttcttctgcaagacctggggctatttttttttcttaaggtatgaaatcaatttcaataaccttaaacaattgaccctctgtcaggcatatgtcaggctccactcttaaggagtcagtgaccatgacctctttgcatatcctggaaaaatgacatcatcaaagtatagttgataatgttataaaggatgattttaaaaatagggtataatcatgactcacaaagatatgaggctgggtgtggtggctcacgcctgtaatcccagctctttgggaggctgaagcgggtggatcatgaggtcagaagatcaagaccatactggctaacacggtgaaaccccgtctctactaaaaatacaaaaaaaaaaaaaaaaaaaaaaaaaaaattagttgggcgtggtggcgggcgcctatagtcccagctactgggg

SEQ ID NO: 11876 - DNA, 1223 bp, Homo sapiens
tggacctggactggctagaagacactctgtggcaaaagaacagctgaaggccctagagaaaaccaggtacagagacaaggaaaatggggagccaaagaccaagcagctcagagaagaggaggaggaaagcaagaagctcagggaattcaggctgcagaaccatgtcccagaggatgaggacctgaaaaggaggagggtttccaggccaaaccagttgcagtggaggagaagatgaaggagaagctgtaggcagccaaggcacagcctgtcattgaggagacggacctggccaaccttgtactctagaagcctgattgggacctaagagagatgcgggcaagaacctggagaaactaaacaaaaagacttggagggccattgccgagctgatccgtgggaggctaaaaggcccaaatgacagcctagtctctacaggggaagccaccactgaacaagaggcctgtgacaactgaagtgtgccctgtctctgtcttgctcccattaggaatgtcctgtaggtggatggtcttgggcagagatgggggctgggttgctgtcacctccagtttggcttctgagcagtgactccctgctccctaatgtctgaaatttccagtgaagtcaccttcttgtctcctgcgtggtctctgctgttcttggggaggggcagtgaggagagccagcaacaactctctgaatgtgcctttgtctgtacatatgtatttgaactttttttaatctctagaaataaacacaagtaaactcccccatctggcagaaatctgtgaaatatttcctaggtcaagcagtgctgtgggtttgggctccaagacagggtggcttcagaggtggtgcttactacgaataatccctgtttagggcttgccatgttgaagctggaggggtggggaagacacagggctgaccttctgggtccaagttctggtccagtccatggtcagtggtggtcatctcaaaacccttgggtgatagagacagggtatgagagttcttttaagacttcccccaggtctaggcttttcagtagtctgaaggacagctgaagaggctcccatcctggttctgtgtggagtcgtacacagtataagaaaaagaaggaacactgggccttgccaagccccaatttgaggccacttaagatttgaggcccctggcactgcttttcctcactctgcctagccccaggcagcccctccctctat

SEQ ID NO: 11877 - DNA, 1187 bp, Homo sapiens
aaatttttactaattggaaaagaaaaactagttggtactttaagaaggaaaatagtgcattttcttgatgccagtttatacttagtagaatgatgttttaaataatttattaaaccctaaaatatctaacataaaatttgaattttgggggttaaggtggtgctagtaaggtaataaaattaaaagagcaccttttctgtttacatataggaacattaattttgtttcaaatgtatttaaagacctttttattaagcaataataagtgtaacattctggagtaaatatatagcatgtaatagtttaatgttgttggtagaaggtacaccctagacagaaatatttctttaaatgaatcagttggtaattctgaaaaaaattgtgctatagaaatgttgcctacatttatgcacatatacaaacactaaattctcctgaatttgtgtatttatagaatcttggacttgttaataccacttactaaccgggcctgtgacactgggctaaacaaagtaagccctgtttactcagcagtgtttgggggacatgaagattgcctagaaatattactccggaatggctacagcccagacgcccaggcgtgccttgtttttggattcagttctcctgtgtgcatggctttccaaaaggagtatgtatatttgctatgtttttattttttattcttttttgctgtatggagatgtgttttgaagtgactttctttcacgatgaaacttagtatctctgttagtgctaaattgctatcttggaacacaaataggaaaaaaactatgatgtttcagtcaagctgaagcagaaatgaggtgataatatcacattgttttccttccttctttggatctggattatatttttagtgtagcaatcttagggaatacgtacaatttaagtagacgcagaaatttgctgatatttttggtcttcaaaacaattcaagaattaaaaatggggctttatcaagtaaggcagtgactgcttcaggtcatttaccgtttcaaatttataagatataagcctaaaaattaaactttagttttatagatattattgtgtttttaatgtatttggtggatagcattaaaaaaaattttttttttttgagacagggtctcactctgtggcccgggctggagtgcagtggcaccatcttgactcattgcaac

SEQ ID NO: 11878 - DNA, 1187 bp, Homo sapiens; identical to SEQ ID NO: 11877

SEQ ID NO: 11879 - DNA, 1187 bp, Homo sapiens
tgatagtttgcatttttctttttaaatgtttacttattgggccccagaatgcttgttggaggagggattggaatgaaatgtatccttcattgaataggatttttgttttagcttaaaaatgaattctaagatatgaatcacttgttttcttgctgacgtagaggcaagacctttttatttttgatagagacagggtctcactatgttgcccaggctggtctcaaacacgtggcctcaagcaatcctctggccacagcttcctaaattgctgggattccaggcatgagctaccctgtcagtttagcgaagacaatttaaatgattaccaagaagttagcaaagtaaatatgtttatataacaacatccaacattcagtgaagagggaaaagcttaccgtgctacgaaacccttttatggtagttcctttgaaatttgtgttgatttttttaagtattagggttatctgttaaatgttttattttgtacccttaggtgcaaatgtcaattgtcaagccttggacaaagctacacccttgttcattgctgctcaagagggacacacaaaatgtgtggagcttttgctctccagtggggcagatcctgatctttactgtaatgaggacagttggcagttacctattcatgcagctgcacaaatgggccatacaaagtaagtgttaaaaacagaaaataaacatggtctcttaatcaaaagctaataaagaataaatctgggctagacccttcacctctaggcaaagtctttgatattctcttccctaccaatctgctgggtgaacagatctacccctaatctgtccttcatgctgtcttttgctcctactattcctgcactttcatattgtgaggcagaattgctacagactgggtaggctcagggactttctcggggtgttgactcttcccattgatttctctagttatggctgtatccgccgcctcctcctccctagttttatcccaggcatctttaagcatcaatctgatgaggccatccatgttacctctctgaccccagaaagcttttgagtttgtgatgcctgttggagtgtgtgctaagtagtcctccctgtcttaaaccctttgactgaacttttcttgatctaacctcaaattggagagagagtaaatgggggttccaggaatcttagaagctagtaacttg

SEQ ID NO: 11880 - DNA, 1187 bp, Homo sapiens; identical to SEQ ID NO: 11879

SEQ ID NO: 11881 - DNA, 3103 bp, Homo sapiens
ctggagtacagtggtgcgatcttggctcactgcagcctctgcttccctggtcaaatgattctcatgcctcagcttctgggtatctgtgacttcacatgccatcacacccagctaatttttgtatttttagcagagacagggtttcgccacgttggccaagctgttcttgaactcctgacctcaggtcatccacccgccctggtctctcagtgtgctgggattataggcatgaaccaccatgcctggccaccagctgatttttaaaaattatttttggagagacaggttctcactttattgccctggctggtctcaaattcctggcctcaagtgatcctcctaccttggcctcccaaagtgctgggattacaggtatgagccactgtgcccagctgacaaattcttaaatacagaattatttttagtttagcctcaaaatcaagtatttgatgtgtttacatgtagattcattttaaatgcagaaattcacatattgaaaacaacacaattgaaaactaattttatctcactgtaacaagtgcattagagacatatatatatttgcacaaatgttgctattctctttgcagagttggtcaaacgccatgctggggtgctaggacttggtgcatgtgttctttctagtccttacgatgttcccacctggatgccccagctcctcatgaatctcagtgcacatctaaatgatcctcagcctattgaggtacagttcttccttattagtttgtacgtgtattatcagtgatgttttctaagaaaccataataataatttcctatacactctgaactaactgctttcataaagctgctgcctctgccaaggcttagtctgctcaccagtaattattaaaaaattacagagaccttgctgccatggatatttgagatcttttggtagtgaggaaattattgtagcttctatccctcccagtccaatggaagtaaagtactgtcaatattgttgtgataaattttatgtttctatttttctagcactgcaaagtattttactggaagctaatattaaataggaaattatgatggcatttttagtaactcaaaagaccattcactttgtccttctcattggctttttggttttgtagaacttggtattgtgtgagatctgaagtctagagggacggtaatttaactaaaagtatcctacatatgatcctggttgtccagagaggttaaaacgtatgtgggttgtctactttacagatgactgtaaaaaaaaccttatccaatttccgaaggactcaccatgacaactggcaggaacataaacagcaattcactgatgaccaactgcttgttctcaccgatcttcttgtgtcaccatgctattatgcatagaaaggtaagtcagcaaagttctgaatttacattggtttggtgactgagaactagatatttattgttttttttctttttgctgacattcttagatgtcagtgtttagataaagttggatggcggggattgtttgtttttaaacatggcttttgctacggccattggaaatgagaattttgctgtgcctccttgctttaggtttaaagcagagaaaatgtgtgactgcttttggacctttgtagatgagtggtgtcagcctgggaatagttagataaaggaaaatacatcttattcttggttgcctcctgggtggggctgggacattttgtgtggccctgaggactctgggttctaaaagttgtgagaacttgatctggattcttacacccattctgttaaagagggagtacccagaagcctttctactggaataggaagaataaaaatttcatttattaggcttttagagttggatgtcttgttacctaattgaaattttttcctccctgatacagatgactagtcctcacttcaggctcttttcatcaaaaattccacaccctcaggtaccatctgtggtggctctctgcaagttttaaaactgcctctgctgagctctcatcattttggtggtttctgtgttagatctcgttagtctgcattccacagcttctcagttgccatttgatttcccaacttgtccggaagtgtttccagaatactgatcactttttttttttgaggcatctgacaaagtcacaaagtctcagactagaaataattacccagtatgatcatggcatccaagaccagagtctcagaactcattaagaaacagtttacttggaatggagaatacccatctgtaatacaggtcctgtcatttcattcatctcaaattattttgaattcttcccaaatggctgctggatttaggtggtaataggggctgtgggccataaatctgaagccttgagaaccttgggtctggagagccatgaagagggaaggaaaagagggcaagtcctgaacctaaccaatgacctgatggattgctcgaccaagacacagaagtgaagtctgtgtctgtgcacttcccacagactggagtttttggtgctgaatagagccagttgctaaaaaattgggggtttggtgaagaaatctgattgttgtgtgtattcaatgtgtgattttaaaaataaacagcaacaacaataaaaaccctgactggctgttttttccctgtattctttacaactattttttgaccctctgaaaattattatacttcacctaaatggaagactgctgtgtttgtggaaattttgtaattttttaatttattttattctctctccctttttattttgcctgcagaatcgttgagagactaataaggcttaatatttaattgatttgtttaatatgttatataaatgtaaaagagtgtataaactgtagagatagcattggcaagacattgtacagatgcaaccttttacacaacatcattgtgtaatttgtaaagattcacgtgtagttctttattatagtgattttgggctttgtacccactgaatgccattttttgtgtttttaaattattttctttatcttgttacaaaaactgagatgtggggttttttttttttcagttcacttatcattagaatgtctgaacttttatgtaacatttttgtgtgcatctctcaatgcta

SEQ ID NO: 11882 - DNA, 1168 bp, Homo sapiens
ccaaactcacccaggtttacaaaaatgtcagagaaagaataggaaggtaggtactgttttctctgtggtgtacctctcgagttctttgtttgtttttttttaaattgtaataggtaataatacatgctggttatgttgtcagtgggtttcatggtgtctttctcaaattgtttgctattgtgtcgtgggaaacaagatgaaacactctgaatgtaaactaggacagcagtgtgctcagaagccagagatgagcagtcacaacacctaagtgttaataccccttaattataaggcttcttttacacacaggcataatctaagacccactccaggaattgtcttgggacagtttactttgattgggtcataacttttgaacctcatttttatttataatgtggcacctcttcctattattaagtattttattttgcagtgtgctgacctacatattcatgatagatgtatctttgccaaataccacaccaaccatatcgcctcatgtccctgagtttactgctcgaattctggagaaattgaaacctctcatggatgtggatgaagaaattcagaaccatgttatggaagaaaatggaattggtgaagaagatgagcgaactcagggcattaaactcttgaaaaccagtgagtggataaaattagtagaaactcagttgaaaacatctatttgattatcctgtagagttttttgcaccactttttttattgtggtaaaatagacataatgaaaaatttactgttttaaccatttttaagtgtacagttcagtggcattaagtacattcacatccttgcgcaaccatcatcaccatttatctctagaatcctcttcatcatacgaaactgaaactttgtaccctttaacaacagctcctcattttccctcccctcatcctttataaccactgtctactttccatctctgaatttgcccattctaggtaggtcacataagttgaatcataagtcttttttgtgtctggcttatttcatgttacatagtattttcaagttgaatgaatgaatttctgaatcatgttgtgtccttaatctgttacccattcatctgtttgctggatatttgggtttccacctttggctattgtgactaatgctgctctgaacattgatgtttgtataagtacct

SEQ ID NO: 11883 - DNA, 1175 bp, Homo sapiens
gacaagcctccttctgaatactttcctatcaaggcaagcattttcagtactttaggattcaagaatatgttgattttttgttttaagggattcaaagtgttattttttcttgcatatgttagttttttacttttaagatagattattgaaactattattggaatatgtgaaacttgtgctgtctcactttgcatggaactgaaactctagttttctttcctattgatatgtgaaacaacttcgtatatattccttatctaatgtctatagttcaatataattttattgctaaactaagcctcacttaaactcatcatcactcttacagtatcactcttagagcaaactcatattataatgagtactcttcggggagacttttttcaggagtgataacgaagaggcagtaagatgttgttttcatgctacttttttgtatatcatttgctaccttaggtttggattatgtgtacattttcttttaaattttaaaaattgtgtatatgtatgtgggtttgttgttgttgtttttaatttctcaacttgctgagtagatgctgttctcttctaggactggggcaaacccggggacttgtggaatctgggaatccagtggcatgttccttcttcagaagaagtgtcttttgccttttatcttttggactcctttcttcagcctgagctcgtcaaactccagcattgtggggatggaaaacttgaaatgtctaggttggttttattttataattagagttattcagttgcagactaaagaagtcttttttggctttatctgtggcatatctcatgtattaattttcaattgtgttttgaaaatctgctatacatgtacttagaaaatcatttaatataatgttgtataacagaaaatttaacaacatttaaacattttaaacccaaaaattgtgggtttctttttctaattttttttattaccttctacttagcaatttcacttgtcttttggaaggtgtgtgtagatatgcctcctttgaaaggaatgcctgttttcctagactcagctaagattttattgggttctcaaaattttattttaagaattatttttatgagatttttttttccctctcccacaggtatttaacaagaaataagtatttgaaaccattagactttcatagtttgaaagtttc

SEQ ID NO: 11884 - DNA, 1182 bp, Homo sapiens
aaaatataatcttgtatatatttgcctttcaaaaaagccttacttatacaaatacattttcagtgctgcccagaagaatctttgaagctctttgttccccactgctgcagtgttataactcagcttacaatgagtaagtcataaggtcattattctctctttacaattttggataagtttttttcttggtttctaaaactctgttaatgacaacagattcctttagcttcacaatattttgattggcaatttggggaaaatttgtctccaaaaaagatatcatccaggttggcagtagcttaaaaatgttactttattaatattcttatacaaccaccattcagaggttaccttcaaaaatatcagttattttgtgagatatagaggggcagaagtcttggttggtgtgtttattttcttgaaaattctgtttctacctccttttggaacaagctcagcttcatgaagaagaaataaaaagtcttcctaaaagaggttttcctcagctattggaaatattaaatagaagtattttaaaatgctatatttagttgaatgcataggtttttccccctaatagtattttgctgtttttagatgatgatgtattaaatgatgaagagctagacaaggaattactatggaatcttcaacttttgtctgaggtattgtaaatctttggaataagaaacatgactgtgaaaacactgacttgcttttaggatttagctctttctgacaaaatgactttaaaacatatgaaaagtcagagttttggaaatttgatgaggcttcagaagatcagaatatgtcatactcttattgtcaaaggagtggtgtagttgatcactgcatgttcagccatctacttagttttaccagttaattctaatatgggtaactcattaattgaaaaagttgatcagatttgggaatttttttggtctacactttaaatttggccatcaatcaaacttcagttttcttttcttttcttttcttttcttttttcttctttttgtctcactatcgcccacgctggagtgcagtggtgcaatctcggctcactgcaaactccgcctcccagcttcacgccattctcctgcctcagcctcccaagtagctgggactacaggcatccgccaccacgcccggctaattttttgtatttttagtagagac

SEQ ID NO: 11885 - DNA, 1236 bp, Homo sapiens
ttcctagaaaggttaaggagaaaagcatgccccatcccacttctcctcccatttcccactcttgaaatagcattgttagcatctgatgtgagccagaggagtatttgaggctgtgccatatgtccttgttagaaacactgagcttataatgactaagaaactccagggggttgtctaaaccaccaaggttataaagggcacagcatcatcacagctgaactaaaatttaatatgattcttactttaccacccatggtgacctaagaaggtggtaagggggacaaactctaaatagagggctcagttgtggctcaccaagaagctaaatatgctgttttcatggtagaatagggaagaagaaactggtaaatatttccaaatgtcatgtgtttacatatgaatctattcacttctttatttttaaaattcttctgagaagtactttagaagtaatccctaaatttaaagtatttataacaaaaattttacatattctcaccagtttagagcattacccagaaggaattgtgactccatggtccaggggattagagttagtcattaggggtgggaatttcttctcagaacgaagttagagctctgtaaccatcttatgtgaccaagtagatgtttgagaaagatctggaattaacgtaatgaaggtgagtagcactgagaatgcccatagagtctgtagcttagatgggggtgggtgtcaccatgatcttagtgttgcactttttggaaactaggtttaggtgaggaatgaagtcacaatcccctaagaagggaataatgaataaactagttatatcagcttattactttagagtagaaaacagacctcatgcaggaatcattctgcatatgtggtgaagccttcttggtgagcagacaaacaaaaaagaaaattcactttttctaaaaaaatagcacatcagacctttgtagcctggagaactcattcttctctactttagaggtgtttctttttctaataactgggaagggctgtctctaaccggagctcctgtaccacccctaaagatatcaataatttctcattctccaacttttagttttcccatttttattggtcctcaaaactttgtctttgcggcactccctgcctcatcatacttgtgacaagttgaattcctaagactcaggctcgtattacaaaggatgcaatttagatgagcaactccctggtgagatgagtggctctctggcaaa

SEQ ID NO: 11886 - DNA, 1252 bp, Homo sapiens
tcttctgatttgatggttgtgttccctgttttcattttgagccaagcttaagggttgccagcaggtggcaaacctaattttacattccaagtaatcagaaaatcctcacaggtgttttgtcatgcacctgcaaaaaaaaaaaattgtatggatggcagcagtagcgctgaaattctccatgaaaattggattctctcttccctgaacttaaacaaatgctcatttgtaaactatatagctccacaactattctctaaagaggaatcagttatcatccccttaagtaaactttttttctgtggccgttaggtaaataccgtccttggacttaatgagtacatgtgtttgttaatgttctgctctgagcgggagagcattgcatgaatgggcacatgtgactaggcagtaactcggggttcatctctactctgttgggtgatgtgtctctacctctgctctcctgtttctagcctaaacccaccaagggacgaatgcgcatccactgcttagagaatgtggacaaggcccttcagttcctgaaggagcagagagtccatcttgagaacatggggtcccatgacatcgtggatggaaaccaccggctgacccttggcctcatctggaccatcatcctgcgcttccaggtaagggtctctgcccagggttgctcagaacttaggccgacctctcaggtatgagcattgttatagagctggcctccctgtatcagagggatcgggaagaccaggttgaaagcatgtctcagagtcatgtgtgtcatatccagccctcagaattgaatgctgcctcgtaggcacgtggaagctactacatcctcctgcaattgtactagccctggtaatcttagctttcctgtcagacacatctcagcggcccaggggcttctaggctgcatcccagcccgccactttgctggcacctgctctaaacatctggtctctgctgcttggctctcaggagcaaaggtataaggacgtggccaatgctaggttattagcttagactgcctcaacttcactcaactatgacatgtgttacagaacattttttggcaaagctgttgagggttatggcatgtgtgtgggctccattttcaccttctcattctctttggatgtgaggaagcagtttgcaggaggaaagtacaaaactcttgtgtttctttgaattgatgatgctttatgggttttgttatacttgaggaggaaggctctaagtatagaagtatttt

SEQ ID NO: 11887 - DNA, 1125 bp, Homo sapiens
gagggcatctaagctcaaggcagagaccagtggggtgggggactcaggagtcagatttggctttaagaccaccagggattaatgtgtgctcaagatttcatgtctgttctttttccttttttggagggggggtggcgcgggaaataggttttttggttttgtttttgttttgtttttgaggcagagtttcactcttgtcattcaggctggagtgcagtggcgcaatctcggctcactgcaacctctgcttcccaggttcaagcgattttcctgccttagcctaccaagtagctggcattacaggcacgtgccaccacgcccggctaatttttgtatttttagtagagacagggtttcacaatgttggccaggctagtctcgaactcctgacctcaagtgatctgcccgcctcggcctcccaaagtgctgggattacaagcatgagctactgtgcccgggtggattttttattttccttcttttcattccgtttctctgtaggacaactttgggtttgaccttcctgcagttgaggccgccacaaaaaagcacgaggccattgagacagacattgccgcatacgaggagcgtgtgcaggctgtggtagccgtggccagggagctcgaggccgagaattaccacgacatcaagcgcatcacagcgaggaaggacaatgtcatccggctctgggaatacctactggaactgctcagggcccggagacagcggctcgagatgaacctggggctgcagaagatattccaggaaatgctctacattatggactggatggatgaaatgaaggtaaaacctgaccgaaaggaaggacgacagagctgatccaaccagggctctcttttctgtgactcattcactaaacccctacgtacagctgtgtgccttgtctaactgcccacatgtacagctagagaggagccacatcacccatgggaagattgctagctcaggaattaaatgagacgtgaagtgtgaaaaagttgtagagaccagttcagtagccagagctctgtttctgtgacttagatatattccagtgtagggaatcaatcacattgtggttttctttatttttaagttttcagggttaaactaacttaccgtttc

SEQ ID NO: 11888 - DNA, 2025 bp, Homo sapiens
aattgatacatcctttccttaaatacgcaaatgctgcctttgctttgagtggcttggtgtttggcagtgagactttgtcatacctcagtctctctggccatgcaccgacaccctggtgtggctgttccagcagctcctggctttcacagctggttgcatatacctctctttggaggatgtttagaatgatttggttatgcttcgtgtatttctagaaacaattatatgcagctgcctttttcatatgattcaagtgctttcttgcaggaggatgatcactttgtctgcggtttggccaaaaaaaaataatgtttatcattgccctcactcctgttctagtcaagttgttagaaggtgctccattgccttatcgcatggccctgcatttacatttagcagtgagctggtaatcataagaatatggggtgtagcttactgcctgccagtgagcctgcacccatgctgagctccctcacacagccacgttccttccttgatgttaaacaggttacaagccctgtgacccccaggtgatccgagaccgcgtggcccacatggagttctgttatcaagagctttgccagctggcggctgagcgcagggcccgtctggaagagtcccgccgcctctggaagttcttctgggagatggcagaagaggaaggctggatacgggagaaggagaagatcctgtcctcggacgattacgggaaagacctgaccagcgtcatgcgcctgctcagcaagcaccgggcgttcgaggacgagatgagcggccgcagtggccactttgagcaggccatcaaggaaggcgaagacatgatcgcggaggagcacttcgggtcggagaagatccgtgagaggatcatttacatccgggagcagtgggccaacctagagcagctctcggccattcggaagaagcgcctggaggaggcctccctgctgcaccagttccaggcagatgctgatgacattgatgcctggatgctggacatcctcaagattgtctccagcagcgacgtgggccacgatgagtattccacacagtctctggtcaagaaacacaaggacgtggcggaagagatcgccaattacaggcccacccttgacacgctgcacgaacaagccagcgccctcccccaggagcatgccgagtctccagacgtgaggggcaggctgtcgggcatcgaggagcggtataaggaggtggcagagctgacgcggctgcggaagcaggcactccaggacactctggccctgtacaagatgttcagcgaggctgatgcctgtgagctctggatcgacgagaaggagcagtggctcaacaacatgcagatcccagagaagctggaggatctggaggtcatccagcacaggtgagcggggcgctggtcagccactggcctgttccttgtgaccaccagtggcccaggaggtgaccaccctgtcaaattgccatttcagatttgagagcctagaaccagaaatgaacaaccaggcttcccgggttgcagtggtgaaccagattgcacgccagctgatgcacagcggccacccaagtgagaaggaaatcaaagcccagcaggacaaactcaacacaaggtgagcacgtggccagcagtgtgccagcctcccacgtgtgggactggggagggtgaggtcactcatcgagctttgctgttgggaatttcccacatggggtcatcgacattgcaacactgatgtcatggcattggcacctgccttttgacatgtccttgttttgtaagaagtgtctctcagggcaacatcattggttgcaggaggattatctgagtcagcccagcatctgcccctcgccacaccaaagttagggccttggtttgacctgtgtccagtgtagaaggtattaagatgacacctgtgctatccattttatagtaacttcaggaacaggactctagcatgtttaacacttaatttgccaatgaaagtcctgattgtcagggcagacctttgttccagtcttatctttctgttgagt

SEQ ID NO: 11889 - DNA, 1148 bp, Homo sapiens
agaagccattgtggttcatcctgattacttgaacgttgcacttggtggaccgtgcctgggagcgctcgcatgccccctggcttcagaagtcatgtcagtgtctctgtagacaaactccactgtacatcttggattaatcttctgattcattgttcattttctcaagactttttgtggaattctctgataaaggaagcttttaggatggtatctatcaggccaccagcaggaattgaaaatgttttcacaaaaatccttttccttagaaataaaagctggtgacagagatggtttccttgtaccgataaaaacaaaaccaaatccatattatacatcaaaaccttgtgagacattcacttgctcttttgccatatttagatgtgtcagtggaatcagaaacctgttttgatatgtgttctctatgagttaagtctgatttgtctttttatttcatgatgcatgtcttttttttcttttgtcaggataacgtcatatagcatcttgtttgtttttccttatctctatgtacatatctatctacttctgactgtagatgggtatatagatagatgccaagcttcttatgttctgggggtagtatgcatcattattgggtctctgccttaaaacacatcaaaattcattttagacaaaaaaacttctgctttgtctttggtcattagggagctctaatgtgtgtttgtggctccaagttacattttgtgtttcattgatctatatgtatatatgtgatgttttcatatatatatgtgtgtgtgtttaaattttgtatcatcaggactgacacccaatttgacactttttgtatctagaagaccctccaaaaaaggaaccacataagcacacaagaaaagagtgctatgatgttcttagcatttgctatcatgcctatttttatctagatttttaaatgtagcttgtcataacaaaattttaattacaattggcttgtatgagaagaaaaagtatttttattgttttgagtgatgacgcagagactcagtgaacttgaaaatagcattgcttcgtgcactttgaataccaatcaggtgttttctgtgctactagttgtcacgttgcattcatgttcacctcctgatttaagtatctcgggtgtgcccagccac

SEQ ID NO: 11890 - DNA, 1939 bp, Homo sapiens
tggccagatgcgccattcccaagccttggagccagaacccctcatgcctactcttagttgagtctcacctgtgtcccttcctctgtccaggaggaaatgaacacatggatccaggctatctcttccgccatctcctctgataaacacgaggtgtctgccagcacccagagcacgccagcatccagccgcgcgcagaccctccccaccagcgtcgtcaccatcaccagcgagtccagtcccggcaagcgggaaaaggacaaagagaaagacaaagagaagcggttcagcctttttggcaaaaagaaatgaactcctttccttcacctcctgcccttctcttaccttttcagtgaaattccagcatgcaagctcagaaccaacacattactctctgtgcctaatgttcctcaatgtggttgatttttttttttttttaatttatagagcatttcggggggggtgggggaaacacacctaaacactttatctccaagttacaaaagtttgaggtgcagagggaaggccagattttttttttaatgaaattatatagattagatctcagtatttaaactgttcctcaattttgtgaggctgtgttggaaataacccgcctctagtgctgttggtatgcaaggcagcggtgcttaatcaatatttcctgtgctcaccagaggcaaaatgtaccaatatcctgacaccattctctctccatttacttctggtggttaccctgactcttgactcttagaagtgcccgagatggggctaacctttattaaacagatcgcatattatgatcttgctgcagccacagtgcagctccacattaactctacagaccaaaccatttgtatctggcatcacttactaacacacgacatgcggcttttctgcatcaactgctatgacggttaagaatgtcagtatacaagaaggaatagaaaactgatactgttttaaataatctgtaatttcaattttttttttttgctgaaatacattatattgtacgtttgagataattctagtacaaagtataataaaactagatgtataataaaccctttaaatcattggtaagtgtacaagtggtggaactgaagcatttactggacaaagtaatgttactctaatggttacttgctcgtgcgttgccacactgtgttataatttgcttcatttccttgctatttgatacatagtgtgcatttctctgtcactgtaactattgtaatgacaaattttcatcttactgcacaatcaaaatgacattgataggaatgaactccagaggctgggcctgaacagggaggtggtcgctcaggcctggtgctcagtcgtacgacctgtacctctcaacttttgccctatctgttaaatatatgctatgtcattaaatgcttttaaatctagcacggtgactagttgttgttcttcctctgctgcgtgtgcatgcccagtagggaaactgcaaagggagaaatgacaaacaagaaacattttacaaccagtctgggctcacttttgcattttttatgcatgtctggtgcacaagctttgaaaactacagcaaacagtaataaatgtgactgttttgtagttatacattcaggctttatcttttatttatgaaaaagttaccagagcacttgtgaaacctgaactctgagataggggttggcaaatttgttctgtaaagggacagagatagtaaatattttaggctttgtaggccgtaactgtctctgttgctcaattctgctgttgcgtaatacaaaggcagccattgacggtatgtgaatgcctgggcatggctgtgttccagtaaaactatttaaggacataaatttgaatttcatataactttgacatgccatacaatattttgattttcttaatgatttcaaaatgtaaagtctattttatacagatcaga

SEQ ID NO: 11891 - DNA, 1890 bp, Homo sapiens
aaggtgtgctggattgtgagaacagtattttcatattgcaggcataatgagtaacaaatctctatcagaccttaagtgtgacttcagagttgccaaaagattgtttttctaacatttggaccattcgtttctgggtttattatgtgtttaaggctttgtttaaatctaattcatgaggccaaggtggcaaaattatagcttagaattaggcagctttaaggatttcatttattgtattagctgaataacatacaagtagttcttggaagatggtattttaagcagcagcaaacaaaactgatatttacattgactttttcattttcagaatccaagcaaaaatccctggattgaagcgcaaagctgaatgaaaacgcccaaaataattagtaggagttcatctttaaaggggatattcatttgattatacgggggagggtcagggaagaacgaaccttgacgttgcagtgcagtttcacagatcgttgttagatctttatttttagccatgcactgttgtgaggaaaaattacctgtcttgactgccatgtgttcatcatcttaagtattgtaagctgctatgtatggatttaaaccgtaatcatatctttttcctatctatctgaggcactggtggaataaaaaacctgtatattttactttgttgcagatagtcttgccgcatcttggcaagttgcagagatggtggagctagaaaaaaaaaaaaaaaagcccttttcagtttgtgcactgtgtatggtccgtgtagattgatgcagattttctgaaatgaaatgtttgtttagacgagatcataccggtaaagcaggaatgacaaagcttgcttttctggtatgttctaggtgtattgtgacttttactgttatattaattgccaatataagtaaatatagattatatatgtatagtgtttcacaaagcttagacctttaccttccagccaccccacagtgcttgatatttcagagtcagtcattggttatacatgtgtagttccaaagcacataagctagaagaagaaatatttctaggagcactaccatctgttttcaacatgaaatgccacacacatagaactccaacatcaatttcattgcacagactgactgtagttaattttgtcacagaatctatggactgaatctaatgcttccaaaaatgttgtttgtttgcaaatatcaaacattgttatgcaagaaattattaattacaaaatgaagatttataccattgtggtttaagctgtactgaactaaatctgtggaatgcattgtgaactgtaaaagcaaagtatcaataaagcttatagacttaaaatatgctttggtattttcatttcatgaaattgcagcagattaaaaatgcacacagtgggtaaactgcttcaaccagcgaatggtagcttgtgcttttagaagggtttttttcagctgatggtgcagctgtttgtttgtttactgtggaaacaaaagtcaacaaatgtgtttacataatcaaattttatttgacacataaaatgtttaagtgatgtgttttatactttgaaaataaattcatgcaccaatgttttaactcacatatatcatacagtgcaggatttatgaacatacataaaatcaaaatcataccatataaacgtttacaaataagtttttcatgacacacggacactattgctctttaaatatggttgtacatgtcatcattaatcgattcattgttcttccacatggttatttcaatgcaagatccgatcagcatgaagagtctagtacaagataggcagacatggttatcactctgcatcaccagtcacatggttacagaaaacagaattgggactgcatagggactctactgcgggcccaa

SEQ ID NO: 11892 - DNA, 1181 bp, Homo sapiens
tattgaacaatttcccctaaaggttagtctgagagagtttaggatttggaaatgaaaaagatctttgttaggaaaacgtgatgagacaacatagtgtcaactttaagaaaaaaaaaaaaacaaccatagtcataactaccatttactgagtgcatccttgtgctcagttgcattaggcacttttctcactgaattctcatgataatctccactttataaatgaggaaactaagtttagagggaagaataaataactttgcaaaattacctagccaggtaagtggcagagcatcagattcaagcccagatcagtctggcttcaaagtgtatgctttttctgtgctagtcagcagacagtgcatatcaaggaaataccccttactgctgagtttttatattgcccctaatttggaaacagttggcttttatagtagaatattttcttaatttcttacagatatataatttctgattgacatttaggggaaaatcactccaattagtgacaattatgatgtgttttgttttctagggcatatctggaatctgaagttgctatatctgaggagttggttcagaagtacagtaattctgctcttggtcatgtgaactgcacgataaaggaactcaggcgcctcttcttagttgatgatttagttgattctctgaaggtaagtttattttgcctttcatttttgatatacccagaatttagtatcaagagagttgagtgtaaaattctgttcttctatattcaagtaaatgataaatattaattaaatcacatggctgtaaacttgtgttttaaaattcagaatccaatcaaataaggatgaagaagtgctattccctttttttttctggtcatacttaatacagagagtcctgtattcctttttaaaggagaataagttataaatcatacttgtgggccgggtgtggtggctcacacctgtaatcctagcactttgggaggccgaggcgggtggattacctgaggtcaggagtttgagactagcctggccaacatggagaaaccccgtctctactaaaaatacaaaattagccaggcgtggtggtgcatgcctgtaatcccagctactcaggaagctgaggcacaggagaatcgcttgaacccgggaggcagaggtttcggtgagctgaggtcacgccattgcatt

SEQ ID NO: 11893 - DNA, 1191 bp, Homo sapiens
acctcaggtgatccacctgcctcagcctcccacagtgctgggattacaggcatgaaccaccgcacccagcccccaagattattttaagtaactccttgttttggattagaagtcttctaggctttggagacatttaatcattgtgtatggctagaatgatttggttatgcagaaataaatttgaataaaaaacatttcgtggtcaaaaataaaggtgttatactaatatacaactaagagtgggtttaaaatgtgggttataaagttagtgtttctttaacttagtgtttctttaaatttttaggtttgattttactttatgtagtagcgtttttgttttcatagatggagcaaatccaaattgataaaataacattctaatttcagatttctttttcaatttttagttgttgacctcctgtactggagagacattaagaagactggagtggtgtttggtgccagcctattcctgctgctttcattgacagtattcagcattgtgagcgtaacagcctacattgccttggccctgctctctgtgaccatcagctttaggatatacaagggtgtgatccaagctatccagaaatcagatgaaggccacccattcaggtgagatgtctggaaaacaaggcatgcattggcaatagtgtaaacaggattggtattaagacttcatctactgtctatagagttacaagcatgcatttttttgttaaagataattgcagttatttgcttgagctataccaaaaacatctgcttttgagattttctaaaagtcgttttaaaggctcatgatggaggagactgtttatgtatcattaaactaactctgctacttgttaggaatatttattagagttaagcattggttatcttacttgaatgagtgttgtatctttttaacatgggtaggtttgatgaggatattctttattgctttttatgctgtctgataacgtgctttctgatatttcgtatctttctagtatgctgatgttttctgttatgcttttctttatgtattttctttatctagtttcttctcgtttcttaaggctttactttttaattattttttggagagctttatttcagcatctccttgtctctcaactatcatcttctacccttgttttcacaagtatactatagcattatatagttgctatggagacacaacct

SEQ ID NO: 11894 - DNA, 2069 bp, Homo sapiens
tgaattacatttacatatttaccattccctttctccaaatacagtttgagtatagccagaaaggctttcctgtaaataaataccagtctatggcatttacccagtgccccttctttcctatgctgtcaccgaaactcttttcacagatattcttctcttctctaaaactagctattagtatcttagttgataacatttgaggtttactcagacttgatttgtctttgcacagcatgtaattgcctctgtagccatgcatatgttatatttacaatagcttaatattttcagtaatgattgaagtctactctattgttacttattaattgctattaacatttcattttagtaaacagtaagtctttactaacactattttggatctgtcataaaacttgcattaactctgagaacactggcattctctaactttcctttctgtccatggtcacagaaaatatggacttgaaggagcagccaggtaacactatttcggctggtcaagaggatttcccatctgtcctgcttgaaactgctgcttctcttccttctctgtctcctctctcagccgcttctttcaaagaacatgaataccttggtaatttgtcaacagtattacccactgaaggaacacttcaagaaaatgtcagtgaagcttctaaagaggtctcagagaaggcaaaaactctactcatagatagagatttaacagagttttcagaattagaatactcagaaatgggatcatcgttcagtgtctctccaaaagcagaatctgccgtaatagtagcaaatcctagggaagaaataatcgtgaaaaataaagatgaagaagagaagttagttagtaataacatccttcataatcaacaagagttacctacagctcttactaaattggttaaagaggatgaagttgtgtcttcagaaaaagcaaaagacagttttaatgaaaagagagttgcagtggaagctcctatgagggaggaatatgcagacttcaaaccatttgagcgagtatgggaagtgaaagatagtaaggaagatagtgatatgttggctgctggaggtaaaatcgagagcaacttggaaagtaaagtggataaaaaatgttttgcagatagccttgagcaaactaatcacgaaaaagatagtgagagtagtaatgatgatacttctttccccagtacgccagaaggtataaaggatcgttcaggagcatatatcacatgtgctccctttaacccagcagcaactgagagcattgcaacaaacatttttcctttgttaggagatcctacttcagaaaataagaccgatgaaaaaaaaatagaagaaaagaaggcccaaatagtaacagagaagaatactagcaccaaaacatcaaacccttttcttgtagcagcacaggattctgagacagattatgtcacaacagataatttaacaaaggtgactgaggaagtcgtggcaaacatgcctgaaggcctgactccagatttagtacaggaagcatgtgaaagtgaattgaatgaagttactggtacaaagattgcttatgaaacaaaaatggacttggttcaaacatcagaagttatgcaagagtcactctatcctgcagcacagctttgcccatcatttgaagagtcagaagctactccttcaccagttttgcctgacattgttatggaagcaccattgaattctgcagttcctagtgctggtgcttccgtgatacagcccagctcatcaccattagaagcttcttcagttaattatgaaagcataaaacatgagcctgaaaaccccccaccatatgaagaggccatgagtgtatcactaaaaaaagtatcaggaataaaggaagaaattaaagagcctgaaaatattaatgcagctcttcaagaaacagaagctccttatatatctattgcatgtgatttaattaaagaaacaaagctttctgctgaaccagctccggatttctctgattattcagaaatggcaaaagttgaacagccagtgcctgatcattctgagctagttgaagattcctcacctgattctga

SEQ ID NO: 11895 - DNA, 1101 bp, Homo sapiens
ctctcagccccgcccattgaacgcaatcccagccggtaagagagaggaagtgccgtagtccccacccactttcatctccttccctttctgttggcccggctggtcgcctatcttctcgatcctgtagccgattggctctctccctcccgcgccagtccctgccctcccctggggagggtgagtcacgccaaactgggcggagagtccgctggcctcactcctagctcatctgggcggcggcggcaagtggggacagggcgggtggcgcatcaccggcgcggaggcaggaggagcagtctcattgttccgggagccgtcaccacagtaggtccctcggctcagtcggcccagcccctctcagtcctccccaacccccacaaccgcccgcggctctgagacgcggccccggcggcggcggcagcagctgcagcatcatctccaccctccagccatggaagacctggaccagtctcctctggtctcgtcctcggacagcccaccccggccgcagcccgcgttcaagtaccagttcgtgagggagcccgaggacgaggaggaagaagaggaggaggaagaggaggacgaggacgaagacctggaggagctggaggtgctggagaggaagcccgccgccgggctgtccgcggccccagtgcccaccgcccctgccgccggcgcgcccctgatggacttcggaaatgacttcgtgccgccggcgccccggggacccctgccggccgctccccccgtcgccccggagcggcagccgtcttgggacccgagcccggtgtcgtcgaccgtgcccgcgccatccccgctgtctgctgccgcagtctcgccctccaagctccctgaggacgacgagcctccggcccggcctccccctcctcccccggccagcgtgagcccccaggcagagcccgtgtggaccccgccagccccggctcccgccgcgcccccctccaccccggccgcgcccaagcgcaggggctcctcgggctcagtgggtgagtgccgcgacctctcgcttcgcgccgcccctcgcgcccctccctcttttgtgtgcagccccagatgctttgggctggtccctcctctccg

SEQ ID NO: 11896 - DNA, 1246 bp, Homo sapiens
cctttcgtgccccgcaccctttgccccccgcttaacatttgctctagtcacttccggcccgttcccacgctccggaaaccattattccgcttcatcctacctccagtcctcacctgagtccttttctccaaacaccgacttcagtgcttagagatagtaactagggaatctgggaggtggaactgcatcttgggacaagtagtccaaggtagaagaaagcagtggagaactacagttcccagaatgcacttccatttcctacctcttccccaagaggcccccctcgacctccttttaaaaattctcttagccacgttgattgtacgggaaaagcctttttaaaacatcttttacgttgcttaaacctacagtttcgaaagcattccgaaggctaaagtgagaaataagcccaggctagggagaggagaaacgaagttcacgtcctagtctggcaccgggttggattgtcgctgggacggcagtcaggcatttggtgtggtcgcctaaggggtgggtccttcggcgggagctccgggaaaccccgtgggcctgcgcggcgttcttccttttcgatccgccatctgcggtgggtgtctgcacttcggctgctctcgggttagcaccctatggtgccttctcttgtgatccctgacctaacctgtctcttccttttcctcaacctcaggtggagccgccaccaaaatgcagattttcgtgaaaacccttacggggaagaccatcaccctcgaggtacgggccgggtggtcatgaggaagccaaggtccgaataaggtcctgaggtggattttaggaccggcgctgctttccatgtcttagaccatgattccgaatttgggttctaaaacttaagctttgaaatgagtaccttttgctgagcaacgacctagaggtgattttcggtggccaaaggctggacctgtctcctctcgaggggttccagctagttagttaaaacggaggagctgcggtggggaaggagacgctctgcccgccgggtgcgagcacgtgtggccctgcggccgccgcccgctctgggctggggagatgaaggtgctttccggtagccgacttgggaggttgcccactgggtgggtaataggtctctcgagtaggtctcagccctgtcgctggttcggttcagtggtaattgtcaaactaaatgagttctgctgtagttccttaatgtgtaaccaacatgctttcactttaacactcataggttgaa

SEQ ID NO: 11897 - DNA, 1275 bp, Homo sapiens
agaaatatctaaaaccttttccgtagactttgaaacatctctctctctcataactccctggattcaagtagcacattggtaataggtatcagagcagtctagagacaattgcatgtcaaaaaatgtacattcatttttaggtggataaaagtaaacatagaaattatgttatggctaaatacagttagtgggtaacttagatttatattagctagcatctaatttgcacaactagaacacatcccagaacaattactgaaaagctgaaatttaatgggtggtgatgtagcccaatgagggcgaatgacattacagcttgacctctccagaacactaatatcctaaaatacagaacatgctgggttaagtgcattagtgcttcaagcagaaaatgctgaaaacaacgtgtaaagtactgaatctgagtaggctgaccctgagaagggacaattaaagagacaaccaagggaacacattgagactacaaaaatatgaataatctcaattatattcatcacacttttttcataccatttcaagaaacgactagacagtagtaaccacatgaatattttactttctccagtataccttgagaagcaaactttgtaggaagccactcttctcccctaaacaacttctgccaaacaataataaagccaactggaaacgaatcggagccattttcattttcctaaccggggcctgacatgctttaaattatctggctgtattctaaatcaacacctaacccctcaaggaaactgaagaatcaatatacagggtaatagctttggctcagagctccaataatgtgcttcagatctgtccatgtggaaatgctttcatccaaatttttaaattggtggttaccaaagagttcacaaaacaggtttgtatgtagcacctttcatgcaaggcatgcaaaaagcctattttaaaatcactgtgcatattatagagttgtagccacctcacaatgaagtactacagcctgtgctgtcttaatggtttatgtcaggaaatgaaaaagatactgtaccaaatctggaattacaatggggagtaataatgtatactaaatgacttttgtattttaagttactttttgtgagtggtgaatttttgtgtttttcttttcagctacacttagtcctgagatgtattttttctttaagtcttgaatgaatacaaaaggagcccattttataatataaaccttgatgtacatgttgagatatttggacaatgaaaatgccttaaaaggaatgcata

SEQ ID NO: 11898 - DNA, 1156 bp, Homo sapiens
gtaataggtcacctttcttccaaaaaggaaaaaaaaatgtaaatttttaaaaaaggagaaacatggaaaaattcccattgttaactacctgatgaaatcttagttgccaaccatggtatctgtatttttttatgttttggggagacattagatcacagtcaccaaataatttaatattcatagctgtacaaaatatgatgcctgtcctaaaaggtaatttttattttatagtgataagttaaatgaattaagacgtcagaaggagaaactagaagagaaaattatggatcaatacaaattttatgacccatctcctcctagaaggtaccattaaccaaattttatgaattcttattctgaaaaaaaacactaggttatttctaatattgtgatgacttctacttttgtgaaggatttgtatgttgaattttaaactgataacaatttttaaaattctgttaggagaggcaactggattactctaaaaatgagaaaattgataaagtctaagaaagatattaatcgggaacgccagaaatctctaacattaacacccacccgctcagactccagtgaaggatttcttcagctccctcatcaagacagtcaagatagttcttcagtaggttcaaactctttagaagatggccagaccttggggaccaagaaaagcagcagtgagtgcttaaactctttaaacatcgtattgatttagaatcctttctaaagattttttaaaacttcagtagtcctttgggggaatagtctgatgaatggcatttctttttaatttaacatcataaaattaattgtgtactgcattagtgtacagccacacaattttctgaggtaaatcatacacagatatactatcatttggccagaggggtaaaatattgcagaaagaaagttaaaataagagctggaatacctctgccacttgctatttctgttaatatgggcaagccttttacctttgcttcatacttcacaggacagttacaaggagcaagttagaaatatgagatgtcattttcataattatatataacttaatcagaataataaggcattctataatgaggtttctgctcatatactttgatggtgtcacattggaacaaagttacatttggggaagcaaaaataggtatga

SEQ ID NO: 11899 - DNA, 1099 bp, Homo sapiens
attttgaaaatgtaattttaacatctgccctctaaccagccgtgtgctctggatcaaaccatccagcctctcttagagcctcaattttggtttttctctaaaatgggaataataaaacctatctcatagaattgttgtgaagatcaaatgaaattttatgtaaaagtgctttttaaattgtaaactgctatatatatatatatatatacaaaaaatagaagatgtaaaataaatctatttacttttcgaatgctctttatagtcctataaaaggactccagtaaattgcttctccttttttttcaagttttctgtgcagtcctgactcatgtgtaaagaaaccaggacattacattttggaaggtgattttgaaaaaccttttttgatcagctttagaactacaaaacaaaattttaaagtttttcttctaacaagcattgtattatattttaaatgtaaattttgtgcttatacaggaagatatcaagtctcttactgcccatatagttgaaaacttttataaagcacttgaatcgattgaatatgttcagacattcaaaggattgaagactaaatatgagcaagaaaaagacagacaaaatcagaaactgaacaggtattgtttaagtatactgcttttatagcctacaaaactgtgtccaaaattgtttgtagttcagattttccatgtgaaatttactgaggaattttctttccatcactggatagcatagagttgaataggagggtaaggcgtcccccctaccccatatcatttatatgttgaattactactccatgttgtaacttacgaagaatatttagtttaatttacaacatcctaaaatattttggagtgttctctggctacatcttctatcattacagagattattttgatataaattatagtcagttaaaattacttcagttcatcttggttatacatatttttccttcagttcaatctgatgatgaactttaaatcattactcaatatttgtgatatatttcttacagtgtaccatctatattgcgtagtaacagatttcgcagagatgcaaaagccttggaagaggatgaagaaatgtggtttaa

SEQ ID NO: 11900 - DNA, 1277 bp, Homo sapiens
ctcaaaattgaatagataccactatactgcaaaaataatagaattgatttttgacaaggctgctaaggttgtagactactaaatggtagtgagtttctttttcctttagttacagaattgtgctgtttagtaatcactagctaatatcaattcctttctttaaatactatcagggacattataacaatgtatgatatgggaatattactgatgcccaaacatcttgccagccaaaaatggaatctctttttttagcctagctgtgtatatttgagtggaaaaggaaacaccctacaatagctttgctaggtgttaaatagtaatgtaattatatttcctataatacagcaatatagtcacctttataaaaactatatttataaaacattcttcctgatcttaccttgtgttttaaacacatagatgatttcgtattctaaagtagttagaagaattgtaatgttcccaacataaaaggtaaatgttgaggtgatgaatatcttaattatcctgatgtcatcattaaacactgtatacatgtatcaaaatatcacacataccctcccaaatatgtacaacgaataagttagtgagacacatacgctttttataaatatttttcttttgaaggattttactatggattgtggaatttgttatgcttatcaacttgacggtaccattcctgatcaagtgtgtgataattctcagtgtggacaacctttccatcaaatatgcttatatgaggtaaaaaataaaaatattgtcaagacttttttccgctaacacaacataggaagtattcctgtttgaaatacacagaatctaaaatctgttgagtcaatagtgatcctctcttttgccattaactccttttaccagtttattccagatgcttatgtgcttcatttcttcatcacagttactaatgagtggagaaatgttctgaagtatccaagggagaaaatctatccagaatatattcatggactagcttattgacacataacaaattaaattgatggtacattggaatctttctataaattccttgttaccacaatgtaagcttcataggtttacccgaggtggaggtggttgaaagtggcagtaatacagtgaaaatgaaattagtactatgtagtatctattacttttcaggctgcatttaagaatagaatatatccaatactactacttttcatgttgagaagaatgccttttgtgatctgagtctcacagcactcaggcaatgccactttacttactgtatgtga

SEQ ID NO: 11901 - DNA, 1302 bp, Homo sapiens
ttttactcaacaccgattgctttggcacttccaaatcaccaaacttgcacctccataggttgactataaataagctcttcacatcactatgaaagtggagcaaaaatatttatatgtaatacattttcagttataataatatgttttcccccaatatatctcgtttttctttttttttttttttttgagatggagattcactctgtcgcccaggctggagtgcagtggcgcagtctcggctcactgccatctccgcctcccaggttcacgccattctcctgcctcagcctcccaagtagctgggactacaggcgcccaccacaatgcctggctaattttttgtattttttagtagaggcgaggtttcaccgtatagccaggatgatctcgatctcctgaccttgtgatccgcccgcctcggcctcccaaagtgctgggattacaggcgtgagccaccgcgcccggcccctaatacatctagtttttctaaaatacctcagtgatattaacacacagaagcaaaaatggtctaatgttatgcttttttaatagtatcctgcagaatcaccagattattttgtggattttcctgttccattttgtgcctcctggacacctcaggtaaattctcctcaggtaaattcttaaatttgttttaagtaattaaaaagtacagttgtcccagagtatccatggggggattatttcttgggccctctgtaaataccaaaatccatgcatacccaaatctcttatataaatgggactttgtttatagcctgtgcacactcttctgtatactttaagttatctctagattataatacctaatacaatgcatttgccatgtaagtagttgttatactgtaaatagttatgttatttatttatttttgaatattttctgtctgcagttggttgaatctgcacatgtggaatccgtgggtagggccaactgtaactgtttttacttaggtagtcattataggttatgaagtaatctttgttttttcagttttccttaagcatttatttataaacacaccttctataatgcttcttttatatttccttacagttaatgtccattttctttctccctctctacatgcacacacaaacacacccactcacacccacacccatgcataaatacacacacacacacgcacacacacacacacaccatccagcctgtagatatttatgcttcattttcagtaaacatgcagaagcacttttgacagacattttcctttaaatttaaattccaaagaactctgtagaaagcagtgaatggta

SEQ ID NO: 11902 - DNA, 1236 bp, Homo sapiens
cattcacttgaggttgaggcaagtgtcattcagaaaacttccattcctgtttactgtaatacctgtctctagtctattctaattttatgaaagatttactttcaaccaagattgtactcactgtaaaggagagtctggtggatatttcttttctcatcacagataaaaattatctttaaagtacacctacctacaaattctgtacaatagtaccaatttgaaatacatagcttgctaacttgaatatcttatacatttgtggtaagaagtggtgaagacatttaaattataataatcctggagatgtgaagggttatccaggatggaggaactttgcgtaggtataaccattgcagggaggcctacttgacagaggaaataacttgcttgcgggttagggagtgataaactattgtaaactaaagactcttacattcatttaaatagaaaatcaatacctacaaacatgttgccagatatttgttatttattaccttccttagtaaaggtataagactaatctgtaattagcacatttacattctaaatggaaagctctcaaagaacttacaaacattaaatgagcaactactgtaaggttaaacactgtgctgccccacatggctgctcttgtggttttaaaagtgcctagatgacaaatcacattctaaaatagtatatttctctctgcacattcttctagcacagaaagaacacactaacatcttaccaaaagtttaaatttgactaattctgaattaatgtaaacacatcattaactcttattaccatgatgattatttttattcagggttatgcagaattatttgcacttgtcccttaactaaaggagacatttacttttctttcatttcttaacagaatggagaaatgcatctatcctttctgttggttttcaaatggtgttgacaaaaatatctttgatcttacttaagaacagaatgtgttggccagttaaatagcaatgataactaagagcaaactctccccagtgtttcgtatagctcagtgtgtctaagggaattgtgtggctattttactgctgtttctcgacaggtttttcatagttctttttatagctaatatattgttctggagctccattctttctaaatactggggaaaaatgagaaatccagggctacggccatgcctgtggcagttaagtattgatgatgaaattggtgaggcattaaggaagtgtgagttggtaag

SEQ ID NO: 11903 - DNA, 1259 bp, Homo sapiens
aatggttataaataatgaatgcctttgttgggagtactttcatttactcattccaacaaactcttagaccaattttccttgagatcaattaaattcaatccctcctgtatgccagactttaaaaaaatgcccaatactaagtagaataaaaaatgtcttttgcttcagagtagtatgattaggactataacagagttgggttgaaaggtctatagtacaccagagtcaagactacgtttgtccttgggaaattggaaaggctactggagaatatgaaacttcagtgaatcttggggtatcactggatatttagaagctgggttgaggggccaggggatccttggcagaaagaaaagcatagtgacatgagagtgcatcatgagatcaggaagtcatgataggttgtaggcaattaagctgaagaggtttatgaggcccttatttgtgtggatagtggacaggtgctgggaatgatggatggcaggaagatctgatactagagcagttaaaattatctaggcaagtgagatggggaaatgaagtcaaacagcagcagcagggatggagggaaagtgacaagtttatgagtctaaactggagagagagaggatgagggaagaagaatgtagaatttgaagattgtttggttcttctggtcttccaattatgttcaagtatatgtgagatgcaatggtcaaagtaataggtacataataaataaaccatttctgttttcagcatctgtagatcaaactttagcttgccttagtttatcattcgtgtgtttagactatgatcaaataaatatattcattttcacactctatttttagtggtactaatatattttttgtgacgcaaaatagtcacattcctagtgatgggaaaactaatgcataaatggatttggcataaatcttgaggaatccctgagagatctggttggataatgagtcctatttttgattttcaatcaaatattctttccactagaattatctgctttcttgctcaaaaagagtcaactaactatctgaaaactaatgataatttgcaagttacaagaaagccattttctacctttgttatacttgtaataaatcctaggtccaatgaatatgtttttaaatatgtttcaaataggtattactaaagtaaaccataagagagacaaagtagaattatttccctcaagtttttgggaaagtaatattctgttcagagaatcaaatggcattatccaaatgaaagtattattt

SEQ ID NO: 11904 - DNA, 1106 bp, Homo sapiens
cttcatttggcatgttcttccttgcttagaaattctggtggtcccttgaacccagagacagcaaatgttcagagctcctatgagagtggaagattatgtgtagactgaatttgaagagccatataccacagaaaaatgttcatcctttactgtacaaattatcttaaaatatcccatactcatctccagagcttgagtgtgttccttagccttgtttgcaggttctgctgatataacttcatttcctattctctctagatcacaaacactttataaaacaaaagaattgctataaatgatgtctaggatgtgttcttttgactgccaggcagatcatataactgtatccaccacccatctttattactctttctatagttccttttcctataatggtaaagaatgctcaaacattagggttagatagacctggatttgcatccaatctatactatttaatggaagtttgtctgtgggaaacttgttactaaattcctccaagccccatatctctcaactgtaaaacaagtataatcacattgacttagtaaagcttggcctgtaatagattctcaatgaatggcaacttccttcacctgttagcttctttctctgtctctatatatgccatatgtcaaggcctggctttaatttcatctccaccttgaagtcttctctggtgaagtctactttatttttttttcaccacttctcaatttgcttttgcacttattttcctgtgcttacaagtcatcctttattataactgatatatgagctgacacctaaaatcaaatcttgtttagccattcttttgttgatttcgattgtccagctagtatgcatattgagggtaagaaggccttttctcctgcatttcctatagagctgggcacacaatagttagtcaatacatagttcttttaattgattgtcaacttgtttatccttgctataaaccagcatgagaagaggggcgcaagtcaatttaacaactacttaattattttcaattagatgctgcattgcggagaaatagggaacccccccaaatgaggaaaaagttgtgatgcagaaaaaaaatgagtgcaaaataactactgcca

SEQ ID NO: 11905 - DNA, 1186 bp, Homo sapiens
gatttattgcctattctagagtaaacacttggggtatgcttactgaacaaatatttttgtgaagtgaaatgtcatatattaagtaaaatgatcatatttatgtgctatcctttccaatacggcttaaatatattttcaaggaatgtttatggtatgacagtacgttaaagagctgggcatttagtgacttaacatctgttttctcatgttctatggataaaatttgggtagagttttacttgttttgaaaggaaaataagcccagtcaaatgatatgaccaattgaaattagggcagaaaatatgtcaagaaactgagaggtaagtttttctgtactggtattctctggaaagtttcatctaaactgcagttgttcgtcagctggattttatttatctagtgccaattacattataattaatgtaaattgaattctcatttagtagatcagtttataatgcagtctatttggatcatgtatttaatttcccccttttttcagattatgaactattatggaaaaggaaaagtgagaattacattagtaacaaagaatgacccatataaacctcatcctcatgatttagttggaaaagactgcagagacggctactatgaagcagaatttggacaagaacgcagacctttgttgtaagtacacagttacagacatcttcagaaataagataagacataggatgttctgtttcttctccatgacaatctgttactttttagcagaataattttctcattctacttctatttactgtattttacacttacatttttactatttgcattagaactaccctttcattctttattagtagacacatcttatgatagttagcaggaagacatttttattgttattaaaagtaaacgtaaacttcttgtatactgtgatttcctttcttggggtggacagtttttgaaataattattcactctgtcttttttttttttttttttttttgagatggagttttacccttgttgcctaggctaaagtgcaatggcgcaatctcggctcactgcaacctccacctcctgggttcaagcgattcttctgcctcagcctcccgagtagctgggattacaggcatgcaccaccacgcctggctaatttttttgtatttttagtagagatggggtttctccatgttggtcaggctggtctgga

SEQ ID NO: 11906 - DNA, 1210 bp, Homo sapiens
aataataccttattaaagtagataggatattgtctccattttataaatatggaaaccaaagactagaagttaaatgacttatccaaaattgttagctacttctatattgaggactagaactgaagtttcttggtttctagggtctttctaataagccctattactgagcacctgtttgtgtgaaggggcagctatggatgccatttaaactcatgtaactgataattaacttttggaatgtagttaccaaatcaaagagcttaccaaaaaatagcccaagactatttaatacaatcttatatagttaccatttgttattaagttaaacctcagttggtattatgaagaggaaaaacattaagctaaacctaaaaaaaatgaatgggtcatttaagtttcagaaaggagcctcattacaatttcagatttgagtataatttccatcaccctaattcaactatttgagctttttttaagaatacatgtgacttgactagtattagattactaaccatttcccatctctatattaaacataaatcacagataccaagattcactttagatatgaggaaaatggttttaatggacacaaaggagtcagccacgttggaaccaacatagtttcataccacgttgaaaccatgtgtttgatatgcaaataacagcaaataattttttcactcttgtcaatgccaatgcattgaaaggcccagaaaatgagaaaaggataacaaacttttgataaaaaggtaagaatttctgtgtggatgttcctcagtttctgggaaaattttgctacaaaagagatttaaataatttaggaggcagtcttttgcatggtatttttggcttacctttgaatctagtggacctgtaatatgtaagaatgaagaatgtgcttagcaaactgaaatgagaagatttctatttcttaaatttctattcctgagattatataaaatttcacgcaaagagtaagcattagctttaaatacttcttccaaatgttcctagaattttgagacaaagattgttaaaaattaatgtatgtctttgttttaggcagaactggaaatattaagtagtgagagtactatagtttcccttttgcctacataaaagcattttaaaattagttttatgatttctttgtaagctttatttaaattcaaagtctttttcataacacttaagagaaagagccctt

SEQ ID NO: 11907 - DNA, 1169 bp, Homo sapiens
tggctagccttgatggccaaacaacaggacttatacctgcgaattatgtcaaaattcttggcaaaagaaaaggtaggaaaacggtggaatcaagtaaagtttccaagcagcaacaatcttttaccaacccaacactaactaaaggagccacggttgctgattctttggatgaacaggaagctgcctttgaatctgtttttgttgaaactaataaggttccagttgcacctgattccattgggaaagatggagaaaagcaagatctttgatatctttcatgtttgcctgcagttgaacaatactttagagtactttttaaaattatttctcacaaagaaatgaatgtacaatccaatgaaaacatttgttattggctatttcaggtgttttgctgctagaaattattaaagttacacactagtatgttggtctggtgacctggttacattttattatacacattattggaccataaggacatttgtttcacctagattttaagattatggagactgctgtcatttttatcttatttaaatctctaggtttattggaagagtaagattgatgaactatagcatgcacagtttggtacagtagagatcattaatacttttaaaagttctgcattaattgacttggaatccttagaaatggagtggtgacatgtcagtatgagaacaggcaaaaggtaaatttttttttttttttacaaccttaagtaatctcaataataaaattttctgatctgtattatatccagtgttgggtttatattttcacccacaaacaactgacactgctatcttttactgtatttttaaaaatttaatttgaaaaggtcacccagaagcattctgaaggaaatggttctagaattatagagtatgtagccctaatagttttccctcctagcaaaaagtctgaaatttatctttcttacaaactgttccatttcttctaaggatcccttaattatttatctctttaagccaggcatggtggctcacgcctgtaatcccagcactttgggaggctgaggcgggcagatcacctgaggttgggagttcaagaccaccctgaccaacatggagaaaccccatctttacgaaaaatacaaaattagctaggtgtggtggcacatgcctgtaatcccagctactcgggag

SEQ ID NO: 11908 - DNA, 1099 bp, Homo sapiens
gagcagctggaactacacgtacatgctactgtgctgagcctacagccactctttattatagtcaacaagagcttcaactgacacagtagtggggtaaaagatgttttctgcaattacattggaaataataactggttttagaaatcctctgagtgtagcgagttattttaatctcagcagcggcagagtattgatgtaaaaatttgcttcagaaagagaaaactatgctgttggcatttgaacatttgatccctgtttgtacacaccacattagtattttttgaaatccttattctaacattagcaatttatgattcatttttgtactgtttcttccatatatctttagaaatactaaaggaaaatgccaccctgataagtaccatctttagccttggaaaccatgcatttacagtattaccattcaataaataaaaacccattctcagctagaaacactaacccccacctttttttttttgtatgtgtttgtttctgtatttaaggaagacatagtatagcttccacaaggaattgttcttcagaaagtgaaaattgtactactcataatggtggagaaatgactgaagaatctgaagggtaggcggctggttgtttgctagataagattaaatattaatatcaacttcataaaatatatgattggtggttaccataaggtaggaatttcatattgcataattgctgaaactactggaatcagcttagttcatgtgttgaactgaccgaaacatgacttattcatgttattatttataaattggattacagttttctatttaaagatttttatttttatatttataaatattagaagtaatatctcttaacacaaaactttaaaaagtgaattttaatacccaaggaaaaaaactgtatgccattaattctccgactttactaaagaaattggatgtgtattttaggactatttgaacataataactcattatagaaaattttagaattaaaatgtctttcagtgtattgcaagttttgatagttttgtatagttttgtattgttttgcctatttttacaataaactgaatattgttaagtgttcactttgatgagtt

SEQ ID NO: 11909 - DNA, 2241 bp, Homo sapiens
attaaaccttgatgttgccaagccaacataatctaaaggagcaccaacttcctattgttttagaagcaattctgacctccttttctgtttaaaaaatctaggtctaaaagtcgttttggtcaagggcgtcctgcataaagtaccttaaaatataagtaaaaagagagaaggcactcttctggacatctgaaattgctcacttcttgaagatcttcagaacaatgacttccaactgttttatgttattattattttaatccacataaatcataattctaaaagaaatgcatagttaggttttatgaaaatctaattgtaaatatgaaactttttaaatctgattttcttctaatatcattctaggctatgtagaaagcaattatttacaaatttgcatagttgagactcccagtgttttcctttatttatttgaaaaagaaaggcctaaactgtcaggtagccaagtttttttaagaccttaaaagttaggggaacacaactggtagtgttaccatgcatggcactgattgtagtatgtctttggagctgtaaatcttgagatagcattgagaactgcaggttgtgtgacgaaattcccaatgatgctaattttaagtctgcatgaatattaaggagtgacaggtctcaagactgcattaaatgaagtttcagggtaaggtatttcagtactgtgttgggcagaagggttaatttttttcagcattatatcgtggaaagtacaatgttaatccaacttttttttctttcagtttttaatgcttatctattgatcatctgagctggaattactgattattactctgtcctctgtgaaactagtggcattctgaatttggtaaaataaccattgatagttttaggatagtaaatcatttctgttatatgagacacccactgtacagttctcagggctctaaaacccaaccatatttctgtaaccattcaaataactccttaaaacagttatacttgctagttcggtctaaaattttccaaatacattagataggtgaaaatttgcatatattcaagaaaaatcaaaataaaattctattttataaatcatgtttaaatttttctagccaggcagaaagagtgctcagggaaaatttgttccaaactataaccatataataaattatgtgtttgtaaattatatgtaggtctctgaaaaactttaagatgcactgtttctatttttttaagtcttaatttgccttataactgacatttcttcaaattattcagagaacagactttaataatgtgtgacaaaagagcaatttccattgaaatattgaagtgttacactcagtttacacgtacagaaatcattctttttagtgagtcttttagttgataaatgaagctagatgttatttgataactggctttgccaaggtttttgaactgctgtttagaaattttgttcccatttatatttgtttcaattgtttgatactgtggaaatagacttttattttcgaaagaaaatgtcttgtagtacatattatatgtaagtactctgttaaataccagagttttttttgtagtttactgtgttttctgattaaaggatttggatttgtacatgtaaacagtgctgtaatggtcacgactagataaggaaaaaatatatatgctcttttgatttttaactgatggtaaaaaggcaaactgcttctcccctgggaggcctataccactgaattaatttttacaaaccagagtttatcagaatttgattctcttcagaatgcttttggccaggtgtagtggctcacgccagtaatcccagcactttgggaggccgaggcgggcagatcacctgaggtcaggagtttgagaccagcctggccaacgtggtgaaaccctatctctactaaaaatacaaaaagattagccaggcatggtggcatacacctgtagtcccagctactcgggaggctgaggcacaagaattgtttgaacccgggtggcagaggttgcagtgagctgagatcatgtttctgcgctcctagcctgggtgacagagcaagactccatctcaatttaaaacaaaaaaagaatgtgtttttaattttgttaatgtttgtctgttatacatagcactggtaccgcaaacattttacttaaactcttaatagcatttctttcgccagatactttaatatttcaccttacattaatcctggattcacatttctttaattgaaataa

SEQ ID NO: 11910 - DNA, 1403 bp, Homo sapiens
tcgttttcagaagacatgtcaaatatcaggtcacagcatgcagaagaacagtccaacaatggtagatatgacgattgtaaagaatttaaagacctccactgttccaaggattctaccctagctgaggaagaatctgagttcccttctacttctatctctgcagttctgtctgacttagctgacttgagaagctgtgatggccaagctttgccctcccaggaccctgaggttgctttatctctcagttgtggccattccagaggactctttagtcatatgcagcaacatgacattttagataccctgtgtaggaccattgaatctacaatccatgtcgtcacaaggatatctggcaaaggaaaccaagctgcttcttgacattaggtgtagcatgtctacttttaagtccctcacccccaacccccatgctgtttgtataagttttgcttatttgtttttgtgcttcagtttgtccagtgctctctgcttgaatggcaagatagatttataggcttaattcttggtcaggcagaactccagatgaaaaaaacttgcatcttcagtatacttcctaaagggcaatcagataatggatatgttttatgtaattaagagttcactttagtggctttcatttaatatggctgtctgggaagaacagggttgcctagccctgtacaatgtaatttaaacttacagcatttttactgtgtatgatatggtgtcctctgtgccagttttgtaccttatagaggcagattgcctccgatcgctgtggttcttattatcaaaattaagtttacttgtatacggaacaaccacaagaaatttgattctgtaaagaatcctctttagctgtggcctggcagtatataaatggtgctttatttaacagaatacctgtggaggaaataaagcacacttgatgtaaaaataattgttttatttttattgacatgactgattgattgattgctattctgtgcacttaattaaactgattgtgatgacttttcatttgtttacatacgttgcttcagtcttctcaggtgaaagtagtgagaaaaccgtgaaagaggggggaaacatttatccattatatgctgtttcactggaagtgttaccagcagtccacagaactaatgtgtccccacagacttctcaatcctctccacaccgaagtgcaaaaccacagcagggagatgtgcagggagatgtggagcaaaacacagccaatttgccctcacctcaacatgcttttgaatgcaatataccactgttttacgacctaagatctacacaccttaaaaaccctaaagtaaaataaaggaatagtgtcaacatgccatttattttttgtcatcttgaactaaaagtacagctgcaagcaagcttgctatagg

SEQ ID NO: 11911 - DNA, 1145 bp, Homo sapiens
gaaaaaaactaagggcttaattaagctaatacagttaaaggaattaaaagatttaacaagccaatataaaggaaatgaattcctaccttttgcagctctttttacctctttcaggcctactcttttgagtatggctgacagtcactttaccattgtctttggacagagaccctggaaagttggttaaagcagttgcctattctccctaatcttttgtgacctactgctttgtaattttgaagacttaacaatcttagagcaagtacttttttaaaaaaatgtgattaaactatttcttcagactagaatatacacacaaaatagcagagctctgaaggtgaggaatgtttaaaagagcttaatgagagtttaacttcaggatagaaagcaaatacgtttgctttgcacacatgtgcacacacagtctgagtctgaaaacatctatcgtagaggacgagtactaccattttgtggctcagtaagcaaaaatgaaattaagttttcaattttttcaaatcatttgtagtctttcaacactttgcacatgatgtatcacgaagctacagcttgccatgtgactggagatttagtagaacttctgtcaatatttctttcggttttgaagtctacacgcccttatcttcagagaaaaggtttgctcattcctacttcttatgttttgttcgtgctactagtaaagagagagaaggttttaaaatcatgtgccccagagaaattgtttttatcctagtttatgcacagaagatgaggctgaagctagctaaccatcaggaaatgtttgtcatgaactcctgatgtaaagctggaaggctcttttatgtttttgtacctgcctgaaaaatacgcaagcaggtatcaagatttcagagattggaaaacatttccaaacacagtaacaagctgggcactttgtaaagattctccagctggaaacttctttggcttagattagatcatttgcagtttcatgcgagatgactataaaacctacctgtcttatgtccctataagatactgtgaactctgaacttcttcatatacattcctagaaagtgggacatattatcaatgaaatatgttctttaagaaatctagcaggtttaacattagtagtaatcatctca

SEQ ID NO: 11912 - DNA, 1557 bp, Homo sapiens
ggtaccttttggtaggtcttctgactgcaaatgctgggttccctctgttaaatcatactacttcctgagaagaaataaaagataaagtgggaaaattctgcatcttaggcaagctaaagaaaagtggtttaaaaattattgccacttcaaaaataacaatggcagaatagaaggtatctatttttatcacctcttgggatctttttgtggggccaaggggaaagcagaaagatactaaaagagatgttcatgtccctttttattcattttaattattaaagggaacagtggctttgtgattaatgactgctgttcagtctattttatatcttacaaggatctgacagttttgttttacattttatagctgcagcttatcttctggtgtcccttataccaagcaattcattccgtcagatgttccggtcaacaaggtctttgcacatcccaacccgtgaccttccactcagtccagacacaacagtagtcctacatcaggtctacaacgtgctccttggtttgctctcaagagccaaactttatgttgatgctgctgttcatggcactacaaagctagtgccctattttagctttatgacttactgtttaatttccaaaactgagaagctgatgttttccacatatttcatggatttgtggaaccttttccagcctaaactttctgagccagcaatagctacaaatcacaataaacaggctttgctttcattttggtacaatgtctgtgctgactgtccagagaatatccgccttattgttcagaacccagtggtaaccaagaacattgccttcaattacatccttgctgaccatgatgatcaggatgtggtgctttttaaccgtgggatgctgccagcgtactatggcattctgaggctctgctgtgagcagtctcctgcattcacacgacaactggcttctcaccagaacatccagtgggcctttaagaatcttacaccacatgccagccaataccctggagtgagtaaaattgatactcttttatctgtatcctcaaatagattggaaatacctgtttttcccctggtgggaagtggtggcagaatatagaatagtctcaccattctttcttaagaacttaatgtgtatttgttttcttaaatacatatataaaatgctgtgttgttataaaattgataactgtgtagataacttttcttagggtgaagttaaagttgcatatccagtaaaacttacctgttttttaatttgtggttttgtaaatgtattcttcatgtgtgcctaatgaaaaaagccagcttcatggtacagttttaaggaattgagtactttgctatttaaaaatcagatacttagcaaaatctacatgctgtggtaaactgtgagctagacaattttatatctaaaactagtagtattccgcagtattttttctcaagctgcatccaaacaaatgaaatgcttaagagatcaatcgagatacatatatatgcagtctaaattgggtcccttttactctgcacacttacttgtaggttttatattaagtttcct

SEQ ID NO: 11913 - DNA, 1104 bp, Homo sapiens
tcaataaaacaacaaaaacgggcagccacagaatttgacctgctggccatagtttgccaacccccactctagattcctaggattcccctttctcatgaagaaactctccacagcagtacagcgagcttcttgtattctcacttagtaccaggttgggcatgtaatcagaaaagtaaagatgagaaaccttagagaaataaaaatacttttaaataaatttccaaatttagcaagacctagaagttatggagttctcatatttgtcttatggtacttggttattttaaattcattttgtaaaccagtgacatatttttctgaacacttcctgttgataaaagtaaaagtagctttaaaaatgggaaaaaaatagggtgaaacctttttaatctctaattgtcaaaaaagtactttagctttgtgtctaatagcatatacaaaaagtaagtaaaagtaattgctcattcagttggccttatattctgttcttgtcatgttatttgtaggtgattgaatacaatccttctcagtgtctagattggttggcagtgcagacaccccgaaataaactggcacacagctgggtcttacagaatatggaaaactgggtcgagcggtttcttttggctcacaattatcctagagtgaggacttgtaagtcaaatatttagaatttcataaaccatttatttattgttcaaagttatgtttcattttgtttttaggcaactacgacatgcccattgttgtatactacgaaattcttggagatgttatttcctttttttttttttttttttttttttttttttaggataggaaaccatgttatttcttgggtaacatcatcactactatcatttttgtttccttgcttgataagagtgataaggcatgatcagcagtaatgaagggaataaaaaggtttgaaaatcctgtcttaaaagtaacttttgagaaggttaaggataaaatggtaataaagacataagctgagagaaaatattggctgaaattatgagttatataaacactttaagttgtacacaagccagtaaaaaagatcttagacaggtagacacatatcaaaaatatttcacaaaa

SEQ ID NO: 11914 - DNA, 1150 bp, Homo sapiens
ttttttttttgtttgtttgtttgtttgtttgtttttgagacagagtctcactctgtctcccaggctggagtgcagtggtgctatctcagctcactgtaacccccacctcccaggttcaggcgattttcctgcctcagcctcccgagtagcagggattacaagcgcgtgccaccacgcctggctaatttttgtatttttagtagaaacggagtttcaccatgtcggccaggctgttctcgaactcctgacctcaaatgatccacccgcctcagccttccaaaatgctgggattacgtgagccaccatgcccggcagagaattgttattctttacagttctggcagtttaatctaagattgtcctgaatgtggtttagagtgttttacattaggtttaggtctttgtgcagttgtttttcatgttacaagctcctgccaccatctacactgttacataaaacaagtcatttgttctcaaaatgatattaaaactactaccgtattaaaattgaattttattccaacttagcctcaagttgaagtgttatcagaggaagaaggggaagaagaagaggaggaagaagatatcctctctctggcagaagaaaaatacaggccagctgcccttgaaaagatgatagctttagttgctcttttggttgaacagtctcgatcagaaaggtgaaatgtttcgaatttaaaatgtttaaagcatgtttggttttattatttttacataattgtttaccactagtttttccactagctttttattatatatgtttaattatgtaattgttattcactagcttttattatataaatccttttaaataatactactattcatcaactcttgtggcataagaatttcagttttttctaccaaacttttacttcatctatgagtcgtgttagaaatagtcattgaaaaaatatacagtaaaatatctagcaaaatagagcgtgcattcgttctttaacctagcaacttcatttctaggaatctgtgtccaaaatacagaaagatgtatatgcaaatctgtttattgaaaccatgcttctgatagcaaaagactagaatcagctgaatgtccatcaaaagggaactagttgaaaaaacagcatccattcaaaagaatatagctgaa

SEQ ID NO: 11915 - DNA, 2134 bp, Homo sapiens
ttattgtggttttggtatgcatttttctcaaaatggttacacatttttttcatgtgattgtgggtcacttgtgtatctttaaagaatcctcacatttccttctcctagctgctgaccccatgatgagcagcggcccttccccattccactcttcttaaggaattggatactagattttcttttctctgtatctccactagctaaaaggattttttgaagctttgtttttgatcatctgtattactgaaatgtacagtttgttgagttttttctctttatcataaaactgaatttttttaatgctacctttgcctcatttccttagtccattgttgagactccagaagagctccagaataccaagataatcttgtgcaaactataaatgggtggcagagaattttgaatcatgttaatttttcaaatctttgttacctgatgagttggctcttgtttgatctttttctttcttcacagatgtttcagcgtttgtgtatccatgtgattcagaggctgagacctgtgcatgctcatctctatttgcagccaggaatggaagatgggtaagaagtactttttgaataagtttgtgtgtctgtgttgtgtgtgtgtggtgtttttgttttttttttttgttttttttttttttttttaagagatagggtttcttcatgttgcccaggctggtctcaaactcgtaagttcaaatgatccgcccgcctcggcctcccaaattgctaggattacaggcatgaaccaccatgcttagccctaatttttaagtttcttaacaacctgcctacaaaatattttttaaaatccacactgaaatatttgttctgtttaaaaaataatctgtaataatacattcaagaaggtaaaactgtttttgttttatttaaattttgcatctgcaaaatcctctacaaattactttatggcttagtctttttgtttgcattgatttagccagtcacaataactacttaagttattgcggttcatattcattatctcaaagataaaagaaattcagagtttaaaaagtactttttctctcgaacagtatttccagacctcatacattctctaagatctatttaattgtctcttaggtcagatgatatggatacctcagtagaagatattggtggtcgttcatgtgtcactcgctttgtgagaaccctgttattaattatggaacatggtgtaaaacctcacagtaaacatcttacagagtattttgccttcctttacgaatttgcaaaaatgggtgaagaagaggtgaggctatatcttgtctatttttttgattatctaccttttttcagtatttgcaacttaattgcttttattttatatttttaaattttgtttgtttgtttgtttagagccaatttttgctttcattgcaagctatatctacaatggtacatttttacatgggaacaaaaggacctgaaaatgtaagtacagttctatcgtacattaggtattagaggctctggttttcatagtttgcatcgtgcgaagtcctgagatgttagaaccctttaaagtcccttctggaacctggtgttagataatatgaagggtctaagattggttgatgtttttaatgtaattttaatggatatagcaagaaagaaacaactaggtaatgaagttcattcattggtaaggtctggaacaaagcaaataaacttaggcaaagtggtcacctactttagggtcttatcaatagtgaattgtttttgtgaacattttgctggtcacatttttaagttctttgctattaagtttatgagagtctttccaaaatttaagtaggtggtctatgaataatattaaagtattacatcagttttgtgttgttcataacaaatgcattaggttgtatgatctacttgcactctttttcagtccttttcttaaccataagagataagtaccctttatatctccatttaacagatgagacaattgaaacttagagaagttaatttgttttagatcacagtgacttgttgtgctttgatcctcggtcagactactgagctaaaactcttaaacactgttttgtaatgcttcacagaatatacactagtagatcataaaatcttttgagtctgca

SEQ ID NO: 11916 - DNA, 1213 bp, Homo sapiens
ctgccagtacattggttcgttttccttttttttaaaaggaaaccatgtttaaaccacttttcttaacatgagaataaaagaagtatgctaattcctttttaggtcttaggtttgtctgctcctagtaaagattaaatagaatggagcattttatattacctatttcaaaagattagtcagattaaagaaatattttatatttatactttatattgaagttgtccataattatgtattaacacatggttgtttttctagtggtttgtttaatatgtcctttatggtagtaggctaaggatggtgaatgactagcagatagttgttttgtacctatttaacatataaactatttgtgcctatttctgtaaataaagtttattataaaagtgattctaagtaactcgtcacattgggaaaattatttttattttattaaaatgacttaaaatattgtaattgataaagtttattttaaaaagtgtttctaagtaactgttgtgaagtttggaaaattatttccattctgtgtaaatcatttcaggttttaaagaagtcagtgatcattcaaaagactcagagagctatgaatatgacttgataggagtgactgttcacacaggaacggcagatggtggacactattatagctttatcagagatatagtaaatccccatgcttataaaaacaataaatggtgagttttaaatatttcaaaacttctttaacaatttatggtagttttctgatatgttttcagtgtttagttttctaaaaacttgccacaaaagttggaaatgaggcagacaaaatttttaaatgaagataactttcaacagacagtgtaaatcagttcttaaacatacggatcttttaactcttgagaatttgaatcctttccttggagaaatgaacacagttttgcagacaactttaggagatttatagacaacatttcaactcttatcttctctattcattcaagagctgttcattgaatatcttctacagtgtagccttatatgtgccattagaagttacctgcatgctctgcttgtttcacctcctattgggaggaccacacacacttctttttatccttttatcaagttaatggttggaagtcattaaaccagtccccagtacctgttttttggtcttcagatattgttaggtagggtctggcctataggtactatatgtgtgctaggcact

SEQ ID NO: 11917 - DNA, 1101 bp, Homo sapiens
tttcaacagtataagtaaactgttgattttgccactgttattgttgctattatttattagtagagtgaagtaaggggaaagttaatgcagaagcgccagtcagacttgtcaagggaataatgaggccttaacaaaaactttacatcacttaatggaatagaaaataacaacattgtacgtgaagagtctaagaatgagcttattaggtatcaaaaaggagagaagagtaaaagttgatcgccgccttcgttttctcttaagagaaatgaacacggaggactttcagatgatggtatatcatgctgctatacgtttttgagtagcttaattgtagcctgtcatcctgtgtatatgttaactatatttggaatgtaattaatatctcagtttagataacatgtttccttttactccccaggaatttttgagagatatcttcaatctcctgtttttgttgccaagtctaaaggaccgacaacagccaaagtgcaaatcacattcttcaagagctgccgcttacgatttgttagtagagatggtaaaggggtctgttgagaactacaggctaatacacaactgggttatggcacaacacatgcagtgtaagcattcttcttttcctttaatctttatagattttgaattcagaaataagattttgagggcactgtttaacaaaagaatctgctcttcacacactttaacattataaatgattattggtagggtgttattaaagttaaaaagtaaacattgatgtgaaggacctttttatatgcattttaaatacttcggctttttctgtaaaagtaatttggggccaagtaaaatcaagttttaaaagtcttgaatttttagagaataaattagttttcatctgtatttttttttatttaaaaaattctatataatgttctatatatattaatgaggtaactaatggaggtagaggctgttaatgtaagcaaaatacattgtgtttcatagtttgtttgggggggatcttttcctccctctttcttcagcagcccatgcaccttataaatgggattactggcctcatgaagatgtccgtgctgaatgtagatttgttggccttac

SEQ ID NO: 11918 - DNA, 1585 bp, Homo sapiens
tatgacttttttttttattatactttaagttttagggtacatgtgcacaacgtgaaggtttgttacatatgtatacatgtgccatgttggtgtgctgtacccattaaatcgtcattgacttattttattatcaacattccattgattgtttttttgtagaatgatcagtgatgtttaagactcatttggttaattgacataatgtataagtaaagagtaggtgtattacgtttataacttattgaatttgggagaactaaattattgttacctataaggaaatgattttaataattttatgtttggtaaaacataaaaaatttatatttgaatttttattttctttttgtattaagacaacgctcctcgacttagatgccttggcaagacatttggctgactgtattcgaaggtaaaatttgatgtgaaattgacatttatattgtcgaggaaagataaaagacataattatgtgaactatcttgcttgtgtgtattttttttcttttttgtagtagggagatccttgatcatcaggatggtaatgtagaagatgatgggcttacaggactcctaaggcttgcaacaagtgttgttaaacacaaaccaccctttaaattttcaagggaaggacaggtaagtgttaagataatcaaatgtttctatgaaatgtgattgaaattttttgttgttacattgtgtattagtccgtttttacactgctcataaaggcatacccgagactgggcagtttacaaaagaaaagggtttaattcgactcagagttccatgtggctggggaggcctcacaatcgtgccggaaggcaagtccgggcaagtccgagcaagtcgcatcttatgtggatggcggcaggcaaaaaaagaatgagaaccaagcgaaagcggtttctccttataaaaccatcagatctcaagagacttattcacttatcacaagaacagtatgggggaaaccgccgccatgattcagtcatctcccaccaggtccctcccacaacaatgggaattataggcaatataattcaagatgagatttgggtggagacacggccaaactgtatcacattgtatgtggatatgttaatttttttaaacatacagacataaaaattgctagaaattaccgacaagaaaagcaaattttgaataaattgaattctggaaatataaaacgggcttgtttttagaatacaaaatcagatgttaattcctgtgactgactgaatatagaaaggtaacctaaggctgggcacggtggctcgtgcctatagtcctagcactttgagtggctgaggtaggtggattgcttgaaaccaggagttcgagaccagccaaggcaacatggtgaaacctcatccctacagaaaatacaaaaatttgctgggtgtggtggcacacacctgtagtctcagctactcaggaggctgaggtgggaggattgcttgagctcaggaggtcgaggcttcagtgagccatgatcacaccactgcactgtagcctaggtgacagaaggagaacgtgtctcaaaaaaaaaaaaaaaaaggtaacctatattttatcagtgt

SEQ ID NO: 11919 - DNA, 1169 bp, Homo sapiens
tatttatatattatggtataccttgagatactttatttgatcatgtgtaatttacatatatatatgtatgggattagaacattatatttattaattatttttatgaggcataatcttgttctgccacccagtctggagagcagtggcatatcagctcactgcagactctgcctccctggttcaagcaattcttgtgcctgtctccagagtagctgggactacaggcgcaagtcaccacacccggttaatttttgtattttttgtggtgacagggttttgccatgttggccaggctggtctcagatacctggccacaggttatcctcctgcctgggcctccaaaagtgctgggattacaggcttgcccggcagaacattgtatttaaaatcacctaaaattatttctgctaacatattaactttgtaatactaactctcactgtttgtggaactttctttttcatctagactgcagttcgtcatgaatcatgcagtggtctctataagttatccctgtcagggctggatggaggagactcaatcaatcgttcttttctgctattggctgcctcaacattattgaaatttcttcctgatgctcaagcactcaaacctattagggtaagattttactgtgtttagaagcagtttctatttttgaaatttcctttgcctcagtttaccgttgtaatatatccttaaaattttgatcatttgactactgtatgtgattttttaccaagaggatagtagttatatactacttaaggtgacagcattgtgacacattgtgtccatgttactactaggaagagactgatttcagctctgtggtctctcatggatactctattttagaaatagcatttattctcactcggttctgggccttgtgttaataagttgactaataaaaaatcataaatggagctctcttctctagtaagtcacagttttctttttatctttatgatattcagaattttaaattttatttcctaccctagttcatatactagtctttaaaaggcttctaatacataataaatttagagcccactttttactaaccccagaaattcagtgtgttgttggatttacattattttcctccctgttcatatcttttttaatgtcagtaatttgagactaatattttcctaaaagtt

SEQ ID NO: 11920 - DNA, 1208 bp, Homo sapiens
aatatagtctcttttgcaaaaattagctgagtgtggtggcacatgcttgtagtcccagctattgggaggctgaggtgggagggttgcttgagcctggaaggtcaaggctgcagtgagccatgatcatgccactgcactccagcctgggcaacagagtgagaccctgtctcctgtcttttaaaacacacacacactcacactctctctcactctcactctcactctcactcacacacccactgctttccttttttgggggggaagtgataaccttaaaggatatatgttaataaattgaattatttttaattcattgctgaatttaattggtggtggtggtgtttttactttacagagttttaaaagctcagtctgatcacaggtctagacatgaaggtaagggttccacaaagttaacttttaataaataaaaacttgaataatatattgatatattttacctttaatattgaacattgtgttttcattttagcacaaaccttttatagtgaactgttttctaatttttctttagtttcacattattcaatgtggctcttggtgagttgggctcattgctgttctttagtgaaatctagccttgctgatagcgatcatttacaagattggctaaagaaattgactctccttattcctgaggtaagataaagattgaaggttagtactgttattttttgtatgttttcatgttattagcattgataataaaagagctaatggaaacaaatatgcgtgagtccataaatatatcacattatctgcttaatcctttaaggtctagagtgttttgaactatgtacaatgtttaagaacttctgactattatatattatgtagcatttatatttttctgaaatgtttatagaatgattattttgctttggattaataaaaaaaagtttttccaggtagtaggaagggcttgagaatttattttggtaatttatgttttagaaaagttctgtggccttttttttttctttctttgagacagaatctccctgttccctgtatcacccaggctagagtgtagtggtgcaatcaaggctccctgcagcctcaacctcctgggaacaagcgatcctctggcttcagcctcccaagtagctgggaccataggtgcacatcaccatgcccagctagttttttaacttttttgtagagacggggtctcgctgtgttgtcca

SEQ ID NO: 11921 - DNA, 1103 bp, Homo sapiens
cacaatctcagctcactgcagccactgcctcccagactcaggtgttcctcccttctcagcctccaaagtagatgggactgtagacatgcaccacacacccagctaatttttgtatttttagtggaaacagagttttaccacattggccagctagtgtcggatttctgggctcaagcaatccacccacctgagcctccctaattgctgggattacagcaattacagtgagccaccatacccagcctacagttgctgctcttaagtgtgattataaaattctggttttccgattcttggcatttttacagtattttcaaagaattcttacgacattctttattgtgttatagataaatatcaaaataatttggaattttgggttaaaattttgtaatacacatctctttagtaactaaatcttgagtgctttttgagggttttccttttgctgtatttaaatatcttttaaaatgtttttgttttaaaggtatttcttgttcttgtccaaggaaccagtttgattcagcgacttatgtctgttgcttatacgtatgataatctggctcctaggtatgcattttaagatatattttatgtgtgtatgtatagcaggaatataatgttttaaaactttattttgaaaaattctaaacttaatagaaaaatttgggggatattatgatgaaatctctcataccttccatccaaatttacgtattattaacctgttgctaaaatgtgtcttgtatttatgagtcacgtattttctgtgtgtttacatgttttcctgaatcttctgagactgaattgcagatatcatgactgttcaccagtactttgttgtgtatctcctaagaccaaggagattttcttaatagctagagtaaaatttttaaatttatagaatttaacattgatatgttatctaacatatagttcatattaaaataatcctattggtattctttatagcagtatttttcttgcttcaggatcaactaaatgtattgcatttagttgtcagttcttctgtttcttttcatcagagataactttctcagcctttctctcatgatacattttcaagtaatgcaggccagtta

SEQ ID NO: 11922 - DNA, 1179 bp, Homo sapiens
gaattactagcaattgctttggtccgtaagtattaagagtttgtgccactcgttgggagacacagcatataatactttgtttctcagttaattttattgataagtaatatccttgtcatcttaattttttaaaaaattataaattatgagcagtatgttttttcaaaaatctcatagctattacatatatttttatattgccttcattaaagaaatgaaagtgtcatttccatttcattaaatacatcttgtataccctctttatttctagatactttttcttcatttttataagattgaattggtactgaccataatatttgagcagcagaatttttatagtacatgattaagtactagctataattatttttattttctggtcttttaatttcaaaattgtattgtggccattctaaattaatgaaaatagggaattgactatttcttctcatttacagtggcagctagactgtcttgcttgcttgctgaagttaatatgccagtttgcagtagatccatccgatttggatttagcttatcatgatgtctttgcctggtctggtatagcggaaagccataggaaaagaacctggcctggcaaatcaaggaaggctgctggtgatcatgctaagggtcttcatataccacgattaacagaggtaaagtgcagaaattaatgtttaatgatgaattccatttatttttataaactgaagaaatatgctaatgcttaagaaatgtattctagattactgtgacttaacctgacagctgaactgacggcattgttttaaagcagtagtgattatgaagcagtattgcttttcatttcatcatccagaatgcagaaatgagtcgtgccattttaatatctgtgagactgaatttattatttgaactcagtaatttatatactttggggatgcatttatgaaaacagaagccatagttggtatttcaacataggaaatttaaaatagagaatcagttttacacgtatgtgttacaaggctttaaaaacaaaagggagtggtgaggtaagccagataaggagccatttatcacccctagatcttgtggaacattagggaagtggttgggttatcaggaacttagaagcttgcaggagggatcctgttaaaccggggtttaggcctctgagaaagcagttacgct

SEQ ID NO: 11923 - DNA, 1450 bp, Homo sapiens
cagctacttaggaggctaaggcatgagaatccttggaaacctgggaggcagaggttgcagtgagccaagattgcgccactgcactccagcctgggcaagtgagtgagactctgttctcaaaaaaaaaaaaaaattgggtgagaacttgagttagcatatgttgttaattttctgtgaatacaagaaagcagtggttttctcagtttaggttggatggattcattgaagcattgtgctcgttattgtgttggttttattcctttatagtatgtttttcaggactagaattttcgtactatgtagtcacaacttgtgagttaaacatgtatatattgttatctgctgtataaatattttttagaactagtacaggtgtatttcatcaattgaggaaatttttaaatcatttatttttattatttaatagctgaataataggagttgcctatgatttttacttttgatacttcagtcttaatgagttacatagtttgacaaacaaaatttagagataccatatttttctttcttagctgtgtggtatggaccaattttggggcattgctttaagagcacaatctggtgatgtcagtcgagcagctatccagtatattaactcctattatattaatggtaagtgatttgaaacattgtctgataggtaatttctatgtgagggtgttttgtgaaactaaaatttttctttgatatagctaaacaagaatataaggctaatatatgtgtctaaacatttggctttcaggtaaaacaggtttggagaaggagcaagaatttattagtaagtgcatggagagtcttatgatagcttctagcagtcttgaacaggaatcacactcaagtctcatggttatagaaagaggactccttatgctgaagacacatctggaagcgtttaggagaaggtaatttttaaaatatcacactgttagaatgaatttcatttttattcctgacatatccagaaatattcttaaagtgaatctaaagtttttgttggggtcaagtagaaagcataatttaccaaagtgaaggatcagtaacataagtaatttttattaagaatatataccattttgccttggaataggcaatacgggttcctgataaatattgcacacctttaataatagagtttgagcagatatgcatgaataagaattgttagacagaattccatctctaagataaagtattgactttgattaaaaaggcagaacaccactactaaaaaaagtttctctaaaactcttaccaagaacatcaaataatctcatagttgaatcaagttgagtcatatgtttcatttgctgttttttttttcttcctggactaggagacagtattttaattttgaatttccatttaccatggaaacatgaccaaaaaattctgttaatgaatatctgtataattaatttagacataacct

SEQ ID NO: 11924 - DNA, 1108 bp, Homo sapiens
ctggagtgcagtggccgatcttgtatcactgcaaccttcacctcccaggttcaagcaattctcctgtctcagcctcctgagtaactgagattacaggcacacgccaccatgcccagctaattttttgtattttaatagaggcagcgtttcaccatgttggccaggctggtctggatctcccaagctcaggcagtccacccacctcggcctcccaaagtgctaggattacagatgggagccacttcacctggctgctgtgattcttttttttttttttaatcataaatatgctgtaggaacataactcttatttatatcaattaacatatggtaaagttagtttcattatgcatcatttcaattaaaattgcaatttccaagaacctatctgtgttaagtgaggacttactgtacatacacatgcctaagagaagtttaatttttttgtatgtagttaataaagtataaaatttataatttttatctagggttaagtttagagcaagttgacatcttatggcattgtttagtagaagattctgaatgttatgatgatgcactccattggtttttaaatcaagttcgaagtaaagatcaacatgctatgggtatggaaacctacaaacatcttttcctggagaaggtaattacatttctctcagtttgttattatttttccatgttccctttttcatctcttgaaatacgaattctgtaatgcctttttttttttgacagtttttttaagtagccaaatgtaatgaattttagcagtcctaatataatttttggtcagattgtgctctaattttgttgtttacactgtttacctctaaattaatagtttatatttataaaaatgttctattagctacaataattcaacaattacaataacttttgaaggcagcactaattttcttagtgtttgtttttttgaaataatcagtaatattgtagtccaattttcaggggtggtgcccacacccacaagtgtgagagctgttttctgtgactcttcatgatttaaataactgtcattgcagtcagtcttttgggcaaagataagccattctccagatgtgtagattgtgggaaggcatattaa

SEQ ID NO: 11925 - DNA, 1160 bp, Homo sapiens
ggtatatatacataattcatgtttgggcttgtcctctcctttacgtaatatttttgacatcctttgagtttttaattccattttgtattgttcaaaggagtataacaagactggcagcctttttaaaaagtacagtttattaatgttggttaccttttttcttactggtttaaatatttatttaaatctatttgtttcaaaatacaggaatccatgcagggaagttctgacgaaactgccaacagtggtgaagatggaagcagtggtcctggtagcagtagtgggcatagtgatggatctagcaatgaggttaattctagccacgcaagccagtcagctgggagccctggcagtgaggtacagtcagaagacattgcagatattgaagccctcaaagaggaagatgaagacgatgatcatggtcataatcctcccaaaagcagttgtggtacagatcttcggaatagaaagttagagagtcaagcaggcatttgcctgggggactcccaaggcatgtcagaaagaaatgggacaagcagcggaacaggaaaggacctggtttttaacactgaatcattgccatcagtagataatcgaatgcgaatgctggatgcttgttcacactctgaagacccagaacatgatatttcaggggaaatgaatgctactcatatagcacaagggtctcaggagtcttgtatcacacgaactggggacttccttggggagactattgggaatgaattatttaattgtcgacaatttattggtccacagcatcaccaccaccaccaccaccatcaccaccaccacgatgggtaagcctacttcaaaataaatattcagttcatatttcctttagggaagtattatatcctatattcaatttgcaatttattctgtattagtgctattcattagtagtatagtgcaaactataaatgtaagctacaaatagataatttcaagttttctattgggcacatttaaaaacacaaaatgaagcaggttgttggccatgcacagtggctcacacctataatcccagcactttgggaggccgaggcaggtggatcacttgaggtcaggagtttgagaccagcctgaacaacatggtgaaaccccatctctactaaaaatagaaaaattagccgggcatg

SEQ ID NO: 11926 - DNA, 1187 bp, Homo sapiens
gaaacctttcctgagtgcttcaatacatactgtggaaattaaaaagtgggaaggcaaagacctcgagtaggataatacatcactaaatcagtgttacacttgtgtacttggtgttaatcgttaccttttcagttattcgttgcttgtttataaactcagggaatttgaatttataaattcagcatcatatttcattctagttatgctttgtagtattctataaaactgattgtatctaattctttataattcctataggaacaaatttaggttttcaattgactctaccttttagacatgagaaaagatgacaattttttttaatgtactattttcattgcttgactttaggtccattgcaaaagaacttgcagactggcttattagcaacaatgtggtggagcatatatttggaccaaatttacatattgaggtttgtggatgattacataacttctctgttctattgatagagaagaatatttttaaaaattgatattaagtttttcttttccagattatcaaacagtgccaagtgattttgaattttttggcagcagaagggcgactgagtactcaacatattgactgtatttgggctgcagcacaggtaatattaacagctcacatttattgagtgctttgcttatcatatgttctaagtgcttctctgtgaggtaaattctattatcctgttttatagctaaggagaccaagacatggacaagctgggactgaaatctggcttccgagtccatgtcttactatgttactggtagaatggaaggaaatcagagtcagtcagttggagcttcttcatgaaaccatcctggtttaataaagagacattttcctgttattctcatttatacagtctacccttctatcctgaattattgtattggtatgtttcttgtctgatgtactgtttttttttttttttttttaaataggcatatatccacatgattcaaaattccaaaagtaaatataaaaaatatattacatgtttttcctttctgccccatctctcaagcatgcagttattatcttctcaggtatatcagatttttttgtataaatagcgaactgtatacatttttcttcctctttctttttcacaaatgtagcataccaaccagatgtggctttgacttttttttttttctttcttaatttattctgga

SEQ ID NO: 11927 - DNA, 1269 bp, Homo sapiens
gattggtcttgtggggtgagcgggaatctcatatatgtcttgtagttggcttcatgtcagttggagcatcaggcacttctctttcatccagcaggctaaccttggttccttgttttgttggtgattagagttcccagcaagagaaggcaagctcaaaggcttttctagcttccacttatgtcatgtctattaatatctcattggccaaagcaagttacatggcaaggcccagatttaaggtgtagaaatagattacaccttttgatgagaggaatagcaaagtcacattgcaaattcttgtacatataatgatgggaggaatttgtggccattttgtaatccattacaggccttgaggaagactaatgttgaaaggttggacagcagagaaggaatctgccaaagagattaggcagggcctgagaggaaaaccagaggtttgtgggttttggacacaaaaaatgttaatgcttacaatgtacattttaagttactgagtggtctttaaaaatgctttatgaatttttgtgtattttctatttctgaatcatttcaggtatttatgcaagctctcggatcaggagttacgacagagtgcagctcgtaacatggctgacttaatgtggagcacagtcaaagaaccattggatacaacattatgctttgataaagaaagcctagatcttgcatttaagtactttatgtcacctactttgactatgaggttggctggattgagtcagataacagtaagctgtatttgttttatttttggtcatcgtttatttgttttctggtctatcataatactacccactatttatggagcacttcatactaggcattgtgctaagtattttatgtggattactttatatggtcttcacaaataatttctgtgtttctcttattttaaataagtctgaagcttagatttatatggatttatactgtgggtccatttgatttccgggtccaactctttcatcattttgtttctgtctttttaaactatttaggtttttatgtttatagatgttttgagaaagaggaataattggagggctttataagcagttaattaattttccaggcagaaaccatagattattgggccgtaggccaaattttactaaatgtttgttttgaatagtcttaaatactgtttttaaataggacaaagtaacatgaaaatctgtattcttggcttctcttggtgagggggttggaagaaggcctggtattcttgggtctgtattcttgcataac

SEQ ID NO: 11928 - DNA, 1443 bp, Homo sapiens
ggaagagagagaaatagccctacggcaggctgatgaagagaaacataaacgtcaaatgtctgtccctggcatctttaatccacatgagattccagaagaaatgtgtgattaaaatccaaattcatgctgttttttttctctgcaactcgttagcagaggaaaacagcatgtgggtatttgtcgaccaaaatgatgccaatttgtaaattaaaatgtcacctagtggccctttttcttatgtgtttttttgtataagaaattttctgtgaaatatccttccattgtttaagcttttgttttggtcatctttatttagtttgcatgaagttgaaaattaaggcatttttaaaaattttacttcatgcccatttttgtggctgggctggggggaggaggcaaattcgatttgaacatatacttgtaattctaatgcaaaattatacaatttttcctgtaaacaataccaatttttaattagggagcattttccttctagtctatttcagcctagaagaaaagataatgagtaaaacaaattgcgttgtttaaaggattatagtgctgcattgtctgaagttagcacctcttggactgaatcgtttgtctagactacatgtattacaaagtctctttggcaagattgcagcaagatcatgtgcatatcatcccattgtaaagcgacttcaaaaatatgggaacacagttagttatttttacacagttctttttgtttttgtgtgtgtgtgctgtcgcttgtcgacaacagctttttgttttcctcaatgaggagtgttgctcatttgtgagccttcattaactcgaagtgaaatggttaaaaatatttatcctgttagaataggctgcatctttttaacaactcattaaaaaacaaaacaactctggcttttgagatgacttatactaatttacattgtttaccaagctgtagtgctttaagaacactacttaaaaagcaaaataaacttggtttacatttatttttcctttattgactcatttattcctatattaatgatagtgggtatttgtgtttaagcatcaagtaacattttaaatgaagttggaccccttgatttacaaacaagatttctaaggttattgttcctagtaaatgcagcagttgtgtaaaatgaacatgttcctaagataccttttgttctcaagaaacaaattcctcctgtggcattttgactcattttacctttatttgggattagagggcacttcttgtctaactctacttagcatctaaatgtaacaaagaataaacattagccttggaatgagaacacagatgtaacctggtacaaatactaattgtattcttaaaaaatgtaagtaaactaagtagccatgagccttctcaaaagggtgagtggagccaggcttggtagctcacacctgtaatccctgccctttggg

SEQ ID NO: 11929 - DNA, 1099 bp, Homo sapiens
cctagagatataagaataggtatactggacctaggagttctgtatgtggtttaatattagcaaaagggtgttgggatattagggcttaaaaataatagtgttggctgagtgcaatagctcagacctttaatcccagcactttgggaggctaaggtgggaggattgcttgagccaggagtttgagaccagcctggacaacataacaagataccgtctctacaaaaatgttaaaaataagcttagtgcgatggcacatacctgtggttccagctactcgggaggggctgaggaggactgattgggcctaggaggtggaggctgcagtgagctttggtcataccactgcactccagcctggacagagtgataccttgtctcaaaaaaataataataaaatattaagtgtctttagttgttttataaaatgcgaactgatcgtcccttttaaaatttgcagatgcttcctttaaataccaatattcgacttgcgtactcaaatggaaaagatgatgaacagaacttcattcaaaatctcagtttgtttctctgcacctttcttaaggaacatgatcaacttatagaaaaaagattaaatctcagggaaactcttatggaggtaagatatgtggagcttttgctcctaaaattctgctctgcctactaataactcttaaaagtgcctttttctaaaatgtatgtaccttttgagatttcttattacttaatatttgatcagtacattatatatattctcaattctgaattacagttataagcccagttttctgattttatgttctccataaagctaggactaaaaatttataatcaaaattaaattactaattattatatcatttctaaggttaaaatttcaaagaccttattttaaaatttcagttttaattcaaataacatgcatttgttcatttaaagatatacaattcatcgtgtaatcccagcactttgggaggcggaggtgggtggatcacttgaggcaggagttcgagaccagcctggcctacatcgtgaatctctgtctctattaaaaatacaaaaaaattagctgtgcgtggtgtcacatgactgtaatcccagc

SEQ ID NO: 11930 - DNA, 1207 bp, Homo sapiens
aaaaatgttactgtttcaaataagtaaaatatttgcacctttaaagattaggagttggctgggcatggtggctcactcctataatctcagcactttgggaggccaaggcaggcagatcacctgaggtcaggagttcaagaccagcctggccaacatggtgaaaccccatctctactaaaaatacaaaaattagctggctgtggtggcacctgcctataatcccagctactcaggaggctgaggcgggagaatcgcttgaacccaggaggcagaggttgcagggtgctgagatcgcaccactgcagtccagcctgggtgatagagccaagactctgtctcaaaaaaaaaaaaaaaaaattgggagtcatatttatataattttatttctatttctgtaaggtctaatttttgagtatttctgaacatcaataatagaatctctgtccaattagaatttgtgccttgctcagtagttttcattttaatgaatgattcaaaagaatacattagcttaagttttgttttttttaataatattttagcaaagaatggctcaagaagtactgacacatttaaaggagcatcctgatgcttggacaagagtcgacacaattttggaattttctcagaatatgaatacgaaagtaagcaagtggtggttttaaaatctgttatttcttttcttccagtcataaactttgaggaaggtatctcatttttagtattagcatttgttatctcaaattattttatattgttaatttgtttcaaaatttagtcttaagcatataattaattcttgcaaatagtcctaagaattatgaatgaagttttgtaatgggactagtatgcaaggtggcttttttggttgtctgattttgtttttttctttttagtatatgtatacaggtctaagtagcataaattctgaatgttattcagagattaaacataacattaaggaattattttgggcaagtaatcaatataatacaggccaggcacctctgacaccaagttgtgtggacagcttaaaaccctactccatggcattgggcttctaatgggacagcactcagtttttatttacaatggaaaatgttataattctggtccttttttaagtttgaacagaagggttgatcaaaatgtgttttgtctgttttaggcttgatgattcacgcttctctttaaactgccttaaagt

SEQ ID NO: 11931 - DNA, 1606 bp, Homo sapiens
ccatctcaaaaaaataaaaataaataaataaatggggaaaaaataatgacctagttatttcgtgtgttttatagtgtcattggggacagagtacattttaatactggaattgtactaaaatttccaatagaattggaaatcttaattttgaccttacgaacttagtaaactaaagcatttttcttcagaaataatgattggccatttaagaaacagtaattaaaaccttaaaggcatttgaagagcaaaatttttttaatctagcattgacataatcactgattttgtattttagagatgctcttagtgatcttgcattacactttctgaataaaatgaagatcatggtgattaaggatattgaaagagaagacattgaattcatttgtaaggtaaaacattaacatctgtatttgtggaaaatgtctgataattagataaatgtcttaatttgtggatttgactgttttttccagacaattggaaccaagccagttgctcatattgaccaatttactgctgacatgctgggttctgctgagttagctgaggaggtcaatttaaatggttctggcaaactgctcaaggtaacagtattacacttaaatttttatttgcttaggtttgggtatggggttttaggttgttttttttctttttttgagacggagtctcactctgtcgcccaggttggagtgcagtggcatgatcttggctcactacaagctccgcctcccgggttcatgccattctcctgcctcagcctcccgggaagctgggactacaggcgcctgccaccacgccctgctaattttttgtatttttagtagagacggggtttcactgtgttagtcaggatggtctcgatctcctcacctcgttagccacccgcctcatcctcccaaagtgttgggtttacaggcgtgagccgccgtgcccggcctgggtgtggggtttttttgacccttcaaatacttaatttggaatttgtttactgaagattacaggctgtgccagccctggaaaaacagttacaattgttgttcgtggttctaacaaactggtgattgaagaagctgagcgctccattcatgatgccctatgtgttattcgttgtttagtgaagaagaggtaatgtcagtgttacattattaagtaacattttgaacattaaaactattatattctattttttaaagatataaatagcaaattattaaaaataattttcttttggataaaataagctaaaaatatatttgtgaatttcagggctcttattgcaggaggtggtgctccagaaatagagttggccctacgattaactgaatattcacgaacactgagtggtatggaatcctactgcgttcgtgcttttgcagatgctatggaggtcattccatctacactagctgaaaatgccggcctgaatcccatttctacagtaacagaactaagaaaccggcatgcccagggagaaaaaactgcaggcattaatgtccgaaaggtaatcatttaatctctaatgtagaaaatattgattaatttaaaatattaaaagctttgtagtcatctgttgaatggaaagctctgtaatgaaaagcat

SEQ ID NO: 11932 - DNA, 1205 bp, Homo sapiens
tcttcatacccacaccccactgcaaaaattataagagtctttcttaagtatctttgtcattgaaaaattaggacttttttctactgtgaaggtaacttttttttttttttaataattctaggtggtttctcagtattcaagtctgctttctccaatgagtgtaaatgcagtgatgaaagtgattgacccagccacagccaccagtgtagatcttagagatattaaaatagttaagaagcttgggtaagcatctctaattacaacttgaataaaaatttgaaaatgagcatcagattgccaaaaataaataaaaacacctagatgaaagtcacaaagctctcttttctctttttggttttgttttcgtgagaatttgtattagtatgggcatctggagattttgtttatgttaccttatgatagtaaggcagcagtggatcaaagagatccaggagtggggcaataataaatgtgaggctgaatcatattttattggactgatgacttttaatctgttcatctattaaacgtacagatgtccactccctcttaactacccctctttgttttcttttatccttagtgggacaattgatgactgtgagttggtggaagggctggttctcacccaaaaagtgtcaaattctggcataaccagagttgaaaaggccaagattgggcttattcagttttgcttatctgctcccaaaacagacgtaagtagaatccaaatgaaattggttctctgtgtttaactttttaataactcaggcatttctttattaaaaatagaaaatactactagtgatttaaagcagatctcaaaagacttactagaattgagacaaaaatagtaattgttggtgccacaagtgacaagtctgtatcctcagttgggatattgaaattgagagctagccatttgcaacgatgcctgtagtcccagctccttgggaaattgaagcagaaaaattgcttgaacctaggagtttgaggttgcagggtgctattccatgacctgtgaatagtccctgcactccactccagcctgggcaacatagtgggaccccatcttttcactgttgctgttaatttacaaattcacacagattagagagggaccctatcttttgaaaacaactagggtaaccattttatattttttggttataaaaaatttacttgcaaaatgtaagataccagtg

SEQ ID NO: 11933 - DNA, 1063 bp, Homo sapiens
aataatacagggatgtaggcttttaagccaggaattaaacttgaaaacaatggtgccttccacggacacccttaccaggtgactcaaggttggcagaacacatcacatatatcccctcaggtatgaaaatggtaaatgtatcctggagtggcccagcatctcagaaagcaattataataaaatattcctaggatgtgttttccctgaggatgagtgatgactttgactcttcatcttctaactccaaagcactgctgtctcaaatagtcaaaatgacaagggaaggaatgttttcgttggagagtctcaacgctgtttccagcacatttttccatttgcctgactgctcttggccctgaatggagtcggaggtggagttctttctactgaaatcataaaagtctctttattggcatgtgtgcattcagatatgctcttggtattgctcatgttgttagctgcagctgggtttgctgtgagtgaattgtttttgtctttagttaggatcacatgttgactcatgactgcctgtatcctgcgattggagtaggcattttagtaaggggcttaattattcttgtatttttgttttgtctttttcactcttcaatccatatgcttatttgggcttgcttgcaaaaggaagaaatatttggttcattccattttatgcaataaaggcaagagcttactgggggcttgggagctgtttttataacatagggggctgttttcatgacctagcagactgaagttttcaaaataaattgggcaagccttaggcgttactaaaatgttgtgagataaggagtgcacttgtgccccaatttgaactctgttaaaaaaatttttaaaaatcaaaaataaaacaaaaaccttgcatcaaagtgttaatatgtaagcctgtacatttgagctccacagtctttacacatattaaatcaacaatcagtcagctgggcatggtggctcaggcctgtaatctcagcactttgggaggtcaaggtgggtggatcacttgaggttagaagttcaagactagcctagccaacacagtgaaacc

SEQ ID NO: 11934 - DNA, 1153 bp, Homo sapiens
tttaaaaaatctcctaactagatttcatatactcctcccattaaagctacttacttaaatgaagatcttgaaaaaacaaatacatatattgaattttattgctgagactgcctaaagacttaagacatgaaaaatcttatcagtaaactgttataaaaacaacaacaaaagccctatatgtaaatgtaaaccaagcaccttttaatttctctatgaaggttagataatgctggtggccttgcaagtaggcctccaaaaggggctggccatgctgtggcaccgggtccacttcccgctcttagttctacctctaacaaggagacagagaatctagaactactgccaggattgttacagaaggacacattacaattttccttaactgttatttgtttttcatgtttaatattgtttataaaaaaagttacttcactgtaaaaaaaaaaaagttgtacataaacttgatcactgtaagataatcaaattgcatttcagttgcaagtacactcttttgttttccctgtcacttagggaacggttatcatcattgcaaatcatggtgacagaattgatatcccacctggagcagtattagagaacaagattgtgtctggaaaccttcgcatcttggaccactgaaatgaaaaatactgtggacacttaaataatgggctagtttcttacaatgaaatgttctctaggattctaaaataggcaggtactttactatgttactgtaccctgcagtgttgatttttaaaatagagttttctgcagtatgcttttagtctaagaaaagcacagatggagcaatactttccttctttgaagagaatcccaaaagttagttcatcttaaagtgcaatattgtttaatcttaaaactgggcaactttggaagaacttttaacagaagcctcaatgatgatcactttgaattgcttgtgatttcaaaaataaagcagtgaagcaatacttgtgtacactggtactttataatgctaactataaactggtttattgttgttagacagttactatattagttggaagatttgccctttaagtacacactggctagttacctagccagtgtgtacttaatgagtccagtttttggcatttctaagaatcttaatcataccattatttcc

SEQ ID NO: 11935 - DNA, 1762 bp, Homo sapiens
acttagaaacctagcctgcttttcccttgagtttactattttagtcagcactcccatactctagtgctaaccaatcaaaaacattttagtttagcctgttattttctctgtatattaattcatgctgtttcaagataaatctgattttcttgggctgaatttatcatgaaactgactctaacagccattggtttattcattttccaaatatttattattgaagtacagcattaaatggcctacttattcatagcaggaatcctgctaagtaaagtatttggacacttgggcactaagaaatctgaattttagataataggactctgactcggtgagcactgttactttaattatctgaatagaaagtttgagatttaaaaaataattttctctccattatttaggttggtcacagcagatgtagctttttacactggaaatcttcaagccttaaaaggccttaaagatttggacctaaatatggccgaaatttgggagcagaagaggtgatgtcatcctggaaaactgggtagttcatctgaccatgggatgtgtttgttatgaagaaaatctggatgcctgtgattcgagaattgaacctgaaacccaaagtgaactggggtgggggaagggaaaaaggaaagtatcaagtgttgggaaactggattcagtgggatctacaaggaatgtcatttttgtgcatcctacagtgaggagtaactgatcaggtgtctataacatttttcattctctctggaaacagactcaggtttctttggaccaaatccaaaagaacacatagctgtaacacagctgtagttgactagaatgctctgtatactttatattaaaaaatgctttgcatttcttccagtgcaatgaaattcatatggtgtcccaccttatttaatgatggtacaatttaaaatcttagtcaacttctgtagaaagttttctctatgaaagtaaagctgtttgaaaaattattatttttttacagatctttctataaaaaataaacatcttttgattgcttggatttaggaattcaatttttgtttcagtgaccaatgtcaagttgcaggctttgtgtgttgcatatttaatatttctactaccaccgtatgtcaactgggtaaagccttccagagctctctaaatacctgaaagacttaagcctttttttaagtaattaatacttaaaaaaaaagatcctggcatctatttatgcaactaaatacttttcagaaatggtatataaaaggctacagtttaatatctgtatttttataaaagtatgatgaagggtttggggtgtttttatttgtagcagaggtaagaatatgtattcatataatctgcctacttttgagttctcatattaacatttagataacatatgaagtatggcccccttggatccttgtttttaagttactttcgatgtgtatacgaacaaagaccagggagaaacagaacttttaaaactataggctgctgtgttggggccagaaataaggtgacaagtaaagacttttataatacctaccttcaaaattagaatcagcagcactgtacaaataaagtgcctgtgcttcacctcacaccaagaatcttgcctaaccctgtcagagtgcctaatatcctgtggtgattatgtataatgaaacagtcttattttgtgctctttggtttcttaaaaggaaagcttgttttctttcctttatcattacagaggtatgtctttggttcttaaactatc

SEQ ID NO: 11936 - DNA, 1099 bp, Homo sapiens
ttttttttccatctcactaagaaaatctggactaggttttcttcatcaattcattagttatgatggaggacctactatgttggtaatcagaaacactggataggctttttgtcagtgtttctgaattggctaatgaatgcaatacctgtcttactgaagcgactcccttacttaataagaatgccatacagagagtattatgcctgttgtacagaatttaaggagccactcattctcagtgttgtgcaagctgatcctgcaattgcacagagtaagagcctctttaaattttgcattctagacacctctcttgtcttgtgttagtcaagaacctgctgtactagtaggtaaaatgcatactttaacatagttaccaaggtcattatattctcagagatcctttgtgccattaagtaatttgatttttatatgccaaatccttttgatttttcttgttttgatttcctattgggccatttttcttttcttgtagaaccgtattgctgttaataagaattatccttgaatattgccagtgtgtggataacatcccatctgttactactgacatgcttactcgtctgtcagatttattgaaggtatgtatgacttcactccattatggaaaaatttttcgaggaattaatacattagggtgtgactaatcttaactcaaagacatttcaaggtcaaattaactttaagacattagttttataacatttgattgtggttgaatcacaacatgttattggaaacaggctgcctgcttccttcttactccacagttagtgatcctcattcacccatagagttgttaatgacattggagacaggagatgatttgttcgttaggtgctgaacatgactgaggccacttaggtcaaaaaacctggactggcttcaaatgtgcatggaaggaattcactgaactttacaaaattcatctcactaaggttagagatttttcttgcatcattctttcagaaccattgatataaaatgaaaatgtgatgattttattcagccatttcatattgagatattttaaactaccagtacggaggaaatgctttattatttttttcaaacctctaat

SEQ ID NO: 11937 - DNA, 1755 bp, Homo sapiens
taacatttaataaagtcagtgttaccactgatgtggtctactagggagatgttgagatatgaagtaatctaaaataaataggagttattaaagcattattttcagataaatgattaaatgacattttgaaatatatgttaataactaatttgaaattaatgttgttttacatatatagtaagtctatatatgtatacctaaatatatgtagttaaacaagtttataataaaactccaacattgtgaaaattttatagtatgacctaaattcatttgaactactatattagttataaagggatcagaatcaaatttggacctcttaagcatttcatgctcaatttctgggtctgaagtattgggaaatattattaaaataaaaaatatatagattataataatcgttaaactaacttggtttcataactcaatttggtgttacactaactctcatgatttttgtattaaaatttaggatggttttcttgagaagctaaattccatggaattcataacactttctagattaatggaaacattcattttagacaccgaacagatctgtggaagaaaaagcacgtcattacttggagcacttcagagccaagctattaagtttgtaaataggtttcatgaagagagaaaaaccaagctcaggtatcatcaccatgtccattctgttgtttgattttttcatttttctttgtgaaacacagttatgtttaaaagaggaaacctaattggccagtgaaaatgcctgataaaggtttttttaattaaaggcagattgtggaattaaaatcacatttcttggcttttcaaagtggagttagaatgtttacttctattaaagtacttatcaggaagatcctcagtaagttgacttttgttcccactcaaagttaagtaaattgtttcatcattctttttgattaggctgagatataaaaagggaactattttctaagtattggtcctgcttattaaagtgttcagcactttttaagtcttatgttctcactcagctcttcttccttttcttttaaaccaaggaagatggtattgaaatgttaaagtttaccttcttttctccttactgtggactagcctcctcttagacaatgagcgctggaagcaagcagatgttcctgcagaatttcaggatcttgttgattctctgtcagatgggaagattgctttacctgaaaaaaaatcaggaggtatgtgtattcattcacacattctctttcaattttatattgtttatttattttgtattaatgcttaatatttctttagttgacaatgcctatttcaaagctagaaccaatatttccagcttagtaaatacttgacaggaaaactatggtaatttataataattatttcaaatatttattgcgtgttataaccatatgccagacactggaccatgttctttacatgcattactccagttcattctcacaacgatctgtgatacaggtactattgtttctttgtgtaacagtgaggaggcttgaggcttagaagggttaaggaatttttatacaaatgatgagttgggatttgaaaccagctttatataatttcatagctatgttcttagctactataccgtattgtttacatacatgaattgagtaagcgctagttagcttctactttgtgtcctatattgagacagaattgagacagagataacagctgtatttctgctttaaagaggctaagtctaatgaacaaaaccaaaaa

SEQ ID NO: 11938 - DNA, 1091 bp, Homo sapiens
aactcaagcaaaggaatttctgaaagtatcagtcttctgaattctgagttttgaaaatatattttgaggagaaaaagacatagtctaatttgatgccttccttttagtgtttttgaatcacctatcctcagtgctgaaattgttttgtataactgagggtactgttggttcaaactatgttagtttacagtttgttgcaaacattgtaaaatacagcgacatgtatattaacttttttctatttatctttattatagaaaataccttagaatgttcttgatagagtagcatggtaacgatggtgtcacacccttggtgtgaatggtagcttagtgagcaacctagctcaaggatttgcaaagttaggaagaaggacgagagagcctctctccccaccccaatctaaatatggaatttggtaaattagaatactttgtaatttgtaagaccaaattcatactaattacccgcgtgaaaggtgtttgtttttaacaacattgaagataatcaggaaagattttttcttaatgtttctctcgagcgtagtactataacaaaaacttaatgctaagaaacattttatatgctcctttggatatgcaatttaatctagattatctatttttctcccatgataactaatctgtttttagtatcagcagcatttggcaagtttattttttggatataaactgtggttcatctgttcactgtttctagaaaaaaatcattgccataagaaaaagtataaattagcaagaaaggagagtgacttgatttgcttttggaaaaagaaatgcttaattaattattctgtatttggccttattcgggcattaggaaatctagagatctaaagggttgaatgacaatagtgcccccgtttttagcagaccagccttaactctgggtttgaatcctaaggagattgccacagtgagacttaaggaaatgtttggttggcagatgagcaccaatgactgcagcgtggagtgacgcactgcatggtctgtttattctctaattccaatatgtcttttgcttccagaagcaagaaaagtttcttctctcccctccttcccacccttttt

SEQ ID NO: 11939 - DNA, 2023 bp, Homo sapiens
ttaaaaatggtaatgataaggacatcactgctgaactttctgctcctgtgaaaggacagtctgatgttttactttctaccaccagcaaagaaataatttcatctgaaatgttagctacttccattgatggcatggaaagaccaggaaatttaaataaagtagtggagcagagacagaatgttggaacacttgaaagtttctctccaggagattttagaactaatatgaatgttgttcatcaaaacaagcagttagagagctgcaatggtgaaaagcctccttgtctggagattctaacaaatgggtttgcagtgttggaaactgtaaatcctcagggaacagatgatctggacaatgtagctgattcaaagggacggaagcctcttagcactcatagcactgagtataatttagactctgtacctagtcctgctgaggaatttgcagattttgccacattttccaaaaaggaaaggatacaattagaagaaatagaatgtgcagttttaaatgatagagaagcactaaccattcgggaaaacaataaaattaatagagtcaatgaactgaattctgtaaaagaagtggctttgggtagaagcttggataacaaaggagacactgatggagaggatcaggtttgtgtttcagaaataagcatagtgactaacagaggtttcagtgttgaaaaacaaggccttccaacactgcaacaggatgaatttttacagtcaggtgttcagtcaaaggcttggagtttggtagactcagctgataattcagaagccattaggagagaacaatgtaaaactgaagaaaaacttgacttacttacttctaaatgtgctcacctatgcatggattctgttaaaacttctgatgatgaagttggttctcccaaagaagaaagtagaaagtttactaatttccaaagcccaaacattgaccccacagaagaaaatgatttggatgattctttaagtgtaaaaaatggtgatagtagtaatgactttgtgacttgcaatgatatcaatgaagatgattttggtgattttggtgactttggctctgccagtggctcaactccaccttttgttactggtactcaagattcaatgagtgatgccacttttgaagagtcttcagagcactttccacattttagtgaaccaggtgatgactttggagaatttggggatataaatgctgtttcttgccaagaggagacaatattaacaaagtcagacctaaaacagacttctgataatttatcagaagaatgtcaattggcaagaaaatctagtggaacaggcactgaacctgttgcaaaacttaaaaatgggcaagaaggtgagattggacattttgattctgtgccaaatattcaggatgactgcaatggttttcaagactctgatgattttgcagacttcagttcagctggtcctagccaagttgtagattggaatgcttttgaggatgaacaaaaagatagttgttcttgggctgcttttggagaccagcaggctactgaatctcatcatcgaaaggaagcctggcagtcacataggacagatgaaaatattgatactccaggaacccccaaaacgcacagtgtaccttcagcaacttccaaaggagcagttgctagtggccatttacaggaatcagccacttcagttcaggtatttactaattttctctattttgtatgatgtattaattgttgtggaggcttctaatttcagcttttcaaaaaatattttttcaactgagtacttgttaaaggagtctcgttatgatgtataatgcctgtctgatttgtgggttggttacatttttcacaaccctttgggaaactacaaatagtcctatagtaaagcgcagtaagatttttctttatctcaatgagtttcgttaatatttacagatactcatcaacttggattttttggtgactataaataccatatatgttaaaaaaaaaaaaaaaaacccacacttattacctaattgacggttc

SEQ ID NO: 11940 - DNA, 1244 bp, Homo sapiens
caagaaaaagcagacggataactgatgtgaattggacagtttctattgcttttccttttttccatcccttccctaccatcaaaagcatacctgctctaattaaaaaaaaaaaaaaaaaaaattcaagttcagctgatttgttggtaagccgcactagaaaggtatacatagtaatgtatatttatttacatactgaagtcctaaatttatattagaaaaatgtaaataatcgggggtaaacatttttgaagatttattctttttgtgttgctggggtgtatacatttatgtctttgtgaaatacactggtggtgtccttcttacaaaacttttgaaataaaaaaaaaactcaaatcttcactgtctgtgaaatccccttcagtcttttcagattgcattgactgtcctcttgatttttcatattacatgtcaaattacttttgctatcataaataagctccaaagtcccccatttaatttttttttaattttgtgtatgatgggtttcagatctggcttttgttaacattttggggcttttttaatcttttcaatctggcgtattgctgtttgaccttttgcaaggtacttaattgctcttttgttatagggtatggatcattgtcagaacttgattggaggggtttaaagagattgtgtctgtttaaaatcagtatgattcagagaaggaccaaattatatgaatgtcttacaatggaatttacttgttactgatttttttgttctattgtaccactattttttgaggattttgcacagtgtaaaatgacataatcatagattgctatggtttaggctgtatatacagtgaaaactatgggttttaaatgtttggggaaattcctatggaaaaaagagagacatgtagaagaacctctaacaaggttaatgtgcatgcccaaggtcttttgaaatttcagtgtgtaaatttccttttagcttatacaaaaataaaataatttaaaagaaatttagcctggtgtctttgtactttggtatgtgaggaaaaatgtaatgagtttgaatgagaagttttgttgaatattaacatatttcaatccagagaaaatctttggtagggcttctactttgttgaagccaggaagaattagaatctggcctataagaattggatcagcacttttagtagctgagctgtttgtttttatatagaacatgagatcagtaaagaaattcccatgattcattataatgtgtcttca

SEQ ID NO: 11941 - DNA, 1246 bp, Homo sapiens
ttaccccaaaactcagacaggactttctatgcatgttttccctcctccccccaattcccccccccatcaccttatctcccaggacacacttgagaagtagctttttattcctagtggtgtacatttaattttaaaaaggttgcaatgtatcatgcttgttgccgaaactgtttatggccttcttgtttcagttttttcttttcttccaatggtactttagctgttgagtgcaggttacaacctatattgttatgcagatggcttctttaggaataacttttatatttatttaaaaatttttaaattatgggatgttttgttgttgttgttgtctttgttgttggtcatttgtcaatattcagtcaccaattctgctcacttcttgccatggataaaattgggtctttctggctaattaaaaaagacaactttataaaatggcactttaagcaagccatagttagttttatttttgtaatgcacatggcaaagcaaagacgtttgtgatgaaggaactgctcatctaagcaaaagatttgagtatgatatgataaaggctttctacattctaatttactttttccccccacttgaatgtgttttaaaggctaattatcagctcagtagagcagtgagaaactgatcaaattgcacttgttctcctacaagcaacctccacgcagacacctcgtactgctacaggtgtgtcatttcctttaataggaccagggaccatgtaactgaggtgagggttgtagtagatgcttccagtgtcagtatgcctgttaattttaagagcttccctttcttgcagagaacaagtctgcccagattccatgctttctataactggaggacctggcaaacctgccgcatgctgcacacatctacctacgtacacatatacaatagtattgatgattctgaacaataacagggtaaaacagttggtttgccattgttaaaaactgatttacagtaacttacaacaactgtacttttgttggattagcaaatcatgtgtttaaacaaatcccatatgttgggcaacagttcaaataagcacggagaagtgttgcccaaacttggttctctgactcttatgtatttgtaaggctgggcttcaaaatcaaaacaaaaaccccaaaaacagcaggcaaatgctttttaactctgacaccgttgccataaatccctgatactcaaagtctaacaagaaagacatggaaaattagcagcccatttt

SEQ ID NO: 11942 - DNA, 1462 bp, Homo sapiens
gtgatgtcccaccctgttcacccagccgccagtcatggacacagggcactgcccttgccaacttttaccctcccaagcaatgctttggcccagtcgctggcctgaggcttacctctcggcactggcattgggctccccagccggaactggttaccaaggacaaggacactctgacattcggcttgatccatgtccaggtgcaactgtgtgtacaccagggatctgtttggaaacaaccccttgagctgccaggctcaagaaatcatggactcacagggtcctgtgtggttacatcttggaaaaaatgcagatgtatttcactctccccggtcagctctgcatcaggtgttttctgagcaaaccaagggggtttatagtcatctgtcgcattgcctcgagttgcagtaattgaaaaaatgctcaaattcttagccatggctggcctttgctgagctgggactcaggtgtttaaagagtttgtgctatagctaggtgtggatagcttctgatccctgggttctgggagactgcaggtgccgcacattgtcaagttagaaatactccaggtgggtgttagcactgtggtggtctctggtccacagccttaggtaaacaacttagattctgaggtcaaagaaaaaaggagagggaatgcagccttgtgggggagaagcggggcagagggttctctaatctaatcaggacaggacaggtttcacatacaattgtcccagttcgcatcccagccctggggcacttttctgcttccttccagaggcctgggcctctgataacactttggctttttctccattcacgctgatttggcaaaaggccagagatgggcctccttccctggggaggtgtgatgtagttatcacattcaggacccttgttgatttatcatctattatttgaattcaactggacactctgtaaaatgctgcactgcagcaaaaacaaaaccaccaccaccccagagaaaaccatgtactaattggagtggggtacccccattcacaggttcccaggtcccctggctttggctgatttcaaaatatagagccctttcttgccagtacatccaagtttaaaattatcagcgaaatggtccatgtttttccaattacctgctgacacggttctaagctaagtgaaggggaagatctgagagcgtgctgtttgtggctgttgatgcatattcgtgatgtaacaggtcctggggcctcactttaccccatttgtaaaatggggctaatgtcacctgcctcttacctacctcagagggatttggtgaagcaaactgttaatcttcgaaaacgaccatttcacttcttggatatcaagtgctaacccagtatgttcttcttttttatgtaagggacagctttctccacagagtcctttctgctggtgaggacagcatttctgagcagggctttgttctctatgtgcattagga

SEQ ID NO: 11943 - DNA, 1247 bp, Homo sapiens
cttcaagttttcatgaactagcaaccccaccttccaccatggttctgggcgcctgattttgctgtgactcccagacccagccactgtttctgccaccctgtaacaggccattaaagctccccagtgttcagcctccttcactcccttgttttccctgttgctatgtgtcacctgggccctacagacaggggcacacgcttatggatgtgtgtaccattgagatgagaatgggtagatggaacggagaccatcaagccacacccccttcttaaaactggggacatgagcctgagcagaaagggtgaagaagagccatgggacacagagttgacccagccagggggaaagcccagctctctttaaaccagctaagccattccagtctcctgtgaagccaaaagggaccaggaaccgtgcaaaggaaactggaaacttttccccgctgggtagagcatgttgctgatactcttctgttttcaagggaaacaatcacattgtttgattccaaatggtaaatgaacactcactattcttcaggcttcagtaaatctttttttcttccttcatatatatatacacaacacacacacacatatgtatatctatacacacatgtgtgttgtgtatatgcatgtgtgtgtgtgcgtgtgtgtatagttttagctccaagccaagcaagtttgtgtttggatagaggggaacttaactattaactacaagttgtatgtctgtggtatcttgattttcccatttctaaagatgaatttcacaaagccataaagcgtgaaattagagctggacttaagactcattggccgaccatcctgtgtcctggcctggccctgcagtaagaagcgtgtctgggtctggagaagggtgcttccgagagtgtgcaggtggcccttccccttggaggcgagaagagagaatgtgctgtctatcttcctggttttcagtccacagagtcggtagaccaggggttacgtgactggggaaaatctcacatctccttgtctgaaaacatttcccctgctgttctctttctaacatgttgtggtaaatctgttcagatactgctcatctgactgttttgtacatgtgacaattgccttaaaacctagcacagtcctcagaaatgaataccgtgtttccactggaatctgcagttcctttattcccttcttgtgtgttgaagcggcacttgctgatggaggagctgttgctcttctaggagatgggctttgggt

SEQ ID NO: 11944 - DNA, 1223 bp, Homo sapiens
tcctttgggagtttgttcaggatttcctcaccatcttgcatcctttccttgctactgtgcagggtgaggaattggaggggcctgagtatgatgatttctgttttgcgggttcagctagagagctgggcctcaggaccggccggggggactgtccacggttatctcctgttcctcaagagtgactggtgactttttaaggaccagggattataggccaagaggctgctgcccagaggtccaggccaggggaattctggcaaggagagccctgccgtgtttctgacttggtgattaaaggctttaggggtaccctgaagagacttgggaaaggagtgtccagggctttgggctcctgggggctctgaacctaaatcctcttcagacccaagggacatgtcagaaccttggagccctgtagtaggcagcactgtccctggttaaggagaattccttgggcttctctgactgccaggcagcttctcctagtgggagtcacatggggcagggaatcctaccaggttctgtgactgcaggcaaatcaccagatctttcaggccctcagtatcattgggaggtgaccggaatgatctgttctgcccagctcttacattcttttctgttctgcttgccaaggcctttcctgggaatggctttgatcttctcggtgtcattgtagccttggctgctgcagggtccccttgtggggctgcaccctgtgaggaggctctgagcgggactgggagagaacagaggctgggccccacctgcctgggagcaaggggcagtgggaggctctggcacctgtgagtcagagattcggtgaggcaggaagcgaatcataaacagacacagaaatggcctttcacggggatgagtccggtgcttattattagaattcctgttgttcgttaagctcttaccatgtgctttgcacacatgggtgtatttaatccttaccttctgaggagctggtgctatgaggggaggaaagtgaggctcgaagtcatacatctggaaggtggcaaagttaggggctggcctcaggtttgtctggctccaaaacccatgtccttcaacactgtgctgtcctgcttccctcgggggtgagttcttcatcaagcagataaaaaattcagtgaagaagctgagatgaaccagtcattctgctagtgttcagttaccactggcgtgtgaactgagcaggatggggtctggggcgacct

SEQ ID NO: 11945 - DNA, 1481 bp, Homo sapiens
acaactatttgctcaggacatgatgctgataccgaagatgatccatccctagcagatttgccccaggcactggacctcagccagcagcctcacagctcaggtctctcttgcctgtcacagtggaagtccgtgctgagcccaggttccgcagctcagccttccagctgcagcatctctgcttcctccacaggcagcagtctccagggtcaccaggagagggcggagcctcgtggtggttctctggccaaggtctcctcctccctggagccggtcgtcccccaggaaccttcctctgtggtggggctaggacctcggccccagtggtcaccacagcctgtgttctctgggggtgatgcttctgggctaggcaggagacgcctctccttccaggctgagtactgggcctgtgtgctgccagattccctgcctccatcacccgaccgccactcccctctctggaacccaaataaagagtatgaagatctgcttgactatacttacccactgaggcccgggcctcagctcccaaagcaccttgatagccgtgtgccagctgaccctgtcctgcaggactccggggtagacctggatagcttctctgtctctccagcaagcaccctcaaatcacctactaatgtctcccccaactgcccaccagcagaggccactgccctgccattttctgggcccagagagccaagccttaagcagtggccctccagagtaccccagaaacagggtggcatgggcttggcatcttggagccaacttgcatctacccccagagccccaggcagtagggatgctcgttgggagcgcagagagccagccctgaggggtgcgaaggaccggctgactataggcaagcaccttgatatgggctctccccagctaaggacacgggacagagggtggccctcgcccaggccagagagggagaagaggaccagccagagtgcccggcgccctacctgcacagagtctaggtggaaatcagaagaggaagtggaaagtgatgacgagtatcttgccctccccgctcggctgacacaggtttctagcctggtttcgtatctaggatccatttctaccttggttaccctgcccactggggatatcaaagggcagagccccttggaagtgtcagacagtgatgggccagcttccttcccttcaagctccagccaaagccagcttccccctggagctgccctccaaggatctggggatcctgagggccagaatccctgtttcctgcgctccttcgtccgtgcccacgactccgcaggggaaggcagtctggggagcagccaggccctcggggtctcctctggactgctgaaaacacgcccctccttgccagctaggttggaccggtggccattctcagacccagatgttgaagggcagcttcccaggaaaggaggagaacagggaaaagaatcactggtgcaatgtgtgaaggtaatgacactcaacgt

SEQ ID NO: 11946 - DNA, 1152 bp, Homo sapiens
tggttattttgtcttgtgaggtaggtaggacacgttatcatggacccctctttactgataaaagattgagatgccatgaggtaaagttgttcttcgctatagcttcaggttagtcatgattttagtcatttattttacgttcacttttccagagaaacatggacgtatctggctccaagatgctgattctagttagtaatggtgctgatccaagaattggtttccatggcaggcacgcctcttctgggctgctccattcctacctgcaaggctgggttttctcagcctgtcatttttgatgtcacaccaggctgtggttttcattgctttggcagagggaggtacagagtcgtggagtcgggacaggtgagcaaggaggagagaggaaactgaaggtgcacagtctgtctccaagtcctcctgatatttttagccttttgataacataaatagctgttcgatcagtaacaccatgtgtccttttatttgtctctgcagacattttgctgtcagctggaagagctgatctgctggctgtataatgttgcagatgttactgaccacgggactgcagccaggtccaatcttacaagtctcaagtcttctctgcagctttaccgggtaatatgcggtcctggctctggcttgttccctcacaagagtgtggctaaattactcgattacaaagtaaaatctcaaataaccaatgtctggtatgttatagctcagttgactattatacctgaaatctaattagagcttcacattcttaaagcggaacgctttgtaaaatgcatgaattatttcccaggccaaatggagcttgaagatacaatatatttatctcaaatcaaaaatactttaggttttgggctggcaggtgcagtgggacaagtcttttatcccagctactctggaagctgagacaggaagattgcttgagcccaggagttcgagtacagcctgagcaacatagcaagacccccccccctcaaaaaaaagttttttcttaattaaaaacaaaaatactttagggtgatttgcaatataattttccaaatgtctcagggattataaatacagacttgcactattatgacgcctctagttatgtatggctattgaagtaaaattaaagactcagattttttt

SEQ ID NO: 11947 - DNA, 2320 bp, Homo sapiens
ttttcatactgaatttgaaggtgttgaattatgtatgggttctgcagtaacagtaaggccacagccttttaaaaatatgtgcactagaatactgtgacagtgacaatttgtgtagcatctgtttggatccaatgaacttagttcctcacgctccattatggatggtagaaatgcactaagaattagtgaaaaagatttttcagtgttaattgtgcctcattattctcttaggaatttgctgattcccttggaattccgtttttggaaaccagtgctaagaatgcaacgaatgtagaacagtctttcatgacgatggcagctgagattaaaaagcgaatgggtcccggagcaacagctggtggtgctgagaagtccaatgttaaaattcagagcactccagtcaagcagtcaggtggaggttgctgctaaaatttgcctccatccttttctcacagcaatgaatttgcaatctgaacccaagtgaaaaaacaaaattgcctgaattgtactgtatgtagctgcactacaacagattcttaccgtctccacaaaggtcagagattgtaaatggtcaatactgactttttttttattcccttgactcaagacagctaacttcattttcagaactgttttaaacctttgtgtgctggtttataaaataatgtgtgtaatccttgttgctttcctgataccagactgtttcccgtggttggttagaatatattttgttttgatgtttatattggcatgtttagatgtcaggtttagtcttctgaagatgaagttcagccattttgtatcaaacagcacaagcagtgtctgtcactttccatgcataaagtttagtgagatgttatatgtaagatctgatttgctagttcttccttgtagagttataaatggaaagattacactatctgattaatagtttcttcatactctgcatataatttgtggctgcagaatattgtaatttgttgcacactatgtaacaaaacaactgaagatatgtttaataaatattgtacttattggaagtaatatcaaactgtatggtgataagtattgttttgattcttatggttaaagggaaatagagccttgcattatattcaacacagccatttgtgtgtgcacaatgcaaactaaggtattctagacctatcttagagcagcatccagtatttgctttctagataatatgcccaataacatgacctagaggggcttctgtgctgtgtagggatttaaccaacttcagtggttcagggagctcaaactatatgtaaaacaagtttagaatgtatgctatctagcccgttatctctgatccttctctaaaaccatttgaaatagcttcattgatcaacatttcataaatgcatctgtggtagaggtagaaagcagcacctttcctaattggcaaatgatcagactaatgtgtgctaatgtttttcttccatgctttcagtcagattcaactattttatcctccacagttgcttaacttggtgttggaggagggtttaagcattaagataggaagcaggaaatttgattgctctaaatttagaaattatatccctaaaaattaaaacatgaatactgggtggtaatgataattgaggcaaatgtatttattttggtgacattttgcatatatgaagattttctgaaataggaccttcaagatcctagggggttttgtttggtttttaattgtgaggaataaaaaatcttctgcccacactggcattttaaggtgactgaggtcaaacgttgtttccttaggttgaaatagcagccaaaacattcttcacgcaggggcttgggatatggctgctggcaacacattttgttgtgggctccttaatttaatgataaaatttaagctaaacacaagccaaaaatgaataggtttttttaatttttatttttcactaaacaggcaattgaaatacatggtacaaaaataagtggtaagataattgtaaaatgaaatggacagaatattcaattttccatctatgaaaatttcacaataaaaatcatagtttactttgtattataggcgtgcttggtggatctattcatcctcacataaggcaactgacaaattcctgaagttaccaatagttattttggtgaagatctttaatgcttcagaagttttgtttttgccttaatacagtataaagggggaaagagttcagaaactattttctaaagtagctaaatgacacaaaacaaatgtcaagatactgtgatgccatgccgtgcacttcatttttacacagtaaaagttgtttaaattgtc

SEQ ID NO: 11948 - DNA, 1118 bp, Homo sapiens
ccccgcacccccggcagtccctccggtttgaccactccccccggtcccttgcctcccccgacccccagcctccgtcggccgccggcaccaccctccgcccctctccgccccctcccccgtggggcgctgactcgcccggctgccacgtctcactgatgacatcactagggcagctcggccttagccaatccgccagggggagtccgagcgaagtcctagccagcgagtcagaggggaggggagcagggaggggccgagggtggggaggtgagggagtggggaatggggcgggcgacaacccttcaggtacgcatgccccagaggcgcggcgcttggcgggaagctgagtcctggccttgcgtcgcactgtctgtcctcagctcgcgtagccgcgctcgcgactccctttcccggcatgccaggcggtgcggccgccctctgggccgtgtaaaggcccctcggtctaaggcttccctatttcctggttcgccggcggccattttgggtggaagcgatagctgagtggcggcggctgctgattgtgttctaggggacggagtaggggaagacgtttgctctcccggaacagcctatctcattcctttctttcgattacccgtggcgcggagagtcagggcggcggctgcggcagcaagggcggcggtggcggcggcggcagctgcagtgacatgtccagcatgaatcccgaatagtgagttcaggagagcaccggtcggctgggtccgtgggccagcttgggggatcttaaaggggtcgaggagggttggggcagaagtcggggcatcggctggggtgaggcgagggtgatgggtcaggagaggctggcggccgggagtcgggccccattgtctgacgcggaggggcggccgcgcgggggaggggtcgggccggaggggtgagccgcccgggcctggaccgggtcaggttagagggcctgactgcggggcgggtgctgaggaagcctgccgaggggcctggggcggtgtgaaggggtatcttctctcggaggcagtgacttttgaaggaggacttgtctctaaggggaggggatggggtgggagagcccttctagagggcactgtcagaccctgcgcccg

SEQ ID NO: 11949 - DNA, 1194 bp, Homo sapiens
aattgtacagagctttaagaacgtgttctgctgggtgtggtggctcacgcctgtaaccccagcagtttgagaggccaaggcagacagatcacttgaggccaggagttcgagaccagcttgggcaacatggcgaaactctgtctctacaaaaaaattacaaaaattagccaggcatggtggtgcatgcctgtagtcccagctgctcaggaggctaaggtgggaggtatgacttgaacccaggaaatgaagattgcagtgagcctagattgagccactgtactcctccagcctgggtgacagagccagaccctgtctcaaaaaaaaaaaggaaaaaaaagtcctgtttttcagtcctcagtctcagggtctgtttcttctcatctccttggacagcacataatagtagactaaaagtcttaaaagagaacactcgctttaatacttatgcattagaaacaaactgcaaaataactaaataataaattctggcttctagttggttacgtttctgttttggcttccctactgtatttggaactcgctggctttggttttcctgatttgactttttatttaaatccccctggcttttatgcaggtttattgactggtgtagtggtagactctggagatggtgtgactcacatttgcccagtatatgaaggcttttctctccctcatcttaccaggagactggatattgctgggagggatataactagatatcttatcaaggtaagtgaaaggaaaatatcatggaaattaaattttgtaatttgtttaccaccttaacacagaattgaatctatcgttttaggattccagcaaatctgtaccactagagaaattatccaattacctcccttatttatataaaaattcatataagatttatacacatgaagaaaaaagaagatacattaaaaacaaggaaaaaagtgtacacacatgatctctgtatactaatgagagtacattatatcattacataattatatttgttattcctgaggagtgagtagacagatatttcaaggatagaagagacccctaatttgaaactttcttggacagctcaggcagccttttctgccataaaacctttctttgagcaggtatgttttaagccatgatcttggttgggttgtctgctcttgtcctttcctacaaaatacagtgatagcaaattaatga

SEQ ID NO: 11950 - DNA, 1170 bp, Homo sapiens
tcctttattgccaatctttgaactcattcaactccaggacatggaagaggcctctctctgccctttgactggaaaggtcaagttttattctggtgtcttggggaagctttgttaaatttttgttaatgtgggtaaatctgagtttaattcaactgcttccctacatagactagagggctaaggattctgtctgctgctttgtttcttctaagtaggcatttagatcattcctataggcttcctattttcactttactgctctaatgctgctagtcgtagtctttagcacactaggtggtatgcctttattagcataaaacaaaaaaaactttaacaggagcttttacatattactgggatggggggtggttcgggatgggtgggcagctgctgaaccctttagggcatttcctctgtaatgtggcgctttcaactgtactgctgcagctttaagtaccttaaagcttctcctgtgaacttcttagggaaatgttaggttcagaactaaagtgttttgggtgggttttgttgcgggggggagggtaacaatgggtggtcttctgatttttatttttgaggttttgtcaactggagtacgtagaggaactttatttacagtactttgatttggcaggttttcttctacttgtgctctgcctggagctgtttccatatgatataaaaagcaagtgtagtattccattactatgtggcttagggatttatttgttttttaaaatcaaccatgttagctgggattagactccctacagtccttcaatggaaaagtaacatttaaaaatcctttgggtaattcgaattacagatttaaaagagcttaagatctggtgttttgttaatgcttctgtttattccagaagcattaaggtaacccattgccaagtatcattcttgcaaattattcttttatataactgaccagtgcttaataaaacaagcaggtacttacaaataattactggcagtaggttataattggtggtttaaaaataacattggaatacaggacttgttgccaattgggtaattttcattagttgttttgtttgttttgatttgaaacctggaaatacagtaaaatttgactgtttaaaatgttggccaaaaaaatcaagatttaatttttttatttgtactgaaaaactaatc

SEQ ID NO: 11951 - DNA, 1541 bp, Homo sapiens
tttgtaaacgttagcagactttcctgccagtgtcagaaaatcctatttatgaatcctgtcggtattccttggtatctgaaaaaaataccaaatagtaccatacatgagttatttctaagtttgaaaaataaaaagaaattgcatcacactaattacaaaatacaagttctggaaaaaatatttttcttcattttaaaacttttttttaactaataatagctttgaaagaagaggcttaatttgggggtggtaactaaaatcaaaagaaatgattgacttgagggtctctgtttggtaagaatacatcattagcttaaataagcagcagaaggttagttttaattatgtagcttctgttaatattaagtgttttttgtctgttttacctcaatttgaacagataagtttgcctgcatgctggacatgcctcagaaccctgaatagcccgtactagatcttgggaacatggatcttagagtcactttggaataagttcttatataaatacccccagccttttgagaacggggcttgttaaaggacgcgtatgtagggcccgtacctactggcagttgggttcagggaaatgggattgacttggccttcaggctcctttggtcataattttaaaatatgggagtagaaaacaacaaagaatggaatggactcttaaaacaatgaaagagcatttatcgtttgtcccttgaatgtagaatttgtttttgatttcataattctgctggtaaatgtgacagttaaaatggtgcattatgtatatatattataatttagaaataccattttataattttactattccagggtgacataatgcatttaaatttgggatttgggtggagtattatgtttaactggagttgtcaagtatgagtccctcaggaaaaaaaaaaaattctgttttaaaaagcaatctgattcttagctcttgaaactattgctacttaaatttccaataattaaaaatttaaaatttttaaattagaattgccaatacttctacatttgagaagggtttttttagaaatacatttagtaaagtccccaagacattagtcttacatttaaacttttttctttaaaacatggttttggtggttaacttttacacagttctgagtactgttaatatctggaaagtatcttgagatatcagtggaaagctaaacagtctaaattaacatgaaatacttcattttgattgagaaaataaaatcagattttttcaaagtcaatttgaattttgtcatttctttctaatagttatttcttgtttcattttcttgttaatgcaagatgaattgacagtttatgctagttgttaggtcaagttcatgtcagtgttctattattgacaaaacaactcattatttctggtatgattttataaatacataagaaaatagaatagcgatttatagctacatcagaggctgttttcttccaacaaactgttttgtctcccaaaagatttaaggtggctttcacagaattagaaatgctaaagagacctgtatgtaaca

SEQ ID NO: 11952 - DNA, 1271 bp, Homo sapiens
ccagggctagaatggggatttcaggtttctatgagcctccccattacccctaaagtagaacattttttaaattgtgttgccaccacttctaaaaatttagcaatattagaataggatactagtgaagtaagaaattttgcttgttgttttgcaaaccaaatagtttcctcaaacacaaatcagtgttcccacgaacaagttccagttgagaaacactaaggttatggtgaataaaaccatagggagcttcttccccccaacccctggctattttatattaatggggagaggggatttttaaatgtcataaatttgaagagtggtgggttgcattttcttcatgggtttatgttttcgtttcattttggactcaatttcacatcaccaaattcctcatttatacttggggaaaaaacaaggccatatgtaaaaacccttccaatgcctaagtgtctttctcctgcaactccaaacccagactcgccactttgggtgcacaggtggttaggtcagccaactggttctgcctgtcgccttgccacggaggaggcttctaattagctggaaaagagtatttttctaatacgttgcaaggattagccaaatcttcttattgaagaaagaagaaaagtgaagagtggttacctatacctagcatagtacaatcagaacctcgtggagaccaccggggacaggcttgcggacgccggctgttcttcccgccacgatctttctgtggtagcggccagcagaagacatggcctgctccccactccctttccccactccttctttattgcacacaggacaccagtcttcaaggaaagggacttttttccagtctgccaatcatattgggaaagtgctagctgtgctcaccttcatggggctgtttccagctcgtccacaagctcatcgattttctttagtagattaccggtgtaaatacccagtgtgcttatgagtcagttagtagacgtcttcattcattggagtaactggtttaggctttccagtttggaaaaggagcagagagctgtccatctggattgatggaagaaaagagaacctcatccatgcctggagaacatctagaaaaccttcagccagcctccagtgctgtcgagagaccaccttcccccgacccggaggcacttccttggggtctttctctagggtctcttctctacaaagcacaacactaatgttcgtttccttagacctcagttcaagtgcccctatttatttcaataagaacgcacatatcccag

SEQ ID NO: 11953 - DNA, 1141 bp, Homo sapiens
aagatgaccacagagatgatgagccagagaaaaagagtggagagggattggtattgccagaagttgggagaggagaaattttagagtaaagttaatttttcaacttttggaatttggagcctcgggggagggaagctagatgaccatcaatataaaaaccccaacataaaagcagtaatctgaaatacagccaagacccaagacctgagcatcaacttagtgccctgcagccaggaggaagaggaataaccgtgatgaagagagtgtagtgaaggggtacaaccaggacagtggggagcagcgaagatcggatggtcagcagccaagcaaagcctcctttcccattggagagactcacagatatgtgaaggcaggggttagaggggttttggtagttgccaccagtgatggttcctaattagacttctgtaaccagacatcatcatggctgttccactagtaaccagcctgtgtgtttccatccttcaggtggtattggaatgctatgtaagaaaggacttggtctacaccaaagccaatccaacgtttcatcactggaaggtcgataataggaagtttggacttactttccaaagccctgctgatgcccgagcctttgacaggggagtaaggaaagcaatcgaagaccttatagaaggtattgaacttgtcgctgcattcttagtgggactatggaaatgttccaaattatttttaattccaatagtctgccatcatttatttgtggtttatttgcgggagggtttgggaccaggtcagtagatgccaaaacttttggaatttccaaggagagtaattaaagtgacaattcagggaaaaggagatgggtttcagagtaaggagtaatcccaattgatttttagactctgctgtgaaaaaacaggcaggttctggatttccatgtgcatgtatttttgactgctttcaccttgtcctgactattgaaatggctttggtctggtctgtcttggctcagaagtagagaatggattctggcgggcccagaaggctcctggcctacccactgtcctcctgtaatcagaggcccagggtgtacagctgccactgaaaaggaaagggatctgtgacctctggagccctggttcggtttaggccttgg

SEQ ID NO: 11954 - DNA, 1286 bp, Homo sapiens
ccagcctgggcaacaagagcgaaactccgtctcaaaaaaaaaaaaaaaaaaaaacaacaactaaaaaccaaaataggtgtgtgtctttccaacctaaagatactgaattacagaaatcaattcatttatcagtacttacacctagaaactggagaatattgtgcctgtatacatctttcgatcacaagtaatttttaattacttatcttttttaaaatgtacttttatattgagtttaagtgttttgttttttccctaaaagttgagatggaccactttttaaggttgccgccaagcatagatttctttcgataaaacaaaaaaagtgctggctggtggtcatcttgcattttgaaacgtgttctgcaactaccagaccattgtcatgccctgtgcttcttcttcttgtcgttttagtgacagctatattgtgcgtgtcaaggctgtggttatgaccagagatgactccagcgggggatggttcccacaggaaggaggcgggatcagtcgcgtcggggtctgtaaggtcatgcaccccgaaggcaatggacgaagcggctttctcatccatggtgaacgacagaaagacaaactggtaatggcagacatacaactcgtgggttaaattagtaacaactgctttctttacgttaaatcatagtcctctttccttaacgtatttttttctttctttctctgacttcaaactcttgcaaaagcttcaaaagttagaaccccggagctggtgccaaattgtaaaacgtgactgtcctttccagcaaagtctcttttgaccacacgctttatccgagatgcttagaagtatatttggctgttttatttgcatctttgattaagatgtctatcattgtaaaaaggtattcaaaacaaaagtgtactcttttattattatgaatcacattgtactgagctgtgaagtcagtgttttaaaaatgtagagtttattcatggagcatgccattgaggtttggatggtggcaggtaaaacagaaaggcaagatgtcatctgacattaggctacttataaataaatgtttatctagcttttatttcatgccctaatgaataaaacatgcttggaaaaagaaagtaacaagaagtagtggtatcatactttgtgggtttttttgggttttttttttttttttttttttttgagacggagtctcgctctgtcacctaggctggagtgcagtggcatgatattggctccctgcaacctccacctcccaggttcaagcaattctcctgctgagtagctggga

SEQ ID NO: 11955 - DNA, 1152 bp, Homo sapiens
aaacaaggagagaaaagtcaaatctttttccttttcccttttctgatggctatgactgaatttttttttttcatgaacgattcttgtgttcttatttaaaagaagaatttggcatatggcagacctcctcaagctatctttagttggttgtggggtgtaagtgattaagaatgcagctgtacttgctaccagcacatgcttttaaggagattgctaagcagacaggcctggttagaagtttagaatagcctcttggaaacaaagatctaatttttcaagtgcatggtatacaagagtccctcccttcaggactgaagcactgagggctgtttgcatcagagcagggtgacttatttgtttaaaatggcaacacccttggctctggggaggcggccatgcttcacttggaggagacaggggaagctggcttcacttcactttgtatagtttggcttcactgctcctttggaataaaaaaattctttacttctctagtatgtcccaggacaaacccatctctgtcctgttgctcagttatactacagtgctggttccgtagtcttcaaagcttggaactccctcttgcctttgctccaaaaatttgttctttcactcagcaaatatttaccaagtttctgctatatgcaggaccgtgtggagaactcaaagatgaatcagacgtggggcctgtccacaaatgttgtcagtcaagtgtaggacatagggcaagcacacgggagcttttgctgttgtgtccaagaatagcatgatgcgccgtaggtatttggtgggggaaggaaattagtgggtgggtttcaagtaaacccacatggagaaggtgacatttgagttgagccttgaaggacaggtttatctgtgcagagagggaagttttaggcagagatatagcacaaaagttagaaaacaaaaccaaaacaggtggaagagaggaagagtaatcaacctttaactgcgttgccatgcccttgactgaggcctcacccacattatcccatctaatcctcctcataagaaaacttttttcctcataagaaaactaaggcctgcagcattaaaataacttgcccgagaaggctcataagtggttagagtggagatttgaacccaagacagttcaattccagatttgaa

SEQ ID NO: 11956 - DNA, 1101 bp, Homo sapiens
aggagcaccatttaacagatgaggactctgaggcctggggagttaaacccaggtcacacagttggatagtgggagagtctggttgcctggttgtttttctacagggctcctccaaatgagtgccaggaagaaagtgcgggggtgttctgcccattgcaagagggtcagcttggagaaataggtttgaattatggagtgcctgacagaaagtgggaacagtcacttagcaaagaagtccgggtcttctcaaataggagtgctctgggtgggaggagaagggctggtaagcctgaggacttgtggaggagctcagatgtagctgcttaaattagttcaaagtgagaaatgtaattactatacttgctcaaaccaaatgtctgaacattgttataaaatgaggtgtaatcacagaaaagaggattgcagtgccgtatcactcccacaaaatagcctttgtgttctcaggagccccatggtgctgattaatcttctgggggcgttgaagccccagtaagttcaggtgtgtgtattggacttaattgggggagttttgtcctgctcgtttggacagtcattcacagttatttgcatttgtaatgagtgtgtgatgagagggggaaaagactcagccttaaacatgttagctaggaatatttgggatcagaataaaataagatccaagcaagagggaaaatcgaggatgatttgcagcaatttgtccttgttaactgctatttgaatgataaaaggaaggttgaaaaggacatttcagtaactccctggataacgacttcctctatcactatcactatatatcacctcaatgactatgtcatctccatgctcttctccaccaaggtggaaagtaccataagaaggtcattaagtcctgattctgccacttgttggtcatgagacgtagggtagtgacataaacgctaagccttaattttctctcctggaaaatgggctgatgtatatacatttagatgagctaatgcttggcacataagaaaagcacacggtaaatattagcaaattgtcattattgtcataattattgtttatagtatctctacaacgtgtttataacgtgtgaca

SEQ ID NO: 11957 - DNA, 1161 bp, Homo sapiens
acggaaaggctgccgccctgggaagcttgggcgctcagccctagaagaaatcacaggaagtaattaaacagagaaggtcagagaaagaggaagtggttgtgttgtttctgatgcaaagagcattgttgttactgggaatcaagatgatgatgtttaaatctcttggaatgtgactgcttggggatttgattgtattgtggtccttttagtttattcttttagacagcaatgtagttaggaaatgaattgcttttaggtcttatcaggaatccccacgtgcctaagcagaagtcttaagcgggagttggttgtagcttggcaaattgcacttaaatgaaatgaatgtcaagactattagaggttaattttaggtgtctggagttctccctaattctcctgattaaacactttaacataatagtttccttaattggaataatgatggaatattagcatgcatattaaaccatttacccaaatttgaatagggttaaaatgcaaattatccatcacttgtcagtgcttactctttacagataattctggtgagaaatcgggaagagactggaatatgaattggaatagggctttctacttgaggcagctttgctgggaaagtcaagaataaactagaggactgaaacaagtgagaggcccctttgtttccccccaaaaggggtactaaaaatacgaaggcctgtgctgtcaataactccaacacggaggtgggtacaatgggaaatctgaaataaactatagaccctccagttgtatcttcattaggttgtcatatttttccttttttttttttttttttttttttgagacagagtcttgctctgttgcccaggctggaatgcagtggtgcagtcttggctcactgcaactgccgcctcctgggttcaagcgatcctcccacctctgcctcccaagtagctgggtctacaggcaagcgccaccacgcccagctaatttttgtatttttagtagaggaggggtttcaccatgttgtcctggctggtctcgaactcctgacctcaagtgatctgcccacctcagcctcccaaagtgctgggattacaggtgtgagccaccgcgcctggcctggctgtcacatttttctttcagaagaaggtgaataaaacttaaggtctctcccca

SEQ ID NO: 11958 - DNA, 1179 bp, Homo sapiens
acttttcagcttttctgaaattcagtgaagcaaatattttttgataatactccattttggttttgtgaatatatcaaaatttttgttaataaaatttccacagttttgatctatcaaattttggagttaaaataattataactgttaaaatcttagagctttaacatcaaaatatgttaaataacagttggatataatgtttcagaacatttttagttattttttaatcttgtttaataggttaaaaacacaaagtcaagaagaagaacttatgaaactggctaaacaatttgataaaaatatggaagagctagatgtgattcaagagcaaaacaagaggaattatgattttacccagatgatttcagaaacagagattttaagtaattataaagataatatacagatgtggtcattacataatatagttcccgaaatagataatgctacaaaaaagccaatcaaaggaaacaccaagatatctgtggcaaataatcaaaatagcagtcagaagccatttgaccaaattgctgaagcagcctttaatgctatttttgatggttctactcagaaatgtagcggacagttaagccaagaactgccagaggctttttggagcaccagtaatactacctttgtaaagacaaatgctttgaaagaggagaaaatcattactaatgaaactctggtcattgaaaaactgtcaaataaaaccccacgatcactttcttctcaagtagatacacccataatgacaaaatcatgtgtgacttcctgtactaaggagccagaaacttctaataagtacattgatgcatttactacaagtgattttgaggatgattgggaaaacttactaggtagtgaaccttttgctatgcaaaatatcgacatgcctgaactctttccttctaaaacagcccatgttactgatcaaaaggaaatttgtacctttaatagtaaaactgttaaaaatacgtcaagagcaaatacaagtccagatgccaggttaggagattcaaaagtattacaagatctttcttcaaagacatatgacagagaattaatagatgcagaatatagattttcaccaaattcaaataaatcaaacaaattatccactggaaataaaatgaaatttgagaactcttccaataaaattgttattcaagacgaaat

SEQ ID NO: 11959 - DNA, 1311 bp, Homo sapiens
gagcgtatttatcctattcatttgcatttcctagcaccatgcactttaataggcaataaatacatatatgttgaatttaaccaaggtgtacagtataataaaattcagtggtggcgaatagcttagtaaatctattgcctttgttttttatctttaaggaaagaatcagagtatatatgaacagagtcaaggaaataacagacaagaaaaaggctggcaagctggacagaggtgcagcttcaagatttgtaaaaaatgccctctgggaaccaaaatcgaaaaatgcatcaaaagttgccaataaaggaaaaagtaaaagttaactttttggttttgatgtacacatattcaaaaagtacatcttcccccccccccccccccccgcaaaataattctgtggcagggcaaggtttaaatgtgtttcttattaatatgtaaattcacagtaaatatgtaaagctaaatactttcctctccaaagatcattatctttattgattagcactgaggattttaacattgtgatatattatatatttataatttaccatctcttgatgagactcttatttctttatataggtcagtcttgcaagtaccattttataagcagctgtgaaatttaagtgaaatgttctttgtaaacatttgtactattttaaatgaataatgaccttatgaagtatgctatctgtaggctgaaattataggtacatctgttttcactatatgatattaagaaagcgtgaaatgacttaaatgttcatttttttctgtatagatactttatcatgttttcatgattttaggaattactgctttgttgatattcaaagtgtgaaactaaaactttatggttgtactttaattcttggcatgttgcctctatgtcccatttaaaataaaatacattctcattaactttagatgggaaataaggttgtatgttgatggatgaattttggcatgatgactgtactctcaataaaggctgaaaatgttgtataactgacctgtgtatttttatcttttgagtaaatttgccttccaaattaggaagataggttttagaagtcatcacaaatagagaaattcttgagtttttgttcctgatgcatggtgtccacagttcttttcatctcattttttttcagattttttttatttcatgtttttgaggctgtatcaagtacatacaagtgttttggaacaacttcttaagttacctaatgccacttaagcagatgagaagtccaaaggagattacactgtgtttgtattgtggtttatttttctggaatattagttaca

SEQ ID NO: 11960 - DNA, 1931 bp, Homo sapiens
gggagtcgcaggttctgtaagccttctgcagaatgttacgttgtccacccagcccatttcaagtttggattggagtccagataaaaggggtctctgcgtctgtagttcatttgaccaaacggtgagagtactgatcgttacaaagctcaataaaatttgacttcaagactttggacttgaggctgggcacggtggctcactcctgtaatcccagcactttgggaggccgaggcgggtggatcagaaggtcaggagatcgagaccatcctggctaacatggtgaaaccccgtctctactaaaaatataaaaaaaaatttgctgggtgtcatggcgggcatctgtagtcctagctacttgggaggctgaggcaggagaatggcgtgaacccgggaggcggaggttgcagtgagccgagattgtgccactgcactccagcctgggcaactgagcaagactgtctcaaaaaaaaaaaaaaaaaaaaagactttggacttgaaaccttccagaggaacactcacacaatttaagataggttctggagtcctctgaccctcattgaacaaagctggatttggctgatgataaaagaccccagccacaagcctctgggccagcctccagcctctctcggggcttgtttgctgacttgctgctgcacgtgggtatcagaagcaccaagtaaactatctccagggccagttcttttctctcccttccatttctaagtcaatagttgtctataattaaacatatttcagatttgttctgtgtccctgaagttccatattttatctttatgcttgtgttatgttttagtgtctataatgttgtggtgggaatcatttcatttggtttaaaagagtttgccttggaaaaactgaattaaccttcataaatacattttgagagatttcagtgtgagtaattttctggacataatattattgtataaaatatcaaaatggtgggccaggcgtggtagctcacgcctgtaattccagcactttgggaggctgaggcgggtgaatcacgaggtcaggaattcgagaccagcctggccaacatggtcaaaacccgtctctactaaaaatacaaaaaattagctgggcttagtggcgggcgcctgtaatcacagctacttgggaggctgaggcaggagaatcacttgaacccaggaggtggagattgcagtgagctgagattgcgccactgcactccagccctggcgacagagtgagactccgtctcaaaaaaaaaaaaaacaaatatatatatatatatctctctctctcaaaacggcacggttggtctagatttgggtagctattttctgcaatttaattcataaaacaaaatgctttgattttaaagagctcttttttacttaaaatacaggaactgaattggtgagacttttggtttttgactgtggtaagtgatggtgaaatgtacaagattgtaggggttttgtagtcttatttttggtcatactttaaaaatgcattttatgaataaacttctgtttttgagatctacagaagctttgattctgttaccttaacagtagtaataaagttaacattgtcacatcattttgctttataaatgcttaattagtagttttaattcactttgtttctttaatgttcaacatatctttagctaagccttttggaattattgactttaccacattttcattaagcctaccctcccccacctccattgaagagaacgcagccacctaaaacattcacaatatgtaaagtatatgtgatttcaggggatcatggagagtcacttatttggaatattaagttaagaaaattaaggtttttttttttttagtttagaaaatttttagaagtctctcttagaacacttgtatttggtaatagagtcaacaacaataaatacctgtattttatta

SEQ ID NO: 11961 - DNA, 1911 bp, Homo sapiens
tgctttcttctccatctctgaagatctgctcaagacgtccagcaatgctctctgtgtatttaaatggaagtatttttctctgtgaagccacattttccaacatgagcctcatgaagccaactaagtgttattgaactgtaattctctcaataactcagtgtagcactttaaagtctgaaggacagcaacatgaaaagagcatatcaatgtggtggagaaagggaaggggttggctttttaatttatttttcttcatcttttataacaagaaagtatctatatatacatatgtaaatatttatatatagatatatgtagctttctatatatgtagtaggttggctttaatttaatatacttgattcagaaacaaaacaatagagtacaaaagtgccaagcagaacataaaacatccttacttttatttcacacagttttatatatagatagaagactgtacaatttgagccgggtgttaggccagctattttccttttcctgtgctttctcctttgagagattgacaaagcatttgttaacgtcctattatttaccttaattacatttttgtaacaaaggagtctgtaactttatttatacttatgaatatatccagggactacttctcattgctgagcagcttttaatacacctctgcttgaggagaaagtctagttcattgctactgccaagagctagttcttgtgttcatatagtaactgcacagggcttatagctgcttcattctgctactttgtaactaggagccattgcatttattaaatgtccctcagtaacgttaagtgctagttgtgattttatacataaaggccagaagctgtctgaggcaatcatgattgattgtatgtatcacttactgaagaatacctgaagtgatcatgtaactacttataagggatatccatttgtttgattacatgggtaaataatttgtcattaaacttgtgtttgaatcatgaattcccttgtttcaaaagacttgcagctaatctaaaaaactggtgatatttaatatgcatgtatgtatctaaacacccacatatatttgtggtttaagtgtgagaaatcttgctaatctatatgccacagaagagcaaaattgtatccaaatttatgccacttaaatttctttaccacgagggatagagcatgcatactggtttttttttcttgatttgcccatataattggtaatggataacttaataaatttgtgtgatataaaagtagtgtatcatgttctactgtttgatcttatcccttcccatttctgcaaaggtactgttagctggaagaaaaacattttggttagctttgtatgacagtagtctttccctttatagtttctctataaaaactggttttaaaatcagtggaaaagggcaggttgaatcaaggtgaatcaatctgaaattgagcacacctgcctgccatcgctgttccttcaactgagtgctgcacatcatgggctctgtctgtgagagaaaaatcccggtgcttggtgtccttgcatgacatggagttttgcatgtagatcaatttaaaatgtacctcttgtttacataatttgcataattttaaaagataatgttgccaaactttggaaatgttaatgttcagactgaaaatctccactacatgtaactttcttcctctggatcagtggcatggcttataatcccagccagtggtttgaactgttccagtgtcaactgccatgtgctctgcttcaagggggaactagccttttgtgaattttttgtacataagtatttgttacaaatattttagcaaatgctttctatttctcttgcttgtgcatatcttggctggcgttacagaaaaatagtgtaaacattatttccttaccggggaatgagggttttttct

SEQ ID NO: 11962 - DNA, 1210 bp, Homo sapiens
tacactttcacactttaaaaaaagcagtcatgtactgtaagccaagactcaacaaatttataaaaatgacatatagatcatattctggtgccaaataaaaaacaattgaaatcaatagccaatcaagttaccaatcaattttgaaaatctcatgttttgaaatttcaaacacacacccaaagcatttgtgagtcaaagtaatatcataatgtaaattagaaaatacttagaactgaccaattatgaagatgccaaaaccaaaacttggaatgcagctaagtggtccttacagggaaatttgtcatcttgagggtttatgttagaaaagaataaaagtttaagacaattagccaagcatagaacacaggagattagagaagaatgacagagtaaaccctttcaaaaaagagaaggccaagaccaagaaagaacagaatagaaaacaagataaatggagaggtaacaaagaaaactattagttgggcatagaagaggtgaaaagagaaatagacatgtatagaaagaactgtgtacttgcttgtcaatctggatgggaagataagctgaagtcaatgctgtcatgggttctgggtagtactggagagaaatcattgatcaagagaaccaagaaagcacacgcaaactgagttcatcccccacctacccctttccttcctagaaagcctttgtacacaaaatggttgctataaaatattgtaaaatgtgtacattttattctcccccatttttatcaccaactaaaatttggcggattactatgaaactctcaatttgcaaagctgtttgtccctacagcagtctttgatcactatgttgtgttttttttaagtttatggttctactttttctggtctctcgcttcttgatatcatacctgtgttttctaatctagatactcccctctgcacttctaatttgacagtctaagcttctgggtacctgaatatcagaaaaccaagcttacataaattgcatatgaaataaggattcctagtctctaagaacttgagagaaggcatatggcctaagaacccaagctttagtgaatgaccaatgtgtccatttatgccacctcctgggttattgaggctattccagatagtcttttgggttgagcaccctggttcagtgaatccatttgagagaagcacaattataggaagaagtgcaaaattgaaaaaggatctga

SEQ ID NO: 11963 - DNA, 2709 bp, Homo sapiens
cttgaacccaggaggcggaggttgcagtgaggcgagatcacgccactacactccagcctggcgacagagcaagactctctcaaaaaaaaaaaaaaaaaattttttttttaaatgggctgggcatggtggcttgtgcctgtagtctcagcaacttgggaggcttaagtagtaggatcgcttgagcctgggaggttgaggctgcagtgagctgtgattgtgccactgtgcttcagcttgagtgacagagtgagaccctcctgactcaaaacaaaaaacatggtttctcctctctctcctgtcttcttactctctatcccatttgatgtagtgatttttaaatgcttttgtaagttaattcttaacacaaaagagacattgtaatgaggcacaccactaaagtgagcatgcccaattaaaaccagtgtaatataggataagaaaatctgatttttcaaaaaagatactctacataaagaatccttcatataaaaagttctttcttgtagtacatttaaagttttaattcactcatgtataactgagagttcctttgagccctttttaggcagggaggcatgtctgtcatctagcgtgtggcccagtaagtgattattacattggaatcagtttttcagtcttttaaaataaattctgtgccataagaataaaagataaagagaaaaattaatgttaactatttttagcttattataactatgtcaacaagtgtttattaatacctattatgggaaagtcactgtggttggcattgaaaattacatcatctttaaagcagtatttgtccccagatggactcatcactagcaaagactaggttcattggaaggcatagggtgagagaatgggaagatgaagtggaggcgggttgttaaagtgctgtcagtgagtgattttgtctacttgaataatggtccatgtttgggggcatattgtgtttcataagaagtgaaaggtatttgcaaagtaagctacaaatgacccataaatctgttaacaacagtccttaatatgcaaagatgaaaaacaagcattactgctacccaaagggaactggtgcttggtgatgtgcagatggggctgttggttaagagagctattacaggttttctctcttaggtttcataggaggtagttactgagatgagattgttttatctttttgaatacagatctcttgtcttgagttagttctgaggatgggagtaataaaggagttttttgtttttttgtttgtttgtttgttttggctccttagtaatactcctctgacatttatttctattattcttcaaagaaaggaaaccaactgaaatgtttgctttaacaaacattttaataagttctctgggtttttttttccccttttaaaaaaattagcatataccatagcaataaaagaactaatgttaactattgtatgctacaacttaagtgatttttctaaagaagcacaatgtcattgaaagtattattgaaaaggatcatagtcacattgaatttgtgaaggccaaagaaattgaagggagtgatattttcattttatgatattcacatatttagtaaattttgtgtacaagaataccaggcagagtgttttacccatggaaacaggtttcagattactttatttttactgttagagtctcaagtttagaaatgctaacacttaaatcagtttttttctcactatacttgaagattgttaatattttgatatcttcctagcttgatgaatttaaacatatcttcagatctgtgacagtgacagccaataggactgataatattagcttcaaaccaataatatccagggttaaaataaaaatcatagtgaaagtacgattgtaaaattatgctatattaacttttaagtctgtaataacttgacatcaaaatgttatgtaattaccataaataatggctagcgagaacatctttggaaattctcaaattacctttcttactacactgtttgcagaatgaatgtagaaatgatcctgttagctttctgaatgttctgtggttgaatgtgtttttgcttaaataaagcttttggtatttgtttaaattacacttcttgagaagtggaaattttaggatcatctttgctttgtttcagttttgtgatttttgaaatgaatgtttagtttactgagccagttggtcatttcttcctcatgtcgttaagtccagtgagtaagcctgaactgtgaataaattaccaaaaacttgcttagaatttcattttgaagcaatttgctaatatttgaagtgtatacacatttgtagttatgttagaaattgtattgtactaagaatgtaatcaatgtctactttagttgtaaacatttctgatgtcaaaactttattcattactgttgattttaagaataagaaatcactgcctaaatattaccaaaagccactgtctctacccgaacttcccagtttgggaaagaatcgttagataaaacaaaggctctgccctttctgataccaaactccacagatactttctcacatcttttaaaacattttgcaataacatattgtttataggaagtttacggggtatgcaatgattaaaacttttaagtgaattgatagttgcaaaagaaaggataatatttaaggtcagtgagtagcaagacaatctaaagtttctgtaatatctggctctctgttaat

SEQ ID NO: 11964 - DNA, 2257 bp, Homo sapiens
tgatttttgtgaagttacctcttacattttcccagtaatttgtggaggactttgaataatggaatctatattggaatctgtatcagaaagattctagctattattttctttaaagaatgctgggtgttgcatttctggaccctccacttcaatctgagaagacaatatgtttctaaaaattggtacttgtttcaccatacttcattcagaccagtgaaagagtagtgcatttaattggagtatctaaagccagtggcagtgtatgctcatacttggacagttagggaagggtttgccaagttttaagagaagatgtgatttattttgaaatttgtttctgttttgtttttaaatcaaactgtaaaacttaaaactgaaaaattttattggtaggatttatatctaagtttggttagccttagtttctcagacttgttgtctattatctgtaggtggaagaaatttaggaagcgaaatattacagtagtgcattggtgggtctcaatccttaacatatttgcacaattttatagcacaaactttaaattcaagctgctttggacaactgacaatatgattttaaatttgaagatgggatgtgtacatgttgggtatcctactactttgtgttttcatctcctaaaagtggtttttatttccttgtatctgtagtcttttattttttaaatgactgctgaatgacatattttatcttgttctttaaaatcacaacacagagctgctattaaattaatattgatatattcagtattctcttcaactttgtcacgaggaagaatttcctgtagttaattttaactttccttcattacattgttgcataaaactagtcccttagtgccagtttggaagttacttgcaattgtttggaagatttgcaggtcgctgacctcatcatttcactctaagtatatgtggtaggctaagctcagaaaaaggtatgtatgctttacactgataggcaccaaatttagtattgtatcctaagtatttttcctcttctgtattttctgtgctctacccctgaaatatatttaggaataaagaagatataaataaagtgatattggggtatgttcagcttgtaagtgtcagaaatggaagttgacaatttggattaaaatatttaaagtagaatgttattatttgatacccccaaaattgtgagtaataatttcttaatggagcttttctggccagatcttcagggctataggagagtgtgtttgtttttggtgaagtccttctttttcaaaggtttttacttttaaattgtgaagataagctatttagcacaattatttaagtaagctgttttttcctttcttttctttcttttcttgttttaacttctgggtgaggttaagattttctaatagttattgttgttgccagagaagcatagaattctgcttgtgtcttagggttagagaaagatttgttatattttgaggtaatttggaaggactttcatacatggtgactagaaacctgatctttttaagaataaaatagggtcactatttacattatatataatatatggctattatagctatattaatctactttaattgtttctaagattattttgtgtaagtcagctagcgtgtgtatagtgtcatttcttatgttttgtatattaacgttttacaaacacaatttgtgtgggtttgtagcatttcttatagtttaaagtatgattcagcattctaagttaaaactaatatgtgaagtcagtcattagtctgcataatctctgtctccctctgtgtgtgtctttctataaagcacatgtgtacacacacacacacaaatatactgaaagctagggtaagttctaaactgaatatcaaaaaccaaaatcaagaacaaagaagtgatattttccaaacaaacatggattctctgccgggtgcagtggctcagcctgtaataccagcctccactttgggagtctgaggtgggagtattgcttgagctcaagagttggagaacagcctgggcaacatggtgagacctggtctttacaaaaatttttttggccggacgcagtggctcacacctgtaatcccagcactttgggaggccgaggcaggttgatcatgaggtcaagagatcgagaccatcctggccaacatggtgaaaccccgtctttactaaaaatacaaaaattagctgggagtggtggcgtgcgcctgtagtcccaactacttgggaggctgaggcaggagaa

SEQ ID NO: 11965 - DNA, 1169 bp, Homo sapiens
gaggctgaggcaaggagaaccgcttgaacccaggaggcaagaggtttcagtgagccgagatcgtgccactgcactccagcctggcctacagagcgagactctgtctgaaaaaaaaaaaaaaaaaaaaaaaaaagaaagcaaatatattttggcatttaattggccttttgtctttgttgggcgcaccaaggttactttgtgaatttggatattgaatattatctaataaagttaaaatattagctttttctgtattttttgaaacatatattctagacagattcctagataattgtaccatcactacttcttgctaggatatttaggcctgatcatgaagtcctaagtgaggcgccctaagatattatggtaagagagatatttttaatctgaaaacagggtgactaaggagaaggtgctacactttcatatattggcattctgtgcacaattgaaaggaaggttccctttaacattacaaaggaaaaaaattaaaatacattgttacagaacaggtgttggcaagttttctggagtgggccggatagtaactattttaggctttctggaccatgtagcctctgtagcaactactcaactttgcagttgtagtgtgaaagcagctgcagaaaataagtaaaagaatgggcatgggtatgttccaaaataactgtatttaatacaatttttatttgtcaattaagaaaaataattaaaaaaaaaccaaaaacctgtattaggctgggcgtggtgactcatgcctgtaatcccagcactttgggaggctgagatgggtggattgcttgaccccaggagttccagatcagcctaggcaacatgacaaaatcccatctctataaaaaataaaaaatttagctgggtgtggtggtgcatgcctgtagtcccagctactcaggaggctgaggcaaggggatcacttgaggccaggaggtcaaggctgcagtgagctgtgattgcgccactgcactctagcctgggagacagagcaaggctgttgtcaaaaaacaaacaaataaacaaaaaccgtttatttataaaaataaaccctggggctgcaggtcagtttgctgacccctgatagagaatattttggatataggatcttgttctgtcatccaggctggagtgcagtggcgcgatcttggctc

SEQ ID NO: 11966 - DNA, 1141 bp, Homo sapiens
gcagtggctcacacctgtaatcctagcactttgggaggccgaggcgggcagatcacgaggtcaggagattgagaccatcctggctaacatagtaaaaccccgtttctactaaatatacaaaaaattagctgggcgtggtggcaggcacctgtagtcccagctactcgggaggctgaggcaggagaatggtgtgaacccgggaggcggagcttgccgtgagccgagatcgtgctgctggactccatcctgcgtgacagagtgagactctgtctcaaaaaaaaaaaagaaaaaattataaatgtgtattttgacatgtttagttttttatacttatgagaaactcccccttgaaaaagttccattgcctttaaacggtttgaaatgtttgaaagacagaatctaacttcacgttttttcacatacttgacataattatgctaattttgattttttaaatcagaatttttcattaaatatttgtttatttgcaggtatatttgcttacttaaactaccatgttcctcgaacgagacgagaaatcctggagaccctaatcaaaggccttcagagactggagtacagaggatatgattctgctggtactttaaaaaaaatactatggattttgcatgattctttaaatagatactatttttattgttattaggagactagactattaaagtctgttttgttttgagtaagtgtaaattggaagaatttttgtcttttatcatatttaaaggatttatttatgtaatctcaacagtgttaccatttatgtggagtattgcttatgatgatctcttaagaatattattgtaaaaacatcatatgggggattattgtggtaaaacaaaattcgtgaaggtcttactctaaattcttttttctttcctataactttaatttttatccattgatttcatgctttgacacataaacttgcctcagattcttttttcttatttttattatttatttttgagatagggtctcactctgtcaccccagctggagtgtagtggtgcggtcatagctcactacagtctcgaactctgggctcaggcaatcctccctccgtagcctcctcagtagctaggactatagctgtgtgccaccatgcccagctaatttttaa

SEQ ID NO: 11967 - DNA, 1102 bp, Homo sapiens
tccctagcttttaacagattttgctattgtttttataaatgtgaagttatacccttctgattcgacggtgtatataaaatggaattttggggatgggcgcggtggctcacgcctgcaatcccagcactttgggaggctgaggtgggtggatcacctgaggtcaggagtttgagaccagcctgaccaacatggtgaaaccctgtctctactaaaaatccaaaaaaattagccgggcgtagtggcgcatgcctgtaatcctagttactcggaagcccgaggcaggagaatctcttgaacccaggaggtggaggttgcagtgagctgagatagtgccattctactccagcctgggcgacaagagtgagagactgtctcaaaataaataaataaataagtaaataaataaataaataaatggaatgtttgcaaatgagatcctttttaaaagcagtaaaggaacttgcaattttaaagtatcctaaaatgaatttttcaaaagttttttgtaattatactgtctaatggctttggagataattgagggatgctgagattggctgctaggattggtcataaaaccagtactattaacatatccttacatatactggatatgaagaagttgtgagagaaaataattgcttaataagcatttcttcaattgtcccctggaaatggaggttaataggttctggtaatgagcagtagaaggcgggaaagggttttgtaacacaagtttgggaaattctgctcttggagattcacaattagcaagattaaaggttccagaaagttctaaatatatacctaactttaaccaggtagttcttaaacctttaattatgaaacctttctttacttcattcctttttagcatccggtgaaatagtgttctgtttctgtggtttgagaattttttgaccgtatatttcaggtgcctagaaagtgttagaagatacttgcaggtatttgaaatgatggctttatacttggcactctgccctttgcagagatgactaaaataagagagttgccttcaagaaattgctgcctgatcagaggaaagaaaatgaatgcacatgcaacagcttcaggtgaaaat

SEQ ID NO: 11968 - DNA, 1223 bp, Homo sapiens
tgagccaccgcgcctggccccagttaattatttatagtcttttctgcccagctgagactctgctatgggtagcctctttgagacaaggagaagtgatcaatgctttaattaatttccaaatatttaatttgcttttattttattttattttttttttgagacagagtctcgctgtgttgcccacgctggagtgcagtggcgcgatctcggctcactgcaagctctgcttcccaggttcacgccatcctcctgcctcagcctcccgagtagctgggactacaggcgcccgcctggctaattttttgtattttcagtagagatggggttgcttttatgtttttaggataccgggttatgattcaaaccttgttctttggggctgttgatagatttattcttactggcttgtcatgcctcattatagagtgtatcaggtaaagaagtaatattaaaatcaggaaaacagcaaaatctaatcattttcttaattcttaaattgtctttgttttttggttttaggttatggatgatgaatcagatgaaaaagaagcaaactcaccttaaaataatctggattttctttgggcataacagtcagacttgttgataatatatatcaagtttttattattaatatgctgaggaacttgaagattaataaaatatgctcttcagagaatgatatataaatattgcatgtttgctttacctcatatgagttatttataacctcttgaatcatcttctgtacacgtggattttatccaaggatatttttatttttgtccctcatttcccatggctctttctttgcatatgtgtgaaggagtttaaaatacatttccccccatctaatttatttacttttttccatacaggaagaaacagaatgctttttagaatattctaaaatagctttttgtgaaatatctaaaactatttttactgaagtttttagcttaagaaacagctaaacaagtctgttttaaaaatggtatctggctactagcccccaattaagtagcaaagaactgcttaagaccaaaaaaaagaaatcaaaaatgtccgggtatggtggctaacgcctataatcccagcactttgggaggccgaggtgggcagatcacgaggtcaggagtttgagaccagcctgaacaacatggtgaaaccccgtctccactaaaaatacaaaaattagccgggcgcggaggcacgcgcctgta

SEQ ID NO: 11969 - DNA, 1185 bp, Homo sapiens
agaggtgtaagggggccaggcgctgtggctcacgcctgtaatccctgcactttgggaggccggggtgggtggatcacgaggtcaggcttcgacctctcaaaatgctgggattacaggcatgaaccaccgtgcccaaccttaaatatcttgtgttatactgcaaattgccttttttactaagtataataattttgaaatatatccatttcaaaaaacatagttctagtttactcattttacgtgctggagagtatttcattataggaataagatatagttaatttgttcctttatgttcaaggcacacacctgtagtcccagctacttgggaggctgaggcaggagaatcgcttgaacccaggaggcggaggttgcagtgagccaagatcacaccactgtactccatccagcctgggcaacagagtgagactccatctcaaaaaaaaaaaagaaaaaagaggtataaggtagtgttctgtatgggtctttgccgttgcctggaaatacagcattttcctttaaatgtttataggaaaatgaagaattagactggaatttactgaaaccagatatttatgcaacaatcatggacttctttgcatctggcttacccctggttactgaggaaacaccttcaggagaagcaggtaacatgttgtattgagtaattaaaatttgtcctttttttagacttttctattttcttcacatttaccttgatttcagaagtcataggaatctagatttctatcatttaatatatttagctctgcaaatttatatatcattttgaaagcttgtgtataaattggcattactctataaaacaaaaattttcaattataaaaattttcaaacatgcagaaaatatcatgctcaccaatttgccctccactcatatctaacaaatgttaattaagttacagaatgggcttttgggaaaaacaaaacaaatgttatcttttgccacagttgctttagactcattttaaataaaatattaaacatacagtgtcagaatatagagcataaagtaaaaaaaagaaaccgctaaaaccactgtacccccatcccttttcccttcctagttccagagatgtgtgaaaacttgttttgttttatactatacatgtaagtctctgcagggaatatataagactagtttttgtttttaagttttaaatc

SEQ ID NO: 11970 - DNA, 1620 bp, Homo sapiens
tcacacttggaatcccagcactctgggaggctgtgttgggccgatcgcttgagctcatgagttcaagaccaacctgggcaacatggcaaaaccttgtctctacaaaaaatacaaaaattagccaggcatggtggtgcacacctgtagtcccagctacttgggaggcttaggtgggaggatggcttgagcacgggaggcagaggttgcactaagccaagatcgtgtcactgcactccagcccaggcaatagagccagaccctgtctcaaaaaaacaaaacaaacaaaacatgaatgaatgaaatggctcaccttccctattatgaactagaagaaaggatgaaggaaggttggcaggaccccagccttactctgtagtgacaacccagaggtacttttcccggaatgcagggtcaagtttatgtgtgaagggactctagaatagctggtaaaaatggctacatggtaaccattcttgacttagtccagtattcccataatttgtaattccataaatttattctcagctgtcccccagccatttctaatagaaggatgtgtaccccagttttgacaatgttcttgaaatcaagttagtgttacctgcattgcattataatggaactatatgtacatgttaaagggatccgtttgattcctttcggcaaggaattgcaaaaatagtttttaccaataccagttaaaataggataggttagactttgggggcagggtgagacagtgcagccttttcactctgaaatggcaaatcagctgtactctttgagtctaccagagattcctatttgagtgtgaatggggtgtgtgtgtgtgtgtgtgtgctcattcatcttcatgctttcttccatggtgttaattcaagctctcctaataaaggtatccaaagagtactgagaagtgaccataggtatttggcatgagtaaatgtagttccttttgccaaaaaaactctcaaaagttacaactggagttcttcgcgataaaaggttggggaaatcagccatggctttagccttgttcccaagtacacatcttcttatccacaaggatgaaactctgtagggctcaccctgagggctcatgtgtggcattgagagggtagcagtgaccagaacaccacaaggcccacaagatgttttgaatgagggaacatttaatgtcatttgttaggagatagaaaccaaataataaaggacaaggaccacgctcattccgtggagaagaggtgaactccctctgctgactatttggaatggactgaatgaggaggtctctccagccagaaggagtattgaggtcatcaggcctcagaaaacaatgtacacataatctcgggctgtgaacaagagaaaggagggggggaaacatgaaagtcaatcttaacaatttttgcaatacctcttatttgcagaccattggatttatgttattgcactctcggtgtgatttatcgtatgtatctgataggttttatgaattgttttgagttgtaaactcctataccctttattaaaatggacctaattaagtgatttatgctttgtgcaatttcttaaatcagatctctctaggattgaagggatccataggtatctttcact

SEQ ID NO: 11971 - DNA, 1169 bp, Homo sapiens
ctactttcttgttttcgtttgttgtgtttttgctttacacatttgatagggaacatagaagttgtgacctttcatttcagtggaaagcattgagccagaatatatttattcctaaaccatcgagccacacatgcattgatgaaccctgaaagaatccacagtaattgactaacaggcagtactgaatgaaagatgtcatatgtggtgaaaaatatttaatatatcagtttcttgggctcacatacagccctttagttccaagtgcttggttagattagaaaatgggatgaacacaatttgatgctgaagcagctgctgagcagcacccagggagtctaggtcatacgccctatattgttttcggcccacttattgttgagttgaaaagtctcatatttgtagactagagtgtatgtgtttagaggctcatgttgtatctgagttttctctggcaactaagatctctttctaaacgttctagaaagatactggtatcttactggcccattatttagtaagttttagaatacatgtacatcagtgttttcaactgcttggtggacatttcactgatgcataatcaaagtagcagattataatcatcagagtgatctgacaaggaaattctgtatttgcttccataaagaaaaataatcaaaacatatatcagatataatatatatgcagtatatcacataggaaattttattgtaggaaattagagaaggatgctactcaattcattctctagcaggaagaatacagcttaaaaatcacttgggtccctttaataaagaaaagtgtgattctgtgttgtgtgtttggaactgaaattggagaacacgtgccagtcgactgtgaaatggttgctggataaaaccacagatgtggttttatccgagaaatgtgggactgaaattattttgatgagaggtacataagagagctgcagaaaagactgtagcttctgaggaggcaggagtaccttgttaatatccaaaccacccctgagttctaatgttccaactccacctaaacgaggaattggaaactttaaatggaattatctaatttaaattcttagttttttctttgtctttctcagctgatacttgtagttttgttttgttttttaaccaccaagaacacttgcaagtttgttactgaaa

SEQ ID NO: 11972 - DNA, 1120 bp, Homo sapiens
caccccaatcccaaaggggccctattgttgctagttttaattcctgtagctcctgttctaagtcatgcccatcgaagaatcaagattagtccctccactaaatcaagatttagtactcttgaaaaggggagatgtctggaaagaagagcaagataaaaaccctgcacatcaacaggaagtataatcctgcagttactaataattcctgtagaagcagcagctctaggagtctccagatctgattctcagtctgtgtgcaagccaggctggctctcgtgcatgactgtctatgggtgtggaatgtacgtcagagcctgtgtagagatacaggcagatgggctaactcctcatgtctagtcatgctggcagggctttccccacatccatgcttttgaaattagtgtgagtgtacaggtttgtgtgtgcatgtatacgtgtgtgtgcacaggaagcatttccacttgagggaaatcctgccccatcatgcctacctccacaatgaaatcactcgttttttggtgtttgctcgcctaactgacttgaaccccattttatttatttagtttttttctcatggcaaagtagaatacgttggaaggtgtagggaaatcctgctggaactggtgtttcagagtaaatcttttttctctccggaatttcttgttttgctattaacaaattatatttacctgattatgaaaaattaattttccttatacattttccccttacaacactagaaaagagcaccttgttacagttccggcctctcagtatgtgggctaaatgccagcattagggaattcattaatcatgagactaggctacaaactaggcttgcttgttttggggtggttttgttgttgttgttgttgttgttgttgttgtttccaaatctctactgccttttgaggaaatgtaaatctgagacatggaaataagtgtttgggagaatggaaaagagctgaatcaggtaggcatgaaaacttttacattctctatcctctttagatgttgaaataggccagacaggttaactgatgttttttaaaattgtcttttatttctggaaagatctgacttattcctagcttttttcataccctttattattagtgcc

SEQ ID NO: 11973 - DNA, 1115 bp, Homo sapiens
attttactgcccacacatagccaggtctgtcctccggcatactagtcagctcagttcacctagacccaaaatcagtacaccttgagtacatagtgcccactattttggagttgtcatttcatttgtagagtcctttgataccagggatttctctagatttggggctttataagctccctgctgcctagaactcctaactcactgcccaaagaattcatttatttaaaaaattagggcaatacattaacaggaaaactgcccatttatccccagacattttatcacattgagaagtaactgaaacataagcaatattaattctgaatatcctaacctagtgtagtaaagacatttatataggtacttataaggtccaagtgaagtaattcacatcatgagagaatgaaatactgaaggacaatagggaaagagtgacattttatctgagtgggagcctgaaagtttcaaaaaggacatggcatttgaactggggtttgaaatgagattttgatagttggctaaggaggtggggttgtggagggcatcctggcctaaaagaagagcaagagcaaaggcacaggtcagaggcttgaaagtatgaggatggtttctgcagaggtgagaaatgtggctgaaatttacaaaaatggcactcttgcatcccccaccgtggagtttcctcttttttccctctccacccacttttccctcttactctgcatctcctgtgttccacttgggatgacccctgttgagatacttggagaggaataacttccctgtgcacattaatgagactgccagaaataaaacgtttatttatgtgactgtgaaaccaaattttcacgtgcattactaaatgatatcttggaatgggtggttggggaatgtttttcaggttgaaaacatcctcttgcatgaccgaggccactatgtcctgtgtgactttggaagcgccaccaacaaattccagaatccacaaactgagggagtcaatgcagtagaagatgagattaagaagtaagctttttctcctttcatggagttttgtccacaatcagatgagcaactttaccttcagcttatggatgagaaggtcagggtggggagagaat

SEQ ID NO: 11974 - DNA, 1125 bp, Homo sapiens
ccatttaaatgctatactgtaaagatggagacaattagctcatgtgtcaaaaactcagatattactgaaattcatctttaagcaaagcatacattcattttctagttgatgattggcattggcctgcagtaaattaggacagtgatttttaacttgtatttggggtagtgagcatgcagacaggtcacaaataggaagggaatatataatttgaaaatgcatagattggctccaggtccagccagaaaaggagagaacctcaaagaagatggggattggctgtataccctctaaagaggcacattatagacttaagaggtcggagtgtggagaagacgtgagattttcatatttatcaaagaagatatggtttttaaaagactgataaatatggcattaagcagctgagttataaaatgagtctagagaggtggtacctgtagttgagtactgtatgtacctctgggaacaaacatatttcttcctgttcttgctagtttcagagaggaggagtgaaaagagcaatcaacagcaaattctgcgtggtggtttgctgtgagctccacagcatttttgaaaggtcagctctaggtggctcgctcaccaatgatgagaatttccttgaaaaaagttaattttagatcatagagacttcctcagaagatgaagtattcctttctcttttaaaatcatagtgttagaatcagtataacatcaaatgggttatttaagtggctgtctactcacccagcaattatgtggtgatttttaaggtggtatgacagagtgttgttcaagtctaccatcaaatcctgcttctagggttagctcacagaacacaaatgaacaactgtatgagatagggaagtaggttatctggtctcttcagtgatcttggatatatcacttcccctctctgagcttgtcttatgtgaataaggagatcaccgggtgatcttgaaggtctcttctagtgcaaacatggtttttaagttctgtggtttttgttgacactatttgggagggagaatgagattgggttgatgagacggaaatgttagacctatgtagctgggataagaaaacattaaaaaaaaaaagaaaagaaacagggttttgctatgt

SEQ ID NO: 11975 - DNA, 1103 bp, Homo sapiens
gtctgctgtgggtgaatcagtttgagctggtcagttttctccttgggctctgtgttaaccttggcagacaaggaatggcagtgccaactgaagctttgttatttttgtcaaaaaacagagattattggaccaaagagctcatggtatctattattattatagaaggctaagcatagcattgatgctagattatcttttgtcgttataatgagcttaaataatgatgcctgtcatctaggacttgaatcctgtagaaagcaacataatgccacataatttgtttgctgcatgttttcaaggacacttacagctattgtactgggacctttagggtaagagaaagattattgtccttttggtactgagcatgaatttgagaacaaaatgatgactttattacctatggggacaggaagaaggaatggaactaaggcatcgtaggttgggtccttcctggaggactggggcctgagcagcatttactgagatggcaggtctcctgctagtaccttggttcattttctctggtcagtgaatctgattgattcaggaagtgctgattattttacaggtttgttagacttgtttaatctcccctgggatagcccacccctgttccacaggcctttgttctctgctgtttttagaagccttggaatcttggtattggaggggaagggggcagcactggaagaaataatttcattgggctttttggctgtagagaaaaatcttggcttgaccaggtgtaactcagtaatgattatggaaaacctgatatccaatactgtctttcctccccttcccccctggaataaagggagtgctatgatgttctccttaggagaagactttcaaggttagtactgtgtgtgatggtttaaaagcatgagaattgaaggtaaatagcccttggctggaatcctggacatgtccctgtgatgttaggaaaagttaactaagatctagtcttctcatctataaaatgtagatttgtaaaatgcaaaagcatgggttgttgtaagaattaaatgatgtatgcaaagcacttcacacagtgactggtgtatgttagttagcagtttgtaaatggtaactcttag

SEQ ID NO: 11976 - DNA, 1169 bp, Homo sapiens
ttaatatattaactagtgttcattacatgtagctgaaatgtaagttaaaagaaattaagagatattctttgtcctgtgtaccttatccttgagtgaggcttttgggctccagagtttcactggcctgttcaggtcttgggagggggattctggcgagaatgtgtaatcctaagtacctttctcaagccttcctttcccaacttgctgcactatacatgccaaatgcccagaaacagctgaattcccagcctgggggtttcattaagaccaaagttaatttcctgggattttaaaataaatctccttatgttcttatctgtaaacctaaggtttataaaattcttgagaactttaaaactagcttattttgtattctaatagacatgaatgtacgtatcccccgtccacaaaaacatttaagaataataggtttgaaaagaatggctgtttaacttacatggttttttatagattttgaaggtatggcctttcttgaaactgaacaaggaaaaccatttgtgtcagtattcagacatttaaggttacaatatattatcagtgatctggcttctgcaagaattattgaacaagatgctgtagtaccttcaggtaagagaacataatttgtaattttaagtaatatatttctgattataaagtaatatagatcatagaaaagaacaaggaaagaagtagaaattattattaatcccaaaaaggtatacatctttatgccaaagtggaatcatcctatagaagtaattttctgtgcttacatatcatgagtattttcccatatcatatttcatgaaatactctctagaatatttaaatgattatctagtattctgtaatatggatgttctttaatttaataaaccagtacatgattttggatgagactttttaaaatgacttttgaagtatttaaagatcataagtgatttttctattagtgctccttaaatttgtttattttgattttttcttattctaaagtcttaaacttcatgttgaagcaaatgtgtctttgctaattataatttaaattttttgaaataactactgatttacctttctgagttaaatctctagtgcttgtgaataattctatttagtactatatatacatatacaaaattgaaaatagaatttctgtttgaacattt

SEQ ID NO: 11977 - DNA, 1958 bp, Homo sapiens
tttaagtcaggtactcttactgtccccatcttacagtgaggaagctgcatttgacaaggtcacacagctaatgggtgggagtttggagagtggagttgtggatctcagactcaggacactatctcctttggttcactcagttcaacagtttggttttttgtttttattttatctaattgtcattgaatctacaaatctgtcttataggaacaagtggtgatgaacttggacagcaggcttctgatcttccctttatatatctgctgtaacttcttgtatatatcaccagaaaaaaagaattgaaaataatcgtcacccagaaaatccagaaaactgaagatttcatcagttggaaacagtagcactttgaaaactttttaggccagctttaatttaatggccctactgatattcacatcgaaggtgactaacaatgacaaaggccttatgaactgtacagacaatacagaagattattcttatcctcattgcatttctatgcatatgcgtaagaacattttaaagccaagaaaatatctgtcaaaccatttctgttagaacgatgtcaattcatgcttttaatttagcatcaatagaaaattgctgtaggtaaatctcacatttatctgcaacaaaatatagatttaatttttagcttaaactttgtttctaccttatgttagtggacctcagttatccatctgtaaatttctttttatttggctaaaataatctaaaagaataatttggttggccaattagaaatgcctttttcagttggtgtattgaaagctttcctttaacattttcacctgctcattgtgattcctccttttagtctaatatctttccaggtcatacttgtttttaatcattaaatattttcttcctggttttggagactaagctgataaactttttttaaaacttaagcattgtcattgctattttttttaatttgactttcctaggagtttaagaacagtgaaagttagctttgcaccttcaaatgatcttgaatgagggaaaaatcagtttgattccaaggatatttcttgccttacatggtcttttctttgacagtctgtacacctttattattaggttttgaattatttatgtaccagatattatagttttaaacattttaatattctctgatctttagaattatttatgttcaaattttagttgggaactttgtttcctacttaagctcaggactttttaccctctgaattgagtgcctttgagtgacacatgctaatagaaatttcatagtaaatgtaaataaggtcagaggatgtaatatggagcctgatgatgaagcattaatgtaaaaatggaacttatttttgtcaaaaatgagatgtacacttgtcatgatttatgtatgttgaccttttgtgtttattactgttttgaaaatagccatgttcattttctttccagttagagtaagtacttctgtggttaatgtatatttttattatggtttttaaaatgggaatcatttttatgtatctgtgcaaataataaatgcccatttggaaaaagagtaagctcttacataaaatggaccaaaaaatcccccttaattgaaaccaaaattttttctttctagttaggtttttttcccaactccttttaacttttggaatttattaataatttttttcttttttaatgatatgcccataggttcataaattgcttttgttcttttaaaattcatccatttggtttaacttaaaggaaccttttaaatgcctcacccttgaccctcagagctggaatttaaatgtttctaatacagtgatttggctgttatcaagaggttacatttcagctgggtgtcagccaggtgtggtggctcacacttgtaagcccagcactttgggaggccgaggcaggcagatcatctgaggtcaggagtttaagatcagccatgaccaaca

SEQ ID NO: 11978 - DNA, 1853 bp, Homo sapiens
acgagcccaactcccccgaacgccgcccgccgctcgccatggatgccggtgtgactgaaagtggactaaatgtgactctcaccattcggcttcttatgcacggaaaggaagtaggaagcatcattgggaagaaaggggagtcggttaagaggatccgcgaggagagtggcgcgcggatcaacatctcggaggggaattgtccggagagaatcatcactctgaccggccccaccaatgccatctttaaggctttcgctatgatcatcgacaagctggaggaagatatcaacagctccatgaccaacagtaccgcggccagcaggcccccggtcaccctgaggctggtggtgccggccacccagtgcggctccctgattgggaaaggcgggtgtaagatcaaagagatccgcgagagtacgggggcgcaggtccaggtggcgggggatatgctgcccaactccaccgagcgggccatcaccatcgctggcgtgccgcagtctgtcaccgagtgtgtcaagcagatttgcctggtcatgctggagacgctctcccagtctccgcaagggagagtcatgaccattccgtaccagcccatgccggccagctccccagtcatctgcgcgggcggccaagatcggtgcagcgacgctgcgggctacccccatgccacccatgacctggagggaccacctctagatgcctactcgattcaaggacaacacaccatttctccgctcgatctggccaagctgaaccaggtggcaagacaacagtctcactttgccatgatgcacggcgggaccggattcgccggaattgactccagctctccagaggtgaaaggctattgggcaagtttggatgcatctactcaaaccacccatgaactcaccattccaaataacttaattggctgcataatcgggcgccaaggcgccaacattaatgagatccgccagatgtccggggcccagatcaaaattgccaacccagtggaaggctcctctggtaggcaggttactatcactggctctgctgccagtattagtctggcccagtatctaatcaatgccaggctttcctctgagaagggcatggggtgcagctagaacagtgtaggttccctcaataacccctttctgctgttctcccatgatccaactgtgtaatttctggtcagtgattccaggttttaaataatttgtaagtgttcagtttctacacaactttatcatccgctaagaatttaaaaatcacattctctgttcagctgttaatgctgggatccatatttagttttataagcttttccctgtttttagttttgttttgggttttttggctcatgaattttatttctgtttgtcgataagaaatgtaagagtggaatgttaataaatttcagtttagttctgtaatgtcaagaatttaagaattaaaaaacggattggttaaaaaatgcttcatatttgaaaaagctgggaattgctgtcttaaactctttgttggtgccttttttttccctccccttttagcctgaggtgtttggagggaggagggagaagggtgggcccgtccttggtattctctcaagctcttctcaccttatcggtaagattccattccctctgtgccccaacaaaggaacatggcaggctgggcctgctttgggatgtttccagggacagagaggttcaagttccagagagaggcctctgcccatttctctggtagaaacaaggttttctcgaggggaaaaggtgtgcccactcagtaggacctctaaatggcagagcgtcctctccatctaaccagttcccccacccccacctcacaggataaacttaggaaca

SEQ ID NO: 11979 - DNA, 1189 bp, Homo sapiens
gttctgtaaaatatacttaaatggaaaaaatgatgttcatttagattgaaaacttttctcagatggattgataattgcattcatcttgtgttttatatgagaaggtgcctcaagaatttcctgttggatttgtttaaaaggatttttatctttcgtgataaactttgctgtgtaccaggaactataaaaacaaaaacttgttactaaagaaaatatctgaaatgtgataagttcttatgccatgttaatttcatgtgtcaacttcaacatttacatgtattatttcattatgtaaaatgttttagcaatttaatattttgcacagttagcaaactttgtatgtcatttccttcaaggcatcatgcagagttgacatgagatttataaggttttaagttgtttgcatgtgaaaatcaaatacatactttggtagtctttgaatacaaagtcatctgctcttgtttttcaagaattttgagacacaaagttgtatgtaaaggaatatattaatttgccgttttctaggtagatttgctcaaaaagagtgaatcaacttaatatgtacaaatgatagctgtgaaactgtagaatatctttgtgtcaggcttggagttcattgtgacctccaaattttgcctgaaggaccagctgggcaaagcatcttttaaatgttcagaggccaaaagataaacaaaaaaaaaaccttaaaatcctacctctttaaacagccttcagataagagaatcctcagtgcaatcattattttgattcgtttggtacctgttttcctggagttcccgattttattattttggggtggctccaagcattaagaggtttaatctttgatggcattgttctagttttgaaatttctagtatatttcagagtctcttagaagacttgtgtgggaagtttcactttgttttcagtgaagatcacaaacctccttcttcctttactcaagaggaaaggtcccagtatacatatttgaatggttgatggttttcaagaccttcagggagctccctgcattttacctagaaacagaaaaggcccgcaaaatcttaagtttcctggcctgcatttcccgggtaggggcaaatgactccaagctggtctctaagccaatacccttataaaccagagcccaggaaagacagctcgagtgtataattctctggagctc

SEQ ID NO: 11980 - DNA, 1587 bp, Homo sapiens
acacacggttctaattaagtgtgaaggtatagctattgcacttatgccatctccaaaatttcttaagtattctttcactatccattaggagtttttcttaaacttgtctgataataagaatcacctggagttaggaggtggtggttgcagtgagccaatctcaccattgcacttcagcctgagcaacacgagcaaaactccgtctcaaaagtaaataaaaataatcacctggagtttgttaaaccatatggattctcaagctcctctcttgaagattctgattcagtaggtctgggagtggcgcgctggattttgatcaaaattgtagagcattttaaggtgagtacctgagggagaacttaaagacatcttagttggggagtagtccttttgaattttacagctagatataatcttcagtcagataaaatttatgggagctggtgtcttatgcctgactcttagtaatttcataccggtttgaagtacgtgtgcccatgcctaaagccttgactttcagaatgttgtcttttgattcttctgtcttgatttgattaggggtgaaatttagaagtcttagtaatgtaacttgaagatgttaaacaaaaatctcaagtaaaatgaaaagcaaatatgggctactgaattaagaaactggcattctagtattaaatcctcacttcaggagcttttaaaaatactgagacccccccataaccagagattcagattcaaagactgaggataggaccttagcattgtagctatttaaagtttctaatgtgcacccagggttgggaatcaccaatgtgggtgtgaaaatgcctacaaagggttttagtgccttagaagtcctaagaagcccaatctgtatcaaagcagatccattttgcaaggatctttcttttagaactttctcagttctcttagtaagaactttagaagtaatcttgataataagcacagacagcctaacagcagaggcaacttaaataactcctgagcagttggcactagaacagaatacttggaatgacaccaaagttaaccaagtccagcatatgtccaaagagttaagtgtttcatttactgtagcattctgggtgagaaattggttgctgaaatcttaagacagtggtctcaaccttggctgcacattggaatcacctgtagggttttaaagcatccaaatggtaattaacaggcagcaaaacttcagaactagttctgcatctactgtgcaaagatcatgattaactgtcaagacactggtagaacagaacaagcaaaagattaagagttcaaaagtaaatgcaaccaatttaacatgtagtgttattaaaaaattacaaaggcctagaccagcctgggcaacatggtgaaaccccatctctacaaaaaatttttaaaaagttggccaggcatggtaatgcgcgcctgtggtcccagctgctcgggaggctgaggtgggaggatcacttgagccttggaggtcaaggctgcagtgaatcatgatcatgccactgtactccagcctgggcaacagagaccatcttaaaaaaaaaaaatccttccattgaatagaaa

SEQ ID NO: 11981 - DNA, 1672 bp, Homo sapiens
aaaaaaaaaaaaaaaaaaaaaaacttggccaatcacactaccatgtccctttaattgaccaagataatacatattaaacctgtagcacagggcctaacacataatgagcacgcagtaaatggaggccttactctcagctttttctacgttcttccttcttgccacaggaccgcctggcccggtgcaccatgcattgcaacgacaaagccaaagattcaatagatgctgggagtaaggagcttcaggtgaagcagcagctggacagttgtgtgaccaagtgtgtggatgaccacatgcacctcatcccaactatgaccaagaagatgaaggaggctctcttatcaattggaaaataaaagtatttgccagtggccatcagggctgagggcaagaatatattttttataaggaattgggaattttagtcttttaagcaaagtttacgaatgaagaaatgaaggatggccacaagcgtaaggcatatgtcacttgcctctggacactggttattttatgtttcagtccctaaaaaatgaaatggaaaaaagtggtgctaaatcgagtcagagatattacaggagagttttagagcttattatttcctgtggccagtgcttgtcctggcagtaaggctttcccctgtaacaagccagagccctccaaggtaccagactcttcttactacacaggtactaacaggctggcaggttagagttggtggagtctgaggagagatattttctctttgttgccaacatcctgtttaccaaaagtgtcaccccaccatcttccataagctgtgaaacaaaatcaatgaggtcactaacttagaagggaaagaaagttttctgggtctttgttttcttgatttggggtaatttatacaagggcatacaagttgattttaagatgtggaactgggaggtagactagtttggataagaactttgaaatgttccttgtggatccccatttctggtcatcaagatgtggatgtacatttcttaaaattattacatgctgcatctttcagcctggagactgtgcagaaacatgagaggtgatgacacactaattatgggaagcagaattactggctgatggcccctgaggctgtgtgtaacaaaatgacaggacaatcttgcagtaacactttccccttgaagagaagggggttttgattgtgatatatactagtatctaggaatgaacagtaaaagaggagcagttggctacttgattacaacagagtaaatgaagtactggatttgggaaaacctggttttattagaacatatggaatgaaagcctacacctagcattgcctacttagccccctgaattaacagagcccaattgagacaaacccctggcaacaggaaattcaagggagaaaaagtaagcaacttgggctaggatgagctgactcccttagagcaaaggagagacagcccccattaccaaataccatttttgcctggggcttgtgcagctggcagtgttcctgccccagcatggcaccttattgttttgatagcaacttcgttgaattttcaccaacttattacttgaaattataatatagcctgtccgtttgctgtttccaggctgtgatatattttcctagtggtttgactttaaaaataaataaggtttaattttctccccacta

SEQ ID NO: 11982 - DNA, 3094 bp, Homo sapiens
cggggcaaacgcttagggatcctggttgtcttctccttcatcaaagaggccattctacccagtcgtcagaagatatactgacccccatgcaggcaggatgtggggggcaagatcaggagagtcaggcccctgggcctctatgccaggtggggaccagaagtcgggaaggcacctaccacctgccctggctttcttcccctcaactctggagccccatccccaccctccttggggggctcagcttggctcagatctgatgcttcaagaggctgtaacctcagagggcaccaaggagggtggcagagcctgcttagccaggaggccgaggtccctcagtcctcccctgtcccttccaaggtgggtcaggaggttctggccccgctggggcaggcagggcagggtctgtgaagcttaagagcagatggtgacaagttctctgggcaggtggccatggggaggggccatggcttggcatgtccaacagaaatagtttttgctgttgaacggtgatttctgtccaagtgcagatttccgtttgaataaagcttcgcttctaggtggcactgtttgccttaataccctgacagttcatcttcctttcttcctgctaaccttctgctctggactggactcacttttctgctccagggactccttttctgggtttgggtcttgcccttcccaagggactgttcttgtggcccttaatgggaagggggcaggggtgaggagctgagcctgctcaaggagtgggaagtggggctataggcagcctctctgatgcactctcttccatctctttccccaaggctccgtgactgtcaaactgggagtaggagaggggacaatttaggactgggctagattttcagaagaacatctacaatatcctatttataaatcttcctctgggaaaaggagtggtttctggctgaatactatcttaggctcaaggagaaacaaaataaaaattagcttccaggcagcctgtttttaaagaaatgggactaatgggagaagctgtttgtcactctaagagcatccaagccctggcccgtctgtgcactcttggctcctggggagatatatctgccttctaagaaggcaggccaggtcttgggcacagacctgcatttgttgaccttgcactccaactatagtgccttgcaagtgctcaacagtacatattggaatgaagtccctatgagagccatttctggccatgttctatacctcaaagtgaggctggcaggtacagagatgaactgtacacatgtgatacatttaagccactggaaaaacccctgtgcttgaaaatatttcctctatatcatgcctggagttccatcatagcccttcatttccttggctttagcatttaccttctcttaagaataccagctttcccctttccctgagaggaagagcacatgttggtctcctcttagtgtgaacgagattgccaggcccttttctcctatgcacaccaggatagacaaggcaggggatactggcagcctgcatcatcctcccattgggctgacagctggccctactttcctccctctgctgcttggtccctcaccttgatgatgtggcttcgccccctccactctactgccagtgttctcccagggcttgctaaatccagcagacccctttcctgtcttactagatctgggcagcatttgacatggctgatcaccccttgcttcttggatggcacttccctggcacctctgtggctagttgtcctacctccctggctgttcctttcaggcttccgtgcaggcttctccacttgcccatgcacagtagggtctttcagggttctgctgtgggctccctagggaagcccatccatctggatggtttcaaggatggtgaggaatttagagttgacctccagccccaacatccttcctgatcacctgaaccacagttttgctgccctctaggtgcacagacaattcaggtccatggcccagatggtacttgctgtcttctgcaaacctgccccttctgggtacttcccttgaccccgagatcactcaggagccagacaggaaacttattctattcctgttttctctttctgcccaccacatccaatctctcaaaacggtcaggtctaccttaacatctcttgatttgagccactcccactgtcatcagctttcacctggattatcgtgacagcctcctactgcttctctatcatgtggccagagctatcttcctaaaatgcattgcatagttgatcaagtcactctctggcctaaaaccttccttggctccctgctgccctcaggataaagtctggacccctcagcatggcttgtgagactcatggtgtccttgtccctgctcacctctctggtctcatcacttgccttcttgcattctgggtcccagcctcctgtatccagagatgcagtggctctccattgccactctgattcctcctttcttttggtcacagagaaagggtactttctctgtcaaatctcaacttagacttgacttcctccaaggagctttggctatactctctcctcccgacccccaccctggcatactacacagatcactctgggctcacttgcctgcctaatggtcatctccccagtagactgtaagctccttgagggcaaggattgtgttggaatttttgtattaacagtgcctggcttggtgcctggcacctagaaagcactcaataaatgtttgtttaatgaatgaattgtagtgatgtgtacaaggggatacagggaagccagttaacttcctggaggaagtacaagtgctttcatagactcgaatggaaaccacacatccctcccctcccttgatgtactgcccatgcctccctgaactgcagaaacctcagtagccgctgggaataaggatggcagcccagagtagcagggaagcccatgccagggggacatattagttgccctccaccccattctgggtctcagcttagagcctgcagcaggaagggcttaatctgaacaagaaacagaatttcccagtgggtccttccatcctggaagcctgggcccttagggctgggagggcagtgggggtg

SEQ ID NO: 11983 - DNA, 1181 bp, Homo sapiens
ttctttaacaaaagtgctttatgactttaataaaatattagagaatggtaggatccatggaagccccttgcaaaaacttgtgatagaaaattttgatgatgagcagatttggcaacaactggaattgcaaaatgaaccaattttacaatactttcagaatgcagttagtgaaacaattaatgatgaagatatcagtcttctcccagagagtgaagaacaggaacgtgaagaggatggttcagagatagaggctgatgacaaggaggacctagaagatttagaggaggaggaagtgtccgacatgggtaatgatgatcctgaaatgggtgagagagctgaaaactcaagcaaatctgatctgaggaaaagccccgttttcagtgatgaggattctgaccttgactttgatatcagcaaattggaacagcagagcaaggtgcaaaacaaaggacagggaaaaccaagagaaaagtccatagtagatgataaattcttcaaactctctgaaatggaggcctatttagaaaacatagaaaaagaagaggaacgaaaagatgataatgatgaggaggaggaagatattgatttttttgaagatattgattctgatgaagatgaagggggactgtttggaagtaaaaaacttaaggtaaagttttgagagaagagagagcactttcctcctcaaattagcttttcttctgtttttctaggagagatttaattgtagttagaagatttagtgataagaaatattgtgctctatcttatcagttataaatgaatctgtacttccattcaatttatgttccagttggtcttataattttgtggtagtgttattagttgccattttcacctaataattatttagttattagtttggttattagttattagcttgtagtgttattaagtcagaaagtaatatatacatacaatatacatgcaaatctatatgcatgtgttaatatatttttctatccctaattaatagtttttaatatctttttattttagtcaggtaaaagttccagaaatctgaaatacaaagatttttttgatccagttgaaagtgatgaagacataacaaatgttcatgatgatgagctggattcaaacaaagaagatgatgaaattgctgaagaagaagcagaagaactaagtatttcggaaacgtg

SEQ ID NO: 11984 - DNA, 1251 bp, Homo sapiens
atatatggcatgtacagtaagagatggccttataacatgtgtataatgtttgcctacacttgtgggtctaaaatagaaagggtttaaagggtgagtatcatgtgcagaacatcttaaaatttgaaatgaaacatgataaactaactcaaggcttgacttttaaacaaactgtgatggggaaatgtggaattaaagttggtaaccaggtaggaagactcatttaaaacagaaaaagatatttgagtaatggtttctttgctttcctaatgtttattctttgtgacttgaatagttatttcaggagttgaaaattttctttttgctataatttgcttactctgtaataagtaataataaatatttattataacaatgatataatttactattaatatattaatgataatttattaatatattgataatatttattataataatattccagaggaagattcttaagtgaacctagaaataaattgtaggttttgttatgttctacctgcactttatgtttcaggcttgggatgatgtagtacgtaaagaaaaacctaaagaggatgcatatgaatataaaaagcgtttaaccttagaccatgagaagagtaaattgagccttgctgaaatttatgaacaggagtacatcaaactcaaccaggtgaggaagcctgtaaggccaagccattattattaaagaaatagaagtagagaactaggctttttgtgactgttgaaatcgtgaaacagaaatcttgagctctttggctacctcatgtaagtatgagacagagcatgctaggaatagaagggttctaatattcccgctggatgtgaggggttgaggggggttgctttgcaattagactttggtcacctgatacttttacaactcattaactttctagcaattatggtggtgctacaactttaaaagcatttctcattgatattttgaagtaactgatatattttacatgattatgaattcattctgatttttaggtctgttttttctttcacttaactaaaatctctgggctgggtatggtggctcacatctgtaatcccagcactttgggaggctgaggcgggcggattgcttgaggtcaggagttttagacctgcctggccaacatagtgaaaccccatctctactaaaaatacgaaaaaattagacgggcgtggtggcatgtgcctgtaatcctagttacttgggaggccgaggcaggggaattgcttgaaccagggaag

SEQ ID NO: 11985 - DNA, 3217 bp, Homo sapiens
tctggggatagtaatgcacaaaatggtggagctgaagagggggatggggcgggcgaggggtgcacagcgggaaggggagtggtggtctcacaatactgtgactctgagtaactaatatgctcagtcttattctaagcctctgagtatttctattttgttctgctgacttttgtttggggagtttcctgttttgtttttttaaatagctctttcgagttaaggaaattgcattttccccccttcatcagaagtgttccgcggtgtgtatttaaacaaaataagctgactaagaaaaactggatatttaggaaatgcccctctcaccctgctgtatacttatcagggacagtgagcacctggagagctttttgtggaatctattgagttggatgggaaaagggacaagcagaaagagcaggtggtgcaaactggaatttgaggctcagctgccccacccccggggtctcctgcaatgaactcggataaccaatgtgctgtcaagcccttgcctgtttgtcctgaaccccattcaagaaaacacagacttaaagtacttagtttacagtaacttttgatgattgttgaaagttgtaaatcagaaggtagggctgtgatggtggttgtcacttgagtcatttagttactgttgtcctgttcataagcctgtgttcaccaccaccatcagactcaccatttataagtagaagagcactagggttgatctgccacctcatctttcatgaagtctattccccagcctcctttttaagaaaagatactgctaccaaaggcataggggaggcctgctgtgctggcaattagcatgagcctgcagaagtcatccttgaatctgttgtgtcttaattttatttggacagtttttttttccagcctcatcaacacttggtcttcctggtgtcttaattccctcagacaagtttatgcacttttttaaggaaatatttttcaggacactagtaagaagctcagttcacagtttggatatttcttcccacattacagaattatggaaaggaactcaaaatcagcctaggaaagtgagtcctgcttgacccatgtgactgtgtacctgaccttctgggatcttttcagctattaaaacattttactgttcccacatacccagctttgcaagttttgtagattgacctcttagggtgtgtttctttgtctttcctgcctttaacttgctggggtcttttgttgctacccctaaggaactaaactgggtgccaggagctaccttcgtgtatagagatgtagatggcagtgtggggtacaggagagccatccaggccattctcccagggatgaggaattggagagccctgaagataatagtggcttctttctgattgctactgtgctgtgtgataggcctaatagggaaaagatatgtaacttgaaacaaagttggtataaattcagtatgtggctgtgggacagaggttggaaggaaaggactagggtatggaaagctgaagaaattctccttatgagctctcgttgactttttgaacagtgataagctaatgccagatttaaaatacacattttttcctatttgagtctttaggattatatcatttgaaaaaattgccttccttgttaggtcacatgtcataggagagtagcttagagaacttgcattaccagacagacacattaattcccaaagcctctatgttgagagaatgaaactgttaactctttttcagagaggactatgaataaagaaacttctttattcaagcttcagctttcagctgggttgtttcctctaaaagggaaagggcattgcaagtgcatagaggaaatctctcccttctgggactgcttttcctccttcatcctcgtgagcctgtccaagctcagaattccgaaggctgttagaaatgcgttgggattgcagagagaaaggagcttgtctttccttctgctgtgctggtctgttttggatgtcagtcttcaggactatgaaaacttcctgccagtttagcatggacactgagggctggcatttctagtcttcttcagacactgaacatactgactccaggtataggaagcagctagcaaattgattcttttttaaatgcataggactctgcttccggcggttcctcttgtagtccaactctttttgccatctatttatgttgggaggtaggggcacaattgtcactcacaacacaggctagttagagtttgctaccttcttagcagaaaatgcatgtgtgtcttgttggaccttcactggggaaaggctgggagcctctggctgtcagtgacttttctcacagaagaagaaccagcaagccagactggacacctttaccctttaatggtaagacttgtatttataaggggtaattttgatgttgaatttaagccactactttgtttaaacttttttaaattggcaactagaagtttgagaatttgtatagaaatggaacatgtatttctaacagttgccaatctggctggtcccaatgttagtttattagtgattgatctgtaattattgggattatttattcaactctaaaattccaagatgaaaataatttatctctttcttttcaagggaaaaaacccaaatgaatgcattttcagtttctccaggcctttgaactgcagcagaaaattcaaggatacagcctaggcctgggcaaatgcagccctgggtctttgggccagtttctgacaataatagttgagttttgggaatcacataagggtgaaaccagaaacgatcctaaggaaaggcttgacctttgttaacacctttagtttccaaagtcacagcagctggggtccctcttttttttttttttttctttttttttgagacatagtctcactctgtcacccaggctggagtgcagtggtatgaccatagctcactgcagcatcaaattcctaggctcaagcaatcctcccatcttagcctcccgagtagctgggacaacaggtacgcaccaccacggccagctaattatttttattatttttattttttgtagagactggatcttgctctatttcccaagctactcttgaattgttgtgctcaagtgattctcccatctcagcctcccaaagtgctgggattataggctgggtgtggtgagccaccccagcctggggtctctttaattaaggttataatgctaaccatggcttaaaatac

SEQ ID NO: 11986 - DNA, 1104 bp, Homo sapiens
ttaacattaggaagtaaacagttggcctctgaaataaacactaatctttagtattgtgaagtcccagtttaaggtttctcagaatgtttgtctttcagtgttaacgtttgttctaatgcccagcttttattgtatgctttttctgaaggctgtgaaattctggtattactgggatattggggctggagggaggagtggcaaatgagatatctgtatctcaaatgcctttctggaatccttttctgttccatttcccagaatgtggctgttttcatttgatcgttacaaagagtggttgtttaactttggtgttaatgtcatttatttgacatttcaaactgtcttttcaaactaacttgatcaatattgaggcttttttcccatattagccagaaagcagatactagttttggtaaatgacttctctaaagaaaacactatgatttgaaaagactagcacacaaggacaaatatggaattaaataattcttctgagtagacctgtgttctctgtttcaagtatggaactgcataatggttcagtttgtatataagataataacttttttattgaaaaacttgtgaaggggaaagtcttgctatatccttgagccaggaatcaaggtctccattgttatcctagccccatagatgtttttacttagccctaagtttctaaagttttatgtagggttaatatgcagtacagtaatgaggcaggaatttgaatattttcttcattattggaaatgagtcttgtaatttaaagacaaaagcttgttttgagaagtaatattcatatacctgctgtaactgtgaatgtcactgctcttttctggttgtgctttgccacaaattttattgtgaattgtaaagatttgaaactcttaaaattagccatttatattttgaaaaaaaggggtgtgattattttaaaaaaaaaacattttagcatgcaaagaataacttgcacaatggatagaatatatattgattaaggtttagggtcaagaggtatttctctaatctggtagaaaagttttctcctcaggatgtaatctttggggcatgagggaagaccagtttggttcaaatgatttaaga

SEQ ID NO: 11987 - DNA, 1129 bp, Homo sapiens
tgtgactatttggaatctagccagtggtcaaaatttgtttacaatactatgatttttaactttccaacaggagccattatttccatttaatttggatgaatttgttactgtggatgaggttatagaagaagtgaatccttctcaggccaagcagaatccactaaagggaaaaaggaaagaaactctcaaaaatgttcctttctctgaacttaacttaaagaagaaaaaggggaaaacttccactcctcgtggtgttgagggagaactatcttttgtgacattggatgagattggggaagaggaagatgcagctgcacatctagcacaagctctagtcactgtggatgaagtaattgatgaagaagaactaaatatggaagaaatggtaaaaaattcaaattcactttttacattagatgaattaattgaccaagatgattgcatttcccacagtgaacctaaagatgttactgttctgtcagtggctgaagaacaagatctcctcaaacaggaacgcttggtaactgtggatgaaattggagaagtggaagagctacctttgaatgagtcagcagacataacttttgccactttaaatactaaaggaaatgaaggagatactgtaagggattccattggcttcatttcttctcaggtgcccgaagacccttctactttagttactgtagatgaaatacaagatgacagcagtgatttgcatttagtgactttggatgaagtaactgaagaggatgaagactctctggcggattttaacaaccttaaagaagagcttaattttgttactgttgatgaagttggagaggaggaagatggagataatgatttaaaagttgagttagcacaaagcaaaaatgaccatcccacagataaaaaagggaatagaaagaagagagctgtggacacaaaaaagacaaaacttgaatccttgtcccaagtgggtccagtaaatgagaatgttatggaagaagatctaaaaaccatgattgaaagacacttaacaggtagatacttggaaggggtagtctttctgttttatgaggggattacatttaaaattaattttaaaatacatgttgtggcattaccaataatgtcacccagtatt

SEQ ID NO: 11988 - DNA, 1244 bp, Homo sapiens
tcaaagtgttctccgtgggctgtatgtatgcacataggtgtcagtgcacacgcgtgtgtgtttgtgcacgtgtgtgcatgtgcacgtcagtgtgaatgcgtgaatgcgtgtgtgtgcctgtcggtgtgtatgtgagtatgtgcgtgagagggagacgtgttaaagcctgacatatggatgatgtggagtaactcacagtcaggctctacgggtcacagaaatgcctgcaacagctcagctggcaggcagcagctgcgggagagcccactgctcagcatccccctggggcctcaggtcagggtccttaaatcacttgtggcaatgaacatttaaggttccatcttattttgttaatccacgtgcctgcttctgactgagattctctttctctctgggccttggctcttcccccatctcctctgaagcgcactgcagcctagtggctctaagtgtaggctccggcactagagtggattccagctctgtctatgccgtgtagggattgtgttttctgtacaagtctctgtgcccctatttcacctgtgaaatggggataatgacagtatctgctgatggggttcctgtgagggctaaacactgcttagaacagtctctggaattgagtaagtgtgaagtgttggcagttattgtttgggagggaagagctattgggttggccgtgtgggccacatgttccctgtgaatgtgagtttccatgatctttctctgcaggtggtagactctcgttctctcaggacagatgctctcctcggggagttccgggtaattgcttattttctatgaaagcagtcagttctcacttctccgtgttggtggagcctctgtggaccatgggcaggggctccagagatcctgtgtttctctgctttgggaaaatataatttcaaagaacaacgccaagccctctgcacagcatctcctttcaccccagaaaacctctccacaaaggtagaagagaaagaaagcactttttgtcactgaagaggccttaaaccagagtgagatgtacatcacaggcaatgatccactaagatgctgcaaagacagaaagaaatctcacgctaatttagccagcgggtccaacccattgcccaccacatacgttctcaagagaagctatgccccaccctcaggtcaggggactttacatttcagacctcctgagaatgacatttgtatactaaagctgacaaatggcttatttagtttcttaaaaagatgta

SEQ ID NO: 11989 - DNA, 1147 bp, Homo sapiens
aggtctcctgtccctttgcaatatttttaatgccttttatttatttaaacagtttttccttaaagccctatttctgactactctgacttctgttgtctgattctgcaattggttggctctagctggctcttgctcatggtgcctagttccttatgtgtttgattgtgaactcatgttccttggaactttatctgagaattctttggggcctgggtggaagttacattcttttagagaggatatgtgtttacttttaccagatgtctggagacactataaacacagattaacttaaaactaaatgttcagtgtgtggctttttgggtccactagttagtatgcattttggctccttatttctctggatttttcctttctcatttgcccttaagaattttctttacattcccatcagctcagccatgcatttaaaatggattttagaaatatcttttctgttaatttaggtgttcttacttggagggtttctctggttgtctaatttgtcattttgctggaaatcaatgtctttattagaggtttaaatttgaagtcatggttttcatcatgcaggtttatctccttcagggttgtgtactctaatttcttgtttgcagtttcctcttaagacttcctatgaatacacatgagccatttgttttcttctgctttttactcaactctttaagagcattgggagacatttgtctttgtcttcagatcgctcttcttcttttgcccttaatatcttcttttttttccttgtgtttatccttacagagggaagtccttgcttgtcaaatactgggacctcagttagattctttccataaattcatgggcccttctaatctcaaactcagacaaaaagaagaaggaaatagtttagatttgcagtagtttcactttgctggttagaaatccagcagggtgggagaagtaagaaggaaaccaggatcagaggcagctatgtggggctattcttctgggctgaagagtttatttcctatgtttgttatggtagtcaggggttagctagggtaggccagagggccagagctgctgcgcctaccaatgaactcctatgtaggaatttcttaagtaaagtagagttgaccctctcccactaggcccaccaggcagggtg

SEQ ID NO: 11990 - DNA, 2622 bp, Homo sapiens
gtgaacaagcatggcatatggcaagatgacagcttcattccaatcccccaagaatggcggtttctttagcctgatctaaccccaggcttttattgcaattttttctagggcaggatacagctaagtagacagcagtaataattggatcccatgtttaactgcatattgccccagctctaggagtgttgagtctcaactcgaagagtttttctggatcttgaaagccagttttcatggaatcagagacccaatcccttccctgttcatctcatttccttcacttacagtcagagcacttggttcaggacataaatcaacagttacttccataggccttcacagggcgtttcagacttagcctcctccagtaatgccattgaaatagttcagatttcggaagcctaaaaatggcctttaccttacccttaggtgtaacctgaggattagttgggattgttcctttatgttttaaaaccagctttttggttatcatctttaaggaaatgtcaccagctctgcactgtgggggcagccatgcctggactggatgcctctagggatggagacattgttaccataaagtcgacagagccaaccatggcttgtggcttgttgcctctggcccaactgtccttcactaaataatatcctagatattattttgttgctcaagcccaaggttcccaccctcttttgagatccccaaagccatctttggccttgtctaagaaagattgcctataatcctgtcctccaaactctaaagcctggagcagcttagcgtggaggctgcactcattgacccagatggactcctgagacttaacgcaagggctttgctatgaggtcagtcgggggaaactgtactttaagacacttcagaaagatgctactggctagtagcagaaagatggctagtggcaagagtataattgtgcatcaccaaacaatgacaaataagccacacaggcatttccagcttggattgatgggaggagagactcatcaaacagaattcttcactacctttgtcagctactgagttgcttctggggagggaagtacttccttgcccctccccaacccccctacctcaccatatcctatcatatcttgatagtcatggggaagaggatgtgcacacagacatacaaatttcctcaaagctggagagaccaggctacatgtgagctcatagatgctgctgaggctcatcctgagggctggatggttggccagggtttcagaatgagggtaagggatgagcactgccacccagaacttgataagccaagagaaggcaggagccaaaatggcatcgccaagctctcatctttgttgaaacaagtgagaaacgattatattaatctgaagttctattgcttgagaagagttcaaaacacttctctttgctagtacccagtttgcagcaagatctcttcagctttaagtgctgagagactttgaagtggaaatggagagatgtgtaagcatggcacagtgtttgtctttttagaggatcatcattgctggtctggtctcaaacctctgccttggaagaactgtgctatacaggaaaaagtgaacaaggtggaggaataggggttattctgcacagaagtcccatgaaaggaaaagcttattcaagctcaagacataaagatggaccctttgatatatcttctctccattcttagtctgccttcaccttatctaacaaaaaacaacatgcagctactgagttgtatgtagagacatactcttggtgggccagggaaggtaaaaacagggaccagcaatgtcaagtttttgaactagaaaagtgggatgtttttagttttgtctataacctgtagctgggccaacccttgagaggacttgtgcaaagcatgtgtgcccagacccatcagactcctcagatatggcctcaaatacctagagatgtagaagtaccgtggagggcctcaataagagggcaagcacacagatggctagaagcctgtatggcttctggtcaggatgaacccttggccaagttcttgaggaaaccaggtctatattcctgaagggacagttcagtttgggactctattaggtttcagtagtaatataggctgcttgcatcattttaacattcatagggaaaatctctttgagcaggctataaatgaagctgttgcaggtagggaagaacaggacctgaaaatgggaaccaggaagtgagatcctgttggcaaagggaatgtagagcttccagggtgcattgcccactgttctcattgcataccagtcctccaagtcagtctagccttactgtacacttgacaagtgcttactcagcaagtcccagacccacggccttttatctcccaagactggctttggccatgaccttcctcatcaggcctctgagcacactctctaggaactgctgcagaaattcccctaccttagcctcccttctcccaggactcctctcttgactgcaattgcctcttcttcttcttcttcttcttcctttttgttttttttttttttgcctgcattcacaattacttttcacaaaggtgttggaaatggcatttttattttacacagatagttgcacatatatagagaaaa

SEQ ID NO: 11991 - DNA, 1133 bp, Homo sapiens
agaagctgaagggagagagacatgactccttagaagcttggtcctcctctcccccagcttctcttgtcttccctgtcatccgtctgccaatctccctgtccatggttagttaaaggcgctttttatcctcttttctttcccacagagtttgccagatccggcccggtgcctgggttccaggaggacacgctgcagttggccttcatcgacttgagacaagtaagtctttgtgtttttgttttttgtttttcttttaagatgtgtgactgaagaccatcaggtcttaaggaaaaggggaagggagggggattggcgttggcgattcacattggagacctaagggttttccctgtatttgaggccacctcttttatttagctatctgggatccttagctatggtggagttaaaggttttgtgggtagaagggaaggcgggggtgggaggagggacccagagtagagggactcaagtgaccctcaagtgatgcgacccattgtgctgttgttggcttttgcagacatagcaaaaagataactcagcaaaccaatgctaagcaggtgcactgatgcagagactgcctgcttggagaagttttgtttgtagataatgtggccagcagcatttaagaaaaatgaaatattttacattctggattgttggttggtttgttgactttttcctgctgccttaagtcttcccgcctcctcctttgtagaatgttgtcagccatgggtaactaagtggtcgtttttgaagatgattagaaaaggcctggaccagtgatgctaaccctattaaagtaatgtgatgaaagctgatacttgggcatacctgagctttgggaagcccattagatagaaccagtcattctataggactgtttcttgcagattgaactgggtgggttggtaggccttggtggtttggatatagggaacagggtgagcgggggcctagtgagggagagagttaactgggctctgtcatctcttcactcttaagatggatggggttggatagaaagtgtgaatgaagtaagaatcaatgactgatgcttctttcctattaaaacaatcttttttttttttgtctgtttaaaaaagggggctggctttgtttctcctgccata

SEQ ID NO: 11992 - DNA, 1422 bp, Homo sapiens
gaatcttggttttagacatggtagtctagagggtccatgttcagtgggcttttgaatttcagtccagaacttgatggtgacaaattggagcctttggcaaccctgaccacacatttcagccaagatgacgtgtttcctctggccagacctgactcagccccacccccgacataaaacagggacctgaaaccttctgtccctgccttggccatgttccctcatcgtctccttttcatcctctaggtcctctggacacagacatgcagcagttggcccgggagacctccgtggacccagacatgcgaaaagggctgcaggagctgaaggcaaaggggaagctggtggattgcaaggtgtcagcccagaaactgctgagcttactggaaaaggacgagttcaagtctggagcccacgtggacttctatgacaaataagcccatgtttttggcttcctgaacctttttgcccccacttttagacataccccagagccctgtggctccccacaccctgccataggggcagtcctgccttacacatagaagcattcatgcctgctgccctgccctcaggcacagccagctgtgagctcccaggtcattggccttaccagttgtcaggagtctgtgctgtgcaccctgggttataaggaggcttaggagagaggttatgggtattggtgtctctatccccaggaatagaacttaaggggtgggaagaacaggaaaagaagctggaacacagaagagaggaggttgtgtctcttgctcatagcaagcctgtgggtagaggaaagagtgatctggtgtcgaataggaggacccatgtagattcgcagatggcctggatgggaggaagggcagacggtacatgtcccagcccacatagatgccccttgctgagggtagcaggaccttctgttgaactttgtgtcctcactctgatgtctccttccttcagaatctaccacccctcccccaggctgggagaaggggctcctgggtgtctgtatacacgccaaaggcagatacaaataaaatacagattgtcctttcttcatgcttgctttctcctctgatacagggcctatgactgactgcctggttcactgggcccaaggccattcccaaggcagttaacccaaaagtgaggtgttgtccttatttcctagggagctttccgggggccatctgcctccagtcatcaggccccactcagtggcaagcccaggtgcaaagttgcccacaatcggcatgcctgcttttttgtgctgttgcccacgctgaccccagccttgatagcccttttctcaccctgggctattcagaatacccatcttttagggcccagcttacagcctgccctccacatggccctaaagcctgggtcctttccccaactctgtggattgccaattccacc

SEQ ID NO: 11993 - DNA, 1202 bp, Homo sapiens
cacagcaaggcgctttggggggaggagtgaagcaggcagactctgcatttgtcaccccccactccccacctgcccacccctcccaggtccccccacttccatcctgcagcggggctgggagagttcaggcggggtcaacacccacactgcactgggccacggggcctggcccagtcatgtgagtcccaggatgggggagcagaaagaggatccctgagctagttgccagctaatgggtggccccagacttcaacaaccagtgcttcactaaggagccgggaaccctccccttagcccaggttcccaagatctcagatggcagaggggcctagccaaaggcaggcactcagccataggaagcaagaatggagaaggtctgcccttaactcagcccgctgctcctgccccaaccctcttgccccctgagtattcagaggcagaggcactgtagcctttctgctctgtcccactctgctgtgtgacctcagataagtcactcctcttctctgagcctcagtcttccatccatatgatgagggggtggtgctgggtgaacactgaggtttctgcctctctggcacctgctgtcagggaggcaaatttctgggaacttgatttgctcagagacaggaggggctggatgttggaccgacagtttaagaggatagggcagcgcaagggccccagtgatggtggaacatcaggcctcggggtcaggggggatgcgacttcaggtcagagagccctcccagatggacacccactttgcctgcctagtgggcttgccctggaggagaggaaagcagcccctcggtaagtggccgctctctgaggccagaacgggtgtcctccctgatacctgttcttttccactttcacttaccaggttcccaagggcccccagatccctcaccaggctgataggcagatggacaacagaaccaccccttccctaacctttgcccatgcatttgaacacagaaccccaaggcttgcgtaggaaggagtgtagtgacctccctccaggtggaatgccatcttcctcctcatcctgctctctgcatcccctctctctgcagccagtgccaatatctgcaatgtggtcctgatgcggtacggggagctggaggaagggattgatgtcctggacagcgatggcaacctcgtgggctcctccaagatcgcagcccgacacgtgggtc

SEQ ID NO: 11994 - DNA, 2055 bp, Homo sapiens
aactcttcccccaagacagagcaggggtgaactgtagcttgatgcagtaatctgggacaagactggttgctagcacatactttattatcccccaaggatggtcagccatttcttcccacagccaaagccccatccccttcatttccctccagtccctggaggggcttctagtattactgggacaatgaccacgctgcctgtttgtctgtgagttacgggcaaccagcctcttcagcctcacacccattcccctgagagcaagaagcctgtgtggtctgggccagtctctgccatgtcctgagtctgcttcagtctggagctgtttgtggggcgagtgccatgtggacagtggtggatgatgtgtgtgcttcaggctgctccctgacccctctgacctttccacgagtgtcacatgggaatgtgtggggcgcaggggcgggtgcggagagagcacctttttgcttttcgagctcttgaccacctccaatgtgtaggtccctccaggctggggcttgggactgcttatgatttggggatcaagcctccatgtctattcttgttgcctgtccagatgccaaaactctgtgttgctgcagggtttgaacttttggaaaccaattaaaatgtgcctttggtgggcggggtcaagagcccctggatgtcgacctctcccgctgtgtggcgtccccctcccacctgttgaatacatagggatggctctctcagggccctgggaatgggaatggacagcactgctgtgggctgttcccctcccctaaagttaatctcttggtctggccaagttgctgctccctcaaccttcctgctgtcttcccctccctcaaccccaataggaggatcccaggataaacactgctgggcaggcgggcaggcaggcctggggctgccctgctcactctcattgtctggcctcaggacttagccatactagaccagtcagcttgcctggaagagggaggtcccactatgcctttgggagacacctatacttaggaaaaagcctttgttgtcctcccatccatccattaagctgctatctcagcctgtcccttctgccccaggggcttgcctggcttggctgcagtgcactttgaaatgaagtatctgtcctttggcccagcccctggtttgcttgtagaaaacatggtaggcttccccaaggcatctgcagggaactttggcagcttggggcaccctgaattagcaaaaatggggggtgatgaggtgctgaagaaggatacttaacagcttagtgaggaggcaagagctcctctgggaccaccacttcttcaggagagggcctgtgggcttgcttttggaaggcctcaggcagacacgtgccctctgggtgatgtctgtctgctgccaggatggagcagaggagcgccacacatggaggaaagcccctgtaacgttacctaccttaaactccactcatcaaatctgagaaaagtatccactggtccccagggtttcagtcatgcttttgggggtcattgggtattagagaagtaagtatcttttctgagagagggggagtcaccccccctactggggattcctctgggctttattcactcccagccctggccctgacctttgtgggcctccctaatgcccagggcatggatggcttcagaggagtttttgaatcgaagcccagggtccttgttgatgtttcttctcctagccacacttggaggaaagttgcaggtgggttgggcagggagcaggcatggttctgctttgctgtttgtcttcctagttaaggctctttataaagagcttgttcttcatgttttaagcactttatgaagaataaaacattcatgtactgcaggtggctctgttgtgttcctgttttggaatgaacagttacaggaggctgctgtgggagaaagcaccttaaatcaaggtgatgggattcttggatgacactgtccctgccccttataagggggcagcagcacagtgttgcccagcagcctgaacttagtcttttctgactcccagggtacccacatttattgcgca

SEQ ID NO: 11995 - DNA, 1214 bp, Homo sapiens
ggcccggcccagcccagcccgcagctgcggcggcgctcagagttggttcctgaccgccttctgccgcggccgggtttgtcaccaggtcctggggtctgcaccggctcggccagacctcgccccccgcttctccgccatggccctggtgcggggcgcggagccggcggcggggccttcccgctggctgcccacgcacgtccaggtgacggtgctgcgggcccgcgggctgcggggcaagagctcgggagcgggcagcaccagcgacgcgtacacggtgatccaggtgggccgcgagaagtacagtacgtcggtggtggagaagacgcacggctgccccgagtggcgtgaggagtgctccttcgagctgccgccgggggccctggatggcctgctgcgggcgcaggaggccgacgcgggcccggcgccctgggccgcgagctccgccgccgcctgcgagctggtgctcaccaccatgcaccgctcgctcatcggcgtcgacaagttcctgggccaggccacggtggcgctggacgaggtcttcggcgcaggccgcgcccagcacacgcagtgagtagggggcgcgggggcacagaaacggctaaaggcctaacagggcggggctggtgggggatcaggaccccgaacttcagccgggccagtgagcccttgcctcgtgcttaagggcgtaaaccgacagaaacgttggttcttcgcatttcggggtcgtcttcaagcttcccaaacgtgcgctgtgtggggctcagccactggtggtccctgggaggcctgggggaggtttaagtggtggcgaacgttaggagtagattgtcaagtaaagttaggaatgagattcagaggctttggggctatggaaacctcaagaagggaaatcttggggccgttcttagaacctccgggcctgcctccctttcctcaaaggggaggggaactgcgggcgcctgtccggcaggggagtggagaggcgcagccttgccctacgggggaaggaaagccaggtgtcttcctccagggcgaggttgaatgttgattaccccgctaaacgtagaagctggctgcagggggcatctgcctcttgctctcaagatgccctccactatctagagatgtcacccccccacccccatcctgtccctctgtgtcctgtgtccctggtctgaggataggaggagcttctaagttaaggaaggaaacac

SEQ ID NO: 11996 - DNA, 1114 bp, Homo sapiens
ctccagttgctgtaagacagtaatacacacacattattctacccatttttaaaggcaggaaaaggaaacgaggcttacacggacaggcactgtctccactgtcctgcaaccccaccacactaaggcatcagtccctaccatcttacctaaacttgcctctccgagacagaagccttgcttttctgtctacaagacatcctatttatccagcacccccctcctcccagcatcaagcctctggatacatcttggggctgtttctcacctgtgtgccctgtggacagatctgaagctccccacaggcacaaagggattaccttcccccaccattaattcagagcaccctggggaaagactttgtgtccaccatctgactgggggggtcgccatggctgggtgaggccaaggccctatctcaccaacctgcctcgatgtccttgtatagctggtcaatgaaggcgtcaagctgctcacggtcctgaggcttcaactccagagtgtcacaggcatggacccactggcttagggagctggggggtcccaggcagcccatggttggggaggcagaagcccaggtcacagggctctccacctccaggtaagttaagcccaggaagaagggtctcccatccccaccccacttcattctccaggtgggggcccatcttccccaacagaggctccccaaaacagattccaatgcctcattctgattcccaccactgtgtccagttcagtgatctgtccagagtcccaccctaccccatcccagtcttgaaaggaactgtggctaccttcctcagtttcccacccctgagagtaacttcaatagctctggaacattctaacctggtcccgattccttggccattggtcccaacaagagcaaagagagaccggaatccatctggagtgaaccactgtggggggaaaaaagagatgagtgctcattacagccactgacttttcttccaattggactctctgtttgggaagccttctgtgagtcaggctcatctgaactccagaagaccaagtcggctttggctcagctgtcccagtaggagatgatgacctgattgctcctggagagctggagtaacaaggaggccac

SEQ ID NO: 11997 - DNA, 1158 bp, Homo sapiens
actgggtcaggggtaatcaccagtcccttcttgcaggcctcaacttggggtgcttcagttagagggcaaaaaaagatctcgggctttggaactcccagattgatggggacagtggggcatgatggggtaccaagaaagtgaccgtcaccacctctcttcatgccctcccagctacatgatccgccgctctctggaacagcatgggctgccatgggccatcatttccatcccagtcaatgtcaccagcatccccacctttgagctgctgcaaccgccctggaccttctggtagaagagtttgtcccacattccagccataagtgactctgagctgggaaggggaaacccaggaattttgctacttggaatttggagatagcatctggggacaagtggagccaggtagaggaaaagggtttgggcgttgctaggctgaaagggaagccacaccactggccttcccttccccagggcccccaagggtgtctcatgctacaagaagaggcaagagacaggccccagggcttctggctagaacccgaaacaaaaggagctgaaggcaggtggcctgagagccatctgtgacctgtcacactcacctggctccagcctcccctacccagggtctctgcacagtgaccttcacagcagttgttggagtggtttaaagagctggtgtttggggactcaataaaccctcactgactttttagcaataaagcttctcatcagggttgcaactgtgtcctagaataagagcacacgggtgggcaggaccttcaaactcactcgtatcgtcccatactgtcgttctgaggaaaggaaacacccacagaggacagtgactggcctaggtcatttgggaccagtgctcagactgctagtcttagatcccagcacagcttcctgctaggagccaaggaagccctgggaagccagagttcagcccctcaggagaagactcatcttagagcctggaactgggggtccaaactggacctcagggctaggcatggtggcccatgcctgtaatcccagcactttgggaggccgaggtgggaggatcagttgaggccaagaattcaagaccagccttggcaacaacatagcaagatcccatctctacagaaaaattaaaaattagctgggtgtggtggt

SEQ ID NO: 11998 - DNA, 1085 bp, Homo sapiens
tagtgggtttttttttttttttttaaagagacggagccttgctgtattgcccaggctagtcttgaactactggctcaagtgatctcccacctgcgactcccaaagtgctgggattacaggtgtgagtcaccgtgtcaggcctttgtcagaaccttgactgacttcctgtggccaaattggatgcagaagcatgctgcaatccctctatgtgcctggggctgtttggctcctgccagacccttggctgtgtcccagcccacagagcacaaaagaagctgtcgactgtagtttaaaagctgccacatatgagatctttgactgcagtcaccatctgtcactgataatctgccctaaagatacaaaaggtgaagttggagagggctgagtttagagactggaagggaactacctccacactgtagtagaatcagataagagggatttggttttcaagacctgatgcagattctgcccttgtgtcccagggagcagaggaagctgctggaaaagtgtgccatgaccgctctgagctccaagctgatctcccagcagaaagctttctttgctaagatggtggtggatgcagtgatgatgctcgatgatttgctgcagcttaaaatgattggaatcaagaaggtacagggtggagccctcgaggtaagcctgctgtggccttcctagacagctcttgctttcatattgacccttcagacagcttcatatggcagaggggtactcattacaggaataaagagaatgcatgttaggcaggaagtcagacttacattgtactttccatactgccattagaggctgttactagatgaacttggtaacctctgtggatattatttgtcagcagagtagaaaattggactgtatgattttcagaatctcaggttctctgtgtcagtgggtggtggaggggtagtaggactagctcaaatcatcaatgacctcccaattaatacatctgagagggatttttcagttcactgcttactcctaagtgatactgttaagcttgcccttctttcattcatttatcttgaatagatgatacatatttcaaactgtgaaggggc

SEQ ID NO: 11999 - DNA, 1178 bp, Homo sapiens
acttctgacctcaggtgatctacctgccttggcctcccaaagttctgtgattacaggcatgagccactgtgcccggccaaaggggtcttattgggaactccatgaatccagcacctcagaagagtctagacctcagccagtttaaactatttctcgcatctggacagcaccagctgtggttctcagccttggggttactttctgcttttgtgttggggagtttcaggtgattcctaagtcatctcatggggtccttatttgcttggactgaggagtagctattctgtttatctctgttaattcccagatgaatcagcatgttttatttggtgggggcagatgggtatattttaccctaccgtatatgtcaaccttcaccccaaagcattctcatccttttctgggtctctccaggattatcaggcaattgttgatgctgagtggaacattctctatgacaagttagagaagatccatcattctggagccaaagttgtcttgtccaaactccccattggggatgtggccacccagtactttgctgacagggacatgttctgtgctggccgagtacctgaggaggatctgaagaggacaatgatggtaaccagattttcacaggctgcttctcggcctttgtggccctgaagggttttcactgacccctggtataacagagtgtactgtcaggttggcgtgtgaattgagccctgttttttttttttaactcttttttttccaggacacattccatttccatgtgtgtgtgcccagtagcacaaactactttagtctaaccaaaacaagtccagaaatctggtttgtgagagaacctagcagtaatgctatgattagctggacaaactcaaatattgattcttccagccagattttttccctttcatgagcatcccacaaaagatacttttaggtttaaagtactcctgagttcagttgctggacccagtgccaccctagtttaggggagggagtataagctgaattgaatgggtccctatctccttttaacttcttctgtttgcctttgatgtgttttagttctattttgttttttttttgctctttcagagagggggaagggtcgcctggaagtcaagggaaagggcgggtaatgtagaggctctgggggcatgcgtgggaattggctttgagacgag

SEQ ID NO: 12000 - DNA, 1387 bp, Homo sapiens
ttacctctgtgtctcacttgcctcatctgtaaaatcgggctatttgaagcaatgagatgaaagatgggatagtatttttgttattcctgtttatcttgagaactcattgtttgatatatatatatatatatatatatatagtcctcaggtgacctgaggatggggccgccccaaaacacaacagcttgcctgggagaagatcccagaggtcttgtgtggtatgtccagggctaaggggaggagttggcgggagtaggggtgtttccaggttcctggcatgctcataggaagatgcagtattcttcagcgaaatgccaccaagttcagagagtctgcgggttcctagcagtgtcttttggagtaccagtttacaagaggaaagttgaaagtagttccatattacctcctttcttttcctactcttttaggggggtacatggtatggagtagacatcaacaacgaggacattgctgacaactttgaagctttcgtgtgggagccagctatggtgcggatcaatgcgctgacagcagcctctgaggctgcgtgcctgatcgtgtctgtagatgaaaccatcaagaacccccgctcgactgtggatgctcccacagcagcaggccggggccgtggtcgtggccgcccccactgagaggcaccccacccatcacatggctggctggctgctgggtgcacttaccctccttggcttggttacttcattttacaaggaaggggtagtaattggcccactctcttcttactggaggctatttaaataaaatgtaagacttcagataactttgtaaattattttggcatggtactcataaatgtctggctgtagctcagaattttagctttacatgcacttgtccaacagggagacaagagcatcctggggtgagctccactagagtggcccgtctggaagtttcactgtggttgcattctttgttccagaagtggctggacaacacgcagttgctttcttctggcatcatcttatttagccctggcctagccagacactgctctcagggtttctctggtttgagtaaatgggttacattaccttgtctgccccttctatctccatattcttttggtttagtcttttgttccctcttactcaagactgtgagaagggtgttttagggagggcttatgctctctaaactctagtgatcccttggaagtctactaaggagacgactgaaagcacccacctagtcttttcagttcagcccccagtgatcttggtccttctgctttcttgtgaccaatgggagtttggaatggctggcacagatgagctggaaatccagcagtgtctaacatcctcctgatttacactggtcctgatagctggcctgcaccctgctgtag

SEQ ID NO: 12001 - DNA, 1130 bp, Homo sapiens
gagtatcttcaagtacaaattccttcataccccagaaagtctgttcctttttgtagtaaaatgaatctttcagaggtttcccaagccacttctcatgatacagtgaatattcaaaagagagctacatttgaagcctgtacaaaagcttatccccggaacacatgtgccataatatacaaacttctacttttgtcagtccttaatatctacctctctgaattttcatgaatttctatttcacaagggtaattgttttatatacactggcagcggcgtacaatacaacttagtataaaaggtttttttgtgttaaaaaaagatgtgtagtaatgggaagaggtctaaaatgtagttaatattgtgagaacaacagctttacattttctatactttgatgagaatgtcattaaataggaagctatataatacatgagtggacattttcatctaaatattaatatgtatggtaactcagttaatgacttagcatgttttcctttaacatttttctagaaaacagaatcttggcattgtcttcctcaagaaatggactcttcccaaaccttggatacatcccagactaggtttaatgtgagaacggaagatactgaagtgacagacttcccctctctggaggagggcatattgacgcaatcagaaaatcaagtaaaggaacccaacagagatctcttctgttctccactgctaggtaatgcctgtttattttaactagtagtaatacctcacatttgtaagttttgcggggactgcaagtcttgtaactttcccctttttgagttaaggagctctgtagagacctactcagagggattagcttatttctgttttgtttgtttgtttgttttttactggctagctgatctaattatattaagtgtgcagttgcctctcattttatcacttcccgttgctcacagaaggcagaaaggtgataactgtctactgtgtgtgcctcctcagtcttgaatttgcagagtttttgggatgaatagtatactttggttatctcagcaatggagactccatgatcccccacaaaaaacaaaaaacaaatgttcatatttacctttttgatttttagaattaattaaggcatatgttattatcct

SEQ ID NO: 12002 - DNA, 2063 bp, Homo sapiens
agtactacaggcatgtgccaccatgcccagccaatttttaatttttctgtagagatagggtcttgccgtattgccaaggcttgtcttgaactcctggctttaggtgatcctcctgcctcagcctcccagagtgctgggatcataggtgtgagccactgtgcctggccttgcatggtttcaagagcacaataaatgatgactagtaaaaaagttaacgcaggttaaatgaaaaatcatggtaggcgtcattatgaaaatcacattctgtgtctattgttttaggagaagtctgagataatatcagggttatagggtggtagttcaccttttagttaaaaagaatttgctttactcagtcattagccatcttagaagagtctgaaattaggagagctgtgtttttcaatacacttttcaaataaacttgatttcagtgacatatgtatttttgtgttagtacttaaaaattaaatgtttttaatgttatttatttatttatttttaactatatattttcaggggaattcctgataagtctgaagatactgaatggtcttctcgaccatcggaagttagtgaagctttattccaggctactgcagaagtagcttcagacttagcaagcagtcgctttagtgtatctcagcacccgcttataggcagcacagctgttgggtctcagtgcccttttttaccttctgaacaagggaataatgaagagactatttcgtctgttgatgaactgaaaattcccaaagactgtgatcgttatgatgatctttgttcatatatgtcatggaagacacgaaaagatacacagtggcctgaaaacaatttagctgataaagatcaagtttcagttgcaacttcatttgacataactgatgaaaacatagctactaaaagaagtgaccattttgatgctgctcgttcatatgggcagtattggacacaggaagattcatctaagcaggcagaaacatatttaaccagtaagtaccctgattctttttcagattcatctgacacaattgataaaaataaaattcccaagggaagtaacaattttagtgtccccttttcctatgtgccatggaacaaagagggaactttgcaccacccagaaacgtgtgtaatcagtaaggactgtttttcctttccatgtgaagttgctgctcatcatcatcatcataaaatgtcatattctttcttgtgttgtttgttggaaagaagaggaaaaggggttcccttgacttctgatagtcattattttgagaatgtttatttaagggctccagctgagattgaggtgaaacaaaagatggattctttggagggttatgaaagaaatgaagaaggtttacagaaagaatcatctcaatgttttgaactaacggagactagaaataatttagtatcttcagaagtgcaacccagattcttagaaatacagtatattaggaatgttatagctcctgataattctgtaaaagtttcagaagcacatgtactctccaggggacataatacctctaaaatggaggcttctggttggattgttatatccaacttggatgagatatcagaacaactgtattttcaagaggaaagaaaccaaaagggaacttctctttttggtgagaaaaatattgatgctgctgaaaatatagcctttgaggcagttattgcctctattgagccttctaagaaagagagtacagtaaatgaaatccaagctgacatcaataaatatttaacagatgacagccgagagagagccaaaaaatccagatctttctccattaaattataatgatgaaacctctttatttgataggcttaaacatccatgctatcagtctactcctggggtgtttgaaccagcagcttcaaaaccattgttgcataaaaagggtaataatgatagcttcctatactggcatccaaatttaaaattaccccctaatgctcttcagaaaatgttcattaagccactttgtgttattccagagcttaagtcatctgcttctttgagtgaaaaatcttacaaccaggctgttggt

SEQ ID NO: 12003 - DNA, 1962 bp, Homo sapiens
tcacaaagagagaagcctggtattttctaccaacagaccttgccagagagtcatctgcctaaagaggctctgaaaatttcagtagctcctggactagcagaccagaagactggcacaccaactgtaacctcaacttcctactcacaacatagagaaaagcccagcattttccaccagcaggccttgccaggtactcatatacctgaagaggctcagaaagtttcagctgttactggaccaggtaaccagaagacttggataccaagagtactttctaccttctactcacaaagagagaaacctggtattttctatcaacagaccttgccaggtagtcacatacctgaagaggcacagaaagtttcacctgttcttggaccagctgaccagaagactgggacaccaactccaacctctgcttcttactcacacacagagaagcctggtattttctaccaacaggtcttgccagataatcatccaactgaagaggctctgaaaatttcagttgcctctgaaccagttgaccagacaactggcacaccagctgtaacctctacttcctactcacaatatagagagaagcccagcattttctaccaacagtcgttgccaagtagtcatctaactgaagaggctaagaatgtttcagcggttcctggaccagctgaccagaagactgtgataccaattttaccctctactttctactcacacacagagaagcctggtgttttctaccaacaggtcttgccacatagtcatccaactgaagaggctctgaaaatttcagttgcctctgaaccagttgaccagacaactggcacaccaactgtaacctctacttcttactcacaacatacagagaagccgagtattttctaccaacagtcgttgccaggtagtcatctaactgaagaggctaagaacgtttcagcggttcctggaccaggtgaccggaagactgggataccaactttaccctctactttctactcacacacagagaagcctggtagtttctaccaacaggtcttgccacatagtcatctacctgaagaggctttggaagtttcagttgctcctggaccagttgaccagacgattggcacaccaactgtaacctccccttccagctcatttggagagaagcccattgttatctacaaacaggcctttccagagggtcatctacctgaagagtctctgaaagtttcagttgctcctggaccagttggccagacaactggcgcaccaactataacctctccttcctactcacaacatagagcaaagtctggcagtttctaccaactggcattgctaggtagtcaaatacctgaagaggctctcagagtttcttctgctcctggaccagctgaccagacaactggcataccaaccataacctctacttcctactcatttggagagaagccgattgttaactacaaacaggcctttccagatggtcatctacctgaagaggctctgaaagtttccattgtttctggacctactgaaaaaaagactgacataccagcaggacctttaggttccagtgcacttggagagaagcccattactttctaccggcaggctctgctagacagtcctctaaataaagaggttgtgaaagtttcagctgctcctggaccagctgaccagaagactgagacattaccagtacattctactagctactcaaatagggggaagcctgtcattttctaccagcagaccctatcagacagtcatttacctgaagaagctctgaaagttccacctgttcctggaccagatgcccagaagactgagacaccatcagtatcctctagtttatactcatatagagagaagcccattgtcttctaccaacaggccctgccagacagtgagctaactcaagaagctctgaaagtttcagctgttcctcaaccagctgaccagaagactgggtta

SEQ ID NO: 12004 - DNA, 1268 bp, Homo sapiens
gaagactccatcccagacagcttttcatagttcctattctcaaacagtaaagcccaatattttatttcaacagcagttgccagatagagatcaaagtaaaggtattctaaagatttcagctgtccctgaactaactgatgtgaatactggaaaaccagtatctctctctagttcttattttcacagagagaaatcgaatattttcagtccacaggaattgccaggtagtcatgtaactgaagatgtgctgaaggtttcaacaattcctggaccagctggccagaaaacagtattaccaacagctcttcctagttccttttcacatcgagagaaaccagatattttctatcaaaaggatttgccagatagacatctaactgaagatgctctaaagatctcaagtgctcttgggcaagctgatcaaattaccggattacaaacagttccctctggtacttactcacatggtgagaatcacaagcttgtttcagaacatgtccaaaggctaatagataatttgaattcttctgactccagtgttagctcaaataatgtgcttttaaattctcaggctgatgacagagttgtaataaataaaccagaatctgcaggttttagagatgttggctctgaagaaatccaggatgcagaaaatagtgctaaaactcttaaggaaattcggacacttttgatggaggcagaaaatatggcactgaaacgatgcaattttcctgctccccttgcccgtttcagagatattagtgatatttcatttatacaatctaagaaggtggtttgcttcaaagaaccctcttccacgggtgtatctaatggtgatttgcttcacagacagccattcacagaggaaagcccaagcagcaggtgcatacagaaggatattggcacacagacgaatttgaaatgccggagaggcattgaaaattgggagtttattagttcaactacagttagaagtcctctacaggaagcagagagcaaagtcagtatggcattagaagaaactcttaggcaatatcaagcagccaaatctgtaatgaggtctgaacctgaagggtgtagtggaaccattgggaataaaattattatccctatgatgactgtcataaaaagtgattcaagtagtgatgccagtgatggaaatggttcctgctcgtgggacagtaatttaccagagtctttggaatcagtttctgatgttcttctaaacttctttccatatgtttcacccaagacaagtataacagata

SEQ ID NO: 12005 - DNA, 1177 bp, Homo sapiens
tccctatgatctcaagatataactgcaaccttgaaaactcctagttctcccagaactccttgacagaatgctctgtttcttgtttatctttgtacactgtgtgtatttagcacagtcccctaatttatggtggacatctagtaatttaaaaaaatgtattttcaattcagctgaaaaatagcatttcctcaactaaattatataatttaacattctaaattaaaagtaggttttaagataaaagtaaacatgtgtgataacattgtatcaaacaaaataaagggtactgctgaaattttaccttaataacgtttgacattgatgtgtccacaatatattcctatagctacttaaatattccttgaaaccacttttggaaagagatttcagtctctaatggccaaggatataatctgctgtattctttctcttttttggtcagattaccagagaagatgaagaccccactttctgctttctctgaaaaattgtcatctgatgcagtcactcagataacaacagaaagtccagaaaagaccctattttcatctgagatttttattaatgctgaagatcgtggacatgaaattatagagcctggtaaccagaagctacgcaaagctcctgtcaagtttgcctcatcatcttcagtccaacaggttactttttctcgcggcacagatggtaagagaatgtgattgcattttagattgttagaccagctcttttgtgtagttatcttagaaatttgtggttgtgtctttctagtcagaaaacctaattttaatttaagaattagggtccatatgattatatctgtcttttatttgcatagctgtcaacagaatatgatttattatattttatcttaatttcaagcacagttaacatgtagaactcatgctgtttgtgttaaaacttagttttgtctcatcatatttgcaataaaaatgcaagtagttcataacaacttgaaagtaattgaggtctgcttttaaaatggcggataaattatcttgtattacagtaacagtaatgttattactatatagtgcgtatatagggagagtatgtatatactaaatactataacaaatagatgcataaacatgtgatagtgcaaacacaatagcagtttatctcttacttataaagcaatcaccagagacccaggttg

SEQ ID NO: 12006 - DNA, 1189 bp, Homo sapiens
ttttatatcatttgcatctctgccttgtattattagaatttattttacatggcttacaacttcagtttgactgacgtttccttctgattatcctacccattgtagtgtagtgtttttttgtttgttcgtttgtttgtttgtttgttttttaagaccaagtctcactctgccactcaagctgcagtgcggtggcaacatctctgctcactgcaacctctgcctcccaggttcaagcgattctcctgcctcagcctcccaagtagctgggattacacgcacctgccaccacgcctggctaatttttgtatttttagtagaaatggggtttcaccatcttggccaggctggtcttgaactcctgacctcaggcaatccgcctgcctccaccttccaaagtgctgggattacaggcatgagccatcgtgcctggcctgtagtgcttttttcatagaattggtctaagaggcaaatttttaaaaagtctttctcaatctcatgtcgctatttgtgttttgtattacttccccgtttttctgtaggatccaatgatgccattgctccagacttcccagctcaggtgctaggcacaagagatgatgacctctcagccactgttaacattaaacataaagaaggaatctacagtaagagggtagtgactaaggcatccttgccagtgggagaaaaacccttgcagaatgaaaatgcaggtaactggattggctttgtatactttgtagctttttctccccttttcatcctaaatgagattactatccaatctttatcctttttttctgttttgttatacaagcttttctccttgctgttatattgagcatatacaagaaggcaaaatttcataaaatcctttaataataaaggaagcataagcttcagagatttttgaaaattataaacttcattttcacaacggataataaaatatgatacaacttttgaaatgaaataatacccaatcaagtatgttttagatactaagatccacagaaaatcttgattaaatgccacattagtttatctctgtcagatattacaaagtaatgtcttataggctggattctgtagggagatatgtagctgacatgattttttttttttaatttttttaaagacagggtctcactctgtcacccaggctggagtgcagtgatgcaattatagctca

SEQ ID NO: 12007 - DNA, 1209 bp, Homo sapiens
aaagagcctcagcatcaatgtgaatttgggaaacaaagaagtgatggatactactaaaagtcaagttagagattatccaaaacataatggacaaattagtgatccacaaagggatcagaaggtcaccccagagcaaacaactcagcacactgtgagtttgaatgaactgtggaacaagtatcgggagcgacagaggcaacagagacagcctgagttgggtgacaggaaagaactgtccttggtggaccgacttgatcgtttggctaaaattcttcagaatccaatcacacattctctccaggtctcagaaagtacacatgatgatagcagaggggaacgaagtgtgaaggaatggagtggtagacaacagcagagaaataagcttcagaaaaagaagcggtttaaaagcctagagaaaagccataaaaatacaggcgagcttaaaaaaagcaaggtgctttctcatcatcgagctgggaggtctaatcaaattaaaattgaacagattaaatttgataaatatattctgagtaaacagccaggttttaattatataagcaacacttcttcggattgtcggccctcagaggagagtgagctgctcacagatactaccaccaacatcctttccggcaccacttctactgtcgaatcagatatattgacccaaacagatagagaggtggctctgcacgaaaggagtagctctgtttccactattgacactgcccggctgattcaagcttttggccatgaaagagtatgcttgtcacccagacgaattaaattatatagcagcatcaccaaccaacagaggagataccttgagaagcggagcaaacacagcaagaaagtgctgaatacaggtcatcccctagtgacttctgagcacaccagaaggagacacatccaggtacatggctacagattccatctggcaatgtgactgccctcttcatggactttttagttaagctttgcacacaggtgaaaaaaacaagccatttgccctttcctctctataccatttcttaccaactggaaaagagtgagaaagtgtagtacagtgctattgtgagttgtcattattttcatcaacattcatttacgaattaccttttgaatgaagggctttgctgctagatccttcacagtctgcaaagtttacccctgaaatgggggagctttgaggttagaatgatctctatc

SEQ ID NO: 12008 - DNA, 1161 bp, Homo sapiens
attcatttattgatttgggttgtttccactttttggttattgtgaatagaattgatatagaacgtttgtgtacacctgtctgcaattcttttgggtatatatctaggaatggaaatgctgggccatatggtaattctgtggattagcttattgaggaactgccagactattccatagtacctgcactattttgcattcccatcagcagtgtataagggttcctccaaccctcctccttttttccacagcgactgctttagtttatattcgcaccagcagttcacaagggtttcaattttattgcatccttgccaacacttattttccattttttaatatataaactaaccatcctgttgggtgtgagttagtatcattgtggttttgatttgcatttccctagtgattattcatgttgcacatctttttatgtgcttatttaaccatttgtatatcttcttttgaaaaatgtcttttcaagtcatttggccattttaaatctggctgtttgattttttggtttttgagttgttgggattttctatatattctggatattgatctcttgttagatacatgatctgcaaatattttctcccattttgtaggttgcctctttcacagtcactctgctgaccgtgtcttctgacatatagaagttttaaattttgatgtagtccaatttagctattttttttttgttttttgtgcttttggtgtcatatcttagaaatatttgccaaatccagtgtcgtgaaagttttcttcttaagagtttaataattttagcttttacttttaggtctttgatccattttgagttaatttttgtgtatggtgtaagataagggtccaccttcattcttctgcatgtgaatatcccgttttctcaacatcgtttgttgaaaagactttttttccccattgaatgttcttggcactcttgccaaaaatcgtttagccatatacgtgagggtttttatctgggctctctattctgttagtctatatatctctctttatgccactactgcactgttttgatttactgtgtatttaaaatgagttttgaaagcaggtagtgtgaaacctgtaacttagttcttttttcaaaattattttggctgtttggtttcccttgagatttcatgaattttagta

SEQ ID NO: 12009 - DNA, 1245 bp, Homo sapiens
gaataaatctgtcaactcagcctcaaggttactcccagagacacctatgatccttcccctcaggtaacttggagattgtgaacggtgccaaaaaacacactcgagatgttgggataactttcccaactccaagttccagcgaggctaaattggaagagaacagtgatgtgacttcttggtcagaagaaaaacgtgaagagaaaatgctctttaccggttatcctgaggacagaaagttaaaaaagaacaagaagaattcccatgaaggtcagtttctcattccagatcttgtagtagagaaactagtgaatttcaagtcccctgcgatgctgactctgtgtttccaagtgactctatgtggtccccacctacccccagccacaaccttgtcaggttttcagagtccagcatggcagttacacagtcatccctgcagcaaaaccagactcaagggcaccctgtggcctctgacagctgagacccctgagaacctgtattatatgcatatcctggataagagctgggtggggctgtaaaaaagtgaaaaatctgtgttccttctaaaaactgtttcctgtaggagtttcctggtttgttcctgtggaaaatgtggagtctagatcaaagaaggaaaacgtgcctaacacttgtggccctggcatctcctggtttgaaccaataaccaagaccagaccctggagggagccactgcgggagcagaactgtcaggggcagcacctggacggtcggggctacctggcaggcccaggcagagaggctggcagagacctactgaggccatttgtgagagcaacccttcaggtgcagtgacgttgacttaactttaatgctacgtgtagggagaagaagggcaaggcgcagagaagctggctctgtgacttggtgagctgaggtgtaggcctgagacgctcttttccagcacctccgcagttcacctgttttcacgcacgagggttgggtttctcatcatctgtcaaaggctgccttactcctaaccatagatggtgcatcaccgtcgggatctggggacaaggccgcaggagggaggatttgcatctctgcttattgggcctgtgggtccctgtgtgtggagggcccggaggcctgacgcttgtgcggcctcatgtgtgttcctccatgtccgtagctcctgtttctgctccatgtcggatttaaaggaaaccaggtctcttctgatgtgtcccttgggggataaaggaaatg

SEQ ID NO: 12010 - DNA, 1163 bp, Homo sapiens
tcattttctatacgtataccctttaagactcagtattagaaaagaaaagggccagggggaataaccagtctattatcctagtgtaatagatgaggaaacagattttgtgagagaataaaagttatctaaagtcacacagctagtaaatgtcaaagccaaaactgaaatgaggtctctggatttctacttcaatactttccctgttattccaagctgtttgggaatatagggggaaagaaatctaaatttagtggcaaagaaatctcatgaaaacctttttaaaaagtttctctctttacctgacatggtcagagaagaagaaacatcaactgcagatagaagggaagaagagacgatactagcggatgtctgggtggctgaagccaaccagtgcatgtgtccagtatgaaggccactggtcactggttactggtcactggccccttgtgatgatacaaatttacaggccacgcccaggaaaccccaagatgctaccaggtggtggtcggtttggtgggagaatgatgtcacaaagcaggcagtttaaaggtctgcgatagccaatagggaggtcagattccccacaagacaggattggctggcagaggtggtaggaaaggtgtaacagcactaagtggctgagctctggggaggtgaaatctgcaagacagacatgatagtcccactttcccccaggctctcatgttagggagatcatctcaatgtttctcataaatgttcactaatataattaactaacatttatattttatatgttacatttcataatatgtaatagtatgcatttataattatatagtacatacacaatatccttggggagaaaggaaagggatgtttaagttgagcaattacagttgttctaaaactatttcagtgaatctgattaatgaatttactgctgctttttaattttattgtattttttgtgagatggagtctggctctgtcgcccaggctggagtgcagtggcgtgacctcggctcactgcaagctccacctcccaggttcatgccattctcctgactcagcctcctgagtcctgccacttcgcctggctaattttttgtatttttggtagagacggggtttcaccctgttagccaggatgatctcgatcacctgacctcgtgatcggtctt

SEQ ID NO: 12011 - DNA, 1199 bp, Homo sapiens
acttcacacttagagcacgtgtgtacacacaggcttggttggatttctttccatcttgacaaaaaacaaaataaagtcctagtgtgactttgatcattgtgaattaaggacctttttgtgtgtctctggttttaggagagcctcatttgtgtgattgatctgaggctctaaaagtttctgagcaacattaagaatgtctcattaggatcttctctttaaaaatatcttaaagatcttctttttgtttctgctggtgaagctccctagggaaccagagacatgggaagatgaattggaggctcaagaagtaccagagagaggatttgcaagaaaagttggggtcagatgtgcacctgagtggtatgaagcagggaaatgcttttcaaatagtgtggttcatttttttcctttttcccccttctctctctctttagacaggctcagagctcagcccagttgatggacctgttccaggtcagatggactcagggccagtgtaccatggggactcacggcagctaagcgcctcaggggtgccggtcaatggtgctagagagcccgctggacccagtctgctggggactgggggtccttggcgggtagaccaaaagcccgactgggaggctgccccaggcccagctcatactgctcgcctggaagatgcccacgatctggtggccttttcggctgtggccgaagctgtgtcctcttatggggcccttagcacccggctctatgaaaccttcaaccgtgagatgagtcgtgaggctgggaacaacagcaggggaccccggccagggcctgagggctgctctgctggcagcgaagaccttgacacactgcagacggccctggccctcgcgcggcatggtatgaaaccacccaactgcaactgcgatggcccagaatgccctgactacctcgagtggctggaggggaagatcaagtctgtggtcatggaaggaggggaggagcggcccaggctcccagggcctctgcctcctggtgaggccggcctcccagcaccaagcaccaggccactcctcagctcagaggtgccccagatctctccccaagagggcctgcccctgtcccagagtgccctgagcattgccaaggaaaaaaacatcagcttgcagaccgccattgccattgaggccctcacacagctctcctctgccctcccgcagccttctcat

SEQ ID NO: 12012 - DNA, 7154 bp, Homo sapiens
tccacgcaccctcctgcatcacactggaactggggcctctgcttaattgtcagtcagaagggtatctgcagcagccacagccagcctgataggaggccgtggggatgcaagtacagcaggacttgttatctgcgtggaagtgagcttggtagaggggaagcactgggtttctcctctagtttgcatccctcagagaatcagaggctcccctctgagctctagtttgctcccctctgagatactgaggtgagtagcagcacttcaggacatgtgggtgtgtgccagggcagcagggcttatgggcggagacggttgctggcaggcatctgagttctcattctcctggccctggtccctgcagtgatcccgactgggctgggcacagagtgggtggtggtggttcagtacaacttctggagttctctagggtgaagagaggagtcggtgggggtactgtggaccccgcatgaggtgcttctcagcagggatcgcctcctcccacccccagtggggctggggctggggcctgtgctgagcagggcccagggagtacgacccgttctgggctggacatgcctcagcacctcacctgcctgtcccaaaagaggaaacatccctgggaaagagggagggtccatccccagtccccgacccagggcctctccaggctgtggtgttgtctgcccctctgccatcttgccttctgtttccccaggcctgtctctgaagggtggattgtcccagcaaggcctgaagccctccctcaaggtggagccgcagaaccacttcagctccttcaagtacagcggcaacgcggtggtggagagctactcggtgctgggcaactgccggccctccgacccttacagcatgaacagcgtgtactcctaccactcctactatgcacagcccagcctgacctccgtcaatggcttccactccaagtacgctctcccgtcttttagctactatggctttccatccagcaaccccgtcttcccctctcagttcctgggtcctggtgcctgggggcacagtggcagcagtggcagttttgagaagaagccagacctccacgctctgcacaacagcctgagcccggcctacggtggtgctgagtttgccgagctgcccagccaggctgttcccacagacgcccaccaccccactcctcaccaccagcagcctgcgtacccaggccccaaggagtatctgcttcccaaggcccccctactccactcagtgtccagggacccctccccctttgcccagagctccaactgctacaacagatccatcaagcaagagccagtagacccgctgacccaggctgagcctgtgcccagagacgctggcaagatgggcaagacacctctgtccgaggtgtctcagaatggaggacccagtcacctttggggacagtactcaggaggcccaagcatgtcccccaagaggactaacggtgtgggtggcagctggggtgtgttctcgtctggggagagtcctgccatcgtccctgacaagctcagttcctttggggccagctgcctggccccttcccacttcacagatggccagtgggggctgttccccggtgaggggcagcaggcagcttcccactctggaggacggctgcgaggcaaaccgtggagcccctgcaagtttgggaacagcacctcggccttggctgggcccagcctgactgagaagccgtgggcgctgggggcaggggatttcaactcggccctgaaaggtagtcctgggttccaagacaagctgtggaaccccatgaaaggagaggagggcaggattccagccgcaggggccagccagctggacagggcctggcagtcctttggtctgcccctgggatccagcgagaagctgtttggggctctgaagtcagaggagaagctgtgggaccccttcagcctggaggaggggccggctgaggagccccccagcaagggagcggtgaaggaggagaagggcggtggtggtgcggaggaggaagaggaggagctgtggtcggacagtgaacacaacttcctggacgagaacatcggcggcgtggccgtggccccagcccacggctccatcctcatcgagtgtgcccggcgggagctgcacgccaccacgccgcttaagaagcccaaccgctgccaccccacccgcatctcgctggtcttctaccagcacaagaacctcaaccagcccaaccacgggctggccctctgggaagccaagatgaagcagctggcggagagggcacgggcacggcaggaggaggctgcccggctgggcctgggccagcaggaggccaagctctacgggaagaagcgcaagtgggggggcactgtggttgctgagccccagcagaaagagaagaagggggtcgtccccacccggcaggcactggctgtgcccacagactcggcggtcaccgtgtcctcctatgcctacacgaaggtcactggcccctacagccgctggatctaggtgccagggagccagcgtacctcagcgtcgggcctggcccgagctgtctctgtggtgcttttgccctcatacctgggggcgggttgggggtgcagaagtctttttatctctatatacatatatagatgcgcatatcatatatatgtatttatggtccaaacctcagaactgacccgcccctcccttacccccacttccccagcactttgaagaagaaactacggctgtcgggtgatttttccgtgatcttaatatttatatctccaagttgtcccccccccttgtctggggggtttttatttttattttctctttgtttttaaaactctatccttgtatatcacaataatggaaagaaagtttatagtatcctttcacaaaggagtagttttaaattccatttaaaatgtgtatttattggattttttaaaagcgacaatagtaatggtaaaggatgggcaggaaaggccagtagtgctcccccgcccagtctcgctgggtctggcgagccaagcccctcgggcgctggcgaggtcctcagccatctgcccctcgagagccaagcgcggacggtagccacccagttcatccctcccgacatacaccccttccctttggggaagggagcctcaggacagcttctgtcctctctgataggatgggagagtctgcagaaaaccatctggggtcccttttccagtccccggcttggagtcgaagggcagatgcaccccaggccagccccacgagatgctggcatagctttccccagaaaccaggttggaagtagatggcttcaagcttgctagtctccacactgaatcctctgtccgttatttatggagtcacacgatgtcatggttcactaggcagcacctcacgctggagctggagtgcgaggttcttaggggccgtgcccaccatgttgccaagccaatgcatgctgagctgaaggaatttgtcttagtggcagttttttaaaaaatgcccccaaagtctatgctgatactgaaaaagggctactgtatctttaaaaacaggaagttgaacccaagctgtgaaaagccagtggtgctctgtgcatggtgctgtgcggagcctggtgctgtagtgttgtgctgggactttcttgactcttgggcaggtcacatcctacaggagctcagcagaccagtgtaacaacagttaatgcatctatcctgatccctgaatttccacattggacaatggtgcatgcctcacacctgagcctgcttcctccatgctgtcattgggttcgggggcctacacttaacaattttaaagtgcaagagtcaaacattttcaacaggttgctataattttcctccctaattggtgccatttctccatttgatcattttctttttttcctttctcccctcttcatccactttaatatagctgttctgaaattctggtgcattcattcggttctttgaaatgagaatgtggtgcttaatttttgtgacgttgtcgagagaggttgggcctgatgggagcaacactcatcatcaccaagtcaaactttgttggagtgttggtttttcttgtgatattagcagaaatgatctcatgctagccatgtggatgtgtgtgtggtgaatggggggcttcatcaggacacacagaggggaatgtggccacacggtggatgaccaccaagccctgagatgaacaggtatttactgagcagttgtattcagatatgggtcttcatgaatcatgtttaacaatcagatgaccgctataggcaagttcctgagcttccgggtgccttgagtaagagctgagaaccggcctgctgggtgtttactgtatctgtttggaagcactggcggagggtcgttgtaagatgtcctgagcatttatgtggtctggttttaactgtaaatagtgaaagatttttttaagcacttttgcctagatttaaacagcaacttgaaaaaaaaagtatgttttaacatgtaattgtgggagaaattgtaaatagtagccgaatatttaatgtgctttgtctatcctccacttttaccatattctgtaaagttgcatttattttacaggacaaaaaaatgaaatattattgcttttgaaataaatacccaagagcttatcaggacttagaattattcagaactcagatttataggaaaacctctgaccttcagtttgacaagctaaaggaagcagagtctttaatgagcatgctaattttctagttttgaggaaaaattgggtcctttaaatgctattttgcttatcgcatcagtacttttatgcaggtctcatttgactccgtgcttaggtagatgcgggggtgccttgaaaacttcattttaaatgatcttaagcaagaaatacaatattttacgaaacatttggagaatgtgaccgtctgtatgacccgtggaagccccaggttggctgttggtttggaaggtcccgagtgtaacccaggtgattctgatacttggcatgtgtgaatcttcctgatgtatgttaaataaactcttcccctcatcaccctttggtaggaaagccattagatgaaaggagaaaccaatacaagctaaaagcatgcgacgtctgtcccccagcccaaacagccttggttcatcagtttctgcagtaggagataggctgctgagaggtgagtcaagaggcagtctccattggatgtccccactccccgcagaatggcgtttccagagttaggcggtgtggttgccgtgctcaagcccatgctgatttgtacactacatgtctaacctacctcaaatctcagtcattaaaattagcatgctttagacatatatttaaaaagtaactatgcacagctctttatcccccccttgctgctgaagctttcttaaagagaaaaatcaaatttttattttttactggcactatcattttttaagtcctaaagatgattaacagacatttttatcatgagaagaaaaataaagccattgcaactaaagaacctaacagcatgaccaagttcgaagagtcatattatagcaacggaaatcgatggcgtcttagtcatctccccagtgtgccctgtccacggacaccatccacgtgcagtgcaaacatttggttccttttctgctctgttttgttttccctgcctgttgcgtgcaagggaagtgcttgtaaagttctgtgctacgagatttttaaaataaaaatcgcttcgcagcaggttctcacaaaataactggtgctagctcaagaaatcatcatctgaccatcagaaatcttgactaaaggtgttgcatggatttgggggtctttcggtttttggttttgggtctggcttttagcagggccaatgtttcccacaccccggcttcatgggtactgctttgccttctcaccaaggtgacgatggtgtgcgtggaaagagatgataccccaccgccccctcttggtccttccaccagcctcttttgggaacagtagtttgcagagcaagggatttttaaagcgctaaagcaaggaaagaagtagcagagcttaactgctttgtaccacacagcagtagatgtgcaaggacggttgacaatgagtcgatgataacctaatttcattgagagaaacccagccagacttgcttctagaggtttaatcaccatgagatctcaaaccaaggcaaagctggtggaaaactatatgatatccctgacgtgcctcaaccagtatctctttccttttgttactgaagtgtgttttatggactaggaagcatttttatgaattgaaatagtctaaataaaatggtgctatggtgttttaatgtgactgtccctgatcctgtcttgctgaggtgctatcaacgttctgaaaccacaaccaaccaaaaacaaggtgggctccagtctcttggcttttttttttccctcccctcttttggtgctgtcttagacccgtttaccgtgctataatctgctctgagcagtgttgtgttgtgttgtattgttcttcccttggtggccaaacaaagcaagtcgagaaggcagctatctccctttctgtgatcgggagtgggcctgcctggcttggcaggtgctttttggttccacacctgtcttctcaggcttgatgtgaaagaaagggcgaagggttttttgagtttttgtttttgaggaaggggagttgggtacttctgcctctcctagcatgataggcattctcatagccagggacagattttctcctgcagcccagggtgctaagcagacatctctgggagtcccaagggcacaccaagggagaccagatggatctccttcctcccctggcactggctgggaccatggtgggcaggggcttcattctctgacccagcgttgcttctgcctctcattggtaaccccttatgttcggactaaaggaaggagctttctttgctcactcgatgccactgaggctgctttttagttggtgctaacctaaatttcttcttgggtccacagaagttgatgttttaaaaactcaccaggaagctccattttgtgtcatccactgtcacaataatttttttaaatacctcaaaaacaggacatcatgacaacttcagtaaagtagattccatgagggtctgatacctgcaggttgtccgtctg

SEQ ID NO: 12013 - DNA, 1725 bp, Homo sapiens
tccaaggctagggagccaaggggaggaggagaattggaggaaggggagataatgggaagaggatggcgccttcctgagttggctagagggccaacctttgataacagtttgacgaaatcaatcttttttttttttttttttgagacagagtctcactctgtcacccaggctggagtacagtggtgggatctcggctcactgcaagctctgcctcccaggttcatgccattctcctgccccagcctctcctgagtagctggaactacaggtgcccgccaccacgcccagctaattttttctatttttagtcatgcctggctaattttttgtatttttagtagagatggggtttcaccgtgttagccaggatggtctccatctccttacctcgcaatccgcccgcctcagcctcccaaagtgttgggattacaggcatgagccaccgtgcccggcctatagaaatcaatctttttgactcttctcacttttatctccccatgcccaaggtttgcctgttccataacactcactcccttcccccttgctaatcagaagccatctcctctcagtgtctgatctctgctcttcatacatgattacagtcatggggtagagagtgcttgctaaattatgcagttaatcctatggtgctttaattttcaggccttcaaaaaacacttgtacagtgatgtgcagatttttaaacagttgaacttccttgtactacagtttttgtattgacagccaaatttgtctttcattcttcagattgtgaataaagtgatttttacagggcttccagcaaagtttttcctttcatctaaggcttgtagaaccctagcttatatagctgcttacatgagaaatgcaaaatctgtattcaccatgactttagtaacaaaggtaaagttttttagtagtgccaaggcaagaggaacaatcttggtggtagtactaagttttgtcaatattgtggtttcctgattgtattgttggctttctctctgagcattgaggtatactagaagtagagcttctcaaacataatatcattacctcataagcattaacaaatcaggcccaaagagcgtaagtcctagaaatttgttttaaagcagccctagtcatggtgctggtgctaccgccttgttttaggagcctgcctcctgtcagtatgaaaccctcacctgaaaaatgccagcctggacaccaaacactgagccccttcaacaggcacattatttccccctgagatccataagggaatttagtttctactattgtagagttctgaaaagaggtaaaatagtagtcctttggtcatcctatttttgctttcaattttgatatttcagactgtaaaaggccttgggggatgatagtacatgtggtagcagtaatttttttgaagcaactgcactgacattcatttgagttttctctcattatcagattctgttccaaacaagtattctgtagatccaaatggattaccagtgtgctacagacttcttattatagaacagcattctattctacatcaaaaatagtttgtgtaagttagttttggttaccatctaaaatatttttaaatgttctttacataaaaatttatgttgtgttttaaaatccttaggggctttatctatttttctaagtcagttaactgtacttctaaaaaaagtattttgtatctacttttgtaacttcgtcagaataaaatat

SEQ ID NO: 12014 - DNA, 1155 bp, Homo sapiens
ttctaaggatggtcttccaggcttttaaactgaaaagcttaattcagatagtagcttttggctgagaaaaggaatccaaaatattaataaatttagatctcaaaaccactatttttattatttcattatttttcagaggccttaaaattctggataagagaatggaggaaaatactcagagtacttgattattttatttccttttattaaaaaattacttctatgtttttattgtctcttgagccttagttaagagtagtgtagaaatgcatgaacttcatcctaataaggataaaacttaaggaaaaccacaataaaccatgaaggtgtacacatcttataacacagataaagttttggtgtgctacctattcttgagagagtgagtgagtgtatgtgtttaaaggaaacaaaatgggagaaataagttttaaaaaaatcctcattttgttaatattcaaaagatggactgagcttccacttgggttttatcttgttttaattgtttttgtatcaaaacttgaaattcctctatttctattgggatataaaagccttccccttcagtgaagaaaacatttattttttatttgattcctaggatttagtaaactctagctgtctatttaaaatgtactgaggcacaacaagtattatactggaagacttgccaaactggcaaagctttaagttcatcagcattctatgtggttcagagctgtgatttttgcaaagtattttaccaacctcctcgatggctttgataaaggttagatttgatgtttttttttagatttatttttcttactccactaaactataaagaaaataattacttagaaactccattttaaataatcatttcctagaaattcttaaatatatacagaattttaaagaaaacatttcatctgatttagttagcatccacatatcattgaggaattaaagtgtgggacagtcattattaaaaaaaagagagaaaagccctctattagacattccacaatccatgttttaagcttatccaaaggtccaaatgtcagccattctgtatgttcatgttgatcatttgcgaacaagaaagcaggtttctaggtatcacttaggatgtgaactgcctctcaactttaaaccctgttagctttacttttt

SEQ ID NO: 12015 - DNA, 1130 bp, Homo sapiens
cttagatgtataaatattccttgaacaactctgtatgtgcatgttattttactagtgtgttcacaaaaccttgaatgatgtagatgtgatttttgagttttatgcttatgtatgttactttttccttgcatgcttgtttaataatatattaaagtacacacatgtcctttgccataactaaagcagcctgcctgtcttgtttctatgtaggagtcagacaaaaagctgggtatatcactccagttcctggaggtgttggccccatgacagtggcaatgctaatgaagaataccattattgctgcaaaaaaggtgctgaggcttgaagagcgagaagtgctgaagtctaaagagcttggggtagccactaattaactactgtgtcttctgtgtcacaaacagcactccaggccagctcaagaagcaaagcaggccaatagaaatgcaatatttttaatttattctactgaaatggtttaaaatgatgccttgtatttattgaaagcttaaatgggtgggtgtttctgcacatacctctgcagtacctcaccagggagcattccagtatcatgcagggtcctgtgatctagccaggagcagccattaacctagtgattaatatgggagacattaccatatggaggatggatgcttcactttgtcaagcacctcagttacacattcgccttttctaggattgcatttcccaagtgctattgcaataacagttgatactcattttaggtaccaaaccttttgagttcaactgatcaaaccaaaggaaaagtgttgctagagaaaattagggaaaaggtgaaaaagaaaaaatggtagtaattgagcagaaaaaaattaatttatatatgtattgattggcaaccagatttatctaagtagaactgaattggctaggaaaaaagaaaaactgcatgttaatcattttcctaagctgtccttttgaggcttagtcagtttattgggaaaatgtttaggattattccttgctattagtactcattttatgtatgttacccttcagtaagttctccccattttagttttctaggactgaaaggattcttttctacattatacatgtgtgttgtcatatttggcttttgctatatactt

SEQ ID NO: 12016 - DNA, 1171 bp, Homo sapiens
gaggaacttccttagccttcctggtctctgcaactccccacccagcctgtgagcctgagaagactcgggtcaccccctcccccatccaggtctggaccactttaggtgtggcctgtcccagctggggcccctcaggaaccgcaaagaccctgtggccaccttctgggcccttctccccagagacccaaacccagggcctctccaagcttgaacatccctctcttctatgacccataccccttaggcagttcaccctttcagatggggtggcaggacacacccacctctgcaatccttgcaaggagcacctcaggccccttcagtatcttctggaaggcagggggtccttgaaccatgttccacagaatggttgcatccaggaggaactggctccccagaaacttctccctcccccaaccccgctcctgcagaaggctgccggctaccatctggacctgttctgggtgggcatcctcatggctttgtgctcctttatggggctcccctggtacgtggctgccacggtcatctccatcgcccacatcgacagcctcaagatggagacagagaccagtgcccctggggagcagccccagtttctgggagtcaggtaggaggggtcagggcctagggatcacccaatggggaggggcccactcggggaggagaagctggctttgcctgccacaaaaggatttggacaaaaagggcccccgctctgacggcccaagaaccacagggacaggagtgctatccctggagggagggaaggagagagacagaagtccagctctaagtggggctttttacctactgggctccaagcagtatgcataccccatccataaatatgcacacgtgccagacactcatcttcatcagccacccaaggtccccacaaggcttcgtgctgtcctgcccttttcctcttcctcaagaccctccaggcccctactgccctgatggccctcctgcgggttcaggtcctgctcagtctctattcctccagaaggctgtcctgggatcacccccgctccccagtctgtggccctgcctgttactcctgttccttcacttgcctcttctctcacgccccatggtaggcagagaagtacatcttcagccccttagggcctccagggcgagaccacaccaaaccctggctttctcc

SEQ ID NO: 12017 - DNA, 1247 bp, Homo sapiens
gaaattttgcgtgtgggaagtaaccccaaggagttaaaagccctgcaggggcatagaggagcctttgaattgggcttcggggaagcgagcggccccggcctaaagtcggggttgatgacagaggctggcccagatggctgcgacaggttgtgggatggggctggcgactggggaacaagcgggagcccaggccaagagtccgagcgcttggggcccgcctagctgcccaccgcccttggcccggggatgcccaagacattttggggttcaggcacattttaggagtcgagctggggccctacaaattgagaccaacccgggctttttccaggctcaggcagataatcctaaccaggccgcggaatgggcagcatggatccgatgaaaatgcagaccgtccacaccttactttttaagtcaacaactccgtcgggtttgtacccagaccgtgcgtctccgcccctcggcgtgcacgcgggcgagggaaggaggccgaggtggctggggctgcccccgggagccgcggaaggggaaggcagggacgcgagtctctcacctcgggcaggtcgctgaagaggctgagtcggaagcggccgcgtttgaactccatctccagggcggagcccctggccacggtgacccggctccggtggtttcgggagaacatgctggcggccctgcgactttgcctgctcagtgcgctccccgcgccgcccggcttagcctcctctcctcggcttctgtctctcgacgctcgtccgccagtccggccgggaatctcccgctgcggggctccaaaccccgcccccggagacgacacctgggccgggcagggcgcggcaacctcctcttccacccccgccaaaggcccagcccgtccggccagtccctgggcgccaagccgacctggcccgacggccccggagcccccaggggcgcactgcacctcgcgagcactgtgggagcgcgttctccctgcccgcgcgggtcgcgagcgcctacctggacttgggacggaccgagaagccctgccccgccagccgccccaacctggcaagcctggcttcccgggcgctgaaaaccccgtggctcagggatcgccgcgtagcacgctctggctctactcgggccctgggaccttgcccagtttcaatcccggcagcctccgaagagaccatttcaacatcccacagtcccaaatgttccttcttcgtccccctccccacctaggctcctctgcgaggcta

SEQ ID NO: 12018 - DNA, 1247 bp, Homo sapiens; identical to SEQ ID NO: 12017

SEQ ID NO: 12019 - DNA, 1699 bp, Homo sapiens
cgccccgccctcggcgcagccatcagctccgccttggctgcctcctcgcccgccctactcagaggcggcacccaggacgcgagcaggcggacagtaggacgcggggcacgccggtacctgaagtccttcagaagtgcacgccgggaccaggattccgggaggccgactcctccctgccccacgaatgccgggaattgtggtctccgccggacgcgagttgtgagacggcccaaggggccgcggggtatgctgggaccgctagcccttccggcgcgcctcaggacttcgggtcccctcaccccgggcggatgcccaaagactccgccttcccaagagcccctgcggccgggcgcgaaaatggcggcggcggcgacggccgggcgctcctgaagcagcagttatggagcttccctcagggccggggccggagcggctctttgactcgcaccggtaagagacccggcgggaagagaccgatccccgcgtgctctcggccttcggcgcctgaccacttcgcctctcgcccccaggcttccgggtgactgcttcctactgctcgtgctgctgctctacgcgccagtcgggttctgcctcctcgtcctgcgcctctttctcgggatccacgtcttcctggtcagctgcgcgctgccagacagcgtccttcgcaggttccgacgcgggcgttcggggagtgtcagagctgggtctggcccgaggccacacagtcaccacctcctgtgtccccagattcgtagtgcggaccatgtgtgcggtgctagggctcgtggcccggcaggaggactccggactccgggatcacagtgtcagggtcctcatttccaaccatgtgacacctttcgaccacaacatagtcaatttgcttaccacctgtagcaccgtgagtgagagcgaggccgagagcgccacggggcggttccctggggcccagctgaaggcccccctgtccccactcgcgttccccatggaggatactgagccttacccctaaccccgatcctctacccaacatgtcagttttttttttcattttcctcaatatttttcttcttgctttctcttctcctggttcccagcctctactcaatagtccccccagctttgtgtgctggtctcggggcttcatggagatgaatgggcggggggagttggtggagtcactcaagagattctgtgcttccacgaggcttccccccactcctctgctgctattccctgaggaagaggccaccaatggccgggaggggctcctgcgcttcaggtgggtttagcacaggtatggggcgccagctgggtaggtggtcaagcttgtgggcccttgagtttttacaactttcttcggcccttagaccccatcatctccagttcatttcctttctgtccactttaagttctttctcctgaatcccttcattcttcaattatgtgcttgtagagtttgacagttgcctgttataaggcaggtgtgagctgctgactaggctggctggattcccatcctactttctccttcctcttctagttcctggccattttctatccaagatgtggtacaacctcttaccctgcaagttcagagacccctggtctctgtggtgagtgtgtgttgaacagggaatctctggggcttgaaggggaaatttcccatccctggccctggcttaggcctcatctcatgccc

SEQ ID NO: 12020 - DNA, 1168 bp, Homo sapiens
tggtgccctcatgtggtgtacatcttttatgtacatgttgcactttattgctagaagacagaaagtgagttgccattgtattttgtagtacctagcccatgtcctgtccatatatttatcaatgtgttgatgagagacttgaggtggaactcaggatggggagaatgcctgggtttggctaatagggtgatctgtgtactttcagcatccttgctgaactacagcttcgagaaccaagctttcccgatgttcagcatggtgtactcatccataaagtcatcctgggctcccctgcacaccggtgagggagaggctgcagtgtgatatggggatgggcaaggtgtgcatgtgtccttgaactaggctttgtactccttcctttctctctgtccatttttctctatagggctggtctgcggcctggtgatgtgattttggccattggggagcagatggtacaaaatgctgaagatgtttatgaagctgttcgaacccaatcccagttggcagtgcagatccggcggggacgagaaacactgaccttatatgtgacccctgaggtcacagaatgaatagatcaccaagagtatgaggctcctgctctgatttcctccttgcctttctggctgaggttctgagggcaccgagacagagggttaaatgaaccagtgggggcaggtccctccaaccaccagcactgactcctgggctctgaagaatcacagaaacactttttatataaaataaaattatacctagcaacatattatagtaaaaaatgaggtgggagggctggatcttttcccccaccaaaaggctagaggtaaagctgtatccccctaaacttaggggagatactggagctgaccatcctgacctcctattaaagaaaatgagctgctgccatcttttgtgggcagttagtcaggtgctgctctttgtggtgtggtgggctctggtctgttctgctcggtgctgggcctgggagcaaagattcccatgcttggctacagatactgacagctggcctctgaaggagggtgaaaacttctgcttgacagttccacatccatagtgcatggtctgatgagtgcggttgctgacatgggtttcttggtaagctcctgaggtaatggcagcctcagacccctgccattaggggccagtg

SEQ ID NO: 12021 - DNA, 3070 bp, Homo sapiens
aagtgcaaatacaaaccaatcatgactaagatggtttttcctgtgtcttcctcccaccttttccagctttgccaaagtcatgcatgagacagtgaaggacctggctccgaaatgtgatgtgtctttcctgcagtcagaggatggcagcgggaagggggcggcgctcatcactgctgtggcctgccgcatccgtgaggctggacagcgatagaacccctgaaatcggaagggacttcctctttctctccttcttccctgttttaaattataagatgtcatccccttgtgtcagagacagaccccttggcttttgcttggcagagaggaccccactggactgggttttgtctctgcatctcattgtagagcttggtggctgagcttggccctattaagataaatagagttccaaataaggatttgttcacatgcatcataaccattcccattggttctcctaaaacatgaaaattatctcccttagtaatcccccttgccaaattccatgtccctgtataattctacaggatggggacactaatgaagatacggttgcttcaccttggagcctgaacatgacatttctaagtggggtgcatcccccagcactgatgttgttactgattctcctgtcagagatctgggaggtctccactgaggatgtgagcctgattatcctataggcagacgtggggagggtggaggggtgacagtggaggaaaatccatggatatccacgcagcagcccctctttaacctcatctacaagcatttgccctgtggattccagcatttgccattcctggaatcaaggaatcctgagtctgggcaatgaaaccaaagccaggagttgacgcatcctgcagttgggccagctgtcgcatctcagcggggcgcacatgttatccacaagcaatggacctttggggaagggggagtttttagtttgttttacaaatttttcctgcaaaagtggaatcactgtattttcattttaatttatatttgaaattttatttagttcttgagtagatctgcttcttcatcttgacatgtaatgaatggtcagttgtacgtaatgtatttatatgttaatttgttatgtatatagatgtgcaagtcttgtcagaattggcctcagtgtagttaaagggcagaaggggaagatactgactagtcatagaaatacctcattcgcctgtgggaagagaagggaagcctcttcagggtgagtgaatggcaaagcggttgcttctggctcctccttcccctgtggtcttggaagtgtgtggaaggcagggacagagatggaggccgagccaatagactgaagagaccacagcaattggctcctccatctagagattttcttggcagtattccatgggatgttaagcaaaggaaaccaaaggaatcgtttcaaatggactcatggcttagaaatctttattcttagggcagtcagtagtattctaaagctttctgacaagataaaggaagtcaccaaaatttctttttttaaattgtatctaatcctcaacaacaaaccaaaacagaacaattaaacagccaaataaaacctcagggacaacatttttggtgtatttgagccctcccagcaagtttcaccttgggtttgtattttaaatgttttacaagaattgtccatgtgcttccctaggctgagctggcattggtctgctgacctgtttttgtgtttttcttttttttatacacaacatttatttcaaactattgggagggatgagagtggcttaaaaacttccatccctacttttcaagagtgcagttgattctgaatctgaaagcccgcctctgtcctaaaatacaaacaagcacagacattaaacctggatactatatgataaagagggatgtaactattgaattggatacaaggatcagaatggaaagaaactcacgatgaaattgaacctggtttttgtatatttatcaaacttgtgctgagaatagtgtctgattatacgacttttaagcaaagttgggtgtaattaggtgaaaacagcccaggtcctcccgggagcacagaggggctaggggctggtccttctcgtttgctctagtcttgctttgctgtctggtgtagctcctctgctgctcccatctgcactaattgacccaaaacgtgggtatttcctgctacacaaaagccaaaaggtttcatgtagattttagttcactaaagggtgcccacaaaatagagattaattttaacttaaattttaagcttgaagattaggtactatctgtgaagttacacttttttttttttttttaaaggtagagatgtgtgtgtgtgtaggtattaaagatgtgttgttggtttccaaaaaggaacactggaaaataaattttgaatgtttatgttctcagaatcaggttgacagtcccttgctgacatggctttgctttgtgtaaatacagtggatctcaatcttcggggtgtgatgaatagcgaatcatctcaaatccttgagcactcagtctagtgaagatgttgtcattatgtacaatacataactagtttaattaactatgtgatgttaactattattaataaattttaacattttccaaaataatcaaatgtgattcatgagtgtttttaagagagtagtcatcttccggtcgtatcagtacttcctggccagcccgatgagtaatttatgggtgtcttgattttgagtgtgtgtgtttgagaggcatgtggcttttccagaaactcagtcccagtggaattagaaggcagcttttcctggactgccttggaccccttagatttcaagccactgaagagctatggctagtcctgcggtctactgtttaaatagcttggctgaaattagcaccaccctgagggcctctggctggtcttggttggcaaatgtgattcatattcaggatatatagctctcgtgaacatccaaaaagcacttgcctctgtcctctccctaccaagcttttccttctccccagtaagcagaacacaggtctggggagtaaattcatcaaaagtccctagtgatac

SEQ ID NO: 12022 - DNA, 1096 bp, Homo sapiens
tcagcagggaaaaaggaaaacccttcagaggagagacttgggtagagtggcactgcagtgtctggggacagacaagggagggctgggctggtttccccttgtgcaggttgagaagacgtcactctgatctgagaggtgccacagcgtctctccccaggatggtttctgttggccacagtgccaggaagccctacctgtagaggctgtctgcttggggtggcggggcagtgtgtgaaggtgtctggggttgccgtagcggactggatcccttcataccttctgccaaattgcaccagaaaaagatatttctttttcacctagcaactggggatttgatttctgactcttgtctggctgggaaccctcacctgggtaagatttcgtataccgtattctcatgcgccctgcgtctattgccacgttcttctctgacaactttaagagcaaagcgaataaataatttaggggtaatttaggaggcccccaacccccgcgttgaatggtatttgcctatgcttttcttaactcttctagggagacagctaatatatataagagttgctggtagagtagatatggatctcaaggcagcaagggacgcatcttataaatgccctcatttgcccaaagcctcatgcccttcactgcagattgtgctgttttctgactgaggtcagcatggctgaagttagtcaggtgtctcttttccttgtgtttcagataatgcaatagaagctgtggatgaatttgcttttctggaaggtgagttccctctcagtgggcaatcatttccgcctgtcttttgcatgttgatgtgaaattcaaaatctcataaaacggatgcctgcttcttgtttgtgtagggataattctccgcacttgctattaggatagaaaaaagtaacttgctaaacctagtgaggttcagttttctcccttggggaattaaaatttctacctgaaaattgctaaccataaagaaataggagggaatataaagatcccagtggagttagatgaattcgaaagttcgattcctactttgatcgccatccctaaatgtcaggcttgccccccctcatcatgttacagatca

SEQ ID NO: 12023 - DNA, 1211 bp, Homo sapiens
ctctttaattagagagtttacctcatttattttatattcttttcttatatggtcttcatcaatgttcattaactaacacaacgacttcttagcccttttcccacttctaattctagctcttccgactagtatgcttaattcctaactgcccaccatctgtaatgacatgttttccctggggatattttggatggatcatcctcaaaattagtattttggtcttagagaactgctgccaataccggagcctcttctgcattaagtttgcccagcttgttacactaatccagcttctgaggtcccctgatatactcattgctctttgtatgtttaggtactttagattgattgccgagcggggcagttttgtgagccttcatctgaagccttcagttcacccctctgcacaggcctcagctttgaagaacggagtctttgcacttacacacactcttcctgttctgccttcacctatgccgggataagcagagatctcatcaattagctcttctctgcaaggtcttccactatttctgtctgtcttccatatcaagcctggatgcagctgctgctgcttagagcagagatgaagaaagtgttctgcataagtggcttcctgaatgatgaggaccagaataaaggtttttgatcaacctcagtccagtgtgttttataatctcgcctttgttcctaccctgtgactggagagtcaccatacctggtcacagaccttcctgatcttccctgccagccattctaacatacagtcctttcattaattttgttcttttatttttccagcacatcaccagaaagtggttccagaatttatggaacaccacttgccctcaggagttcaaataaatatggtcctagattgaaagccagttaaattttttttaagttttatttattgacatatccacatactctatatttcaccaatttaaagtgtacaattcagtggtatttagtatattcacaaatatgtacaccagtcatcacagtcgattttagaacattttatttatttatttattattattatactttaagttttagggtacatgtgcacaatgtgcaggttagttacatatgtatacatgtgccatgctggtgcgctgcacccactaactcgtcatctagcattaggtatatctcccagtgctgtccctcccccctccccccacccgacaacagtccccagagtg

SEQ ID NO: 12024 - DNA, 1149 bp, Homo sapiens
aggtatttctaaggttcttgacattttgttcaaatccttgtaacaatctgtctttagctttattctctgagaaactgagcaaacctgtttccattgccttcttagaagggttcatgtatatagcactacagaagcataatgaagtttctcagctcccaaaattattgttattatactgctgtgaaaaaataaatattattcaaaacctccctctctgcttctggatttaggaaatgtaaagttgaagctctgcatctgtttcgtgaaattcaggctgacacagactgattttgaaagctgttattctgtgttcaaacaccctcatcctggtacatttttcttctgtaatttgattgttcaggggatcctaaagataataggtttcaaaatcattttgatcctaaatgtgatttggatcttttatctttattcattccatctctcttctctctctcttctgtttctgaaggaatttgaaaagaggaagatgctatgaaagaaaaaaaaaattcctaaaactgtggaatggatcacgtagacatgtaacccagcagcagtttgcttctgttgtccactgattaatcagcctatgtgcctgacactggtcttgcagtacaactggaagccaaaacaaggtggaagatgtcctgaattaagatgttttcaccacattgtattacagagacagccaataaatctactatttgatttcaatatggttttggaggcttattattgttccagtgtgaaggatgaggagagtgggagaaatggaggtgtatttatgtgtgtgtatgttttaatatgttctttttgtttgtttgtttgtttgtttgtttttcttggagacagagtcttgttctgtcacccaggctggagtgcagtagtgtgatcttggctcactgcaacctccgcttcccggggttcaaacagttctctctgcctcagcttcccgagtagccgggattacaggcacctgccgccacacccggctaatatattttttttgtatttttagtagagacggggtttcaccaagttggccaggctggtcttgaactcctgaccttgtgatccacctgcctcggcctcccaaggtgctgggattacaggcatgaggcaccgcgctgggcctttaatgggttcttt

SEQ ID NO: 12025 - DNA, 1669 bp, Homo sapiens
cggcgcgggagaagccgcgcccagccgggctggtagcccagcggggggcgcggcagggcgaggagcagcccgcgctgctcccgcccctcgggtgccagcaccgcccctgctgcggcgggtgaggggcggggcggggcgcggcgtatataaggctaggggcgggcgccgctcttttgtttcttgctgcagcaacgcgagtgggagcaccaggatctcgggctcggaacgagactgcacggtgagtgcggcgccggggcggggggcccacccagggtgtggtcggatccggtgcaccgggcgggcgcgccgcaaccgcgacaggcgcccttctcggaccggacgcaggggccggcgaccacgccctgggaccgagaagaggggtgcgggacgcgcccagatcctcggccttggggctgctcggcacgccttggcgcgagtgccacgtcgagaggcgtcggcggggagcgcggaaggggacgctggcccccaggcccaggtcaagcgccttggtttgcccactaggattgttttaagaaaatggcagacaaaccagacatgggggaaatcgccagcttcgataaggccaagctgaagaaaacggagacgcaggagaagaacaccctgccgaccaaagagagtgagtgtgcctcggtctcccgcgccccagcccagcccctcaccctgctcttccttgcaaacccactcctccaccccccaccccgccgttgtccccggtgtgggcggccccggccactctttcagtttcacaaagcgccttgtttctccccagccccaagcttccttctaaatccccacacctcgtgggtgcctcgcccacaccgggaagcacctcggttgcgggtgggggttgcagctcccctccagcgcccgcttcccgctctccacagccattgagcaggagaagcggagtgaaatttcctaagatcctggaggatttcctacccccgtcctcttcgagaccccagtcgtgatgtggaggaagagccacctgcaagatggacacgagccacaagctgcactgtgaacctgggcactccgcgccgatgccaccggcctgtgggtctctgaagggacccccccccaatcggactgccaaattctccggtttgccccgggatattatagaaaattatttgtatgaataatgaaaataaaacacacctcgtggcatggctggcgtggtctgagtcttttagttgagtatgcgtgggcagtgccactgcagcaaagcccctcgatggagtagagttcctgccgcaaaggggaggaggtgggtcgcagaatgggctgactcggagggagtttttaattttggctttacctgcttctccgtaagatttcatgacttgttagccacttaactcttgctcgtaagcaatctgtgtaaaatttaaccccactttgtccccaggttgcgttggaaaatgctttttcaaaagagcaaggtttgcttttgataagcttcgaaagccccactgtttccctctggcctcctcctagctgactcagaagggaacactgattttaaagaaagaaaagacaatctggaatgttggaaattgggtgaggtcacaaagtctccggaagcctttcttcgggagcttaaaacaaaggcgggatctagggatacagcaacgggaacgtcaga

SEQ ID NO: 12026 - DNA, 1085 bp, Homo sapiens
atattacaaatgtaaacaggtacctaagcactccttgatcacgtgacgttgttgaatattttaggcacactttcttttggagtgcagtggcatgatctcggctcactgcaacctctgccttccaagttcaagcgattctcctggctcagcctccggagcagctgagattacaggcatctgccaccatgcctggctaatttttgtatttttagtagacacgaggttttaccatgttcaccaggctggtctcaaactcctgacctcaagtgatccacccaccttgtcctcccaacgtgctgggattgcaggcatgaaccactgctcctggcccacactttcttttttacattattgtatcgtacgattacatttttatatgtttaaaaactaatattcctcaatgcaattctaccttatttttcagatttatactatggtggggaagctttctctgtagagcagccacagtcttttacttgtccctattgtggaaaaatgggctatacggagacatctcttcaagaacatgttacttctgaacatgcagaaacatcaacagaagtggtaagtgaagcagcaaccttatgactaaaatgatgttgtaaagtatattatttctaacattaataaagctaggtcactgtcatctgcttcctgctcagtgtaatgataccgtttgcatagttattaaaatcatcttttaacagcaaattttatacatcatgggaggctgcatttttgcaaaataatacctcttactgtccacactgggtttcttaacctgtagctaaacccacagcatggagtcttgaccaaattcaggagccctttattcaatgcattgtgaaaggttaaaaggatggcaacctgcagtgcatctcttgttatagtatccttgctatctgcttaacttttcttctacaaggaacttcacaaggaaatttaaaaacctttggtagtatcataataatccattgtcacatctcattgtagcatatcgctgatcttacctggttttcatcagatcacatctcttgcttcctaggtcaagctctggggtccctagaagttcttcctatcctgat

SEQ ID NO: 12027 - DNA, 1167 bp, Homo sapiens
cttacactcagctgtgtaagacggttgaggctgctgggaatttttcttcgtgataaatgtcatgttaatctatctgtgtgtcttatacaagaaatgcaaatctgttttctgcttagcagcggcattggaaagaagcttgaagacagagtaaaactaataatccaaaaggaacctttgatgtgctgaatatacattcagtattgttcctttttcattataggtggtatttgagatttcatgagctatatagagaaacttttttacctcacacacccaatacacacacacacactcacatgttgccttacatttgagtgtctttttagggttaatagccctcatagatagagttgggacatttgcactttaagttaaatgtgctgtttttaaatgcttacaattcaggaaatctttacatctgtctagcaaggactcaggtgattttttttctttctgtgaaatactttcgtttttttcttaacttttgggttatgatgaatcgagtggtgttcgacatgtacgtagaatgtttcaccctggccggggattaggaggtcctcgtgctcgtagatcaaacatgcactttactagcagttctactggtggactttcttcttctcagagttcatattctccaagcaatagggaagccatggatcctatagctggtaagttagtttcacattaataagggaaatggcaggggaaggaggagctccttttaaaactttttgtgatgccaggtgcggtggctcacacctttaatcccagcactctgggaggctggagcgggtggatcacttgaggccaggaattcaagaccagcctggccaacatggcaaaactccatctctactaaaaataaaaaaattagccagatttggtggtgggtgcctgtaatcgcagctactctggatgctgaggcatgagaatcgcttgagcctgaaaggtggaggttccagggagccgagatcgcaccactgcagtccagcctgggtgatggagtgagaccctgtctcaaaaaaaaaaaaaaaaactttttgtgagatttgtgttcttaagtctcacctctctgatcataagccatgttccttcacaaaattcccaaatacattaaaagtgtaaaatgtgttaaaagcagacacttaacataaagtaattcatact

SEQ ID NO: 12028 - DNA, 2343 bp, Homo sapiens
cctgtaaaacttcacagtggagagcactgtagaaattggccatgccattgttcattgactttttaacaataaggtcttttctttttaacttacacaggttgaatgatcctaaaatgtctgaaacggagcgccagtccatggaaagcgagcgtgcagaccgcagcctgtttgtccaagagctccttctgtccactttagtgcgtgaagagagctcatcctcagatgaggatgatcggggggagatggcagattttggtgctatgggctgtgtagatattatgcctttagatgttgctttagaaaacctaaatttaaaagagagtaataaaggaaatgagcctccaccacctcctctttgatgacatcccaattcgcagacaatgtcctctgtgctgtatttgccaatgaaagtggacaacaactatcttgggtttgtttggtgattgtaatttcaggtctgtcactcttgttacattgtgtacattcaaaaggaagagagaaaatatatatgataatcatttccacttaactaatttttacttctagcaggtaaatgtaggtagcagtgcaggggtgatctctgcttcctgtaccttgacatgcaaaaggctctcctaatactccacattcaaactgaagaggaaaattgaaatctctaatgaagctgctgtgtgtatttatgaatattaatgaataaaaactgcttggatggtttaccttaactactgcatgaggttttttgcagcgtgcatgagttttagtgaccttgttatttaagaagttaaatacaaggagtaaaacttaaaaaaaaaatacaaagcccaaagctttcccaaacattattcaatggttacacgacgaagtagcttttgaataatgtctgcctgaatcacctttctttgtgtgcctcctacgcacaaagccagctctgcagtggaatctggggattatagccgggtgtggcactccgccctgtgtgactgtcctgtcgccctgttagtcatcttgcctgtgtggagctcagcctgtctctttaactcatctgtagaagacacaccagtaaagctactgttggaatctgctgcaggggcctttgtgtgccctaaaaacaaatcctgttcatgtttgtttaaagtttttactttttgtggttgtttaaaattttttcaattgttaaatatgttttattcaggtgtagatgaatttcatttattgactgttcaacagagttaacctgaattatgttgtctttgtttttaaaaatctcacattctcaatcatattttgcattatttatgtatttgctttgtagtttgctgagacagatcagtatcaggggagctttgaggatttgccttcccagatttgtcagtatattacaaccaaattcttaatgctaattttagcaccttttatttattgggttttttctggcataaaaagtaaagccttttaattgaatcatgccacctatatgcctatattattaatcctatgtgtaaaaaaaatgtacagctttttttgggtttgttttggggtttggaagggccgggttattttttatttcctgtttcagtttttgtgcatagactttcacaatagctccaaggcagggacagcgggtttgggggttgggagggcagtttttggaatgtaaatttaggacttttaaaaaggtgcgcacagcttctgataaatttataactagacttaacctaatcatgtctcgttccagttctcttttctctgagcccttttcaaagtctcctctctttctcctgtcatccttttcctttcctgtccgtgtatctccgtttcttcaacatgacaagcatacagacttgaacacccctccggtgttcttccgagaactgtgaagtccatgttcatccaaatgtaaccaaaaaagaagtcaccctacatgtctgaaaaactgttgcttctcctctgaaacttcaaactccaacgatttccaaatacaatagctttgttttctttagttctgtaatggataatgtttaaaggaaaactttacaccaggcttctggttacactagaagtcaagcccattagggattttcattttttttcatttggttgttgagaagtttcaaaaatcagttttcaagctgtggtctttcaaacacatctgcacataagtcacacatttcaataaagcattttcaagactgttgaccacttgaatttctttggtgttagtggattaacctaaccattactctgagattttatatctctaatccagtattttttttctttttatgctaaacatgggagatcctggttttgtgtgaatgcattattttggatgtgagaaataaa

SEQ ID NO: 12029 - DNA, 1211 bp, Homo sapiens
ccaagttcaagcaattctcctgcctcagcctcccaagtagctgagattacaggcacgtgccaccatgcccggctaattttcgtagttttagtagagacagggtttcaccatgttggccaggctggtcttaaactctagacctcgggttatctgcccatctcggcctcccaaagtgctgggattacaggtgtgagccaccacgtccagcctagtctctttttttaaatgtactcttaatattggtgattctgttcatcaatccccctacttaatagttgtataattttacatgataattgctttctacataaaattaatatttttcatgcttatattttactctttcaacaaaaaataagcatatatatatttctaccaactgatacatttcaagagataagggtcacaaggagattttcactcaagttgcacgtggaatgtttacctgtttttgaaagggcatgctcagataatgacagcagatttgaacaatgcttcgtttccttagttctcacattgctacatggatgggatatgttggtcacctatgtgattacatcatcatcaatcaggcagaagttcagtccttctgaagattcatgctaaagctggataacagatttccattgactagtataggctgaagccatactttgatgtattcccaggatctacctcatagttgcaaagattaaataaggttgcatataagcatgtagaacagtgcctggcacacacagcaagggttttgttaagataaactcattatctgttttagtggtcctgggtttcatgatcttgctagcctttataaatttttttttttttttttttgagatggagtcttgctctgtcacccaggctggagtacagtggcacgatcttggctcattgcaagctccgcctcccgggttcacgccattctcctgcctcagcctcccaagtagctgggactataggtgcccaccaccacgcccggctaattttttgtatttttagtaaagatgggatttcaccgtgttagccaggttggtctcgatctcctgaccttgtgatccacccacctcggcctcccaaagtcctgggattacaggcgtgagccactgcacccggctagcctctataaaatttaatctctacactgcactattcctaggacactaacttatgtttaattttggattgctagttttctagaatacatattctta

SEQ ID NO: 12030 - DNA, 1135 bp, Homo sapiens
atgttgggattacagatgtgagctacggtgccccaaagtgctctttttgttgaacagtgtgtgagcccagctacctggagggtgtgtctacctgcctgaccctcagccatcgcagcctcatgacggctacaccccgcacattatcatacccctcaaatgtgccttccaaccccacacagatttcttgtggttcccatcctggtgaatcttctcagttatccacattacagacctcagtggaatcttccacaccacctggctcatgatggtctctgctccttgcctttcacgttcttcagaggctagtgacttcctaaagtgaggattgaggaaataacaaccacgataagagttacagctgaccctggagtgtttcctgtgcaccaggagcccgttccaagtatctgtatttattcactcgtgtcatctgtagcagccccaacacataggttaggacctgtcactagtcccatttataggtaaggaagctgaggtgctgggaggttgcatgatgtgccgagcatctcacagccagcaaatagcaagtagctagaccgcttcctccctggcaggtctgaagcacatgattcctagccccagccttcctaagggcccctaacagacggtggccttcccctggcatccagagtggctctgctgactggagcagtcaactgtttctcctctgcagttcctgaaggaaggagaaaagggggaggctggtgggttcaggtttcgtagacctaagaggccagctgccctgtgacccctcctgagttggggcttctttttgggggattagggaggagagttataagagaaagaggtgcggagagcagggagcacctgagagagggctggaagaagtggtaaatagatggacctgcccaatgagagtagccagcgtgtgcatgtgaggggcaggtagcacagagggaatgtattccttgtctaacttggcatatagccaaaagctaggtgtaagttagtaaactacagccttcaaaacagcccctgggaaaggccctgctttggagggtagaaggacatataggaggctcccagaggtacgggtgtgcctccctgctgggcatgggcccgcctgctgggggcagcagcaaaaggaagcaagtag

SEQ ID NO: 12031 - DNA, 1209 bp, Homo sapiens
tagttctggtggaacatatccctgagtttttgcacactgggcctccatccaggccttttcctgggagagtagaaaacccatgggctctgtggggtggggaaaagccctcagttctgggtctggaagcatcatcagttgcagccatgagcaaggttttgccattctgtgcctcagtttcctcatctgtgaaaaggtgataacattatttctttatcccactatgttgttctgaggattaagtgagtttgcagtgtaaagacatagacaaagacatagggacagagaaaggtaacatttgttattgttgtttttctgtagcatttgtgtctaatgcagtggactgtgtgcccaataaatgagtcctttaaattaatgatagaaagagaagtggggaaatgggttataagcagtgatgtactggtaaatatttaacagtcagctcctggtggggaggattgtgctctgattagtgtttgccaatttccatgatgtaaatactctccctgtggctgatttcaagctaccaacgtgacatcactgaacactgagtttgaaggagatgccagtacaccagtgccagctgctctggtccactactggaaggcatctgcaatagaccaaagccataaggcacccatcacccctggccttctcaccttgccacacacaggaattggtaactgggccttttaaaaaagcactcggtaatatattaaatattaaacatagactagctcaaaagtgagaattttttttttttgagacagagtctcgctctgtcgcccaggctggagtgcagtggtgctatctcggctcactgcaacctccacctcccgggttcaagcgattctcgtgcctcagcctcctgagtagctgggattacaggcgccggccaccacgcctggctgatttttgtatttttagtagagacagggtttcgccatgttggccaggctggtctcgaactcctggcctcaaatgatcacccacctcagcctcccaaagtggtaggattacaggcgtgatccaccatgcccagccgaaaaatgagatttttaataagcctggctagctttgtattacactattttgtgtttcgtgtatgttaaaagctcccaagttgtgccgtcccctgcaaagaaagccctgaatgcacagaattaggcacatcttgaggacagataacctttgagagacctttcagagcca

SEQ ID NO: 12032 - DNA, 1196 bp, Homo sapiens
gattgcttgagcccaggagttcgagaccagcctgggcaacatagtgagacctcgtctctacaatacaggaaaaaaaaaattagcagggcatggtggtgcgtgcatgtagtcccagctacccggtggggactgaggtaggaggattacttgagccctgggaggtcaaggctgcagtgagccaagatcgtgccactgcactccaaccccggtgacagagtgagaccctatctcaaaaaaaaaaaacagacaaatagaccttgtacgtgaggcctggccatttgttaacccgtgtgaaagatgtttcggtggccatttaatgaacatatgttgaataatgtgctgtactgtgtaccacagatacaaaggggaaaaagatacagaaggaaaaaagaaaactcagtatcacatactcagccccttctgatagaacaggtgtgtccaagcagcaacatcctaaaatagttgtcctccactctgggatgtaaaagaagttcttctgggatttggttttattacaatgactgagaatttgctctccctcagttatcatatctactgtgacaggccttgcacacgtcctgtgagatcctacctgccaagaacctgtctgccatttctcattagtatctttgtggtttgcagtcacctgtgtagaatttgcacatatactcaagtgttatttgttttcaattacttcctcaattattgctggtgtgtgtgtgtgtgtgtgtgtgtgtgtgtgtgtgtgtgtgtgtgtgtggtatttcatagccaaagctataaaatgtatttccaataatattagtagaattttttcagcccctaaaacccaccataaaagttaactataataacaaggcccgtaggcctgtacacaagggcatggtttctatcgaagtgtattacacaggccagacctctggattctccacctccagtggctgctgtttaaagcaggcattaaaaggaagatcattttcatgtttgtgatttgaagcatgtgtgtgctcacgaaggatacctccctggacaatgcctggaagaggactttgtgaagtggagactgtacatgattccaccagcaagcatgtgtcttgacaaaggttgttaaggacaagaagttgtgccttagctgtaaccaaaacccagcctaagcaatcaggtgagttgaagtagatgttgtcaaagctaaaaag

SEQ ID NO: 12033 - DNA, 3000 bp, Homo sapiens
taccatctctactaaaaatacaaaaattagctgggcatggtaatcccagctactactgaggaagccgaggtgggagaatcgcttgaacttcggaggcagaggttgcagtgagccaagatcatgccactgcactccagcctgggcaacagagcaagactccgtctcaaaaaagaagaaaaccaccaccaacaaaaaacacatgtaaataattcacaacagtacagaacagtatgaagcagaagccaggattcctctctctccatcaagtgtatatctttctagtgttaggtttcatttcaaactttaaaaatcattttgtgtgctattttaattaattgctgtttctgtggtggtgggtcagtatgtcttaattctgaatgttttccctgcacctcctaaaagatcttttttcccctaagtcctaacagaatggtatattcctctggaaaaagatgaacgtcaccaatggattgtgctgctctcgtttcagctttgatttttttgtccttgagaaccttgtcctccctgctgatttgtttctaaatcaaaagaaatgaagaaaaaagtactgtgacctgagagacaccctcctctagaatttagtggcgggtctgggctggcagaggtagggggctgctttgggctttgcacctgcactttggtgacattgttcttctgtgttccctttatttatgctggtggcttccatccgttcctcctctgagggtgagtggaggggtatatggaaacacggctatgaccaaagggagatcccagcctgggcaggctgcgctgctgaccaccctccctggggcccgggctctgtaggaaagttggtccttgactgtggcattgcactctgcactgtttctctctgcagacctaggggaaaactgcaggtggaagtgcttttctactaaggcctcttactttgggggggatgtgccctacagaagacatagaagatggggaaatgccaatgggcaaagagctactttgaatacataattctcttcaaagacttcagcagcaaaccaaaacagcaggttaaaaaaaaagatgcttttttgggtgcaagtctaacctgtctagcatgagatcttcttgattttctgattattttatgtagcttgagacaaagtgaatcaacttccacttagttgtaccgagcataaaacagaacttgggcttcctggcagtgaggccactgtcccatcacagatttttaaaataaatatgatttgaagtagtgtgatctttcacacaatcatactcagtaggaactttttgaaatagggcaagtttatgtttcatgcgagaaaacatgaaggagggttttggttttggtctgcagtttttccaaagggcttttatgagatacatttcccacaaagtccattttgcctttgttgcctaaaacagacaaaatagacttagatttattaatagaaactatactctctgccaattttacctcagtgtatttaatggtcctttaatctgatataagatgccaagggtatttgataaaaattcttcttccatgccatgtcaggagttaatacaaatgaagaaattccgtgggttcccctgggataagtgagggtagtgtcttggacaacactattgtttgaaggtttatcttttctaatcatgctctaccgcattgtagagagcctaaagagagttgtttctgagctgatctcagggaaatacaaataacttgggagatgagggaaataagatgaattctgtgctgtcaaggcagtaagtctgaagaaaggaccatgcttcttatattatcttccaccttgcttaaaacagcccatagctttgagttgacattttcattcttggcggatagcctactttatgaaggtaaggaatgaactcctacccttcttgggtcattctctgtactgatgcgttagtcttataatactttgcaccaacctgaggaatcttctaggcttctctagcatcccctaagactgtggctatttcacgtctctctccctgcctgccttccttttcccttcctttcccctcctcatgttttctggttgtgcccatctgtaccagctcctttccatccaccttcgtatgcacccagatttttctgttcccatctgtcctatttgttattcatcccgctgctcaacttctccagtatgttgcttcccttaagttgccattcattctcttcatgacttttactaactcacttcggtctctgtctgtcaactaaacttttctaaaggttaccagttatccaatcaccaaatccatggctttttctcaaagcttagtcttgtccttggcagaactggacactattgaccatccaaatggaaattcccctttcttggtgtctctgacaaatggtcctttgccttatcttgtgctggtggtgaagaggccctcaaagccaggcctctctattcctttgactgtctcctcagccattaacccattcttcatcctcggagtgagtgattcccaagtctttgtcttggcttaatccctaaagaacccagttctgctggtatcgaatagttcagcttggttgtcattgaaaggaatttctctcttctgtccatcagcctgtccctcccaactgtctaggacagtcttcggtcacctaaattcctaactgcagacttttgccctttttctctctcatcaccaaagtcccatccatttttttttaataaaagatcctcagctacagtctttccattttccttgcttctcttattgcacacccccagcccattttgcttctctcttggattttgttttttcagatccacatttattgggtttcctgtccagcttcttggaaaggagctcactcttggaaagactgatctttccaaaatattttccctggtctgaagctttggtgtgaacttctcaaggcttagagaatccagttacagaccttttggggttcaggatgctatagattgacaccctcctgcctgtttttctctgcat

SEQ ID NO: 12034 - DNA, 1231 bp, Homo sapiens
attcgaagcatgtttcctagagattgtgtggatgagggtgagctggctgaggcatcactcaagctaggggtggtgtgtaagaagcacgaggagccacaagaggcacctcctatagtcagctaagggcttccctttctgcgcccagcttttggttgaagggtgaatttttttttttttttttttttttttttgagacggagtttcgctcttgcccaggctggagcacaacggcacgatctcagctcaccacaacctccctggttcaagcaattctccagcctcagcctcccgagtagctgggactacaggcatgcaccaccacgcctggctaattttgcatttttagtagagacggggtttctccatgttggtcaggctggtcttgaactcccgacttcaggtggtctgcctgccccggctcccaaagtgctgggattacaggcgtgagccaccacgcccggtgaagtgtgatttctattagacgaatctgtggttcagtcatggatgttaatagaggaacctgttttcctgctacagattcctgagtaaaattgctgtaagagtccacttctggactcagggcaagtcgaagaccagtctatgtagaaaggctgaggcaactgggaaagacctgacagctagttacatatattctgacatagtccccccataatggcttttagtgacacatgtgctgatagaattctaaacctctagaattcccctgctggtgatgctggtgtcttcttttgtgcttgactgtacagggtaaactgatgcagaatgctgcaagtgtgatgagagctagaacgctgtgaaaactcttgctaggaaggttgggctcggtgtgacttgctccagtaggaatcctgggtagagatttttagctgcaattaaacggtacatccagagccaagggtgactctcaactcaggtagttctacaggtcaggtgtgaatttaccaaatctcccaatttgtttatttgttttgttttgttttgtttttttagaggagggtctcgttctgtcactctggctggagtgcagtgatcacagctcactgcagcctcaaactcctgggttcaaacaatcatcccacctcagcctcccaaaatactgggattacagacatgagccattgtatttagccaaatctcccaatttagaaactcctctgtaaagggtttgggtctgagctatatgtttggtcttttttgtttgttttgtttt

SEQ ID NO: 12035 - DNA, 1321 bp, Homo sapiens
gacatcagcagtgacacactcctctccgattatgtgggctcggggcctcccaagggcacaggtctccaccgctatgtctggctggtttatgagcaggacaggccactaaagtgtgacgagcccatcctcagcaaccgatctggagaccaccgtggcaaatttgaggtggtgtccttccgtaaaaagtacgagctcggggccccggtggctggcacgtgttaccaggctgagtgggacgactatgtgcccaaactgtacgagcaactctctgggaactagtgggttagcttggggacctgaactgttctggaggccccaagccatgttccccagttcagtgttgcatgtataataggtttctcctcttcctgccccccttggcacaggtgagacctgaccagtcagatggtggttgagggtgacttttcctgctgcctggcctttataattttactcactcactctgatttatgttttgatcaaatttgaacttcattttgggggatattttggtactgtgatggggtcatcaaattgttaatctgaaaatagcaacccagaatgtaaaaaagaaaaaactagggggaaaaaaccaggtctacagtgatagagcaaagcatcaaagaatctttaaggaaggttttaaaaaaaaaaagattggttgcctctgcctttgtgatcctgagtccagaatggtacacaatgtgtttttatggtgatgtcactcacctagacaaccagaggctggcattgaggctaacccccaacacggtgcatctcagatgcctcaataggcatcagtatgtcgctctggtccctttaaagagcaatcctggaagaagcaggagggagagtggcgctgctgttgttgggacatggccatctagaccggcagcagcgctcgctgacagcttgggaggaaaccttagatcggtgtttgttaaactgatcattcttcacgggagtaagaaaagctggtctggagttgctgaacattgcattaattgtgctgtttgcttatagttgaataaaaatagaaacctgaatgaaaaaaaaagttacaaaaagtggccatctaccgactgggcaaacaaaaaagaacagtttcaacactcagtcatttattgcacatggagtctgatgaattaaaagaataccaatcagagtgtccggggctggcgtgttggcagtttgaagtaccatacagctcagggctgggtgctttggctcatgcctgtaatcccagcactctgggaggccaaggcaggtagattgcttgagctcaggagttcaagaccagtctgagcaacatggcaagacc

SEQ ID NO: 12036 - DNA, 3127 bp, Homo sapiens
tatttgctgaatgaattcagaataggcaacctaatccacttggaaagcactaggcgtaaagtaacttaaatcctgtaatttcagggtgatgctggtttgactggacgcaaaatcattgtggacacttatggcggttggggtgctcatggaggaggtgccttttcaggaaaggattataccaaggtcgaccgttcagctgcttatgctgctcgttgggtggcaaaatcccttgttaaaggaggtctgtgccggagggttcttgttcaggtatacactctttatataacgaacgattaaaagtcatgtaagtgggagggtatttagtagtaatctacttaactacttgttttataccaacgtattatacaagtatatgggtctttgcaatcactgattcttacgacatttgaatccttttaggtctcttatgctattggagtttctcatccattatctatctccattttccattatggtacctctcagaagagtgagagagagctattagagattgtgaagaagaatttcgatctccgccctggggtcattgtcaggtaaagatggtaaagcctgttgctagtcaagtattgagggtgttgggtgtgtgtgtatatacttaaggctgaggaggtgaaggtgtgaaggaagactcctcaaatgggaatatattttaattcctggaacagttttgaactgctgccttagtgaagacttagttatttgagaaatttaaaattacggtgctccatggcttaggctaaccactctagagaatgttccagatttgatatttgagctttgtgctcttctacttaagggtgttaagaaaatagagataaagtgggttgctcaaggtttgttgcaatgtaaaaaccatggtagggtgtgggcggcgggaccttggtaagtattgtgtgatctcaggtgagctttttgacaattgaaatttctcagaataatgacaagttttcgtatttgttgagccagggacggaaaaacaactatagttactaataaggactgtgcaaggagtttggacaccagggaagtaacacttttgccacaaatttttttcctagcatatcccagagaactcatttgccagagctcttgaaaatgagtcttgctgattgttttgctttattttaatttaatgctacatattaagttacggacttgtatattccagggatctggatctgaagaagccaatttatcagaggactgcagcctatggccactttggtagggacagcttcccatgggaagtgcccaaaaagcttaaatattgaaagtgttagccttttttccccagacttgttggcgtaggctacagagaagccttcaagctctgagggaaagggccctccttcctaaattttcctgtcctctttcagctcctgaccagttgcagtcactctagtcaatgacatgaattttagcttttgtgggggactgtaagttgggcttgctattctgtccctaggtgttttgttcaccattataatgaatttagtgagcataggtgatccatgtaactgcctagaaacaacactgtagtaaataatgctttgaaattgaacctttgtgccctatcacccaacgctccaaagtcataattgcattgactttccccaccagatgctgaaaatgtccttgtgatgtgcacgtaaagtacttgtagttccacttatagcctctgtctggcaatgccacagccctgtcagcatgaatttgtaatgtcttgagctctattatgaatgtgaagccttccccttatcctccctgtaacttgatccatttctaattatgtagctctttgtcagggagtgttccctatccaatcaatcttgcatgtaacgcaagttcccagttggagctccagcctgacatcaaaaaaggcagttaccattaaaccatctccctggtgcttatgctcttaattgccacctctaacagcaccaaatcaaaatctctccactttcagctgtcttttggaggacgtacgtaataaggttttaatttagtaaaccaatcctatgcatggtttcagcactagccaaacctcaccaactcctagttctagaaaaacaggcacttggcagccttgtgatgtcatacagagaagtcacagggcagtacctgagggtctgtaggttgcacactttggtaccagataacttttttttttctttataagaaagcctgagtactccacactgcacaataactcctcccagggttttaactttgttttattttcaaaaccaggtccaatgagctttctgaacagctggtgtagctacagagaaaccagcttccttcagagagcagtgcttttggcggggaggaggaaatcccttcatacttgaacgttttctaattgcttatttattgtattctggggtatggcgtaagtacagagaagccatcacctcagatggcagcttttaaaagattttttttttttctctcaacaccatgattcctttaacaacatgtttccagcattcccaggtaggccaaggtgtcctacagaaaaaccttgggttagacctacagggggtctggctggtgttaacagaagggagggcagagctggtgcggctggccatggagaaagctgacttggctggtgtggtacagagaagccagcttgtttacatgcttattccatgactgcttgccctaagcagaaagtgcctttcaggatctatttttggaggtttattacgtatgtctggttctcaattccaacagtttaatgaagatctaaataaaatgctaggttctaccttaactgtgtctgttactcatttgttaaagtgctttggggccataggtacgtgcctataatcccaacactttgaaaggctgaggtaggaggatcactttaacatagaagttggaggctgtagcgaaccattatcaagccactgcactccagcctgggtgactgagactttggctcttaaaaaatgctatcatatgaataacctgagaatactatatgtgtatctttaaccttgaattgtaatccataattagccataattcaggaaaataacctcaatccctagacccagtgggtgggcattttttaaaagcctaagcaagatttagtcct

SEQ ID NO: 12037 - DNA, 1255 bp, Homo sapiens
aaaatacaaaagttagctgggcgtggtggtgggcacctgtaatcccagctactcagtaggctgaggcaggagaatcaattgaacccaggaggtggaggcagcagtgagccaagatcgagccactgcctgagtgacagagcgagactccatctcaaaaaaaaaaaaaaagtatggcctgtgggctgcacttgtactcttataatcttgttccagtgggaggagccactgggtcactcactctgccttttccccaacagtctgagcacttcaagacgacatcgcagaaggtggctcgaaaattctggtggaagaacgtgaagatgattgtccttatctgcgtgattgtttttatcatcatcctcttcattgtgctctttgccactggtgccttctcttaagtaacagggaacctctcccacctgcccttctcttcagggacaaccctccataaatgtgtgccaagagggtctcctttcctgtcttcctctacagagaatgctgctcggtcctcctacccctcttcccgaggccctgctgccatgttgtatgccccagaaggtaccttggtcccccggaaggagagaaaaaagagagatggactgtggctgcatttcttgggtccttagagtgggctggagagacctagagggcccagcatgtggctgggaaactgttggtggccagtgggtaataaagacctttcagtatccctatatgtgtgaggcactttctctcttcccattttgcctttggcttttctatttcttttcttcctgaggataccttctggctaaaattctctcatctgaggtccaagttgttggaagggcaaagagtatatgtttggagaagaaagttggagcccccaccctgtctttattcctcccagttccattcattgtcacaggtctcaagaacaagaattttctgggagtcttggcatatggaaagttcaaaaccttcatagcattttggggtggtatgcaagatttttaagtgttcccattgggtcctgccatggccctgtagtactcttcttctggaattgttagctgaggcatgaagctggttgaaatcctcctgcctcttccaccagagccatctctcttcaacgaccctgtagtctagagccgaggggtggaggaaatggactgctattcctttccttgtgcttctgcatgttttatttgtcttttctctgtccttgtcttctgggacttagcaaggcctctgggtctcagttgtcctgaggggg

SEQ ID NO: 12038 - DNA, 1132 bp, Homo sapiens
agctgactcccacacagccaccctgctggctggagcctgaggaaacctagttcaccacccgcctgtctgttcctttctgcccctcagaaggggcaggagcaccacagcgtctgggggaagctgacaggctcgctgggcagggccagggctggaggaaggcctcaactgtgctctcctcccccagtggccctgatctgcctcctgcgctacgggcagctcctggagcagagtcggcactcttgggttaacaccacggcactcatcacaggctgcaccaacgctgcgggcctcttggtggttggcaactttcaggtgcttccccttctcccctgcaaaccttaaactttacctaacaaggcctggctgcctgcagtgtggcacctcaaggttggggctggaaagagggagaggaaggaagagggagagaggagattcattgaaggaggggtggagaggtggggccatggccacatcaccaactggcccttctctgggcccaggtggatcatgccaggtctctgcactacgttggagctggcgtggccttccctgcggggctgctctttgtttgcctgcactgtgctctctcctaccaaggggccaccgccccgctggacctggctgtggcctatctgcgaagtgtgctggctgtcatcgcctttatcaccctggtcctcagtatcctttcaggacggggcagccaggaactcatcctctagctcaacctttctccctcccaagaggatggggggtggaggcctaacactgccatgtgggggagaggactaacacctctccctttggagaggtgaggcctgagactgcagaaggggtgttgccaggtttccgtatgtcctactgaacatttccttagcctcgttttaggtggagtcttctttgtccatgagagttctcagctgcaacatggggcagccctgtgtgagtgggtgtgtgtcatcgatatcctcattttctatggcaccttcagctacgagtttggggcagtctcctcagacacactggtggctgcactgcagcctacccctggccgggcctgcaagtcctccgggagcagcagcacctccacccacctcaactgtgcccccgagagcatcgctatgatctaaggtct

SEQ ID NO: 12039 - DNA, 1488 bp, Homo sapiens
ttagttttgcagaagtgtgcggtctggtttcgaggaggaagaacctagactcatcagggaggctggctagaagtcgaccacgaagtgctccccagagccccaggcagctttgtgaccccacagcgctttctacttgacgtttgttttagtgccggccatatcgctttgcctgtctgtcctctccattggattgacccatggagcacagagcatctctgtcttctctttatgtaactgccctagtacctggcaaaagaaggaagattgagacaaaagccatagctttgtaagaagaaagtgatacctctccttctagagataacttttttctcctcagtggctgtagccactgtagcagatttccaaatggggtatagcagatttgtaaatggggtgacaagttgtccatggcctggcacagaataggtatttgataagtgtctgttgactgaatgcctcctagacttcagtttgtgttttcatttcttacagatttggaagaggcgagataatgatgaaaccaaccagcagggggcttgaaggaggcgtctagggctttgctcccaagggctgtggctgatgatggtaaataagaacacagaagctgtagctgaacacaggctggctggtgggcttcctaggccagcccagcttgtatgggttctggctacaccagagcaccaagagcccacttgcctgggatggccccacactgtcactcagctgttctttgatcatttttttctagattgatgctcctttctcccatgcattgagctcccatctagcttcagcagggcagaacccttctccagatgtgtgtaacttatgtcttgagtatctgggagtagttgaagaacagataattccttccaaacatcaagccttgggattcttggagcaagcagaaagccagtaacttcgctctgttagaggtggaggattttcctatggttccccccatttcctgatttgtatttttagatggattaaatagtctcctgtttttaaaccagcctcttgttttatatcttttcctttggtggttggctgaggaaaatattttcctttttaatcttcacaaactctctaccctacagtctgacatctggtgcacatcacgctcgccctttcctgtcagcttgtgggtggtgtgtcagttaggatgcatttgtttctaagtaaaaaaatacctgagtcaaggggatacattattattgtgcttaactagagggccagaggtgggcagtttccagctgcagtgcaggaatgagtaagggaagaggaaaaaaaggaaataggaagcgcttctcactacagtgcaattctgaggtggtctcagccagtccagtgtggagccccagggcaaagattccgtcagacaattcagcagaaatggctcccatcaagctcagtcgtgggctctagcagcctagaagaagggtggccttggcatgagcactgtggcaggtccaaagatatgggaag

SEQ ID NO: 12040 - DNA, 1298 bp, Homo sapiens
tgctcatccttcgtctagatcaccactgtccagtggaaacataacctgagccacttgtccaattttatattttctagtaactacattttaaaaattgaaaagaaacaggtagatcaaagtttcaatttcccaaaaagtttccatttctaaactcttatgcacctaataacacagctgcacactatgtaaattattaatgagctgctttatattctgcttttcacagtaaattcactccctgcccccacaaatgaacccacatgctacaaaacatagatatgacaaaaagaaataagtgctttcctactcactttattctcatctattgtagacatgttatatatactaactaatgtaatgttcaccacagccctcagtgtttggtaccattgtcatccccattttataaaggagggtattgaggaacagaggttaagaagccatagggggcagagctgggttcagactcaggcagtctggcctagaggtggtaaatgaggctgtcgtatccatgtctttgtggtctgtagtgcattcccagcctgccccttggaacagctactggtgaaattggcgagggtgatcttaggggcctgagagatggctccatcctgtcaggtgagtgggctcctgggcagtgccgtcatcacttccctggagctccacagcagcctcttaactggtcctgcttcgtgagaggacttccccatctccagtccagcctcgagagaggtctccaaaatccaattccactttaaaccacctcaccactggttgctcccttttattcttagagtaaaattgcagccccctgtggcatggactgcttgcttttctagcgtctcagggtgctgtgccctcctgggtagaccctttaggcacactgcacttggcgttctttaggcacgctgcacttgacattctgccatccgtccccactgtccctgctcccgaggcacctgcctctcccatcccattccagttcctattcaggcctgggcagaaacgttctttcctctgggaaccctttcctaagacacacattgtattagtccgttttcacactgctgataaagagataccccagactgggcaatttacaaaagaaagaggtttaattggacttacagttccacgtggctggggaaggtctcacaatcatggtggagggcaaaaggcacttcttgcatggtggaggcaagagagaaggaagaagaagcaaaagcagaaacccctgataaacccatcagatctcatgagacttattcactatcatgagaataacatgggaaagaccg

SEQ ID NO: 12041 - DNA, 2294 bp, Homo sapiens
tctgctgactgctcccgtggtcactgcttaatccctcctaattttacctcccgtttgacaggcatcgcggtcgaccctcgccatctctccctggttgctgattatatgtgcttcgagggtgtttacaagccactgaatcgctttgggatccggtcaaactcttccccgctacagcagatgacatttgaaaccagcttccagtttctgaagcaagccaccatgctgggttagtgcgtgggcaggagccctggcctcccctctactgacgactctgggcacacgggctcacccatgggcatctttccatggttccttgcacaccagtgggatcttgggatctgaggggagcgggggcggctggagggggctgaacagcagacacgacagctgcctctacgctttgaaggaacaggaagagggccttcccctctcaagtgctagaggggggctgcctcgtgatcccatcagcttcagagactcaggacccacctgagtcccgagacttcagtgttcagccccataatcacctcatgacattcccaacttctacctcaacaccctgacacatgtttttgtgtctctgtcaggatcccacgatgagctgaggtctccttctgcctgccttgtggtcgggaaggtcgtcaggggcgggacaggcctgttcgagctcaagcagcctctgagatagcagctaccccggcaccatctgcccagctccaaggacccttggtgagggcgtggcccagcctgccttctgcatgagaggaccaggagactggaatccagggcagttccaagtgacagtacagagcacagcagcgaccttgggcctgaaagcagtgggcctctgagctgggccagcttcacctggaaagtgacagagttgctcatccttgcccctccctgtctctggatttttatcaaggtttaccaagtcttctgagtccccctgagatggctggggcctcacctgtgctgcaggaggcctctgtggcataacccctaaggagaagtcctgattcacgattcactgagaagaccaaggggaagccatgctttgctgctggggaccccaggcacctccagagtagggaagcggggttcttttgctgtgagtggccagggacaacagacaagattcctgggggctcccgatgagcaggaacgtggagcctgctgcccaaggcctgctccttccggctgctccagcccctgggggcagagtccacaaagagtccccatcaagacttcttccctgagtcaagtacagcgtagcatagtcctccacccacccaacctctctgcctggccagggtcctggccctgccactgtgtggcgaggtgtccttctagaccacatcagccccaaggctgggagcagtcgctccagggccgcagcagttcactcccacacatagaacccaggtcactgctggggcgattgaacaggttgcctggcttttctctgctgtcagtttggtgtggaggcctatgttctgccccatacaccccacaggccctgcttatgggaaggaacacaggcctccagcccagaggactgtgccgccctgttcttggccgtccacgtttcctctccctctagcaccagcaatacatttccctggcatggacagaaaagacagagaggacttatacaaaggctttgtaaaaccagaggctagcttctatctttgtctactgttatttcagctcagggcgggtaattaacatcattggaactagctattaggaaagaaaaaaaacttggttttttttacaacaattttttcccttggtttgcagtttctgcatttggatttgagaacccagggcggggattttcttggcacagtcaggtcttgggtccctcttcctgtgctttcttgtctgaggccttagggggaagagctcagcctctgcagcctcctccacctctgcccctggcctgcctctgctgtgacctccttccagagctagctgctggccctgtggccaggagaagcagaggggagaagcctttatgcagaagctgtgctagccttggtctggggtggggaggctgctgctgtgaccttaggggtagggttggggatcaagggaggctttgtcaagggagagtgaccatgttgctccctacatccatgcaataggacccagcctgcacctcctaggcctacactggggaaagcctgacagaaatcagtacctcctaacggggtctgccaggttcaccaaggcatgggcacagaggaatatgacagttttgaggcaggcaggaagggcccagcctgcag

SEQ ID NO: 12042 - DNA, 1096 bp, Homo sapiens
ttttatagcaggaggtttaaactgtctccaaattgtcataattgagaagaaagaatggataaaggaaaaagtgaataatgaacccagaaattctcctgcttagggggcttgtggtaacagtcccagagtggatatgtgacattctgggggcaaacatgaggagtccaagcatgaatgtctagagcttcagccacccagctgggatctgtgctgtgtaatttgaggacatctcagggtcactggtgggaatttgaagattagagggatcttttgcctaggaaaaacgagtccagaaagaggtagaggtttcagttttctggtttcgggcagcattgacagtctgtggtgtctgctcctgacccctgccacaacccccaccctgaccccccaccaccgtctctaggttgaggaccttgctgcagctgaagtggcagcgctcactgtgtgagccgggcgaggctgtgggcctgctggctgcccagagcatcggagagccctccacccagatgaccctcaacaccttccactttgcaggcagaggcgagatgaacgtcaccctgggcattccaaggtgtggggcacaagggagcacagggtggggtctgtcctagcctctcctggagaaggggccatttaatgagagggggtgagtgagtgtgtgtgaatgagagagtgtgtctgtgtgagagagggacagggtctcattaaagtggggatcagggttagaatttccagagcccagctggtttctttggtgcccaggcctggtaggatctccatttattcctctgccaactcctgcatccacgttcctggggatgcctgtgagactgcacactgctgggggaaggactcaggaacgtacattgttaacaagccccacacaaggtgcctggttgcccaactccaggggagccattcacatagaacgtgcccccacgtggccctgggccctggcccttcaggtaaatatatgtgctggacaaggggaatgagtgtggggtcagacccatctgcattcagtccctggccctgcctttttctagcagaaagactctggacaggtacctcactttccaaacctcagggggtcctt

SEQ ID NO: 12043 - DNA, 1194 bp, Homo sapiens
cacacctgggagctggaagcaggggatctctttgaagcagtcactttgggacagccttgagggcacagagcgtgtgaaagagcctggatccagaaataaccatggatccagcacagtgactgcatcctagctggcctgagacagtcgtggctttgcctcttgtcctagcctaatcataacagtctcctgtttcactctaaaagaagcccagtttgctcagtaaattacatgcttgccctccctgggcttgaatgggccaggatgaagagctgctaggcttatagtcaagcagggtgccctaggacaggttgaagtctctccccattttaaatggggagatggtttctcattgcaatcaggtttctttctgtctccctttattctcattggaagccaatgcttttgatccctcttatgctactgggtatccctcccacatagctgagacccatccttctgttcagatgctgaggatgtggtatgagttggatgaggaaagccgaaggaaataccagaagaaggcggccgcttgtcctgaccccagtctgtctgtctggcgtcctgacatctactttgcatcagtgtcagaaacatttgaaacaaaggttgatgactacagtcaagagtgggcagctcaaacagagaagagttatgagaaatcagagctttctctcgacaggtattgacagtgatttgttgcacaacatgtgcaggagaatctgcctcctagcccctgcctcctagcccctgccctactcactccggaagagggctgcctcctgggtttgagacttcagctagagggagggcagtaagacagccaggggcaacgcacaagccccaagggcccaggagtgaacaagtgcaagggaggcaggagtggacacccccatctgggccaagatagggatagtggtctgctgggaggcttgcaggaaagtctgctctcttgggtttggtgtggtgggtggggctgactgagagtcagggaatctggtcactgttcacctgctgccaaccgtgtgacccagggcaggtcattcatgcccagggacaccaggtcttaacttctcatgaggccttggatccgattactccagtaatcctttgagctttgggttcccatttgaaggcctcagcttggactaggacagacacacacacacacacacacacagacactgtagctcagcg

SEQ ID NO: 12044 - DNA, 1141 bp, Homo sapiens
catgactgatttacagaagagccaggccagaaacgtgtgaaaaatactaaagcataaaaccaaagtataaaaacaagaacacagctgacagcagccagaccaaatttaggcataaatgccaaaaatatgctggagtaactagaaccagatgggattaaacagagaaggccgggggaacgggatgagtttgaagcagtcttgatataggatagtgggcaaatggcaaacgtagaagccagtgctaaaccctggtcatgtgctttgggaagcagttggctcccaagcaagaacatagtgaggatgtgggcaagacaagacagggatataagaagggctcttgatagaaagtggcttccaggcaggcgattagggattagagtttgacttaagatttattttcattcttcttgtgttgtctgttttggcttataggatggccaaccattggcgggactgatccaggatcacatggtttcaggggcaagcatgactactcggggttgctttttcacccgggagcactatatggagctggtgtaccgaggactcacggacaaagtggggcgcgtgaagctcctttctccttccatcctgaagccctttccgctgtggacaggaaaacaggtaattgggagagaacagccagtgtatgtaacaaaaggaaataggccactcatgtaaaaggttttattctcagaagagtccagaccagagacagagaaatggctaagccagcaatagtctgactttctttcccctttgtttggggttcctgagtctgggtggcttcaagggagtgtctagcaagagtagactgcatagtagcctggtgcagtggctcacacctgtaatcccaacactttaggagactgaggcgggcagatcacctgaggtctggagtttgagaccagcctggctaacatggtgaaaccctatctctactaaaagtacaaaattagctgggcgtgggattagtgcctgtaatctcagctaccgggaggctgaggcaagagaatcgcctcagcctgaggcaagagaatcgcttgaacccaggaggtggaggttgtagtgagtcaggatcagccactgcactcctgcctgggcaacagagtgagactccgtctccacaaaaaaaaaaaaa

SEQ ID NO: 12045 - DNA, 1219 bp, Homo sapiens
gctcccatatccctacatctctctgcttcccaaagctcacagggaaacacacacttcttgttttcatagtagaacttgcacatagatgaggaagccagtgtgattgtgtaagtcaaaatattaaaatcctaaactaagacagtgtctttctccattagattgtgagcaccctgaaggtagagaatgcctttcgtctctgtatccccagtgccaagcttaatgtctggggtaaaatagtaggcattcagaaagtatttgaataagttagtgaatgaggtaaaatcagcataccttgggtagtattaaatgtttagatgatacacagcattagagatgaaaggtttagttcaattccctgtgaagacagtgatgttaaaatgatcagtagtatctggtgcaggaaacatgaattggagcagtgaagttttactttggtatgttggtgataaaagttttgtcctactcagttatccttccctcacctttacctgtttgtagtaactttagtcatcttgttttcctagtgtttaatgcctgagtactttgaacctcagatcaaagacataagtgaagccgccctgaaggaacgaattgagctcagaaaagtcaaagcctctgtggacatgtttgatcagcttttgcaagcaggtgactgagttcgattaaagcccctctaataacatgggctttgaagtgggcccaagttatatgattcatatattttgagtaagagttacaggtcctgctgtacttactctgctttgatggctgcgtgctttatatttttagtagtttatttcatttttagctttagtgttacttaagaattacaggcgaagtagaattgcagctttgttggtttattgtagcactggtagagaaattgtatcacccttctaccttagcttctgtttttaatgttaggtaggtatgcagtgctcccagatttcctgtacccttttccttttttttttttttgagatggagtcttgctctgtcgcccaggctggagtgcagtggcgcaatctcggctgactgcaagctccgcctcccaggttcatgccattctccctcctcagcctcctgagtagctgggactacatgcacccaccaccacgcccagctaacttttttgtgtttttaatagaggcggggtttcaccatgtagccaggatggtctcgatctcctgacctcgtgatccacccacctcggcctccg

SEQ ID NO: 12046 - DNA, 1601 bp, Homo sapiens
tttctttctcaactagtaaaggtaaaaatatgtggattagatatcatgcagatgtgaatgacttctgactttgatatgaagaggccagctaggaaaatacaccagaaataagtggtgggggtggggttgtaagaaagtctctctggcctcatcttgcacatgtgtagatgtagcttgttgaatgtgcatcagttctgtggatgtatgttgtcagatggagagaaaaatgtttggctttgcctttttttctttgtaggccatgcagttgctgaagaggaagccagaaaagcccaccaactctggctttcagtggaggcattaaagtacagcatgaagacctcatctgcagaaacacctactatcccgctgggtagtgcagttgaggccatcaaagccaactgttctgataatgaattcacccaagctttaaccgcagctatccctccagagtccctgacccgtggggtgtacagtgaagagacccttagagcccgtttctatgctgttcaaaaactggcccgaagggtagcaatgattgatgaaaccagaaatagcttgtaccagtacttcctctcctacctacagtccctgctcctattcccacctcagcaactgaagccgcccccagagctctgccctgaggatataaacacatttaaattactgtcatatgcttcctattgcattgagcatggtgatctggagctagcagcaaagtttgtcaatcagctgaagggggaatccagacgagtggcacaggactggctgaaggaagcccgaatgaccctagaaacgaaacagatagtggaaatcctgacagcatatgccagcgccgtaggaataggaaccactcaggtgcagccagagtgaggtttaggaagattttcataaagtcatatttcatgtcaaaggaaatcagcagtgatagatgaagggttcgcagcgagagtcccggacttgtctagaaatgagcaggtttacaagtactgttctaaatgttaacacctgttgcatttatattctttccatttgctatcatgtcagtgaacgccaggagtgctttctttgcaacttgtgtaacattttctgttttttcaggttttactgatgaggcttgtgaggccaatcaaaataatgtttgtgatctctactactgttgattttgccctcggagcaaactgaataaagcaacaagatgaaaactgagtatcttatcccttttcaaaaagtacagttctggccaggtgcagtagctcacgcctgtaatcccagcactttgggaggctgaggcgggtggatcacctgaggttgggagttcgagaccagcctgaccaacatggagaaacccatctctactaaaaatacaaaattaagctgggcgtggtggcgaatgcctgtaatcccagctactcgggaggctgaggcaggagaatcgcttgaacctgggaggtggaggttgcagtgagtcaggatcgcaccatcgcactccagcctgggcaacaagagcaaaactccgtctcaaaaaaaaaaaattctagtttgttgtatgtacagaaaatatccttgagaaacaacaacagcagaagtaggaacttctagct

SEQ ID NO: 12047 - DNA, 1249 bp, Homo sapiens
acatttttggattgagattttaaaaaaaaacaaacattggtttaagcctagatgagaatctttgggtgtattttaaaaagctttgcagtgattctgatggacagctctggttgctgtgttgggatttaatctagatcatatgtgtttaagaaaagtaaaaaaacttattaaggaaaagtctgagagaatttgaatttgatttttagttttagcagaaaagaatcttcaattggatgcctgttataactaatcagagttatgcctgaaagaaaatatagaagtgattgtatatataagttttgtctttaaaggcaaagttacagtaaatgagaaagtccatttataattagttcagattaaaagagggttcctggaaaacaactgattatctgaaggcctacctgaattttgccaggggttgaaaataccttattggacactagccaatttctgattgaactggggaatctaaatctcttttcatgttagctaagttttactttcgtttactgctcttaaattataatcagttgatgcagattaccttgtaatgaggtataatttcagtgacatcattaatattttaacatgctcttttgcttagctgacaagctctctactgatgatctgaactccctcattgctcatgcacatcgtcgtattgatcagctgaacagagagctggcagaacagaaggccaccgaaaagcagcacatcacgttagccttggagaaacaaaagctggaagaaaagcgggcatttgactctgcagtagcaaaagcattagaacatcacagaagtgaaatacaggctgaacaggacagaaaggtaagagaaatgagaattgttgcctaacatttaaagtgactctaacttgattgtttacttgtagaaataatactggctcagccgggtgcagtggttcatgcctgtaatcgcggcactttgggaggccaaggtgggtggatcccttgtggtcaggagttcgagaccagcctggccaatatggcgaaacccccgtctcttctaaaaatacaaaaattagctgggtgtggtggctcgcacctgtaatcccagctactcggaaggctgaggcaggagaaccacttgaaccagggaggcagaggttgcagtgagctaagatcgtgccactgcattccagcttgggcgatggagcaagactgtctcaaaaaaaaaaaaaaaatactgacagtcattggctttaggatattgaatataagtcatgcca

SEQ ID NO: 12048 - DNA, 1180 bp, Homo sapiens
cctcagagcaccttcgtttctcctctagaccagggacaggtgtagagataaggactggcaaccagagcctcagcatccaaagatggactgaagtgggatggctgacaggcacataacttacgggaaagggaatttcatacatacgatttttgttttgtgggtaggagggcttatcatcaacactgattttataatctgacaataaatgtctttcattaaagagtttacctaaatgatgttcgattatatgtataatttataaaatatttatgtatagtttgtttattcaggtatatgtataatttattgaacacctactatgtcccagcatatctacaaaactgggtacatacatactgtctaactgctaatccacatttccagtcttacaaaggacataatgattagttaagccctaatttagatttgaggaaactgaagctgagagagggttaagtaaattacccaaagtacagctaataagacccagaatctcagtctcactccttgggatcctgtgtatttccctgagtcttctaacatatgaaaattcatatctaaatcaacaagtgactgtaatctggtactataaatactaaataaacacttcttcataacactgtaccaattcagcttttaaattttattactttgctttcctgtcctttgccaactcttaacctagttaatcctagttctgttgacattggaccaggctcagtaaataaacgaatggatttccagcctttttttcccatctgttcctgcttttagtcctctgaatctgcttcttttcttactgctgctttattttacagtgattttgtcaaacatagaatacaggactaaaaatgcaaagaaattgggtctgtgtttaattttgatgtttcaaattttgagcttccaagtctttgtggccacccaatgaagtttgagtctgcctgttcagatgtgaaaggtaagggctgcagcaggtttaagggtggcccttcaccaccctgttgtcacctgcacaggcactcccccatttgcagatgaagaaatgttcagagaagaaaaatgatggaccaaacgtctgtttgcacaattgaaactctaccagtggactattctattttcacagctacctagtttctgccgatgatttttttaaatgtgaaataaacagtgatactttcag

SEQ ID NO: 12049 - DNA, 3780 bp, Homo sapiens
gcagaaacaagaaagatgtgtcattctgcacaaccgttcccttgggagattgaggagcataatttaagagggaggcatcagcctctcaaagggctcagcttcatgcgatatgtgggatgggactctgatgattgcttcctgttgcggagattcagggagaccccagccctagccagctgcatttggccaaaggagctggaagtctcaacacaatgccttccaggtgctgacctcaaaagatcccacatttacaccaaactgagggacacctttctgttttctctaccaggcaccgcctagaatccttcgatctcgcttcaggaagaaaagtacctcatcctcggccaccgaaaccacgtgagtgagatgagccaacagcaccggatccacagaatgtttcttctctgccttaaagagctattcactaataacatagaaatccgcaagctgggtgtgctttgagtgtgcagcctcacaaacatggccttttctctctccccttccacttttaaggatttatttttttcccccttttctttattttgctggggagaggctaaagggaaaggtagtaggggcgggggtggtgacctttaagtcttctgaggttggtaattttccacaattggattgtcattatagacagcagtgtgttttttagaaagataagagaatcacccctatgctgctgagatgtacatttgtaatttatctgttgcatacttagtttttagtcctgtaaatgcaaacacagcattttttacaactttctttgttcttggtacttatactttgaactatgatgtacatatttatggcttttggcttttaatataatggacttgcaagggctgccagaggttctgatatgtaagaaaactgcaaaaacaaatatagacaaatattttgattctagagaacgtctcagatgtgcttataaagcttccaaatacaactccagtaagacatccctttccctgcaggagtgtggtctatattctttagatagttgtttagtcaaaagaccagacaagttacaaactaagagaaacaatatttcacaacacagtaaagtgtgatgagaggtcaggggaacatcccagtaaaagagaagagtcacaggaagctcatctcctccctggattctggattaggagcttctgaatcttttccagggataggcaggtagctcactcttggtgcaatttcttgaggatgggaacatgtagagctgctggaaggagtaattctgtgcttgacaaaggacgatttctcctttatcgtgaccagtgctgccgatttcctgacagaggagcttacactctgagcaccttgttttagcgaactctagcaaaacttgtttagcttagcaaaaacaaacacacaaaaaactgagaactctgctgtttcagatatgccataacatacatctgaaacacatgtgtaacaatcaaaatggtgggctctagaatggttttggagctcgagatcttcatgggttagacttgctggtcagacccaggagcacctgtggctcacaccttctgttcccctcctggcctgtgcagaatgtaaacagcagactcatactcaatgggcactacaggccttatcagacgttttatacaagcctggattgcttagtaggggaataaggcattctctgagggggctttccacttagattgagaattttatttgaaaagaatctggtttaaatggcattgtggtccgaggtagctgctctccccactgagagctgagccgaaatataagaataatatatttgtgcttcgagttggtgtttctttcagtgtaatgcatgcagtggtcacaacccagttactcataatatttggattgtatttgttcgtagatatgcccagaagactagagaattagtgttatataccatatagaacttactgtcagtcaactataaacaggcccaattaaaaactgttccattactacgcaaacacatattagaggcctttgctgatgacacattagctggatcttagccaccccagaaagggtttgatttgaagctgattgttgccagatatgcatattggaatcccatctacccatagttcctctgaaggtgattttgtaatttgcaaaagggtataggaaaatatacctaaaagcgaatttgtggctgagaggataaacagaagctgtttgctcatgttctgtgccccacacccaccaatacctaaatctgttaaggaagacagaaaatgttttctttgtgctcattgagtagttccagacagaagaagaatatactctttaaaatgtatttacctgttagttggaagtacccagaattatcagaaacgaatgcaaaaaaaaaaaaaaaaaaaaaaagcttacacagcttcttagcaatttttttttttttgccgaaacaataaattgcctttagcagcagtttaaaatcctatcgtgaacaacctatattttcgccattttacaatggagagttgtgacaagtacaggttatcaagtttgcacttaactatgccaaaaaaagtttgaagcgctctattctcagacatgctgtattattacttctcattcaagattgaaaaatataaaggtatccaaactctgtcttaatgtaaatgtaactatttttccttcaagtgttgactagggagtcggtttctctcttaaagacactcactgtacaactgaaagcagctgtcatatttctggcaaaatgtgtttacgtatctgacaagttgtacatttgtgtatgaactgacataaaatgtgaaagcctgtaagtgtacatgtagtggtgtggtgttctgtctagaggatacaactgaatgtttttaatttgctgacttacagacacaggctgtttacaaaatgctagctggaaagtctgtaatgttcatgtcataacttttagttaattgccattgagcacctgttctgaggaggtgagatgtggacttgtgcttataaactggagagtttagtcataatccctcctggctttgtgtgaatagcttgctcactttgctggcctttgaaatgtgttctccgtgataagctatccatgtgtttgtgataagagtgcttgtcaaccatgaccatctttgagccttcctagtcctccacctggcacagtatttgaaatggcaaaggatgtgcttcatcctctaacagtgtacactcccagagctgatattctggattttgactgtgcacatttcctctagttcatgtctgtagtccctatagaatgatctgtaataaaatagtatactggactgtgcatcaaagggatgtaaaattacagtattccaaaggttgaagttctgctgttttgttataatgcctgatacacatcttgaataaagtcttaacatttttcttttaaaaaacatctttgtaatgttgggcttaaaaggaaacaggaaatactttttttcaaatatgggaggtagcaaggattagaagctgagtgttcagccaccgactggcctggtgacttggccccgtgcctgttgcataggatgttgagagggaaagaaaaccagatgatataaatgttttgaaaaccagttcatcacacaactacaaacctgaaagtatcactgtttatttcacatttaaaaaaatcatcggcagaaactaggtagctgtgaaaatagaatagtccactggtagagtttcaattgtgcaaacagacgtttggtccatcatttttcttctctgaacatttcttcatctgcaaatgggggagtgcctgtgcag

SEQ ID NO: 12050 - DNA, 1200 bp, Homo sapiens
attgccaaataatcattggctgtgattagccatggagattacagaaaactaggaaggactttgttgatttaaatagtaattacaagttgtggatgggcacggtggctcatgcctgtagtcccagcactttgggaggctgaggcaggcgtatcacctgaggtcaggagttcaagaccagcctggccaacatagcgaaaccccatttctactaaaaatacaaaaattaggcgggagtggtggcaggcgcctgtaatcccagctacgggggaagctgaggcagggagagttgcttgaatttgggaggcagaggttgcagtgagccgagatggcaccactgcactccagcctgggtgacagagcgagactccatcccaaaaaaaaaaaaaaagtaattacaagttgtaaataagttgtgtgtgtgtgtgtgtgtgtgtgtgtgtgtgtgtgtgtgtacattacatctttttttcccctgcttcccctaggttacaattcaacaaacatggtgtgttgcgggtagaaggcttcttaacaccaaacaagtatgacaatgaagcaattggcttgtggttacctttaaccaaaaacgttgtggggattgatttggacacagcaaagtacatcttggccaacattggagaccacttctgtcaaatggtgatttctgaaaaggaagctatgtcaactattgagccacacagtaagagcatctcttagggggtaggattttcgagcccaatttgatttttgttcctaagtgacacctaagtcctaattgcttgggttttttttcacccagaagtttagataactttggtataatgaggttgcatttttccttttgcaacaggtttgatcagagttagccacctatctttggggtttattttgggccaattaacagaggagtggaactccttttttgttaggaaaggtgaagtgagggtggaatttgcacagcctcaccagcagtgcaggcacactaaaaggggatgaggtctcagattggtttattttaaaacaaaggttcttaatcatgaatacatttcgaggaaaataagaatgggaaggctgactctcagacctaccgagttagagtctgcagggctgggtcccagacttgagaatgagaacaggttcagaatggaaatgattgttagagtcaaggtttgaagggaatacttggaggttctagatgtg

SEQ ID NO: 12051 - DNA, 1631 bp, Homo sapiens
cctgtcggggtcttgaacacagtgcttaaccttcagtgctgcagtgttctcatcactcttaggtagagcagaactgaatctctgagactcaaagaggtctgagggggtggtattttcaaaaggatttcagtaatgaattatgtaacataatttcatgtttggaaaataagggaaaaatgataaaagctgtaccttggaacttgcctctccctgtactcactgtgagtaggtctacgtggtatcaaaacctctaaaagggggaaaatgagttcttgaaatcatgggtttaaaatgtatgtgaaatactggtctgaaggagcccagggaccttttgcaatgttgacatttcatacgaatattgaattttaaattctgagagaaggtaataaaattagtaggaggaagcttattcttagtgacaggttttagatttaaatgtaaaatgcccatattttctcctactatttttaggtgaagaatgttatctaccatgcagtgaaagatgcagttgctatgctgaaagccagtgaatccagttttggcaaaccttaatctccctgcacattggaaatgaattacaggcagctgttcaaactcttcaggcaggattcctgtggactttgagattcatgttacctcatcttcttttttaaactgtacccaacttgtgagggtactctgtctaatgtatatttctagtgtttacagacagtaaatgtgtatatgtagtaactatttacagaacatgcatccttaaactgtgacttctcacctagtgcagaacttttaccaggctgtaaaagcaaaacctcgtatcagctctggaacaatacctgcagttattcttcagctgtttggacaacttagattgggtttataactattaggaatcactgcacagtttatttgggttgtgttttgtgtctgagtcccctccctcatcccttagggtccagaagagcaatggaggaagtgacagctaatgttgcagttcttattgtatggcataggactggcattatatagcagaaatcaactactgtacaatttcttggggttaaccatctttagttaaatggaattttaatttaaatgacgctttgctaattttaagtgttaagcattttgcattaaaatattcatataatattttggctcagtttattggcattatcctctcattgtggtttcaacacaactttcttcaaatgcaggtgtaatggattgctccaagaactcttcttaaaagcaaagaaatcagatgctatagtgattttcttagtgattattacaaagctaacatggaaatttctgctcagccaggtagaaaccctgtcacactttgtcaaggaaacaccaccaattaattaaatttagaaacaggaattaaccaagaaaccaaatagtgccaggctaaatggttctaaaaaggtaagtaatgaaacactttgttttatggcccttcataatgttaagtttatgaaggaaaatgaaattataagttctaggacagtactacctaaaatattcatctctgtgaaggaaaaaaattcacaaagaagcgcctttctttagcccactgattctcctaggccactctttcatttaatttctttaaaaaaaggaattaa

SEQ ID NO: 12052 - DNA, 1623 bp, Homo sapiens
ctgtactgtctcatttttgtatctggtcagattggtccaggaatgaaaggcagggaagattgaggggctgcttccttaagccaatgtggtgttcatctttgctctttcttttcaggggccttgggcaaagcacccagtaaagtgactgatgcccttccagagccagaacctccaggagcgatggctgcctcagaggatgaggaggaggaggaagaggctctggaggccatgcagtcccggctggccacactccgcagctaggggctgcctaccccgctgggtgtgcacacactcctctcaagagctgccattttatgtgtctcttgcactacacctctgttgtgaggactaccattttggagaaggttctgtttgtctcttttcattctctgcccaggttttgggatcgcaaagggattgttcttataaaagtggcataaataaatgcatcatttttaggagtatagacagatatatcttattgtggggaggggaaagaaatccatctgctcatgaagcacttctgaaaatataggtgattgcctgaatgtcgaagactctacttttgtctataaaacactatataaatgaattttaataaatttttgctttagcacttggccccattgtagattgccctgtgcagtaaactttcaaggtgtcggctgccccagattgcttcatttgctgggtgtggaaagagttgctatggccaggcatatgggatttggaagctcagcagaagtgacttctgctctgtggttgctgctccccggctttcacagacatggtatggcagccattcttttatctatttaaccaagaggatgctggggaattgtgctgcttgtcctgttggctggtggctgcattatgtcctggggtgtgcatgtgggtctatttagagcttctgtcccttccttcccattgcaagttgcacccagatgagacagctgtagtactaggtctctttcacctctcattgcctgtccctgcttcgagctggttgtcttgtgcgtgggacatgggccttcctatctgtgttttctcaaagtcaggagctgaccaggagcacactaaggtgtggtcatgcatcataaccaacattcactcatctgggacattcttaagatacatttataaatcatttcagcagtagtactttgtatgtgttgagagtttacagagctctttgacatacgcgatcttagtctttacaaataaggaaaacagctcagtttgggaagtatcagagatgggattcaaacccagatcctctggtccaagttgtatgtgcactgaactaatcaggcaggaaaaaagcccagccactgtctcacagattgttttttgtatattgtagcaaaatcctgaaacaatggggtccttccagtctcatcatacaaaatggcaatcttggctgggtgcggtggttcatgcctataatcccagtgctttacaaggctgaggcaggaggctctcttgagaataggagttcaagaccagcctgggcaacatagcaagatcctgtctctccaaaaaaaaaaaaaaaaaaaaaaaaaaatttcatttttgagtccagaggaccctcctattactcttgatttcatcttcagagtgtag

SEQ ID NO: 12053 - DNA, 1623 bp, Homo sapiens; identical to SEQ ID NO: 12052

SEQ ID NO: 12054 - DNA, 1285 bp, Homo sapiens
gattccctttctctttcttttccccagaattttgattctgacattagcagtgtgggaatagatggctgctggcaggcagacagccaaaggcttctcaatgaggtgatggtggagcacttctttcgacaaggaatgctggatgtggctgaggagctctgtcaggtaacagtgtgccaactgggaggatatgaaaaagaaacaagggaactccttggagtttatagtatttgcagggtggggttttgagtcttcctctagctatagatagatttttaatatttaaattatcagagatgacctcattttactaggagtattttggggaattttttaagtggcaaaaattatagttctagaacttgttatccagatcatttttttcttgttcctgtcccagaaggttagtcccagttcatgaatcaaagggcgcaaaagcgatattctttcttcatgtccatttttgatatagaaggttagtatagcagacaagaggaaagggacaaaaacattgatgtttgttcttctgttctagcccagcttaaacgattttatcaaatgaatttccagctaaaattttttacttcgcattagcagcatttgtcttttatttctatcacacatgagttagaactctacaacagtttaccaataccatgtagtcataatagtagtagctgccatatattgagtgcttaccttaagccaagccctgcctttattccttgctgcaatcccatgaagtaaaaattattgtttccattctacagatgaaaaatctaaggtctggagaagtaagttgcccgaggccttaacaggttctttgtgaaagaactgggattcagtccctgattcatatgtcttcacactccgttctaagccaccatgtgctgttgcatttttgtttggaaacatgaaggaccgaaagaattagtttaaaatcagtctgtaaaccaaacctctaatctaagccttttctattttaaacaattcagataaatgataactcggtttttctctgtaccttacagggattttgtgtatgtgtccatgtaatttcctgcagtaaactgtcattgaggattgtttgcttttaagtaacaaaagacccacaattacagtggcttaagcaaaagtgaaatttttttcttgcacagaaatcggtagtaagacgtccacagcatgtttggtagctctgcattgtgaaactcttagggacttagcaccttgtacctctgttattcccagggtgtctcctgtcttcagagtccaggatagcagccaaagc

SEQ ID NO: 12055 - DNA, 3842 bp, Homo sapiens
ttaataaaatgaaattctaaagttagaagtgttcttaagttgatatttactctcttggtcttggtagccctattatatcattgcagacacagtgttgtgcatgtgtgtattgtatatgtgcaccagcatcaaacattgtgtatctggaaggaaagcagcatgttccagttctaaaatgcagttaccagacccatcactttaaatccttaaagttagaagctagcaaattttctgtagtgcagaacgtttattgctgtttttgtgtttgaatagtataatgtttgatgcctctcttctgcaaagcgtatcatctcattgactgtgaatctgtatattattctgatggatacagataatgatcttttctcttgtgaggtatcttcatttatgcactgtccaaaaatagccatgtgtaagagtctttctgtatgacgaactacatggaaaagacttctgtggacataattctgaccgaaacccatgaagttacttcagtataagaagaacgttacacggaaatcaccaaatattttgcaactttatttcttctgacatggagtgaacatcaataggaatactttcaaagaaaatgaaaacacagaagcaaagagaaatgtggcacttcacattttaaactacagatggacttggtttgagggagggggaatcacagatttggtgctaagttaattagaaactggcagcgttttacagtagtacaccagcctggatgttttttctaaaatgtttacctgggagagctggggtttgtttgtgaggagaaagagtactgtggaaaacctctgcttgagtaccatgtggccaggcctatgtggatggctactccgtgctgtgcggcttcaccagcggttgggattggcccagcttggagtgcttgtgtggtccaacctcagtctggccccatagcgacttttgccccatgattctgcttcactgttggaatcctctttgaagttccccctctctttgctaaagcagtgaaggaagagaacagagacaaactctttggactgtgaaagagaaggtagagaattccaggcaacagtctgaccaagggtgtaaaccagtttattatatatatatttttcctttgaattaaaacctagagtgttgtatttttctttctttctttttttttttttttttttttaccctttttctccttaggccaagtttagcttattcttatctttccacccaaacacctacacaacgtttaggcttcctgtaaggtttgaatgagacagatgtactctgaaggctggtggtaaatgtgtttgatgaccagactcttcatacagtcggcttgggccactttaaaggacaaaagccagagctcagctttatccctctcccagtgctgggagccaaaaaactgttgacggttttttgtgcagctcaagaaaactttgaaaagaacatgctttaactgaagcattggactctgcagctttctgtgtaaggcccgtgtactcccactgggcagggtgaggaccaaaaatctgaaactcttatgaatctgacatattatatggaaattatatcttgtgaccgtcttcaagtgcatggacttaaaattcatgagagactaaatgtgagggagaggtggatttaaagaggccagaccttaaccaaagatgctgagatacagcattctgtcccccctgccctagaaactccataaatgctgtcacaaccctatcatcgctgatgctttctgcatgtcagcagtccaggaggatgctttttgtctctctttgcctccactttacaaaagataatatgatagaggcaacgtttataacagtcacatttaattataatgtacatcaaaggcagaatttcagaatggtttcttaaatttccttgggaaccgtttccacatatcagttatagacaaaggccatgggactatgctaaaccaataaaaccttattagcaaatctttagattctgacttagccagagcatctgagtgttcaagtacagttttacagtggctaaggttgtctcttgatcttttttctccgttgtgtgatcacagatgctatttctgttttattggtgattatacgagacttctaatacataaatgaacgggtattggtgcctctttattttaaaaaatttgaagaaaagagccacctcatattcatagggtgtgtattttttgagtgtgagcatttaattgaaaataagaaagctatgaagtaaatgttaacttctctgtagcagctaatgcatagagacactaaaacccacaccacattttgtgggaaatgaggatcctgatcctcttttgtcctctccaggtagtctcgcaggttatgcagcttaagttcagtcttctttatgctgcgattgatttccacctcagtggcttagcctttgggacagtggatactgcaacagccaagaactcttggttatccgcacaagctgctggtagactacattagccctctggttttccagctcaacctctgataaagtggactgagagccacgctgctcagtctgtttcgtcagccgactcaggttattttcagggaaggcatggaggcatagtttggttagtttcatcactaggatgtataaggtgacgacacaaaccaaatacctttctttcatcacttaactatacgtactttatctctggtaacactagaatgctgtggtcttgagggaatgttagcaaggaacacatagaagatttggtgtttcataagcctgtctaggtgtggcaggttttgtgtggtacactgatgtttaccataagcaggtacaagcttcatgaaccgttcttaatgaactataattgaatagataccaaaaatagaatgacaaatgtattttaatagcagatgaggcagttttaggatgaattttccactgttgattttacttcaagacatagcaagagaaacaaaattttgttttcaagacatttccactgcagtttcaagctgtagtgggcatatgcttcatttacttccaaagaggcaaaagcagctggaattggcttacagcacatgctttgtttcatgttatgggtgaggacctacatacactcttactttagcagtcacttaaccttctccagcaaggcagttgtggggttcactaggatttagtgcctgatcttttttttgggaaggggcgggaatgaatgtgttggggctgggagggaagcagaagaaaatgggagtgtgagtgagtgtgcatgtgtctgaagttcaccattgcccccacctgcacctagcaaggaacaggtgtttgatgtattttgctcatgactgcagtatgcatgtatttttttccttctctgtgttttctaaacttacactaaaggattcatcaaatcatcttgttcagatggctcaggattgtatttattttgcttaccccgtgctcttgggttctatagtatttctataattatgtaacgagaatagtgttgcactgtaatctatcatatagagctatatgtatggaaaattttgatcaattttttaagaaatgtatcctgtttgcaaaggcacagtaaagttgcatcttatagactataggcaataaagctaacaataaaccttatttaacacaaaccacatccatatcctctgttcatttgattttggaaaaagtagcatatccagtagtttcagggaattcattttaactttaagaattctgatatatttaatttataaatttcggactgatataatagagttttggaaaactataagaaatgctttgttaatgtgtgtattcctatgtaaaacacatggcttttcctgtgtatatttttaaaaattaaa

SEQ ID NO: 12056 - DNA, 2174 bp, Homo sapiens
cttctgagaagggtaaagttactggtacgtgacctgggaggtatctgaccatcctgatgctaccctttggcatataatgtcaagatactcagcttttatgctgaaataggttgtaatttgtttgagctgctttgtttttcaaagctctttttaagagcaaaggaggccaggtgcagtggctcatgcctgtaatcctggcactttgggaggctgaggtggatggatcacttgtggccaggagtttgagaccagcctggtcaacatggtgataccccatctctactaaaaatacaaaaattagctgggcgtggtggcacacacctgtaatcccagctactcgggaggctgaggcaggagaatcacttgaacccaagaggcagaggttgcagtgacccaagagcaaccccactgcactctagtctgggcgacagggcgagacgccatctcaagaaaaaaaaaaaaaaaaaaaagagcaaaggaaatgctcaggacaagatgatctggtaagaattttctcccttttttgcagaaaatcccgttttgtcaacctaatgaagcattcaaagaagacatatgactcttttcaagatgaacttgaagattatattaaagtacagaaagccagaggcttagagccaaagacttgtttcagaaagatgaaaggggactatttggaaacctgtgggtacaaaggagaggttaattccagacccacgtatagaatgtttgaccagagactcccatctgaaaccatccagacctacccaagatcatgcaatattccacaaacagtggaaaatcggttgcctcagtggttaccagcccatgacagcagattgagactagactctctgagctactgtcagttcacgagggactgtttctcagaaaaaccagtacccctgaactttaatcaacaagaatatatttgtggctcacatggtgtagaacatagagtttacaagcacttctcctcagataacagtaccagtactcatcaagccagtcacaaacagatacatcagaagaggaaaaggcacccagaggaaggcagagaaaaatcagaggaggagcggtctaagcataagagaaaaaaaagctgcgaggaaattgacttagacaaacacaagagcatccaaagaaagaaaacagaggtggaaatagaaaccgtacatgtcagtacagaaaagcttaagaatcgaaaggagaaaaaaagccgagatgtagtctctaagaaagaggaacgtaagcgtacaaaaaagaaaaaggaacaaggccaagaaaggacagaggaggaaatgctttgggaccagtctattcttggattttgaagctttcaaagttggttctcccaaagttaaattgaaaaaataggtgagagcttggttttatgatatccgtgttcataccacttttcttatgtgaataggttctttaacttctaacaaaggcctagtaaacaaagtgtttagcatgcttgctctccaacacagaaattgcttttcctcattttctaaaagcattattacattttttgaacatatagtgtaatttcctttaatgaaagtgactctgcttttattcatcaaattgctttgatggtggaaatattttctgttgggaggttatttattttaaattggaggattaatgacctttgcacaatctgtttcttgattgggtttgttatagttttgagttgggtattttatgttcattggtttttctctgtgaagcaatttttttctcctttattagatctaacttgcagtgtattttctaggctggaaagtggaaaatgaaatatattataatcttaggttacataaagtttctaaagtttcaaagagtcttgatacaaaatcagtttatattctgaaaatatttataataaagtattctaatttctacatgttgttgtgtgtcagtctgttcctatttaacaatgatttttctcttgggaggaggagagaataacttggcagttcatcatacttaacaggcaagatcttttgggtaggtcacactttgaagctgtaaaaattccttatctatcataccttgcttgctcacatttgaacctggtttttaaggtagaaatctatgactgactgttacaggaccccaccacttacccaaagttagcctttgggtcgggggtttcctcactatag

SEQ ID NO: 12057 - DNA, 1239 bp, Homo sapiens
taaaaatcatatttatgtttcagggatgtgattaaataatcctttataatgtgttagaaaatcaaattacccaaaaattgtccatgtttttttggaatgagggttggcaaactagtgcccacaggtcaaatccagcctgccacctatttttataataaagttctattggaacacagccatgcccattaatttacaaattgtctctggatgcttttgtgcattgacggcagagctgagtagttgtatcagagacttgaaaactcgaatatggctcaaaagcttaaaatatgtacagaaatattttgccagcactgattttaaaaactgtacagtgatcaaacctggccgttttatcacaaaacaatttttatattttcagtacgtgatggttcaagacatgctctctccatcccccatggaacgacctgaagctataaacatcattgaaaatgctgtatttgaggacttggactttccaggaaaaacagtgctcagacagaggtctcgctccttgagttcatcgggaacaaaacattcaagacagtccaacaactcccatagccctttgccaagcaattagccttaagttgtgctagcaaccctaataggtgatgcagataatagcctacttcttagaatatgcctgtccaaaattgcagacttgaaaagtttgttcttcgctcaatttttttgtggactactttttttatatcaaatttaagctggatttgggggcataacctaatttgagccaactcctgagttttgctatacttaaggaaagggctatctttgttctttgttagtctcttgaaactggctgctggccaagctttatagccctcaccatttgcctaaggaggtagcagcaatccctaatatatatatatagtgagaactaaaatggatatatttttataatgcagaagaaggaaagtccccctgtgtggtaactgtattgttctagaaatatgctttctagagatatgatgattttgaaactgatttctagaaaaagctgactccatttttgtccctggcgggtaaattaggaatctgcactattttggaggacaagtagcacaaactgtataacggtttatgtccgtagttttatagtcctatttgtagcattcaatagctttattccttagatggttctagggtgggtttacagctttttgtacttttacctccaataaagggaaaatgaagctttttatgtaaattggttgaaag

SEQ ID NO: 12058 - DNA, 1199 bp, Homo sapiens
cttgccacatcttgttcagtggagatccaagattggggctgaggtatcctggatcacattgcctttttgaggccatgttttagtatgaatttaagactggtgcattcatcttgacttttacactggtttgttagggcatattaattttgctgcacttaatgaaatgtatcctgcctttaattaagaggtaaggcagactgtgtgctacctcattttaaggtgacattgatgtgtttggggaaaatcactctgatgtagaagtacaaacatttgtaagtttttgagagaaaatctgtcccttagctgttgtaagggacacatcaagtcagtccacaaccctcaaaaccattgtgtctgaagggtcaggacaaagttcttgtgggccctcttgtggcataaatcagtagagcactcttttccagaaggttatgttgttagttttctcatcacataattttagtatttgcttcttcaatctagaagagttctatattattttgtccctttctttaaatgtaaatttctaaaacacacctttgtaaatttaaggtggaatttcagtgttggccactttgaacttcggtatattccagacatggaaacgagagccggatttattgaaagcacctttaagcccaatgagaacacagaagagtctaaaattatttcagatgtggaagaacaggaagctgccataatggacatagtgataaaggtttcggttgctgactggaaagttatggcattcagtaagaagggaggacatctggaatgggagtaccaggtacctaacaccactgaggatttaaaatacggttcttcctctcccagtctgaccaaacttattgattgggtggaacgaaattactactacttggggctctcagcttgttctctgtgcttttataaatttgtgattttaaatggtattttatgggttggaactatataactactgcttgaattatttaagaccttttttccatttttgtttagttttgtactccaattgcatctgcctggttacttaaggatgggaaagtcattcccatcagtctttttgatgatacaagttatacatctaatgatgatgttttagaagatgaagaagacattgtagaagctgccagaggagccacagaaaacagtgtttacttgggtgagtaaatgtatcttatctaacgatagtacacattgac

SEQ ID NO: 12059 - DNA, 1135 bp, Homo sapiens
gagtctactttgggatgcaggatggctcagtgaacatgagggagaagcctttctgttgaccctgcaaggagcagagtgtgttcaccttgagtctccagcccacagccaaggtggacgtacctctccaggagcctttgccttaatgtatctctgcctggacaacttgtggtggggggtggggggaagagtgggagggggagttaaatccagtcttatgaagtattgttattaaatgtctttttaaaaagagaaatataaacatatatttttactattaaaatattcagttttttaaatgaagtagaacttgagttcatgttttatatgaaatatttaccaaaaaaaaaaaatgaggtaaactgtatttaaaacctttgacttgagtctgctggtaaagcttctgaatattgagtttgctgagaaataaaaatcaaaacttctttaagctggtaaagtgaggggcccaccagcagtgatctcctgatgccttactggaaactttgtttacttgtctgctaccctctgatttgtttttagttagtttttattgtgagcacacatagtacctagttacatcttaagatcaggtttataaaactgtggagtggagcggtatggtatggaatgacttggaatgtaagctgtcagggagaaaatgttgttacacttttgctaagatctgggggtttcttcatattcctgctgttggaagcagttgaccagaaatgcttgccagtactgccaaagcactgctgtgaaatgtgaagtactttgtttttttatttttaatgattttctttttgttattaatatttttctctgttcctttgttattacttgcatggtttggcgtcagaagtccttacctctttatattgtttgcaggtttaaataaaacagtgtggtgccattttgactcttttgtctttattgtagaatttaaatttaaatggccacagaaggaaagccaagatgggagaggaatcagttttgcccacccagcgtacatcagatctgtgataaggggtagaattcactcaagaaatcttgaaccaaagaataggtaaatactttcattatttctgggagagctatcttccagatatgtcagttatctaaggaaatatgccatagc

SEQ ID NO: 12060 - DNA, 1105 bp, Homo sapiens
tgtgtgggccctacgatgagatccaggggaaggcccccagctcctggcctgctctcagcctgtgtgatgataaacaccactgctccgggtgtacgttcctcatccctggggtggagttgggatgtgtggctaggaagacttgctagatcatggagggaccaggctgctgggcctcaacctgaccagcatctccaccccccgccccactccagccagtgtagggagctctgcggtgatgagcacggccattatggcaacgctgctgctcttcaagcatcagaaggtagggggtgcaatgtggtggggacctgggcggtggggggggtggcgatgtgtggccctgctgcctagccctgctctgcccacccagggtgtgttcctgtcgcagctcctgggggagttctcctggctgacggaggagatactgttgcgtggctttgatgtaggcttctctgggcagctgcggagcctgctgcagcactcactgagcctgctgcgggcgcacgtggccctgctgcgcatccgtcagggtgacttgctggtggtgccgcagcctggcccaggcctcacacacctggcacaactgagtgctgagctgctgcccgtcttcctgagcgaggctgtgggcggtgagtcttgaggtgcacggggtaggtgggatgtgtgtgcagtggtgaagggaacggctccttcttcataatggaccctccgcccccagcctgtgcagtgcgggggctgctggcaggcagagtgccgccccaggggccctgggagctgcagggcatattgctgctgagccagaatgagctgtaccgccagatcctgctgctgatgcacctgctgccgcaagacctgctgctgctaaaggtcaggcctcccctacggcccacttggtcctaggccttcccctcttggtggtaggaatggcccatccctgcccatgctctacctctgaaacctcctgggtagtaggtgtggccttgcccggtctttggctaggcccctgcccatgtgcctggctctcctgaggccacatgggtgcctttttctcccagccctgccagtcttcctactgctactgtcaggaggtgctggaccggctcat

SEQ ID NO: 12061 - DNA, 1126 bp, Homo sapiens
atcggcttccttacccagcacccctccggtaggtgggtggccacgtggatgcctcgctggggcggtcttggaggcctggtctctgcctcgacgggagatccccgatcactggcattcaccccctgcaaaaatcggggcgacaatagctcactgcctacttgctgcagggagatgaaaggctttgcagaaagctttgagctctgtgggggaacacactagagaaccaaaaatgtgattatatggtgatataaaaatccctttcctctgtgtttaccaccacctgtcttcctgtagacttttgttctgtccctggggtgtgtgaattcctaccccgaactggaagccgggagtggcagacagaatcactatttcaagttaaaggatctctttgagaatgtgttcttctggctgcaaaggtctgagttattacgctacatgacaacgtttcgacatttcaccggcaacaccaagagggtttttagtggcttgggtctccccagtgggggataagtcttttgtcatcaaggaggcaaattgtctccccaagacagctcaaaatatccacacctcggcaacagtctaagatgagagcctgtgacaggtggcagcgcccccaggtggggtactggcatcagagcctggtgcgcccctaggggagcctcccactggagtgcccggccaggtctccaagccccaaatgagtccttgtgaaccacaactgatccccccaggtgggtgcttgtggactgcctcggacccagccacgctgctccccgcaatgctgatggggctgtgcattgaggacccctgcttcctggttctcagtcccaccccaaaacctggcacccagaacagttggaagtgtggaaaggaggtttatcggccttcccttggagagggcctggcttcaacattgggccagtaggcatcttagcttggcaggtgtcgggggaatgggccagatggacctgctagatttggaagggcaccgagggagttttctgggtgtagagagaatggaggggaccaaaaagagtccttcctggggtgtgggaggcttcccagcttggtcctcagtgggttgttgaggccagagtatcgccctgggatgtggtggggagctggg

SEQ ID NO: 12062 - DNA, 2555 bp, Homo sapiens
tcattttgagcctactgttggtttgtatgtcagcttaacctgattctcgtctcctgacaggcatgccagatttcctggagaagctgcacatggccactctgaaagccaagaatatggagattaaagtaaaggactacatctcagctaagcctctggaaatgagtagtgaagccaaggccaccagccagtcctctgagcgaaagaacgagggcagctgtggccctgctcggattgagtatgcttgacaggctttgggataagaagggacaaggtgcttctagccctgtctcagtccgttatcactctgctgtagaagggggacatgccacatgtattagaaggcatctgctgtaacttccagtgcaagataattcaataactgatgtcccatttcattcagagcccttattgctcttatcaaaacagaagaaggctacatttgtgggagtgttgtcatattctcaggccaactgttttgaaattcggtatctcactgagctaatctggaacaaacctctcacctcaggccagaaggggatgacctccatttgcttctctgagtagtttcctctgctgacattccaaatcccaccatcgattgtgcagcgctttggatttccttcagttctccaggtccacctggaaagtatagttggccagttgagtctctcaaatgaggggctactgggagtgctcttggtaacaatcatgatgtgaatgggtgtgaacgatacttggctatgttaagtgccttgtccgcaccttgcttttatctctagagacatgaagttattattaattttttttttttttaagtagagatggagtttcactctgtttcccaggctggtcttgaactcctgggccatgcctggccagggacatgaatttgtacaaagaaatttccctccctgcctgcacaatatcacccattgactcaccttatccaaagcaagtttcctgtgaatcggccagttcttctatattcattggatcattgcctccttcctaaccttccccatttaccaagaacactgggagactaatccttttagatagtagctttttgatgctcaaaacatcacatttaaatttagtttaaaaattttttaacttttgtgtcaaataggagttgaggaattgagcaggattctaccctagtccgattgtatagaaaacaccattttgattcaggtattatttttcatatttcaggtttgacttgttcttttcagaaggctaaagtcagaggaatgggggctgggccactcccttggagctctcagatctacagacaagctgtgtgaatgcatagatgtaatcttgtctcaaatactaatacagtggagatttggtttatgttaccattaagttcctctaaaaagtttttcttcctctcttcagagccaaaataaaagtgaactacactgttcagataaggtcacaatctgatgctgtcagtttgaccgagctggttttgcttatggtcatgctgcaatttgttagaataatagggatcaagttttaaatcctcctccttcccttttttctggagtcttgagggccagagtttttgtttttgtttttgtttttgttttcctgcttgctactgttttgtggtgttgaaaagtggtttaaacctgagactaacttaaacacttccttgaccttcttgttgcctgttcatttttgtgccaaggaagtagctgccccagtgtatgtcttgccttctccgcgtcattgttggaagaggagagatgcatcgagcagtcccagctgcttttcatttattacttcttctttccaggacctgacagaagtcagggaagagtccctgggttatgtccaaacttagcacctgcaattgttgggatgtggatggatgtgtgcataagagagagagagaatatgtgtgtgtgtgtgtgcgtctgcgagcgcacacacatgcacaagtgcgaaggagttgcggttgctccatgttctgacttagggcaatttgattctgcacttggggtctgtctgtacagttactcatgtcattgtaatgatttcactcctaactgtgacatttttatcaaatgtgtgaataaatacataaagattggtacaaaaaaaagtgtttgtctttggacaaatggtggtggaaaaatcttgcatattggacttaccatttctttctgatcacaaagttgaaaagaattttactctgagagttgggaggtggaagtggcagggcttgttcattcttggtagatagtggctgacacagtttgcctagaccacgagccctttccaagtgacctgcttggcaactgaaaataaaccacctatgtccacttccctagcttgatatactgacccatatcctttccctttaaaaaaagatcactttggagggagcagtgctagagcttagcagacggtagaaatcaggagggacagaagcaggcctgaggtctagggttgaggttgaggagagggtcaagtcagcgctcttggcggaggggcagtcctgctggcatgctctgagcataacatgagtttatgtgtaattt

SEQ ID NO: 12063 - DNA, 1237 bp, Homo sapiens
gttaggtcagatctctttcactgtctcagttttaattctgcaatggcggttatcactgggagcccccagcccccgcagagacatgcggagccccgcccccaccctgcactctaataaagaagggggccagcgtgccggcctcttaaaacaagttaacacctggcaggattctaacaggaacctggccaggtttctccgcggggcggggctgggacggccggaagatggcggcgacggcggcagccgggtccgagggtcactctccaatgcgcccttgacggctctcgccgccgagccacctaccttgctagcaggcggcctccgcgcatgcatgaaggggcaggagggggcggtgacgagcacttcacggcgccaatgagcacccaggagcccaggtcgcgcccaatcacggcccaggtggcggagaaaaagtagggtgcgcgcgcgccgcgcgtgtggcagtcgcggaaggcgcgggagcttgcgtgctgctgggcctgagctgtctgtctcgtttctgtccgcgcgccctgcatcccggccccgggcgcccgctggaggtcgccgaggagccacagggctgactggtctgctgcccgggcccaggagtgcctggtgtagcagtcgcggagccatcccggcgtctgctgccatgaccgactctcccctcagaggagactcttcctcagcggtggctgcagagacagatgagcggcggctcctggccgcgggaccgtgagacgggttcgtggccggccatttagggggacgctgcgaccaccgcctgcgcccctccggactggttccttgggccccggaagctcgcggcgggccctgcgggaggcggcatgctcccgcggaggctgctggccgcctggctggcggggacgcggggcgggggcctgctggcgcttctggccaatcagtgccgcttcgtcacgggcctgcgcgtgcggcgcgcgcagcagatcgcgcagctctacggccgcctctactccgagagctcacgccgcgttctcctcggccgcctctggcgccggctgcacggccgtcctggccatgcctctgccttgatggcggcgttagccggcgtcttcgtttgggacgaggagaggatccaggaggaggagttgcagaggtgggcgctgcggcgagctctttctgggccgtggggtgggggggcttgtgaaccctggggcctgccctgtggtcgttggcccttgtttacccggtggtc

SEQ ID NO: 12064 - DNA, 1150 bp, Homo sapiens
agattatgctttcctgggaaccgaaatttaggtctttcctatccagcctgtccgattttaggttggattaatgaggttttatttcatctggaaagcagtgaagaagaaatgtgtatgtaacagaaagtagtatttgacaccgtgtttagccaggggttttttgttttgttttgttttgttttgagacggagtctcactctgttgcctaggctggatcttggctccctgcaacctctacctcctgggttcaagcaattcccatgcctcagcctcccaagtagctgggattacaggcccatgccaccatgcccagcaaattttttgtattttagtagagacggagtttcaccatgttgcccaggctggtctcgaactcctgacctcaggcgatctgcctgcctcggcctcccaaagtgctgggtttgcagacataagccactacaccctctctctaaaaacatttttaaaaggagccaatgaggcctgcgcaagccccaacccattggtggtttgttgttgctatctgcctcataaagcagagtggagggtttgtcttttgggaagatgaagtgtcttctctaaaaaagcctcctacatagttggccttggcatctgccaggaatagaagggcagggcttgaggcttcctgagtctgggttttcagttgaggtggagagtgaatacagtgattgtaaccagaaaacccggagtggggtggagttacctccggaactcatcactgttaactcagcctggactttgtgacagttagagaagtggatttcttaataataataatttttttaaaggagcactttggccgggtgcggtggctcacgcctgtaatcccagcactttgggaggccaaggcgggcgaatcacctgaggtcaggagttcgagaccagcctggccaacatggtgaaaccccatctctactaaaaatacaaaagttagccaggtgtggtggtgcatgcctgtaatcccagctacttgggaggctgaggcaggagaattgcttgaacctgggaggcggacgttgcagtgagccgagatcatgccattgcactccagcctgggctacagagggagactctgtctcaaaaaaaaaaaaaaaaaaaaaggagtactttgtgggtttgattttatatg

SEQ ID NO: 12065 - DNA, 1218 bp, Homo sapiens
ggacttgtccacagaaaggcagagtgaagtgggcggccggctcggaaaagtcctgtgcccagaagggagccagttctgacctgagtgataatgaaaggcttcctggaggacgcagcttgagccacacttgatgtgggagtgaactgggatagggacactcctgctgagagaatggcaagagcaaaagcacactggtggccaggaggtggtaagagccgaggttagaaaggtgaggggtgctcatttaaggcactaacagcagaaggagcccaggaaggattttcagaagggaagggagggatgcaaccttattttaatgactggtgacagtaggaagggttctgcctggccttaagtgagggtgttgaaagtgggagacaggacctgccaaaggggaagagggcggtcacagtcaatcccagggcccagtgtctcagccaggtgctggagttgggaatgcgggagccccagtctctgcccacctgtcacgtggcagctggaaggtggcatcaactgcacaggcgaagaggggcccgcacacgagaagccatgggatgtgaagggccgcaaggagaggaccctgggacacaggaagaggtggtgcatctggggcagggcggctttcccaagatgactagagaatcttcagctggcatcttgcctgaaatatccacgctctcagccactacactaatggaacacagatgctatggggagacagaagggaactgacaaacttcatgcccctgttttcaaatagcctgcaatcttacctcttcctctgcattttttggggggagtgacattttaatgggaggcaggaggtttgtggagaagagaaaatgttttttttgtgggggtgggtagagacagtctcaccatgttgcccaggctggtctcaaactactggcttcaggcaatccttctgcctcccttcccaaagggttgggattacaggcttgagccactgcaccaagcctgaaaatgtcgttttgaatgagcccacctgaaacgaagacgcttcattagggttactggtttgagaattaagatcagttctggccgggtgcggtggctcacgcctattatcccagcactttgggaggccgaggtgggtggatcacaaggtcaggagatcgagaccattctggccaacatggtgaaaccccgtctctactaaaaatacaaaaattaaccaggcatggtggcaggtgcctg

SEQ ID NO: 12066 - DNA, 1942 bp, Homo sapiens
ccctggtgcctatcaaggaccagagtgaaggggactacatctcccagcccttcaccttttaaatatgagtggttttaaaaggaaaaaaatgaaaccaggcaacagcaacaatattctgtttttaaaatagggacaagactgttgtcactttttagacatgtatcccattccttttggctctgcaatatttggggctgtagctccttccaagcccatggtagtccctccccgagtctctcccagtagaatgcagcctcccttccctggccccttccctctcagtgacggtgactccctggggccttctcgtggaacccagaggggctgaggactgtggcctggctggcgggccagcgtggtgctcctcaggactgcagcactgagatggaacctggcctcagtttaggaacaggggccacaacagggcaggaacccaccaccctccacataggaatacaaccagtggggccacatcatgtgaggcatcagacccacactgtcagcccagcaggccgggctgtgtccttcagacccagtgctgccctagactctgactcgggactccagcttgccacgtgccctctcccctcttgaatgtactctggtcttgcagtgtgctgctgggactttcttgctcagccatcactctggtcaccttgtttgctctgggtctggctgaattttctgccctgagatctgggcataaagtggatgaaacttgaaagaccttcagtgtagatccagatggccaacctgtccttgttaagttacttgcttcttgggaatcagtgtcccctgctgagctgaaaaggaaatggattccaatctcttccaacctttaaggtgatagatagtttgagcaagactggagaatggacaacactatgaagctgtggctagaaagggactgtcatgtcccatcctttggccagattgactggggatgtccggacagatgcctgcatgggtggtgagggccacatctgcacacgagccagtggctgcttgcagttcactgctgtgatgccagagtgtgttcaaaggtgactctcctgctcttctggactcttctctcaggcaagaaaggctgcaggctgcctgctatgtgatgcctgagcacaaagccaaggaactgaactaagtctttctgttaagtcctgagtttgtcattggcaggtttacttgtggccagctctctctgcccttgggtgtctgagcaggcagaccagaagaccaggcactggacctgcatgccaaagggactggtcatctcctgaggacctgtaaatgaccctgtggactgttccgcacgatccggaacccactttttattcactccccatgtctttggccttcctcttctttctctttccctctgccatcctgacactgatagtttgtcatataaattccccgggttgtgtttttttttctagaaaaaaattaaaagggaaaacaaaaccaaaaaaaccagaaaccacgaataagaatggaaatgacaatggctgcctgtcatttttctgtcacgattttcctgatttggtttgttccctttgtctcagagaagcaggagatgttgatgaggctgtatttttttttctttttcttgtttttgagacaagagtctcgctctgtcacccgggctggagtgtaacgtggcatgatctcagctcactgcaacctctgcctcctgggttcaagcgattatcctgcctcagcctcctgagtagctgggattacaggcatgcgccactatgcccagataatttttttgtatttttagtagagacagggtttcaccatgttggccaggctggtctggaactcctaacctcaggttatccacccaccttggcctcccaaagtgctgggattataggcatgaaccaccgtgcctggccaaagatgtaatttaaaatagttagaagggacttggcatggg

SEQ ID NO: 12067 - DNA, 1283 bp, Homo sapiens
ccaagtgaggaaagtgcagttcataattgcatgtcgttttttaggataatcatagtaggggaaagaactagattgcagcatctgaagatataagtgggtgatatttgtgactccttattagttaaggaaacattttaataagaggtttttagctgaggcctgaagttagggaagagaacaggccaggaactatggaacaggtctctctggcctaattagtcaggtatacccactgatgtcactttccttccaggtgtcagctgacaggggctctggccacagcttgtggggatgacgcgatccgcgtgtttcaggaggatcccaactcggatccacagcagcccaccttctccctgacagcccacttgcatcaggcccattcccaggatgtcaactgtgtggcctggaaccccaaggagccagggctactggcctcctgcagtgatgatggggaggtggccttctggaagtatcagcggcctgaaggcctctgagctacctcgactttggacagagtaatgactccccagaaaacgtcatataagactttaccagcccctgagaggaccaggaggagcatccttgaccttcatttaacttggctcacttctcttcagacttgggtagaagtgcagagccacagaattgctttccttccccgcctttgacatgaggccttcagtaaagagctacagaacatgagtacattgttataccacagatttttcttgcattagggcacagtgttaaattttttggaggtaaatatactatttataatcactatatatagtaggagggggtatgtgtctcaggcttttctgaagttgcaagacttaaagaaataatccatctgcatcccaagtcctattttataaggatattcataaaaattccatggtgaatccttgtctgaaataggtcctcccttcccagtttctgtgtaagtctttgcatttaagacatccaatcaataatgaaggaaatttttttctgaatgtaggtttgagtgaggggcacctctgctttcccttagcaaccctcatatacctccctgcaccgttacgctgtgatggcaactggggatagaaaaaaaatggggaaagacaggaatcctaaaagggagagttattactggccacaagccctgtattctcaacagggatgcaaattggttcttcagtaaggataaaaaaaaatcacaagcagttgtttgtggccctcctaaggcccacagcacatatagtgtgtctgtgatattccattttcatggcagggagtga

SEQ ID NO: 12068 - DNA, 1219 bp, Homo sapiens
gtatctctaaggaactcaaagctcctaggccccaaagactagacctctaatagtagtaccttggacttagtggcaggtactaagtgggagaaggtaccttggcacaaggaaatgagccagaaccaacaaatgaattcatctacttaaaaaattaagtctgtttgagacaacttttgatagtattaaaatgttaaatctaattgtatttcgggaagaaactttggaaagctatctgatttttgttctctcttttgtaactgtaccattttcatggttgcctatggtcatcaagttttacatgctgaaattcttggttttggatcactgcagaaacgtgaagagggctggtgggtggtgattggagatgccaagtccaatagcctcatctccatcaagaggctgaccttgcagcagaaggccaaggtgagtgtgtccactggccctagcatttgttctggcatgggggaagggtgagaatgcttcctgtgtccatgctcatcttgatttctgcctgctctttctaggtgaagttggactttgtggccccagccactggtgcccacaactacactctgtacttcatgagtgacgcttacatgggatgtgaccaggagtacaaattcagcgtggatgtgaaagaagctgagacagacagtgattcagattgagtcctgaggcatttacttttgggtaaaggagagttgagcctgaattaggaatgtgtacattgtaggaatcctggttgtggggaccaggtctgtgggcctcaggtctggccagccagggctggtgctgtccccgcctacctccacttcctttcccttgctcactctggatccagtgacagcaggtgtcatgggtcaagcataaatcatatatagcattttcaggcatgttcctggtagttcttttgagtctgacattctaataaaataatttgtagaaaccatttgtctttgtagtgattccaaattaaaagttttctttctccaacctgagggcacggccaaaaagatctggttattttttagccaggaacgtgcttgttaatgagtatgtctggaggacagacctgctcattaggtgtgctgtcccctgtagcctcgtgagtcagcccagaggagggtacatgcgactgtggcctggcctcagtggtacccacacatcagcactaccacaagaaccaacactgagcctcggaagctagatcacaggttag

SEQ ID NO: 12069 - DNA, 1131 bp, Homo sapiens
cgtgacttgctgtacctctgttcccactgcgtattgtcaccagtgatgcactttctaaatgtgtggcttcttccattttggtattagttaggtctcacacagggaccatgccctgttgatttgcccttggccctctgtgaccgtgttgtcactaattctttattactccttctccctctccaacccacaggatttcttcaagaagttcttatatgagccattgccagtagaatctcacctggaccactgtatgcatgaccacttcaatgctgagatcgtcaccaagaccattgagaacaagcaggatgctgtggactacctcacctggacctttctgtaccgccgcatgacacagaaccccaattactacaacctgcagggtcagtgggcttgggagcacacgtgatcctttggtggttctcacagtctttgctgggcatcttcttgaggctccccactcacctctcgcctccataggcatctcccatcgtcacttgtcggaccacttgtcagagctggtggagcagaccctgagtgacctggagcagtccaagtgcatcagcatcgaggacgagatggacgtggcgcctctgaacctaggcatgatcgccgcctactattacatcaactacaccaccattggtgaggcccggcatggcccgtgtcctgtctgtgggagcctttttacacgggtcaggagcccactgggatgagaggtgcgcccgtgtttgtcagcgggatgacactgcaggggacagcaggggagcccgggcagttctgctccttctctgcctggttttagcttctctcacatttcctttttctgtcagagctcttcagcatgtccctcaatgccaagaccaaggtgcgagggcttatcgagatcatctccaatgcagcagagtatgagaacattcccatccggcaccatgaagacaatctcctgaggcaggtgaggacagcagacttcaggagagcatcctgggaacaacaaactcggcctgtgtgcccagagcacatggcatccctgccaccaacacgcccatacgcatcccccgacccccgccatatgtcctcccgctccatacctccctcaaacccatctccatcccattaccacccacatgcctc

SEQ ID NO: 12070 - DNA, 1177 bp, Homo sapiens
tgaaatttgcagggtcatttcctcagtttgtgtattaaagaaaagctgccccagccaagcgtggtggctcacgcctgtaatcccagcactttgggaggccgaggcgggcagatctccggagatcaggagttcgagaccagcctggccaacatggtgaaaccctgtctctactaaaaatacagaaattagctgggcgtggtggtgtgcgcctgtaatcccagctacttggaaggctgaggcaggagaatcgcttgaacccgggaggcggaggttgcagtgagccaagttcgcaccactgcactccagcctgggcaacaagagcgagacttcatctcaaaagaaaaaaaaaaaagaaaaagctgccccatcgcatcgcatagaggctgctatgggattagaacgtagcttgagatctgcaggtcaacaggtctgtttggcatctcaggttttcctcacataagtgaaagatgcctggtatggcctagtgttgttctgcctccctcctctgcccgccaggtatacatggactggtacgagaagttccaggacaggctcaacaagaaggtggtactcctgacaggcgagaccagcacagacctgaagctgctgggcaaagggaacattatcatcagcacccctgagaagtgggacatactttcccggcgatggaagcagcgcaagaacgtgcagaacatcaacctcttcgtggtggatgaggtccaccttatcgggggcgagaatggggtatggcgtgaccttgcagcacagatgagggactgggactgaccaagtggccttggcattggacctaatgtttgggtctgaggacggaggctcggggcttctccccagaggattctacctgctgccctattccaaagggacaatgttaacttttttggtagtactttaggaaaacagtattgtttagtggaggttggctgccgtggaggaggtagaaccaaacacatgagagctcctagttagaaggaagaatgaggtcattttgaggctgttgggctgttcacaaaggggacctccaggcagaggatgggagccttggcctgcagtgaccctccctccctccctctttccagcctgtcttagaagtgatctgctcccgaatgcgctacatctcctcccagattgagcggcccattcgcattgtggcactcag

SEQ ID NO: 12071 - DNA, 1205 bp, Homo sapiens
tcagatactgagtagcttgctgactcctggaaacttctggtttttgttagtatcataatgaaggcaaagagaactaggctgtcatctttcagcctctttgacttactctagatgttgggagcagtggttgccaggtgaaacctgggccctttgtctttttcaccatgctttgggcagtttctgtatccagagagtccgcaggttcagataagctgaagaagagtaatagaacagcaaaggaagtggcttgaaggatgtgctagtaagccctgtggtttgtgcttaggtctctgctctgctacccaaggaactggtggttcagctggagataaaaagaagaatttgccaagtcagagaagaaaccccaaccccggaaaatcctctgtctccagtctctggaggtgaagcagggacaataagctaaggtagtatcttggccatcccaggaaacttgtggcattaggacgatgaaggccatgcttcagtgttttcgtttctatttcatgagactttttgtcttcctgcttacaagtgggaagatgattgacagtgactctactatgcagggctgttggtaccaacctgagccctataggtggcagtccctggagaagtggtcacagaagatggagctctgatcccctgcttacctcttcacaacacttgtgtgcaaagatagttttagatttggtttagaagctatcctccagaacaggctcccatacttagaatgtttctagttaaggtaataaattaggcaacccaagtgtgactccactcaagtgtccttttctgtaggcaggaagggcccacaacatggcttaaaatgtagtccatggttctggcccacagtacagtgtgtatctataccaggtcacctgtgttcaatctgggagccttcctggccagtctgagtggcagccagaagggagctcatagtgtctaggagtctcaggcaaggtaggtcagggtactgtgggcaggggggatgtgtgtgataggagagggtaccctaaaccccataccttccctccctgacctgaaaagctgatctcaacagggattcacacagaattaggctgtgtttttgcattagctggtaggtgactttctcaaaattcttaaattcagaaagtatttagtaaacttgaggaaggtatgaaatctggaggaggcatccaggacccaggggtttgatagcttta

SEQ ID NO: 12072 - DNA, 1177 bp, Homo sapiens
atgactagtcttgacttgtactgtgtatattattgtgtgtatgtgtgtattattaatacaagtgtgtgctgtgacgatttgatttggtaggattgagaccagaagaatctaggtcttgtgttttaggtcagtggtcttagactaagctacttcgttttactgttccctagcagagacataaaactatggcataatcttctttatatggtgtacatacatggggagcgtccccagggtttgactataattcctcagagtttcccttataggactggctggacaatggcccagaacaagctattcaacaagatcctcaaagccctgcagtctgaccggcttgcccgcttggccaacgaaggggtaagacaccagcaatccgcccacagtgggctcttcgtagttcaggcctcactggctgactgacttgtccccctgcttgttaaccaggtagtcctcatgttttattacttccacttacatccttcaggcttgtaatgagccagtgctgcgccgtgttgctgtggacaagtgtgcaaggagagtgcggcaggctctggcaagtgtgagctgggataccaagctgatccagtggctgcacaccacccttgtggagaccttgagtctgcccatgctggcagcctacctggatgctttgcagacgctgaaggggaaggtaaggctgtgattggggtctgccctgtcctagggatagccatcctcccctgtgggttcaggatgtggggttaggcaaagtaattatctggtcggtctggagtgcatggccaaaactaatgggtttggtactaaaattgggagacagggtatcatttcacatttgtgtctggtgtaaacgttttcagccctgctggctccaggatgaggtatggggcctgaaaaccagagtatacatttagccttcctagccttgcagcttgtggtttgagtcatggctgaattgaattatcatgaaggagacgaagggtttaccagggaagagtttgttgagaaaggtgacagaagcagacccttggtgctcggagcactgggagattgcagagcaggaacgtgccgtgatgccttcaattctgctccccagggcatgagcctttagtagcaacacttagacttttataattcagtacaaacatatcattatagttccctgctttcttactta

SEQ ID NO: 12073 - DNA, 1382 bp, Homo sapiens
ctgtcactggagttttgaatgcagggaccccgcattcccatggttgtgcatggggacatctaactctggtctgggaagccacccaccccagggcaatgctgctgtgatgtgcctttccctgcagtccttccatgtgggagcagaggtgtgaagagaatttacgtggttgtgatgccaaaatcacagaacagaatttcatagcccaggctgccgtgttgtttgactcagaaggcccttctacttcagttttgaatccacaaagaattaaaaactggtaacaccacaggctttctgaccatccattcgttgggttttgcatttgacccaaccctctgcctacctgaggagctttctttggaaaccaggatggaaacttcttccctgccttaccttcctttcactccattcattgtcctctctgtgtgcaacctgagctgggaaaggcatttggatgcctctctgttggggcctggggctgcagaacacacctgcgtttcactggccttcattaggtggccctagggagatggctttctgctttggatcactgttccctagcatgggtcttgggtctattggcatgtccatggccttcccaatcaagtctcttcaggccctcagtgaagtttggctaaaggttggtgtaaaaatcaagagaagcctggaagacatcatggatgccatggattagctgtgcaactgaccagctccaggtttgatcaaaccaaaagcaacatttgtcatgtggtctgaccatgtggagatgtttctggacttgctagagcctgcttagctgcatgttttgtagttacgatttttggaatcccactttgagtgctgaaagtgtaaggaagctttcttcttacaccttgggcttggatattgcccagagaagaaatttggctttttttttcttaatggacaagagacagttgctgttctcatgttccaagtctgagagcaacagaccctcatcatctgtgcctggaagagttcactgtcattgagcagcacagcctgagtgctggcctctgtcaacccttattccactgccttatttgacaaggggttacatgctgctcaccttactgccctgggattaaatcagttacaggccagagtctccttggagggcctggaactctgagtcctcctatgaacctctgtagcctaaatgaaattcttaaaatcaccgatggaaccaaacatgagcttctgactgtgttctttcttctaggagtgggtttggggaaagttcaggcctttattctgagcaggccttttttttgagcttcaagcccatcaaccgttgttttgccttctcctgggttggaaaagccctcagctcagctcagaaggaaagggggtcaccttggctaggc

SEQ ID NO: 12074 - DNA, 1096 bp, Homo sapiens
cccatgggttctcaactgtaaggaaaaaagacaccagacttttgttccctagtgggggaaagcccttagtcttgtacaggagcagcttgctcccaagtccttttggaagctggcagagctatattcctgacagccctgactgccaggtagagcaaaagacattggtgggggtatgtgaagcaaaaggggcaggtgcacacacctccacagtgacctctgtgcacacggttaccaccaactggctggccctcctcctcttccctggcccattgatcatcccttctcacagagggtcatcattatttccaaatattgtttgtctgatgacttcctcttcccagtgcaatttttcccttcctatttcaacctctggttcctgggatgagccataccctggaactggcccacccactgtgtcttccacgtaagggagacctttgcaaagggcatccaaatgggtaggcaggtgacagccgccgtatttattttgcataatattttaatttgtatatttttgtgatttattttggcgttatgagtttgactctcggggagttttgttgttatgactcttgtgtcttttgtcacaaaacaatgatatttgctaaacgatatatggaatttatttttgattggtaataaaaaatcaaatatgtataaatcctggtgaatctacaacttgcctgtttgttctgtcagtattcagtatgttgttgagataaaagtggctgtggctggctgtctcttgtgatgggacaagggcaataaaggattctaggaccattcagcagtgaaatgcaatcagaaatggaatttctaaatatagtcaaggctgtcgtcacaggagtgagagggacgtggctgctggcagacatacaggacagatgtgctcagctgccataagcatgagtcctgtgaaacagatcccatagggcccttggcttgtgagtactggaagggcagtgggcttcagcaaattgcccctcctccctacccatgggactgaaagaagcttgatccaaaagtatgagtaatattgttttataacatgcagctgccttttcgtccacacctacaggctagtggtttcaaagtt

SEQ ID NO: 12075 - DNA, 1049 bp, Homo sapiens
actcgcagtgttgtcagttcccgtgttctgagaagaggtcatgcctgggaggaagggatcgtcatgctgcatcgaatcctctctccgccgtgtggcccccaggagagtagctgcctgttgcacctgctccacacctccccacagcctccctgcaggtgctgtgtggccgtgatgtgcagagagcagtgagggagggttcatgaaccaggtggatcctctttaaaaaaaaaaaagtttttgttatatctctagaacatttcaagtcttttcctttttttctgttcctagctatggggttttagagaagtgggaacaggaaggcatttgtctttttcttctagtttactacattttccttccgtagttcttcagctgtgtggaaacgggcatcacaaggacataggatcatagattgggtagggagggaggaggatttctggaacttttctcaaaggaatttggacccttataaatgggactgaaggtcaaaacaacagtgatatccttgcttagaaattgtcctcaaggaataaactctgagagcaagcccgggttggaaacagatgctttaaaatcctctctccagaacagtggttttttgtttgtttatttgagatggagtctcactctgtcacccaggctggagtgcagtggtgagatcttggctcactgcaacctccacctcccaggttcaagccattctcctgtctcagccccctgagtagctgggattacaggtgcccaccaccacacccggctaatttttgtatttttagtagagatggggtttcaccatgttggccaggctgatcttgaactcctgacctcaggtgatctgcctgccttggcctcccaaagtgctgggattataggtgtgagctaagatcagggattcttaaccttggctgcacaccagaatcacctggcaaattaaaaatacgtggacctgccaccagagcttgtgatttaatcagagtcggcatcagagttttcaattttttatttatttattattattattattattattattattattgagacaagat

SEQ ID NO: 12076 - DNA, 1174 bp, Homo sapiens
ctgaaccagatgagaaactttgggatcctgtcggttactactattcagatggctcccttaagatagtacctgggcatgcccggtgccagcccggtggggggcccccttcgccacctccaggcatcccaggccagcctctgccttctccaactcggcttcacctggggggtgggcggaactcaaatgccaatggttacgtgcgcttacaactaggaggggaggaccggggagggctcgggcaccccctgcctgagctcgcggatgaactgagacgcaaactgcagcaacgccagccactgcccgactccaaccccgaggagtcatcagtatgaggggaacccccaccgcgtcggcgggaagcgtgggaggtgtagctcctacttttgcacaggcaccagctacctcagggacatggcacgggcacctgctctgtctgggacagatactgcccagcacccacccggccatgaggacctgctctgctcagcacgggcactgccacttggtgtggctcaccagggcaccagcctcgcagaaggcatcttcctcctctctgtgaatcacagacacgcgggaccccagccgccaaaacttttcaaggcagaagtttcaagatgtgtgtttgtctgtatttgcacatgtgtttgtgtgtgtgtgtatgtgtgtgtgcacgcgcgtgcgcgcttgtggcatagccttcctgtttctgtcaagtcttcccttggcctgggtcctcctggtgagtcattggagctatgaaggggaaggggtcgtatcactttgtctctcctacccccactgccccgagtgtcgggcagcgatgtacatatggaggtggggtggacagggtgctgtgccccttcagagggagtgcagggcttggggtgggcctagtcctgctcctagggctgtgaatgttttcagggtggggggagggagatggagcctcctgtgtgtttggggggaagggtgggtggggcctcccacttggccccggggttcagtggtattttatacttgccttcttcctgtacagggctgggaaaggctgtgtgaggggagagaagggagagggtgggcctgctgtggacaatggcatactctcttccagccctaggaggagggctcctaacagtgtaacttattgtgtccccgcgtatttatttgttgtaaa

SEQ ID NO: 12077 - DNA, 1173 bp, Homo sapiens
tctctccagtttctggcgctgtgtgcccaggcccagccgggggcctacactgatgagaacctcatgggactgattgagctgctgtgccgcaccagcctggacgtggggctccgcctgctgcccaaagttgacctccagcagcttctcctcttgctcctggagaacatccgggagtggccagggaaggtactagacgcccagagcctggtcctcatacagcttcatcactagggaccaaggtggcccctagagtgccctgggtggggatggcactgcctggaggtcatcggaatgtccctgatctccgtgactgcccacttactcccctgtgcgggctgggtggcgagagcaaggggaaggcggtgtcctcctgtagcccatggggtgccgttctcctgcagctccaggaactgtgctgcaccctgagctgggtgtctgaccaccaccacaacctgctggccctcgtgcagttcttcccagacatgacctcccggagcaggtgcgtgctgctcccccgctgcctcctccctctcacacgcatctcttcggggtcttgtagggatccagagtcctccccatcagccccaacaaacctcccctgcccaatttctaatccccaggagggagaactaaaaatataactcactaatgagttctttacaaatgaaaaaaagcttaattttcttaacatggtcttattagcaaaacaattgccttgtgcaattagctcctgcctgcagggcccccactctcctttctttggggctccctccccagtcttcagctcctcctcgtcattcagacctcagctgaattctgtcccctgatcacccgactcccactcgcacactctcgattcatccttctgttttcttttctgcctagcatttacccatgccagaaattatgttactctttgtttccttgtttatggctgtggctttcctcgaagttacctctaccagaacagctaccttgtcagggtcactgccatattgtcccagatctagaacagtgcctagcgtgctgttcggcgctctgtaaattttttttttcttcttcttgagacagagtcttgctctgtcacccaggctggagtgcagtggtgcgatctcggctcgctgcaagctccaccttctgggttcacgccatactcctgcctcagcctcccga

SEQ ID NO: 12078 - DNA, 2246 bp, Homo sapiens
cgtgtgggaattgagcgccatgtcaggctgttgtgggtatccccctggcagggccagctaggcctgtggttccctgctccgactctcagggctgcctccctgagctccagggccagaatgcctggatgcctgggtagccagtttggggagtgggctgcaaggggcagccagcagctcccactggtgtgtcactgcatccattgccacctcctgttcgtgacctgacagggtgacacagcccctttcacactctgtcctcctatcttcctgggtagatgccctggtgtagggctgagtactgaatggtcttccatccccagcaagggggtgcagcccagggtcaggcccttcagagccagggcagaggatgcacggtggctagagccgctgcactatccttttcagagcacttcatccacttgctcctccctctaccctcggcaccctgggtgggaaagggttgatgctcatcatttattgaggggaagccacttaataaggagtcagacctaaaagggggtgggggacattttcttacctcacccaagaaagaggtcgtcacttttgctgtggccagggccccacctccctctctcagatatgtacaataatttaacacggttgcctgaaaaaaacttttgtaaatcattatagtaataattatggacaaggcccagtgtgtggctctgttttcttgtggctctctgtgctatcgtttgttcttccatccctggggactttcagagaaaggaccagagagaatgcagcaaggcactggctctagcttagcggcatgaaggtttcagtggttggcccgccaacgtggcacaaaaagcctcaggaggctgggctctcaccctgtagcataattccctcgcctgttacctcccctgctgcagtccaccaggggaagtagaaccaggctaccttctttgcccccggaccctggacaggcctatttgagcacctctgctcaccccattcagccagggctaaggctggtggacaccagcaatgatgcaagctcacgccttcagacaagtcaggatggggaaggcagggagaggcagagaggctgtgagcttagccaggccctagaggaataggcagaagagcagtgaggaattagggtttggagaatgtctgctctttactttcttaagtgtttgagaacctacagtgtttccaggatggtgccgtgtgtttggggccaatggtcaacaagttatatccttgccctaacaaatacacacgtcaagggagaaagacagatgagccattttagtacagagttgtgggggccgaggcgttagtcatctggcccgacaggtggggcaggccgacttgcaaggatccagaggttatccagggatggggaaggcattctatgcagatgtgagagcccaaagaagcacctgggaccagtgggtctggagaggaaggcagggacccaatgcccagtcagcagggaaaggtcagtggtctgtggtcattgtgtgagatgaacaaaaaaggtgggttgagctggcacatggaggattgttagctgtgtcctgggagatgggtggccagccatagaaagatggtgaccagagcagtgtgttgtaggcagttggggtttgtggggggtgagggcagccccaggactgaggagatgaggtaggagtgaggagagtactgaggcctgtctgccaaggcgttttgtgaggctttgtggtcacaaggcagttatgcttgcactggccctcaaagggaaagcagaatttgcacggagaactccatattagggcaccctccagaccagttcttcccacagtgctctgttcatggcaccactggctccctgcctcccaggttagagccttatccatcgacgctttcctcttccctgtctctcccactctgtcagtcaccaggttgtgtggttcttctgtagtacctttcccactggtccgttcttttccagcacagccactgccaccatagctatgaccacagctccattccctggccacccaatctatttgctcgtggatctaaagcccagataagattggttctgacacctcctactccaaagtgtcaagtggttctccactgcctcgtgacatgaaacaattgatgtgatgctggtaaaaccacctacgtgagccacatgttgtgtttgactcaggccccttgagatctgttccttccctgttttaggtttacccctcacatcctttgcctgctagccttcaggcatg

SEQ ID NO: 12079 - DNA, 1232 bp, Homo sapiens
ctgttttagatttttaaaacagctgtatagacattactttaaagggcacaggaatatactaggagcttaatagggatcagagctgcacatcccagtcacgccaatggagaggctttactgaacttggggattcagcccggaacactgcacctcccacagctgtaaacctgcgtgtaggcacaaggattttccaggtccccaggcagcggcctcagctgtccacccctggaggatgtggaagaccctcctcccctacctgaggtgggagaagtgaagacattgactgtccgccacacaacacagcagggaccgggcacgctcttgctcccctcaaatccccgagtgcagagagatgtggctgctttctctttaaaacctgttaaacagaacacatctaagagctttcgtttgttttctttgtagaagggcttgagttatgcatagtcttagagaacattcaaagtgatttggaagagcgctaatcaaaacaccacactaacgagcccgtttgtttttaatttccagctactgatagtctttataaactttctctgcaaaccctcaacgcagacattttcttaaaacaacgccagacctcaccgacacctgcttccccgtctcccccagctgccccctgcccctttgtggcccggggcagctacagcagcatcgtcaacagcagctccagcaggtaggcctgctgcttcctttccggttctcagcttgaaatgtgcctaaaacccgatgtcacaccctttaaatggaaacacttagcggccacaggccactgtctggtgttacttctgatggctgccagcttgtgtggacccttttacctggggtccacccccgcttcctgctgctgtgcccagctccaacagtaacccggttcccattctaatccattcattcttaccacctgtggaccgagaaatgcaccatttaactcactagagtgatattctcagtgagccaatgaacatttactaagccttacatgaagacctaaaggggattcctgtgagttgggagtatgggtttatgtgacactaattttggcctttggacaatttggcttaggacttagaagggcaggacctggtccaagaccgttgtgctgggtgaggtgctgcagtaggggatgtgtgcacccgggagggcagcctcctgaccacacagacaggatgcaggaagcatgctgttctccgaggcacggagcctcactcgtgtcc

SEQ ID NO: 12080 - DNA, 1196 bp, Homo sapiens
ttagaaattatgacccgtacagactgggttaaaatgtggcttgtgtgtcttctgcagcttgcacctgcctgcccgcccaggtgattttgcaggcacaatctgaggtgctagaacctggggctttctctgcctctgtctagtcctgctggattgtaagctccatgagggcaggagcttgcttgttgtttgctactatgttcccagcacacagaacactgctgggaaatatgttcggggctggttctcatttgtcttgatagcatccagatttttccaagtagttggctttccgtatgtccattttactctctgtccatatatatacacaacattacatagtactcatgcaccagttaccattcccagggattatgtaattcctcagtacagccctgtgtggtcttgtgtctccatcttacagatgagaggccatgatcaggcagctagtttgtagaaagctgccagggtttgcacccagccattatggctacactgctgggactcttagcgcccctaaagggaagcacttgagtggctcgttgtttatgtcaccatcaggcttccatctcccagcagatgtcagaggatctctggttttcacttctgtaacttttcaaagctctatcaccctttggagaatataagaacattctgagacagacatacagatttgtcaaaactgccgagtttgtccaaactcactgaactgtacccttaaaatgggtgtgttctattatatataagttgtatctcagtaaagttgatttttaaaattgttctcatcacaaagtcaaatggatttggaaagctttaattagagaagaaaaaaagaaaccttttttaatcagaagagtccagcctcttccaacaaaagttgtaattgctttgttttccaagctagctatttaaaaatcaggagttctggccaggcatggtggctcacgcctgtaatcccagcactttgggaggcccgaggcaggcagatcacgaggtcaggagattgagaccatcctggctaacacgacgaaaccccgtctctactaaaaaatacaaaaaattagctgggcatggtggcgggcgcctgtagtcccagctactcaggaggctgaggcaggagaatggtgtgaacccgggaggcggagcttgcagtgagccaagatctcgccactgcactccagcctgggtgacagagcaag

SEQ ID NO: 12081 - DNA, 1141 bp, Homo sapiens
tggtggctgtactgatgaagttgaagtttttttttaatattagattttgtaggttgctatttactgatctgcagttggtccctttttcagcttgaacacactcagctgtgaccccggtcacagtagggggttctgtggagcaggcggttcatcatcccgacccagtgccgggagtcataagcagtgtggcccatcggtccacccacacagcagtcacagcaatagaaactcagctgacgtggaaaacgtcagagccaaaaacagttcaagtacctctagtaggacttctgctcaagcagcttcttcacagtctgctaacaaaacaagcccccttgtcttagattcgaacacagtgactcaaggtcatacagcgggcagaaagtccaaaggggcaaagcagagccagcacggcagccagcaccatgcccacagcccgctggagcagcaccctcagcctcctctgccaccgccagtgcctcagccccaggagccgcagcctgaaaggctgtctcccgcccccctcgcacacccttcccacccagaacgtgccagcagcgcgaggcacagttccgaggactcggacatcaccagtctcatagaagccatggacaaagacttcgaccaccatgactccccagccctagaagtgtttacagagcagcctccatcgccattgccaaaaagcaaaggtaatcatctcccactgccggagatccgtgatgtgtgagggaaaagccagtgcgtgcttaaggagctattaagattatagttgtggtaaacaactaattcagtaggttcctctggctcagatttatctccagtgttggacttcaacttttccataaaaatgcaattagaggtatctgtcataaaagatatatttgtatttcttagattgtttaccaaaatcagaaattctgtggacatctgcttttcttttcagctgcctgagattgtgttattgtgatagatttagcttttgttttattgttaaaataattttgagcacaggagtaaaatggagatcatctgccttttaactccaaattaggatttctttactttagagcaggggttggcagactacagttagcgggccaaatcaccacctggttttataaataaagttttattggaatag

SEQ ID NO: 12082 - DNA, 1194 bp, Homo sapiens
gagaacttgagggtggcaggcaagcttccaggtccaggaagctccttacgctttaaaatcacggaagcattgttaaaagattgtacagatagtaagtcttcctaacagtttcaaggacactaatttcagcatttgctttcaacagtaaataatttcaaaaacaacattatttctgtatgtgcacctgtgtatattagttatgaatgcttaagagcttaaggaaattccatgttgtgtttagagttgtttgatttggatcttaaaagatttaaagtgtttgcactcattgcataccttagctgatttactctcagtatgaaatgtgaagtatagtcaacttttgccatctaaaatgatttatcaaagtagattacctcatgatgaaatctgaggaacagctgatctctctgacatgcagggatggtttataacctgtgacatatagtaattcatgaataatgtatttatcatttggactgggagcacatgatggcaagatttagtcttattcctgattttttatcctttaggtttaaaactaagagaaccaaatttcacattgaaaagaacatttaaggtagagaatacaggacaacttcaaattcacatagaaaccattgaaatcagtggatactcatgtgaaggatatggctttaaagttgttaattgtcaagagtttactctaagtgccaatgcttctagagatataatcatattgtaagtattttattttaaggtgtaatgaatcactaactttcctcaaactctgtgcaaagatatgttttcatatttaccaaaggtctttatccacaaatgcattcatttgtttttttttcacttaatctttggctaaggtatttcttcatatcttagttttcaaagttgtaaattttttttcacttaatctttggttaaggcatttcttcatatctcagttttcaaaagttataaaactttatctccgaagtggatcagataatcttagaaatcaatttcaaaattattttcagggttacgttaaagcaaaagatgttgatgtaaattcacagtccctcagcaacagagatttgtttcatacatgtacagttttttcacgttttgcagtatacggatatgtaatattttggtcagaagacagttttaatacctatctcagtaatagctgcagcatattttaacaattaattgataact

SEQ ID NO: 12083 - DNA, 1229 bp, Homo sapiens
agccaagtctgattaataaccatataccatgtcttatcagtggtccctgtctcccttcttgtacaatccagaggaatatttttatcaactattttgtaaatgcaagttttttagtagctctagaaacatttttaagaaggagggaatcccacctcatcccattttttaagtgtaaatgcttttttttaagaggtgaaatcatttgctggttgtttattttttggtacaaccagaaaatagtgtgggatattgaattatgggaggctctgattgtctcgggtgtcagcttaacattccatagatggggggttagtttttatatcctataatacaaagcatattaaatggcaatatggagtcagtcctgcatttaatgtcttgaacattttaaattacttctattaccatgttgttttttagtagaattgtttcctaaagaaaaccactctttgatcatggctctctctgccagaattgtgtgcactctgtaacatctttggttgtggtagtcctgttttcctaataactttgttactgtgctgtgaaagattacaaatttgaatatgtagtgtacgtgctattgagttgtgaactggtgggctgtatgtaacagctgaccaacatgtgaagatactggtacttgatagcctcttaaggaaaatttgcttccaaattttaagctggaaagtcactggaataactttaaaaaataattacaatacatggctttttagaatttcgttatgtatgttaagatttgtgtacaaattgaaatgtctgtacgatcctcaaccaatgaaatctcaattatgaaaaaaaaaaagtgtaacatatattatcctaacttctaatcttatggaaatcagacatagggtctgtgcccctcaaagctcaagtgtctcagcacagggccatacaactaacacccctacttatagggttagagatggccactgctacaggaaccagaatagcaggtttatctacatcattatcctactaccacaaactctcaaaggatttctcagacagtttgcaagaaataatgaaatctatccttactctacaatcccaaatagactctttggcagcagtgactctccaaaactgctgaggcctagacctcctcactgctgagaaaggaggactttgcaccttcttaggagaagagtgtttttttacactaaccagtcagggatactacagcgtttacaggaaaaggcttctga

SEQ ID NO: 12084 - DNA, 3437 bp, Homo sapiens
cactgtcattgctaactcctgtcagaatcacatggatgagtagtgggctgaatcccaaaaggaaaggggtttagagcaagtggaaacaacagatgttcactatagaaagcaagaatgaaaaccatgaagtggttgaagattagccttacagtaattttattctgatcacttaatacagtagagtcaaacaggaatccaagtttccaactttattatttttggcactgaagaattacaaagaactctagcgtctttatacctccgtggttcactggagttaaagcaatcggggcgttgtacagctcacttgagtttttaaaggttctactaaaaagtgagaattccacagcaatatgggtcattgttgcagaatatcacaaaggtctgttgtgtatactccttttcaccaggaaagggacaataatagtttttttcaatgtatatatatataagtgatctaactttttattaataaaagtaaacaactctaaaatgtatattataaagccctgtcatctttgttgagtaatagctttattgagctttatttggagaaatacacataccgtaaaattcacactgaaacttaccaattcagtgttttttattatatctacagagttgtgcaaccatcaccactaattccagaacatttgcatcactacaaagagcaacctgtacccattagcagtcacttcccttctccctcagcctctaaaaaccactaagacactttttatataacatgtagccttttgtgactggcttctttcacttttaccataatgttttcaaggctcatccacatgtagaatctatctgtacttcattaccttttgtgaataatattccatagtatagatgcaccacatttttttatccattcatcagttggcagactggtttgtttacacatttgggctattatgactaatgctatgaacaatagtgaacaaattttgcatggacatatgcttctgtaagagtggaattacagggtcatataattccaaccttttttttttttttttttttttgagacagggtctctgctgttgcccagagtgcagtggcatgattacagctcactgcagcctcacccaggctcctcctaactcagcctcctgagtagctgggaccacagtcacgtgacaccatgcccagctaattttttttgtatttttgtggagacagggtctccccatgttgcccaggctggcctcaaactcttgggctcaggtgatcctcccacctcggcctcccaaagtgctgggattacaggcgtgggccactgttcctggcccaactttaacattttgatgaactgccaaaattttccacagtagctgtaccattttacatttccaccaacaatctttgagggttccagtttctccacatcaccagcagttataattcatgtttgattacagccattctactgggtatgaagtggtatctacttgagattttgactttcatttctctaacgactaatgatgtctgagcatgttttcatgtgcttattggccatttgtatgtctttagagaaatgtctattcaagtccttagtccagttttcagttcggttctttttattgttgtaacagttttttgtatgttgtagatacaagtcacctaaagataagtgattcacagattctcccaatttgtggtttgtctcttcactttcttgatggtatcctttgaagtataatttctaattttggtgaattacaatttatttttttcttttggtgtatctaagaaaccattgcctaatctaagcttaatggaaatttattgttttatcttcatttaagagttttacatttttacctcttacatgtgagtctgattcattttaaaaataatttttcaggcttttatttgcaatatatttttaaaattttaaatgtaagatacatataaaatttactatcttaaccatttttaagtgtacagttcaacagtgttgagtgcactcacaattatgcaaccaatctccagaactccccttcacccccaccacccctccaactctccaccttgacagtcaccattctactttatgtctacagtaagtgcctcgtgtggaatcataccacatttgtctttgactggcatatttcacttagcatatgttctcaaggttcatccatgttgtagtatgtatcaaaatttccttccttttttaaggccaaataatattcagttgtatgtatatagcacattttgtttacctatctgtcagtggacacttgggttgcttgtgcctttgggtaactgtgaataatgctgctgtgaatatgggtatacagatacctctgtgaccctgctttcagttcttgtgggtatatacccataagtggaattgctggagcacacagttattctaattttttcaggatcagccgtactgttttccacagcagccatactagtctacagtaacagcacacaaggatttcaacttttccacattcttgcctatacttgttattttttatttttttttaaatagtggccatcctaataggtgtgaagtatctcagtgtggttttaatttgcatcttcctaatgattagtggtgaacataatttcatgtacttgttggccatttgtatatctctttggagagatgtctcaagtcattttgaatgagttaaatcattcaaatgggttaaatcccttaaaatggttaaggtggtagatgggtattaaaaaaataggttgtttgctcttttattgttgaagttccttgtatattctagatgttaacctcttatcagatgcatgatttgcaaatattttctcccattctgtaggctgcctttttttttttttttaaatgcacaggggttttgcattttggtgtagtctagtttgtttttacttttgttgcctgtgcttttggtgtcatacccaagtcaccgctgactccaatgaagtttctcctgtgttttcttctaggagttagagttttagcttttaaattatgtctttgatctattttgagttaacttttgtatatggtgtgagtgtccagcttttttgcctaaggatagctggttttcccaacaccatttgttgaaaagatgttctttccccattgaatggtcttggcatcctgtggaaaatcatttgaccatatatgccagggtttatttctgggcatgctattctattctgcacttctgtctgtacatatttatgccagtgccacattattttgattactgtagctctgtaataataagctttgaaatcaggaagtatgcgacctccagctttgttctttttcaagattgttttggctacctggggttccttgagattcgatgtaaatcttaggatggatttttctatttccacacacaaaaaaatcagttgggaatttgatggggggggggtacattgaatctgtagctcacttt

SEQ ID NO: 12085 - DNA, 1184 bp, Homo sapiens
acacccagctaatttttgtgttttttagtagagatggggtttcaccacgttggccaggctgctctcaaactcttgaccttgtgatccgcccacctcatcatcccaaagtgctgggattacaggcatgagccactgtgccctgccaatgccatctttgttactgtggtttttcttggtagttctgatgtcatcacctttttgattttgctaataactggtttatttctctcatgcggtgatacccttaccaaagtaaggggtgtttaattaattacattgtaccaaatttgatttaattgtatatttattttcagttggataacagggcaagattcagaggaagaaaaggatattgatgcattatgttgaagccaacatggaaaacaacaaatattttccctggtcattaacacaaagaagccaaaacaggaaacatactttttactacatctgtttggttggaccagatttcccctccgtggaacactgaagaaagtggatgagttgttttcgaatatgtataaagtaaatgattctcttgatccaagttatttttagaagaaaaacctaattgaacaggtatgggttgggagcataataaatgtgttttgagaattgttctaaagcacagaaaatggaaagactgttatttgcaaacttgactcttcaattgaattacccaattagtacaggccactgatttgactgacacagtcgataacatgcagcctatccagaaggtgtctgttgggaaagtttaggataaaactttttctttagttcagtcttttcctgtctagttctaaaatgaattgtgtttgattccttagagaagaaatacttcatttgtgctctgattcactgaagtaataacctcagcactttaatagcgtccacaggcatagctgatgctaggccccagattgtgttgcccaggctctttaccatcatcttcggactgtttttgtttcctggttacattttcagtctggcccgctctacataatgggccagtgtcagctccaagtccacatccttattatccatgattcaaaagggagagagagaacttcctttttcagggtccacaaatcaaatctataaaaggactctggtcttcccaggatcacctgcccttgcattggaccagtccctgtggaagaggggatgggggcctgtgatct

SEQ ID NO: 12086 - DNA, 1212 bp, Homo sapiens
aaagtgtgtatcttctcaaatcagtggttgcactagtcaataattagaaggtgttgttatttttaaaactataagcaaaattatgaaggcctttaaaaaatctatcataataatgaaaaagaggttgtctcccaacagtgctgtccctcaaagaaaagactggttatgtggaaacagcacgtttggagagattattctagtgaataacagtgtatatttgtggtaggcaaatttctaagaatgacccctactgacacccccaccaatgaccttgtataatatcctcccactttgagcatgggtggaacctgtttgatccatgattatatcatgttatgtagcaaaaggaagactgtctgggggtggctaatcaaatcttgtgactcctttaaaagcagagagttttctcgggctggtggcagaagtcaagagacaaagcagaaggacctcaggcaccattgctgttttaaggtagagggggctgcatgagaaggaatgcacatggctttgaggagctgagagaggccttggctaacagcaaaggagctgggaactgcagtcctacagccacgggaactgaattcagcccataagctcattcataggcttggaaaggcattcatctccagtctccagataagacccagcctggccaacactttgaatccagccttgtgagaccctaagccgagaactcacttaagcctgcttggacttctgacctacagaactatgagataataaatcagtggtgttttaagctgctaaatttgtggcaatttgttatgtaggaataggaaatgaatacagtattttaaaagaggtaaagaggaaatcttcatacttgattccctgtagtatgctggatatttcttggtaaatgcatgaataaagtctttagtagcaagtcatgtacctggaccttgttggggatgttctcgccagagatctcaattagtcttcattggacgtttgttggcaaagttgcagcatcttactgagtagcgtttggtaaaggaactgctagaatgagactataggaataggactgaaacagtgtgtaagggatcttttttatttctagaagaggtgttactttatactgatttagactgctctgagcctgtcagaagtaaattcaagaatgattaacagtggtattttagatacattaagagcaaaaataacctttgccttgtagagatcagataa

SEQ ID NO: 12087 - DNA, 1148 bp, Homo sapiens
attttccaaaatgattttattgtagtatgaactgataagtgagtcccgtgtccaagagactgtatttattactcttaaacacgctattccaaatgatattactactataaacaaagaatattaccggtctcagcaatcagtgatctttataaaagtacttttaaaaaatgatgaattatcaccaggcgctgtggctcacgcctgtaatcccagcactttgggaggccgaggcgggcggatcacgaggtcaggagatcaagaccatcctggctaacacggtgaaaccctgtctctactaaaaatacaaaaaattagccaggcgtggtggcaggtgcctgtaatcccagctacttgggaggctgaggcaggagaatggcgtgaacccaggaggcagagctggcagtgagctgagatcgcaccactgcactccagcctgggcgacacagctagactccgtctcaaaaaaaaaaaaagatgaagtatcaacatcagttcccagccagtctgcttggacacactggggtgccacaagtgggttgcaggttggttgcagacgggcagagatggattctgctgagctttcagagtgaccactggctggggcctagcgctggggcaaggttccagctggctgcctctagcctggaggagcttcatctagttacccaatgtgctgaaccaacagcatgaaatagcatcatttcctgtgctgtgttacaaagtgcaaacgtttggaaacactgatacagtacaattatttccatcactccatgttgttataatttttagttacttttcttgattgaaaagtcaatcacattgccaaaaatgatttttatgtcagttaaaggccagttgaaatttttttattaggatgttttaaatttacttttcactttcttgaatttttttcttctcaaatttccttggcccagtgcccatgagcaaatttcattcaaaaacaggaataaccttttgtcataaaattttggcaccagcttggtatactaaattactgcaaagataactgagtaccagaagtaaaaatctctgcaggtgggcttaggagtactcttgggtccctggttcctcagttgccaactctggtttcatgaagaaagaccatgctctgaaaatctagggaggag

SEQ ID NO: 12088 - DNA, 1189 bp, Homo sapiens
agatctgttgtaatgttacttccattcatttatgtccttttgtccagaaagtcaagcatttatgacgttatttgaatacaacagggtatgcatttactctttaacacttttgatcaatgtggtaaatttactttaaaatgtacttttgggatatatttgaagtcagaattgctttaaaattggaccacataaattttcccaatgctgagaaccacctcttgcatgtcagatttctatagaatatttcagatgactgccctgcgattcgtatcaccacttacttaataatctgctcaaacttggactacagtcatagttgtaagaccttaagaaaggagatattttctcatttagtatttttttgttaaaatgcctttggattttaatgaaaatactgacaactgtactttgctggttaactcactgtttctaaagccatttatatggaaaagggagtagtgatactttcagagttttatggcaaaaggattgttctgtaaagaagctttcatgtctgactttcttaaactttgaacttttccccattgtttctagtttgatagagagaatgtacggattccaggaatgctaattattgatactcctgggcatgaatctttcaggtaagagcaatttgagtcttttctcatcaagcaatctacttgaaaccattaagtctaaaagttcagcagagtcattaacctttgagtagtaatttgatctctataactaccactccacctttgtacctcattgatttagtaatgttttctttgaatacttgttttttatagagggaagtctttactgctttaaaagagcacccccttaatgtggaatgcagaaaacatgctaatacatgccaggcctatctcctgtaaaacccgttacaagtggaatattatgctgttgtctcttgtccatattctttaacacagaaaacttggtcagtaaaattattagaaatattagttggttctaaaactagctcattccacttgaggtcaattcaagtgattggtagatgagcctttggcaagttaagggctaatagtacttgaacaatttaatacatatactctattttgtttgggttttacagagaagtttaaaagtttaagaaaagtattaatttcaagattttctacttatagatcttttccttcttttcaacagtaatctgagaaat

SEQ ID NO: 12089 - DNA, 1066 bp, Homo sapiens
atacagttaatgcttataggatatacatgatcatttttagtgtttatgaggagtttcaaaatgatgagccatttgctcatccggcttctagtgaggcacacctattccagatacgttttctttacagcctggcattttggatgatttttgctcctagggtttgaatgctgctttgttttatgagaataaagatccccgcacttttgtgtctttggtacctacctctgcacatactggtgatggcatgggaagtctgatctaccttcttgtagagttaactcagaccatgttgagcaagagacttgcacactgtgaagagctgagagcacaggtgatggaggtaatgatcaacttttcagtttattgttttttttttttttaaaaatagcaagttccttgagtggaggatatttactacttttagatttaatgaacatggtgcattgtatgtatgtctttctctttgcattaatgccttttaggttaaagctctcccggggatgggcaccactatagatgtcatcttgatcaatgggcgtttgaaggaaggagatacaatcattgttcctggagtagaagggcccattgtaactcagattcgaggcctcctgttacctcctcctatgaaggaattacgagtgaaggtatgctgaggtgggaagcattgacacgtggggacttgtacagtgtttagaagttctgctgagatggtttcctcactttgaaagctgtttgacttaatacagaacacatacatccctcgctctcccttttattttagttgtcatcatacaggaaggcctgtctgtcagagtagagatgtgtgaaagtacctgcttaccagactgggcctttgccagattctaaactacactgttatggttctacactgctaaatacggttgactcttgaacaacatgagggctaggggcactgactccctggccagttgaaaatccacatatattttttgactccccaaaaacttaactcctaatagcctaccattgaccagaagccttaccaatcacatacacagtcgactaacatgttttgtatgtttta

SEQ ID NO: 12090 - DNA, 1183 bp, Homo sapiens
ctttaagcaacagggaatcactcttcttgggtcacctgtacctgtagctccttgggcttcagtttgattgtagaatctgatgggactggatcccccattagggcttgacctctagctgggccttgtctgttgaggaagttgctctatcaggaaagcagcaccaacagagaaagctaggacttttaggtcccctcgtgcctgacatgcaaaccagatgtgattttggaattctactcccttaggcaggcaagccctgttttttatttctgcttaagctttttagtacagtgagagcgggcatctggggccacagctttctttggcacgtttgttatgttctgtttaccctgtttgtgcctcgggcattgcagatcagccggcagtccattgatgcactcaaagactggttcagagatgaaatgcagaagagtgactggcagcttattgtggagctgaagaaagtatttgaaatcatctaattttttcacatggagcaggaactggagtaaatgcaatactgtgttgtaatatcccaacaaaaatcagacaaaaaatggaacagacgtatttggacactgatggacttaagtatggaaggaagaaaaataggtgtataaaatgttttccatgagaaaccaagaaacttacactggtttgacagtggtcagttacatgtccccacagttccaatgtgcctgttcactcacctctcccttccccaacccttctctacttggctgctgttttaaagtttgcccttccccaaatttggatttttattacagatctaaagctctttcgattttatactgattaaatcagtactgcagtatttgattaaccaagcttctgcagattttgtgattcttgggacttttttgacgtaagaaatacttctttatttatgcatattcttcccacagtgatttttccagcattcttctgccatatgcctttagggcttttataaaatagaaaattaggcattctgatatttctttagctgctttgtgtgaaaccatggtgtaaaagcacagctggctgctttttactgcttgtgtagtcacgagtccattgtaatcatcacaattctaaaccaaactaccaataaagaaaacagacatccaccagtaagcaagctctgttaggcttccatgttagtgtagcttctctcccacaagtt

SEQ ID NO: 12091 - DNA, 1149 bp, Homo sapiens
gtaagttagagaaaattcagcttctagaaaccctttcttccagtgtgctgctctcagagtagaattatttgtatttttgggcagtctctcatctgaaaggtgaacttttgacccaggactgttacctgtccagaattttaacatgtgcctcaggccttcacccctccctggggtgggatctaatttgagcttcaccaaggctattcatatctgttggccccaattgcaggacattctgtgagtatatttggacttacctggtcatgtgatagtggctggtagtatatatacacttctttccagactacacatagtacttcaggcttcaatgacaaaaggccaagacgttccaaaaatgtgctgatttggaggtggctttcctagcttgatggtctgtaccttacattgattatccacagtattcaaattgaaatttaaagtggcgtgttaactcccaaacacctcatctctgagcatgctttaacttcctactcatatgtttggcattttatagctggatcagtctgttttagaagcacttccacctgatctccgggaacaagtagagcaagtctgtgctgtccagcaagcagagtcacatggcgacaaaaagaaagaaccagtaaatggctgtaatacaggaattttgccacaaccagttgggacagtcttgttgcaaataccagaacctcaagaatcgaacagtgacgcaggaataaatttaatagcccttccagcattttcacaggtaagttaaatatgggaaccctctgctgtagtttcaatattctcacccccctgctccaacttaggacctgtctcacttccctttctcctctgtatctgacaccacatccactggggaggggaggggaggggaggggagagtgggcttgtctccatctcctgcatctgcaggatgtagacacagagcagcctcccgctgaagcagcagggaagagacgggggagggcatgctaagacagaaacacactgatctggggcaaacacatcaatggccacacttgaatacaacagagcggagatgtataatcctgcatgggggacagtaacaacctgagtccctgtttcaatgttttgcttcccattttctactagtgcattttgcccaggttctgctgttgtagt

SEQ ID NO: 12092 - DNA, 1160 bp, Homo sapiens
aagtactcattactttcactttgttgggaaggtgggtatttgtatttaatagttgagggtataccaaacagtttttgttgttgtagttttacttttttgagacggagtctccctctgtcgcccaggctggaatgcagtggcatgatctcagctcactgcaacctccgtctcctgggttcaagcgattctcctacctcagcctcctgagtagctgcgattacaggcacccgccaccacgccaggctaatttttgcatttttagtagagatgaggtttcaccacgttggccaggctggtctcgaactcctgacctcagacgaatccaccagcctcggcctctcaaagtgctgggattacaggtgtgagccaccgcgcctggccacgtttctttttaatagatgctgagcgtgatagtgagtaaccaacatgtttaatattcaaagttaaaatacttgagaacaattattaggtatataggaaagtggaatggtagtttctccacgtttgtctttccatagccaaaagaggcagaagcttttcttctgagtctttcagaagaaattcaaagaagactagaagccactggcatgaagggtaaacgtctaactctcaaaatcatggtacgaaagcctggggctcctgtagaaactgcaaaatttggaggccatggaatttgtgataacattgccaggtaagctcacctcagaaatgatattggtaattatatttcagtacaggttgttgtaagtaatagaaaatgaagaaaaccaaggaggagtttgaataaagacctgtaaacccgttaatctggtattctgtagaagcaggcatcagcccaaggcattcagcttaggttaatgcacttggtttcagcgaggcccacacacaggaggttggtttgacggcattgctgaccttggcagcctttgcttggcatctttgggctgttaactttactgcatggacagaaagaaagggcaaggctgcagaccaaagggactgctatagtttcgggacttggtgaaacttttttcctgaggaaaatttcaatgtagttcttaaaaacaatgatacaggccaggtgtggtggctcatacctgtaatcccagcactttgggaggctgaggcagctggatcacttgaggccaggaatttgagac

SEQ ID NO: 12093 - DNA, 1268 bp, Homo sapiens
ttttgtgaattcttgttctgtttttcactgaaaaaatgtggctgataccactgtgagatttggtgatgaccgaaatcataatagatcccttacatttcgtgagttggttagtatgtctgtaagtcacactatagacttgtttaaatgacagttgattccttagttgattttgtgactaagatacatatcttggtattattcactaataaagaaagtgacatttttgataacttgagttatacatattttaaaagtttctggttcatctatatgtggagtccaaattgagaagtagagtctagaaatacatctactagcatgattttgcaccaaaaaattcttcagcctgtggatgcttcagttatgttgcctaaagactttaaagattattttaaactagttgttttgtgcataaatggtgggtattttgtgttaataaacttgttattagtagcttattctgcatacttaactatattccctttcctaggagttggacattcaatggaatctaagttggcatctttgggaattaaaacttgtggagacttgcagtatatgaccatggcaaaactccaaaaagaatttggtcccaaaacaggtcagatgctttataggttctgccgtggcttggatgatagaccagttcgaactgaaaaggaaagaaaatctgtttcagctgagatcaactatggaataaggtttactcaggtactgatcattgaacagattttgccatctgttgctctttatatttttacatagtcctacctctacaactaaaccattagaccctcaatgcttgaaattaagtcttaaaactgttgtatccccagagccttaagaaggccttttaaggcactgtgtggtaaggtgtagccccagataagactgagactgaggaaacttagctcttggggaaatatactaaaagattatgctttggaggccagttattagagaacttgagattataattattctaattaacagtgaaaaaataaaaaagatgagaaaaatatttttaatgttgaaatattttttaagctgtagttaaaattaagtttcagcaaacccctccttatgcaagcttttggaaagctgcagcacagatggctgagtagtttccattttccttcagattatggatttggatatgtttttttttttttttttttttttttgagatggagtctcactttgttgcccagggtggagtctcactttgttgcccagggtggagtgcagtggcgcagtctcggctcact

SEQ ID NO: 12094 - DNA, 1205 bp, Homo sapiens
aactattctcagacaagcagttgggatgactggccactttttccttctgtattctaggcctgctacagtgagtggaatttaactgtgatattttggttttaggagagtagcaattactgatttgtctaatttttctgttccttaaaggattctcataaaccattagattaaatgttttgacagttcaaattcacccaccggttttcaactcttcaaaggtttatagaagtattgtcagtatagagaaactgaaataataatttatgctgtgtttttgtttttttgtgtttaaattttttttgttggttattttactcctcaaacattttcctatccaatatgctgtattttggtagttaataaggagaaagagaacacactaattaactttgcagttaaaagttgggtgactaaaatggtacttcagccaattcatttaaaatgctttgtgaggaaatagaaaaaagagaggataagaagactattttgcaacattgggtctaccagatggtggctgtggctgtgattcgttgcctttgctctgtgttgatagctacactcataacattgaagctgtcagttgtgatgaagcgctggtagacattaccgaaatccttgcagagaccaaacttactcctgatgaatttgcaaatgctgttcgtatggaaatcaaagaccagacgaaatgtgctgcctctgttggaattggttagtatctagcttatcttgtactcaaaagagttgctttgagattcttgaatatcagttaattttatggagtttttctttttattagcttcctctcacttgtaaaaccgtttttagcattgcttacaattgtgtgacacacgagataagtgctggaaatataagtaaatggttgataatcttcgcaataaataagttagaatatttcttacttattcttaaaaaattgggaaggtttcattcaacatttgtaaacagttttttttttcccaaaagtgaacggaaaccgtatttaaagctaggtggtggtatgggtttagagttgcgtgttaagtctgagtcttgttactctctgcacttcagcctcccggcacatggagctattcctgtcttcactcagttctagaagtcaccctgactccaagtgctctcagtaactgtccagtctctcctccatctccatccatgctgtctttaaaccttgtactttgtttcca

SEQ ID NO: 12095 - DNA, 1616 bp, Homo sapiens
aattcaagtaaggtttttaaatccatttttatgaaagttatttgtagtatattaattcagcagatatttattgaccatgtagtaaatgccaagcactgtgcttcagaactgggtatttacagcttatagattccaattaattttttatgggaaaaataactgaaaagttttttgggtttttcttcagccatgagaaatgttctattttatttcttctttgggactatctgaagtgaaaataaaaaacaaacaaaaaacacctaaagggctgttaatattctagaatttttctagttatcttgctacttttgcaaagaatgatcttttgtcaaatcagaatataaagtttgtggtttaagtttcagggtttttttttttcattgtcaatattcaatataagaattttctgtttttaaagggggaaataccaaactgtgtaccactaagaaaatgatgaaatgaaaaaattgttttaacctaaaagtcagatattattaactcaaaaattttttcctgctttagaaatcacatcgttaagaagattgaaacggaaaatgaagtcaaagtcaatggcatgaacagttggaatgaagaagatgaaaataatgattttagttttgtggatctggagcagacctctccgggaaggaaacagaatggaattccgcatcccagagggagcactgccatttttaatggacacactcctagctctaatggtgccttaaagacacaggattgcttggtgcccatggtcaacagtgttgccagcaggctttctccagccttttcccaggaggaggataaggctgagaagagcagcactgatttcagagactgcactctgcagcagttgcagcaaagcaccagaaacacagatgctttgcggaatccacacagaactaattctttctcattatcacctttgcacagtaacactaaaatcaatggtgctcaccactccactgttcaggggccttcaagcacaaaaagcacttcttcagtatctacgtttagcaaggcagcaccttcagtgccatccaaaccttcagactgcaattttatttcaaacttctattctcattcaagactgcatcacatatcaatgtggaagtgtgaattgactgagtttgtcaataccctacaaagacaaagtaatggtatctttccaggaagggaaaagttaaaaaaaatgaaaacaggcaggtctgcacttgttgtaactgacacaggtagatacttattaaaattgtcttcttaagaaacagtcatgcttgatcattttgctcttatgctattattggtatttctggtcaatatgaagttctcataaaagtctctaagtatgtcaaatcatgtaagttacagtaagcataacatagaaagctaatttattaaaatatttttaaaacaattagatataattgtggctgactgaaaattttcagagaatttaaacagtaagatggttgggattctgagcattcattcctcacgtagaccttatcagttggtgaagttttgaactgtgttaatataacatctatccagtgcttaaactcctgtaagaatgaaattggtttgataagagtaattgttaatttctagaagcttgc

SEQ ID NO: 12096 - DNA, 1145 bp, Homo sapiens
atttttataattaatgagagactttcagctttactgttccggtcccttgtaccacagcagggaatttattaaaaggaaaaaggggagaaaatggaaaaagaactacatgttggggaggcagttttatcagctcgaatggagtcaacctcagtgtcctcagaagcagagtgtgctgtttacttggactcagtggtgcagaggaaaagggaaatgggttcccggggctggagccataggtgttttgagacctgtctcttaggcaacttggtgaggtattaggttttacattttgagagttcacctgcagtgaccacattgccttccatgttggggtgacgtgtatttactttcaggtatcgaggcttttttaaagccctgggaagttgtcacatcctctgtggggaagaaattcctgcacacagtctgaatgtgatactgactgtctttagagttctctgcagcagaagccctactcttactatctcaagggtgacattttaattgtcactgcattagataagaagatatctcggtttgtagttagacataattgaggataaggcagagttcgggagaagcagtcagtggcacttgagtcacatctttttcaccatgaacaccagctgctctgcatccataccctgatttgacgtagacattcatgtcatcagaggaaactcacttggttcctgagacatttacatgtctgcagcccatttttgtattctaatttgctttgcatgctaacctgtccacaaaccagatttaacactacctggaatggcagagagacactggccagggtcttaaaggagaatctgagctgcctttgggtgtggctgtgtcttaagtagccaggtcacaccaagctccatcctacgggccccaaagcatttggacagcactatgcctccaaaggcacaaaacatctcatcgagggtgggaactatggagaaacaagcagtgcaaacaactgaaatataatattctgtgtttgccatcacttgagacatcatcagataaatgcattctgggaatttggccagaacctatcagaaaaagtaaaagctggaaacataaaatacagaatttgagattttccctaattatagtgaaatttccataattatttccctaataaacag

SEQ ID NO: 12097 - DNA, 1207 bp, Homo sapiens
cctttgaggacgcccggggtctcccacaggcctgtgagttgcctcggcatatgacgcagaaccccaactgttacaacttagtttggatgtaagatgctctgaggaccctgcccacacccctgcgtgcattaggatgtcgctggcctttgctcacctcagaggggagaaaaggctaaagatttgcagtttgacagcccagcagggaggaagcatcacacagcgttaggagccgtttccttcaggtgttaaggaaggggatgcccctgaggttctcctggctagtcagggtggcttcacccatcactggtgggttgcaggaacagcacccaggactctgaggagggacagagaagcaagggggctgctgaaatcgcagagacttttgcagcatcagatctgaggagtaaaacggcacctctggccttcatcttggtgctgcgacaattgtggaggcaaagcattctttctgtgactattttgttcctgtagacagtcagcgatggccagagggtggtgtggtgtccaggggtccatctttccagaatccatgcctgtgtaatgctggtccatgcttctgaacctgtgtctgccaagcgcctatttcattcagcacaagacatacgattttagaaggtgaggggaggggaggctttttctacctgagaaggggagtgtctttgagggccttaaaaggaccatggcccaggaatgggggcgctggttgggcttggagctcaggctgctgtggatcccggcgcatcagttctgacttgccttacctgggtggacagcagtgaatctccacctgtcttctccagggagctcccatgttggggctgaagacgagcaggggcaacctgccagcatcacagaattcagtgtagtttatacatttcgattcctttcatctcagcaaaatgggcactgccagagccatttctgatcacaccaccatcctggaccatgtgactggaaggtgggtaaccaagttcaccagcaataaaacccagcgcccaggtagcctccagcagtgcggcttcctggcaacaaggtaggccctggtgcagggcaagccgcagcgaccatttcagataccgtccacagccaggaccgctgagaactgggacagtttcctgggatgagtgccagcctgagcctgcatggtgccgccgagcccggggtggaggagggagccaggcttcgcttc

SEQ ID NO: 12098 - DNA, 1466 bp, Homo sapiens
atagtggtaactaagaataggatgtgtgagggcatagtatttcattttttcatcaaaagacttcacccgtttaggagtcgtgcccttttgctgttgagtggccatgctcaagtgcagcatgggcagatcacggccaggctttcctcacttctgcaaagcgaatagattgttctctggcatcatgctggcatagtgttctttcattgtcttgtttgcattctgactgaaaccctgacttcctgtgtcattcctgcttctgattttgaagtatgagagttctagtcacatcatccttattaagagatttctttgcatactttattaagtgaaatgtgtgagatgtgtagagatgttagcttcctgataggagcaactatcacggctctcattacaggccattttcgaccagagtttattcgtccaccgcctccactccacatttgtgaggatgaacttgcttggctaaaccccacggagcctgaccacgcgatccagtgggataaatcgatgtgtgttaagaatagcactggtgtggagatcaaacgaataatggccaaagccttcaaaagccccttatcctctccccaacaaacacaggtgtgtattgattgtaagcattttcttatctttttttttaaatttatttttaattaaaaaaatttgtttttgagacagagtctcactcggctgcccagggtggagtgcagtggcacgatctcggctcactgcagcctctgcctcccgggttcaagtgatactcgtgcctcagcgcccccagcagctgagactacaggcatgcaccaccatgcccggctaatttttgtatttttatgagatggggttttgccattgttggccaggctggtctggtggcttcaagtgatctgccaaccttggccttccaaagtgctgggattacaggtgtgagccactgtacccagccattgtgagcattttcttatctttaatccaacaagagtttattttttttttggaaagtggtaagcaataaactaatcctgtcactgtgagtgagcagtaggaagttgcaaaggtttttgggtctctgaagctttgttctactctttggtaattttgctgtggtggggcaagaagtctgatggcaaaaatgttctaacttttctttgtgatgtttgtccctgggagaggtggggtagtgggggtgtcactgctgtgtacagtgggacactacacaatggttacgtttgagctgatggtaacgcttctgatggaaagtggagttactgacaggctgtagggaggaaaacaaggctgggaaggggaacccgcccccatcacacagctggatcgtggtgtatttgagattaaagtagcccccactgcccgagtgtgagactggatgactctcctcaggaaaggcaaggccactcttctattggttggtgaattttatccagtttgcacacttttgagttagaactttt

SEQ ID NO: 12099 - DNA, 1188 bp, Homo sapiens
catcacagacaccttggttgcagttaccatctcagaggggcccaccgtttagatctctgagccaacatgggccttttgttccatgtctgtgctgttagccccctccttggaagttagacacatgaagacatggatcagagatttccaccacagggcgggagaaacttttgatcatttttagtttctccttttatattcacatcacccacattcatgttcactttggttttcttcatgtagttactttcccttgttcctcactcaatttgatggcaccgaggggagacagaagagagggtgatggtggtgacagcagccatcccaggagtgtgatttcctgggctcttgctgactttgtgccacctccaggaagattctcttcctgatcactctcccacaccatcagttagccctcatcaccggagcagagttcctgactgcctttcacagagaaagagtcatttcctgtgtttctctgcaagcagggatttctccttggttttgaggttgaagtctctttgacccgtttataagagcccaaccctacccccccgcaaaaggaaaagcagatgataggtaaaaatgatgcaattgcagctggtaggatgtctgatgccaatccaggaaatgggagccatttcttttgtactagatttaatgatttagtgactttgaactgtgctgtaattttttttcttttttttggtagagataggggtttcaccatgttgcccaggctggtctcagactcctgagactcaagtgatctgcccacctgggcctcccaaagtgctgggattacaggcatgagcagtcatgccaggcctgtgctttaaataaataataagcctggacctttaaaaaaaaaacatggctttacatgcacaggtacaggctgagctcacacttaccatcctttttaatttcacctattatatggatatactgcggttgactaagtcattcccctgttgttgttctgcaaattatttccaagcttttcttactacaaatagcagcaatctgcacattttaatactgattgtttttctctaacttctagatatttcctgaaagtttcctggttaaagagtatgagttatctcacggctttttttttttttttttttttttgacacagggtctggctctgttgtccaggctggagtgcagtggcatgatctcagc

SEQ ID NO: 12100 - DNA, 1208 bp, Homo sapiens
tcctataactagtaaataaaaacattaaatattaaaccttagcgctttgaagtttttaataataaaagttgaagtaaaataaaaatgtgtctctcaaaaccttttttatgagtctaaagaagactttgtcatgtagggagatctccttacaacaaagtccaagagtctgtgtatatacatttgttgatctagaattttacctcatattaaaaaacaacagtaatactatcagcttaacataagcagatcttttttttattgtcatgggatttgaactgtatatgacatctttgacttttttttggtgtcttctattttttttttttaatctctctcttgactttatttggtcttttctatcaaaagccataggagctcactttctcatgaaactgggtaactataaaagtcttacaaaactgacattgtggcaatttatggttaaagaacttctcatcttctcctgtccctgctcctgcttgccttactctctcttttctgtcctttgctttaggatctgaccgcactggccaaagagcttcgagcagtggaagatgtacggccacctcacaaagtaacggactactcctcatccagtgaggagtcggggacgacggatgaggaggacgacgatgtggagcaggaaggggctgacgagtccacctcaggaccagaggacaccagagcagcgtcagtccccggtctcttttagagcggatgagagtattctctcagagcctgctttccactgggacctagttgttcctagactattccgtgaccccatgagcacttactatgtagttctcgtggattcagcagcaggtcgccttgtgtttccccttctcttcgttggtgtgtgcatatgtcagtgcttcccccagcaccccagcgtgtactttattttttccttttgatttgaggatatatgatccaggggaaatttcagtttggtataactactttaattagccataattattcattctaagtttttgctcagaaacaaatggcactggaaagaaattctttgttaaagggagaaagctaagcagttgcttttttggaggaggctttatatcggtagcctcatctcatgttttgattttgagaaggcgaaaagcctaaacaggatctccttgactccagagattaaggcctttcacgtctggattttttctccataggtcatctctgaatttgagcaa

SEQ ID NO: 12101 - DNA, 1193 bp, Homo sapiens
agggaagttatttgcacagaatgctagagccataactacaaacagccttgtgcatacttttctagtttgcattcagtaataaagaccgatatttgacattttcatgggtttctattccaaaactattttggttttattgtaattaggtcactgtctctgatcactcatgatttctcttccctgccgtctctcatgactggattgataaaaatctgtgcactaaactctaaactcagtgggtaatttttctagataggcgtgaaaggcctaaggaaaatgaaatagatcaaccactgatgcaagtaactacttcacaggataggcaaggtggttacaaaggcagagttccttgaaaacaaatccttaaatgctaggcatttaaattttaaattttaaaaagatttagaagtataaaaatatatttttattaagtaagcaacatcttttcagggctgtttcctcatctttaacggtttgcaatttttccctccccaaaagcatatattcgatccaatcagacaatgggctggggagagaaggccatagagatccgatctgtggaaactggtcacttggatggtgtgttcatgcacaaaagggctcaaagactaaaattcttgtgtgaacgcaatgacaaggtaatagttcccttatggattctttttagttgctctatcttttaataatggcttgttttccatggagtttgatgattaatttccttggagttttgataaaaataatcaaggaactttttaaacgttgctttttagtcatgtttgtgaggattggggaatgttttgctttttgctatgaggggatagagatatttttctctgtagaaattaacatatttgggttttgctttgtatatgtatttttaactctattagatgaccagtctaggctataattagagatagggaagataaaagctgccagttcagttggctggaattcttttgtgagtggaaggaaccgccgtgccatttgggtacatcaaaaggttcctctgacctaatgtgtgtcaagaagatgccccttgttagtctgtgagtggtgaaattgcttcctaggtttgcatgacagaaatgttgcacagtaaaaatcatcttatgcagacataacatacctcctgcaccagagaccccatggcatgacaccccctttgcttttcaaaactggccatatca

SEQ ID NO: 12102 - DNA, 1258 bp, Homo sapiens
aaaaaaaaaaagaaaaagaaaacgtgtgcattttgtataatggccagaactttgtcgtgtgacagtattagcactgcctcagttaaaggtttaatttttgtttaaacctagacgtgcaacaaaagttttaccacagtctgcacttgcagaagaaagaaaaaaattcaaaccacatgtttattttttttttgcctacctcattgttcttaatgcattgagaggtgatttagtttatatgtttttggaagaaaccattaatgtttaatttaatcttaataccaaaacgaccagattgaagtttgacttttattgtcacaaatcagcaggcacaagaactgtccatgaagatgggaaatagccttaaggctgatgcagtttacttacaagtttagaaaccagaatgctttgtttttaccagattcaccattagaggttgatggggcaactgcagcccatgacacaagatctcattgttctcgatgtagaggggttggtagcagacaggtggttacattagaatagtcacacaaactgttcagtgttgcaggaaccttttcttgggggtgggggagtttcccttttctaaaaatgcaatgcactaaaactattttaagaatgtagttaattctgcttattcataaagtgggcatcttctgtgttttaggtgtaatatcgaagtcctggcttttctcgttttctcacttgctctcttgttctctgtttttttaaaccaattttactttatgaatatattcatgacatttgtaataaatgtcttgagaaagaatttgtttcatggcttcatggtcatcactcaagctcccgtaaggatattaccgtctcaggaaaggatcaggactccatgtcacagtcctgccatcttactttcctcttgtcgagttctgagtggaaataactgcattatggctgctttaacctcagtcatcaaaagaaacttgctgttttttaggcttgatctttttcctttgtggttaattttcctgtatattgtgaaaatgggggattttccctctgctcccacccacctaaacacagcagccatttgtacctgtttgcttcccatcccacttggcacccactctgacctcttgtcagtttcctgttcctggttccatctttttgaaaaaggccctcctttgagctacaaacatctggtaagacaagtacatccactcatgaatgcagacacagcagctggtggttttgtgtatacctgtaaagacaagctgagaagctt

SEQ ID NO: 12103 - DNA, 1149 bp, Homo sapiens
aaggtttttttttttttttaaggatagaggacaatttgttgtgctgtgctgttctaggtgttgcaaaatgtctagtagccccaacttctgcctggtagatgcacacccaaccaaaaatactcccgcttgtatttaaaactcacttaggttatagctaattcccaggcactgtctgtagagattctgctcaggtagggctctagaatgtccaagaggctgcacagctaggcatgggaaccacggattcaagccatccctctctctgactcaccagatccctctgacatatcttgggccagtggctgtccagcctgggttttaaggagctgggtttcagtgaagaatgtcagtaggttcagttctcttcccagcccttttaatgcagaggcccccttgtcagcctagaaggctgttctaagctcctgtgcaaacccctcttgtgaacccttgggtgtggccatcctggagatggttgactggtgatccagatttcagcctctcccttctctgctttgcccagtgtcatgttcaggcccccggctttgtcaaaagagagaaacacttttccctgggtctcaatcctttgaagttccattgggtgagtcagctccccacttagcttcagaaggatccaggacaggttgtcctaaaattaatacctgcacattcatggacagtgcatggtgagaggaggcaaagatggcagagacaactataactggttgtggaaaagagttgagggagagaagagaaaatattattaaatggaagagattgaaaaatactgaaatcaagtgcaagaacctttaatgggcagagttaaatgacacatttattcatccaataaatatataaaatgcatctaccacctactaggcttcattcaagacaatgataatacggcagtgtataaaacagaccaaaacctaccctcatgaagcttacattctagagggggtagacagttaattaacaagaacaagaagtaatatatatagtaagtcagatggtgacacatgctaggaaaccccagtagggacttcaggtaagacagagatgtgtgtgtgtgactgtgtgtgtgtgtgtgtgtgtgtgtgtgtgtgtgtgtgtatccatgcaacatccaatgatctgggatacctatttggc

SEQ ID NO: 12104 - DNA, 1239 bp, Homo sapiens
aatacataaagaactcctacaattcaacaacaacaaaaaaaaaaattaaataacctgtttagaaataggcaaaggagaggctttcgtggaggcagctagcctgagtctggggagcactgagctgcgcgttgtgccctgcactgctcagactagtgagcaatacggtcaggatggctaaaggtgaccccaagaaaccaaaggacaagatgtctgtatatgccttttttgtgcagacgtgcagagaagaacataagaagaaaaacccagaggaccctgtcaattttgcaacatattccaagaagtgctctgagaggtggaagacaatgtccgtgcaagagaaatctaaatttgatgaaatggtagaggcagataaagtgcgctgattgggaaatgaaggattgtggaccagctaagggaggcaagaagaagaagaatcctaatgccttccaaaggccacagtctggattcttcctgttctcttcagaattccgccccaagatcaaatccacaaaccctggcatctctattggagacatggcaaaaaagctaggtgagatgtggaataacttaaatgacagtgaaaagcagcctagctacatcactaaggcggcaaagctgaaggagaagtaggagaaggatgttgctgactataagttgaaaggaaagtttgatggagcaaagcgtcctgctaaagttgcccagaaaaaggtgaaagaggaagatgaagaagacaaggaggaagaggaggaggaggaagaggaggaggaggaggaataaagaaactgtttatctgtctccttgtgaataacttagagtaggggagcatcgtaattgacacatctcttatttgagaagtacctgttgccctcattaggtttaattacaaaatttgatcacaatcatattgtagtttctcaaagtgctctagaaattgtcagtggtttctgtcaaatggccatgggtgtctggagcaccctgaaactgtatcaaagttgtacatatttccaaacagtttttaaatgaaaaggcactctcgtgatctcactctgtgcactttgctgttggggtgacaaggcatttaaagatgtttctggcaattttttttatttataaggtggggttaactatatggttattggctagaaaacctgagttatcaactatatatatctatagtttgtgaaaagaacaaaacaaccaagacaaactcttgatgctccttgctcggcattgaggctg

SEQ ID NO: 12105 - DNA, 1102 bp, Homo sapiens
gtgagttagtttctcagcctcagtcccctcatcaggaaaatgctgtgttagcactttctgtgaagaatgatcaaaggagtggagattatggagattataaacacacttgacacagtaagtgtttaagaactggtagctgatttttacaaagttatgggtcatagaaggcagtttagagaaaagggcaggctttggagtagctcagttgtattataaccttggcttctttactcacctaggacatacattctctctttagctgtagcttcctcccttctgagatggaaattataagccatctcacagtgttgtgaggattggagctcaagtgtgtaaaatgcctcctctgtgggctctccttggagagttcttgtatcctattgattgtcatcaaaggaaaaaagtggcaggatgatggcataagtgggaagaaccttgagtttaatagtctgaaaaagtggttacaggttcttgctatgcttttcctctctgtggttttctgaacccatcgcctaacctgaagccttaaacttcatctgcaaaaatgttttgtggcaggtaagatgtcttttttttcttccagtacttcccagtttaaaactaagagtacttccttgcttataactaattctattaatattattctaggtgactctgaagcagaactcttgagatggaaggattgtcatctgaggaaaaaaaatcaagattaagagaggaggaactagaatgagattcacataccgtctctcctccaagggaaggagagagtggtgatgcctgcccactccttcctgggcagaacatttgtagcatggaacattggagaatttgcagtctgctgactttctgatttaggaggttgatggggaggccttataatttgcatttctaacaagttctgaggtgatgcttcaagtatgtccaggcagaagggctgcctcacagagaattctgccataccacatgggaattgaagtcacagacatctctaaccctcaagcctgaaaccaaaagactgaaaaccaacactacagtggacaaagaacatctctgaacttgtgtggggaccagtgacacaaggacctaaggtctctctctt

SEQ ID NO: 12106 - DNA, 1194 bp, Homo sapiens
agattacaatttttggtaaattatccaggaagatcttagtgaaaaatgacattttagtagagagacctgtaggaagaagaaaacaagctaggattccaggcagaatacaagaggctggatctggaatgtgcccatcatataccaggaacaacaaagcagctatcagggctggatggagaagtaggaagaacgagttgtactgggggcaaacgggagagattgtcagatcatgtaaagctttgtaagtcattgtaaggactttggctgtactcagatgagaagccactagaaggttttaagcagagtggtgacatcattagatgtacattttgacaagatgactctggctgctgtcctaagaagtgatttaaggtgtgtggggaggggaagcggtgtgtataagactggaagcagggaaacaaattagaagcctgtactgtaatccaggcaatagatggcagcagctttgactacaatagtaaatttggtgggttggagcatgcatgtattttgaagatagagccaataggatttcctgaattttgaggaaaaagtcaagtcaggtaaaactctaaggtctttgaataatacacaaatgaagggcctgttaactagcttaagttatgctatttaaaattatttaatttcaaaaacagttttataaaaccacaagcaagtgattttttcttttttaaagaaaattacatttgattaatcagtgttgttgattggttaataagtacaaagtgtcctaagatccttaagtgaactcttctgtgtctattatatctcaagtggatactattgatcaattaatttttttttagggccttctatttgtaaggcaccgtcataggcaatccactagaagcagtgagagaagacagagtaggagggtaggggtaaaggggagtatgttcctctgagttttaatctctgttttacaaagaaaaatttaatgattgagattattctccaattatgaagaatagtcgaagaatacatgtctgctcattgtcttttggaaaatacacacacagtctgacctttgatcaagaatgcattttagattgaccattttagcttgatggttactttacttactagtacagactatgtagtggtgttaactttcataaatatgggttacactgcatatggcttttaatttacttttgctgttattcagccagt

SEQ ID NO: 12107 - DNA, 1616 bp, Homo sapiens
cgattttaagtcagtgggaacttatttttagttactcaataaaattaatattttatttgtattttaacttacagagtaggttggtaataacagctgaactgtgtaacattgttgcttcaaattgaagtttatattatgaacattcagaatcaatgctcatgtagcagcatattattgagctattttgagtttgaaatgtggagaaacgctaaaccatgtactatgtgttaacataatcccaccttcttagagctttgttccttctgaaggtgtatagatacagcttgtcttgaaatgtctttctccacataatgaagcatgctgaatgctgggaatctggagcagcagccctgggagccctgagttttgaagtgttttggtttgcttcaaaggttagaagaacttgatatgtatggcaaacaactttagaatactagttactcactaacatgaggcgggtaatgttgctctagattctatattccagtaaagccagcttttcttattattggagtaggcaaatgaatggcattagaattagtgggtggcttgtaagttgtagttataggcactttaccacttcctgccattagcaggcatccttgttttttcttttccctctttgttccttcttttccctttctccttatacattttctttctctactttaattctccttcctccttactgtagatcccaagcttctagcttaggtttgcaagtcatattgcttggccctccacattcactgagaggtgaagataggctgaccccctgtcctcttacatttgagggatcatagactgctgtgtgaattctggaaagtctcaggtccctaccagggcactgaatggcttctcaatggctgtagagacagtacagttttccaaagcagcctaattcatctggacagctaccaggcactttggaaagttggttcagttactactatgaggccataatatatttgctggtattaaaattcttcagaattggaattactatttgaaataatattttggttgacttaagttttgagagacaattctaaaattgatctagagactcattcaatagcaatgtgaccttttaaatacttacattaagtaaaactgccagtagattaaatcatatatatatatatatatatatatatatatgtaagagcttcctctatttactactgttgaacttcagtaatttttagaggctaaataatggtcagaatgtttttaagtgtgctcttttattacatgcttgtgcaggttttgtaattcagtacagaaaagtttaaccttgtacatttttgtatgtaaaaagtcttttaagtagtcttatccttatttaaataaacagaataaaattaccttgagtaggtctgttattcttattaaaatggaaaaatgctctgtaatgacttgatctgtttttatttgagtgaacaattttggaaagtattctttatagtacaactttctatacctggattgattaagatcagatgtgattcgagtagtccagccatatcttgtagcccttctttgaatgagagggtggctggagtggtctggtgctgggatatcacggtgctacagagcctgacatgttgactgtc

SEQ ID NO: 12108 - DNA, 1110 bp, Homo sapiens
cacccaggctggagtgcaatggcacgatcttggctcatcacaacctcccccctcctgggttcaagtgattctcctgcgtcagcctcccgagtagctgggattacaggcatacaccaccatgcccggctgattttgtatttttagtagagatggggtttcttcatgttggtcaggttggtcttgaactcctgacctcgggtgatctgcctgcctcggcctcccagagtgctgggattacaagtgtgagccaccgcgcctggccccattctgaactttattaatggctcatgtaaatctgaacttcaacaatcttgattcttacgaggaatagagatgagtctccttttcctttgctactaatttggctaaaattgcatagcgaagttttaaactctcctgacctctgttttgtcttctgtgaaactaggggttgcctgtaatgtactttcacaaccttttatagccccaactttcgctgtgttaaaattgagatgggacaggtccttgattattagggatttttttttcttcaaagtggcatgggatgaactgatctatgtgtaaattgatgttgctgttgcttttctctgagtgtagttaggagggctggaagtatatgggtgcagagatgtagaaaggctacgttgttcatcctgccaccgacaggtcagactgttctcctggctatgttttcactcagttgtgtacctgcagttcatacctacataggaccagccatgggccaggcactgtgctgggtgccgtgggaaaaccacagcaaaccagacaaacaccagcctttggggagcctgtaaaccagtgtggagatcttacaagctcacagtccactgtaatcttaattaacaagtatggaaaataactttcgccatctctgggtgggggaagcacatatgggaagtccccctctaacctctaacccaacccccaaggccaggcagaattcatttgaagcattctggaggataatattttcttcaagatcctcagaagctcttcagtgcacaggcaactcccagatactggaattgtcacctgagctgagacattccacatgccagttgtaagccaggtctccaccacagctggggt

SEQ ID NO: 12109 - DNA, 1182 bp, Homo sapiens
tcacatgtgcatgtacacacacacacacacacacacacacacacacacacacacacacacggttccctgcaaatggatgactttagatgcagttaacaccatccaaataatactagaaagaataacactggaataacaccatccaaataacacgagtaccttcaactaaaaagcggtcaccagagccctccccagcaggaggcctcttggtagctggtgtcagggccgcaggctccctcagccagcatcagtgctccctgacctccctgctgaggagtatgtggcttccaccctgaagccaaacagaaagctcatgcagtagaaaagcctaaaccaagtcccccaaactaatctcacaagcgttttcccagcaaatgggccgtgataattatttctcctcgagtgcctaaagtgtgctaggtacctgccaggtgcccgaatatgtttttatttcatcttcacagtaagcctactagggaaatcataatagcctcattttgcatgtgagaaaactgatactcagaagttaagtgaggtgcccaagaacacacagtacgtgctgggactgacatttgagcccagtgtggcctgactctgcctcttgtgattgctgttcagtctcaggaattgggggtgctgattggtgtgggagggagatgcagttcctgctaggcatcaatactggcgactcccacccacacgactgttgaggttatttgctgcccttgcgctagcccccaaaatgctaagggaacagttccccagttctgcctggaccctagggattcacgtctttgtaacttttcctggttccttaatgttgaggtgagcaagagccattaatcaaaataactgagaagctgagtgtcataggagtatactccttttccgtaattgagtttaatctgggagcagttttgtcagcacacatgtgccgctgccgcatgagtcatcttcagcatctttgtcatcagtttctttgtatggcacagttttctgcaaacagatattcctcagaatcataatctctgaaatgcctgagttttataaaactattaatcagttgtcttcactcttaaagacagagatattattattattattattattattatttgagacagagtttcattcttgttgcccaggctgaagtgcaatggcaatatcttggctcaccgcaac

SEQ ID NO: 12110 - DNA, 1166 bp, Homo sapiens
ggaaatcccggtaggctagggagtgtggtggtgcccaagtgccctgcgccactgagccttgctgtgtctccacaggcctcggcaagacgcgcaggaagaccagcgcgcgggatgcgtcccccacgcccagcacggacgccgagtaccccgccaatggcagcggcgccgaccgcatctacgacctcaacatcccggccttcgtcaagttcgcctatgtggccgagcgggaggatgagttgtccctggtgaaggggtcgcgcgtcaccgtcatggagaagtgcagcgacggttggtggcggggcagctacaacgggcagatcggctggttcccctccaactacgtcttggaggaggtggacgaggcggctgcggagtccccaagcttcctgagcctgcgcaagggcgcctcgctgagcaatggccagggctcccgcgtgctgcatgtggtccagacgctgtaccccttcagctcagtcaccgaggaggagctcaacttcgagaagggggagaccatggaggtgattgagaagccggagaacgaccccgagtggtggaaatgcaaaaatgcccggggccaggtgggcctcgtccccaaaaactacgtggtggtcctcagtgacgggcctgccctgcaccctgcgcacgccccacagataagctacaccgggccctcgtccagcgggcgcttcgcgggcagagagtggtactacgggaacgtgacgcggcaccaggccgagtgcgccctcaacgagcggggcgtggagggcgacttcctcattagggacagcgagtcctcggtaagtgcgctgcgcccacagctccggctgcaggcagtaaatgcgccttgcgcggtgggtctgtgtgccgcgcccttttcacattgtgtgagtacactagaaagagcgggagacgcagatgaatgcaatttagtataatgtttgctactccgtgatttacttgcatctgttttggggatagtgggtgtccatttctggaggtgggagattaactaaaaagatgtttttagctcacagaggtggttctgcttctctcccaagattccccctcttgtatttcacaggctcaaacatcattttctctcctggttgcccattctgtgtacgtagaaggcccgagtgatttactttgtttctattcggtctgtg

SEQ ID NO: 12111 - DNA, 2192 bp, Homo sapiens
taaagaaaggacggactcgccacagctgaactcctcacttttaggacacaagactaccattgtacacttgatgggatgtatttttggcttttttttgttgtcgtttaaagaaagactttaacaggtgtcatgaagaacaaactggaatttcattctgaagcttgctttaatgaaatggatgtgcctaaaagctcccctcaaaaaactgcagattttgccttgcactttttgaatctctctttttatgtaaaatagcgtagatgcatctctgcgtattttcaagtttttttatcttgctgtgagagcatatgttgtgactgtcgttgacagttttatttactggtttctttgtgaagctgaaaaggaacattaagcgggacaaaaaatgccgattttatttatgaaagtgggtacttaataaatgagtcgttatactatgcataaagaaaaatcctagcagtattgtcaggtggtggtgcgccggcattgattttagggcagataaaagaattctgtgtgagagctttatgtttctcttttaattcagagtttttccaaggtctacttttgagttgcaaacttgactttgaaatattcctgttggtcatgatcaaggatatttgaaatcactactgtgttttgctgcgtatctggggcgggggcaggttggggggcacaaagttaacatattcttggttaaccatggttaaatatgctattttaataaattattgaaactcaccagtcatggacttccagttttaaaggttgtctttctgcttcggcatggcacttgttggagtgctaaggaaaatattggagaatttattttaaaagaaaattctgaaaacattcaggtttgtgcactatataatttgatatgtagctattgaaagcatttatatgctacttgggctgagtgtatgcatataattttcactgccatgtaaagttttcagatcttagccagggttagaatcagttttgtgcccttccttggcaacacagaccagatggagaaaaaaaaggtgcaaattgtcccctctggagagatctgtgaactaggcttattgagtgaaaactctgagagcttttgttttcaataagaaccctttcaaggtttagtgttagcattttgtttttcctcttaataaatggaagaacaatgcggtaagttaaagctccacattttccaagtagattggctccgcgtgacaacacaaacctgagcaggcgctgaagattggctccgcgtgacaacaacacaaacctgagcaggcgctgagaggataaagatttctatgtatcagaagcatttaaaaatgagagatcctaagatacctaaccagtgtaagctagacttgcctgtgcttgtacaaccaccttgggattcttcttaattggacatatttttggaatcccagtcttgggcagggcagaggacgatgtggttttgtttctttgtcatgctaaattctccagaacattctggaactagggtcaatgctagattggttgtggtgtgagagagaaagaggaatcaaagatggtttcttatttataattttaattattttgaccagaagtaagtgatataccatgtaccgagatgggattaacagagctgcaagctcatttgggaactactaatggtaaccaagacattgaaaaaggagtgtagacagggaaagctgagaatttgcggggactaagttctgcagtgcaatttgggagaacataaaggccccagggtccagaattctctttcctagttacttgctagttagtatctggaattcttccatgggattcattctttggttttcttgtctgtgatattcataaaatattttcaggggagagaggaggaagggaaagaggagttctatctaattcatcctaaagaaagaagtaatgcatcaaggatgtagtgtaaggttaatttccatgaatgtcctgggaagagagggaagtggagttgaggggcttggaaagggatgaatgggtagacagagcatggttactgtggtctgaatgtttgtgtccccctataatgcatgagttaaaacctaatccccagtgcaatagcattaagagttggggtgcttaagaggattaggccatgagggcagagccctttagtgcctacaaaaggggcccaagggagcttttttgcatctttgccatgtttt

SEQ ID NO: 12112 - DNA, 2459 bp, Homo sapiens
gaaggaggggtgttttagtgtctgttttaggtcaaaattagtgattctatttttatcaaaagttttatcctgaagtttcaggaccactcttccttaataaacttgttaatggaaagcgagctttatgaacatttaaaaatgttgctgctgctttgttgcttaaaaagaaagttgccaagagagacttcttagggaaaatatttgggttttttttccaaaaattgctgaaatattgttttgccatttttaaaaagtctcaggttattaccactctgccattaaatatttgtatgcctgcatttttaaaaattctgtgcatgtactttatggagtacattctatttttgttttcagataccctacaaccaattttttttagtaatcttttagaattgaaattatcataaatgatcgagaataatcatcacatagtttaagattgtatatgttgagtagtttaaaacaatctttgcattttacagtaagaatcaaagtcccttcagtgtgcctttgtcagctaatatgtgaccagcaatgacaaccttgggagtatttattaaatattatgctatgaatataggcaacacagaacagggtttgcagtatagcgtcttgatgctaaattctcatatacctctacacgagaaatatggaggagaaaaacaagcatttacatatattcttcgtcactttgaagatgcatggcctgaactcgactgcttgtgtttgtttacatatcaggcatacccaggcatctcctgcagccagaggttccattgctgtctttgctcagtcctcttttaaaatatgaattagtggacaggcacggtgcctcacacctgtaatcccagcactttgggaggtcgaggcaggtggatcacgaggtcaggagatcaagaccatcctggctaccactgaaaccccatctctactacaaaaaaattagccgggcgtggtggcgggcacctgcagtcccagctactcgggaggctgaggcaggagaatggtgggaacccgggaggcagagcttgcagtgagccaagatcacgccactgcactccagcctgggcaacagagcaagactctgtctcaaaaaaaataaataaataaattatgaatgagtattttctagaaattcaacttgctaagcctgtaatacttaagggtagtttatctagatacagtactttcttccctgataagtagtatcattggagcccttaggtataggagaagaggaagaagtttaaaaagtgtaagtgggccgggcgtggtggctcatgcctgtaatcccagcactttgggaggccgaggggggcggatcacgaggtcaggagatccagactatcctggctaacaaggtgaaaccccgtctctactaaaaatacaaaaaaaaacattagccaggcgtggtggcgggcgcttgtagtcccagctactcgggaggctgaggtaggagaatggcttgaacccaggaggcggagcttgcagtgagccgagattgcaccactgcactccagcctgggcgacagagcaagactccgtctcaaaaaaaaaaaaaaagtgtaagtggattaaaagagaaacttggtctagttcataatatttttaatagggctttccctggctgctggaaaacttaggccagtaagcatctctttgtttaaagtcctacaagacaatttgaaataattcattgttcatgccaaaattctaagtactgtttttcttagcaagtgtaacataatcaggaacaatgggtacaagtaaaacattctttggatgatattcaaagccttattagcactgcacctgaataataggtcattttgcctcactcatttgccaaagtagccatttctaagttaaggaagtttttagataggctcatagccttgtatttcgttttagattgtaagctcaatggcagggatactatattggtaattatgttttcatatagcaaccaccacagtatattcttggtgcttaataaatgtttataattgttaacaataacctgttgtatattgtttattttgaatggtatatatgtgaaatacatatgaaaattgaagtattcatgaatatataatagaaacaagtaaatgaataaaatgacctggttactatagataagccaaattttgaaccatctagaacaatggtgtagtcttccctctactcaatgtaaatgctgggttttttaattattattattattaagaaggagatacagtccaggcacagtggctcacacctgtaatcccagcactttgggaggccgaggccagtggatcacttgaggtcaggagtttgagaccagcctggccaacacagtgaaacctcatctctattaaaaatacaaaaattaatagggcgtggtggtgtgcacctgtagtcccagctacttgggaggctgaggcagtagaatcacttgaatccagggggcagaggtt

SEQ ID NO: 12113 - DNA, 2094 bp, Homo sapiens
gtattgcttgtcagaatccaggtaaacaaaatcaaactacttctgcagtttcaacacctgcctcttcagagacaagcaaggctccaaagagcggatttgagggaatgttcactaagaaggaaggacagtgggattgcagtgtgtgcttagtaagaaatgaagccagtgctaccaaatgtattgcttgtcagtgtccaagtaaacaaaatcaaacaactgcaatttcaacacctgcctcttcggagataagcaaggctccaaagagtggatttgaaggaatgttcatcaggaaaggacagtgggattgtagtgtttgctgtgtacaaaatgagagttcttccttaaaatgtgtggcttgtgatgcctctaaaccaactcataaacctattgcagaagctccttcagctttcacactgggctcagaaatgaagttgcatgactcttctggaagtcaggtgggaacaggatttaaaagtaatttctcagaaaaagcttctaagtttggcaatacagagcaaggattcaaatttgggcatgtggatcaagaaaattcaccttcatttatgtttcagggttcttctaatacagaatttaagtcaaccaaagaaggattttccatccctgtgtctgctgatggatttaaatttggcatttcggaaccaggaaatcaagaaaagaaaagtgaaaagcctcttgaaaatggtactggcttccaggctcaggatattagtggccagaagaatggccgtggtgtgatttttggccaaacaagtagcacttttacatttgcagatcttgcaaaatcaacttcaggagaaggatttcagtttggcaaaaaagaccccaatttcaagggattttcaggtgctggagaaaaattattctcatcacaatacggtaaaatggccaataaagcaaacacttccggtgactttgagaaagatgatgatgcctataagactgaggacagcgatgacatccattttgaaccagtagttcaaatgcccgaaaaagtagaacttgtaacaggagaagaagatgaaaaagttctgtattcacagcgggtaaaactatttagatttgatgctgaggtaagtcagtggaaagaaaggggcttggggaacttaaaaattctcaaaaacgaggtcaatggcaaactaagaatgctgatgcgaagagaacaagtactaaaagtgtgtgctaatcattggataacgactacgatgaacctgaagcctctctctggatcagatagagcatggatgtggttagccagtgatttctctgatggtgatgccaaactagagcagttggcagcaaaatttaaaacaccagagctggctgaagaattcaagcagaaatttgaggaatgccagcggcttctgttagacataccacttcaaactccccataaacttgtagatactggcagagctgccaagttaatacagagagctgaagaaatgaagagtggactgaaagatttcaaaacatttttgacaaatgatcaaacaaaagtcactgaggaagaaaataagggttcaggtacaggtgcggccggtgcctcagacacaacaataaaacccaatcctgaaaacactgggcccacattagaatgggataactatgatttaagggaagatgctttggatgatagtgtcagtagtagctcagtacatgcttctccattggcaagtagccctgtgagaaaaaatcttttccgttttggtgagtcaacaacaggatttaacttcagttttaaatctgctttgagtccatctaagtctcctgccaagttgaatcagagtgggacttcagttggcactgatgaagaatctgatgttactcaagaagaagagagagatggacagtactttgaacctgttgttcctttacctgatctagttgaagtatccagtggtgaggaaaatgaacaagttgtttttagtcacagggcaaaactctacagatatgataaagatgttggtcaatggaaagaaaggggcattggtgatataaagattttacagaattatgataataagcaagttcgtatagtgatgagaagggaccaagtattaaaactttgtgcca

SEQ ID NO: 12114 - DNA, 1483 bp, Homo sapiens
aactataaatttattactgcttttcaacatgctttggattttaaagctaatggatcttttattaataccttttttcctttcatcttaacccagtgttactaaaattagatttcccattttttcccctatatgaaagataatttacatttaccttgtaaaaattatcaccctgctccacttgagaaccctgctgttgtttgcaaaatcaggaccaagcccatattttttgagagctctctagaagaatttatcttcaagaaaatatggtttggtgtttttggttttttcttttctttttcaaagtcccatggccagatatcctataatatactagatgcatgtttgctaatttttacttgaattttttttaaattgtaccaatcaaaaggttctttttctttccagctccaattttttgtaaaacagaagttccagagcacagaaggtcatcatcacaagcaaactttattaaaaaaaaactagaagtgtgctttgattttgctgttatttgttttatcacttctatatttggtgaacagccacagttactgatatttatggaaaagtactttcaagtacaaggtcaatacataagccagagtgaatgatactacaagttgagcatctctaattcaaaaatctgaaatccagaagcttcaaaatctgaatctttttgagcactgacttgaccccacaagtggaaaattccccacccgacacctttgctttctgatggttcagtttaaacagattttgtttcttgcacaaaatttttgtataaattactttcaggctatatgtataaggtggatgtgaaacatgaattatgtaattagagtcgggtcccgttgtgtatatgcagatattccaaacctgaaatccaaaacacttctggtccctagcattttggataagggatactcagcttgtacctatatattcatatatattcactgttgttagaaatgtttaagttgctgttctgtgatgaatctaaatcttttctcttgctaccaagctattgtcactgcagtgcattataccaaagagcgaagtcagtgccactgaaaatacagaacccattaatatcgtggctatctgattacatttatattccaagatgaaccttttttatatatgctaaaaattttggggaatatgttttgggatgtattatggagctaaaactctaacctcttaatagttttatagaacttaaaaattttttatacaattacccaattggtgatatgatcttaagcttttgtgtcagattatttaatatgatgacttcatgctttattatgccttattatggctgacgtattactgtggtgaaacaaaatatctttaaaagttaaaacatccagatatataagctattttttcctaaggataaagtacctttgagcatgagtgtatcacagctttcattaggaaaacttttcattacatacttgtttaaactctgtcttccagggta

SEQ ID NO: 12115 - DNA, 1211 bp, Homo sapiens
aggatcatgtaagtgtgttcactaattttgaatagtgtctaacacaggatcataaatgtgttctataaaaagaatttgataattatagcagggaaggatagtattcttgagtttgcagaatttactactttgaagttttagtgaactaatattacatactctttaaacattatgtgaaatgtcttcaggatagtttgtaaactgctaacaaaatattagtgtgaaataactagaacacttggttaacaataagttgtgtcttttttggtatttcctggtgattcattggctactaaatttaaagtaaatctggtctgttaattcacattgcctatgatacagtatttatactgcaagagtttcttccttggttacatgtataaaataatcgtagctgttaatcaaactgatcatttgctatttgttgtttcacatgttttcatttatttgttcattcagcaaacacttagttgtgtgccaggaattaaaatccagtgttgttcttttcttatttttttttggctagtggaaaatgaaaaccactgtgactttgtaaagctgcgggaaatgctcatttgtacaaatatggaggacctgcgagagcagacccataccaggcactatgagctttacaggcgctgcaaactggaggaaatgggctttacagatgtgggcccagaaaacaagccagtcaggtagggtggggttcttgggaagccaaccaaagaggaagttagagaggattgcatatttttatatatccaggatgatggggcatgtgttctttagaatctcccaaaaccatgatatagaatcatttggtaatgactaattattgtgcttcttgaatcacttgactccttcttgcttttgaagagtcttgctttttaagtccttgtctgactcaaaaagagttaaatatgatgaagaatgtatggcagaggccccctgtttcagttcatgctgacatgagtaactgaaggaaaataccctcattatttgatttctttttgtatttatctgagacgatgatatatttaactgttgtcataaaggtaagttggaacacaaatcattttcttagttttatttatttattttttgtagagacagggtcttactatgttgcccaggctggtctcaaactcctggcctcaagtgatcctcctacctcagcctcgcaaagctttgggattacaaatgtgagcctc

SEQ ID NO: 12116 - DNA, 1191 bp, Homo sapiens
ttatttttttccctttttcaagccctatctcatataccaatctaagggtattttaatgggaggaaaaccgtaatgagcttttgataacactgatttgtcgaccttttcccaaaattaagtaaagagaaataagataatacttaaatgctgatacaactatagagacttgttatttcagtggttagaaattataagctgctgatggtgtctgtggttcagaagctacaaagcatccattttgtagagtggtctttttgttgttgactgtacatttcagaatgcttgaagaaggagtatggggaaacttcaaggaaaaaggaatccattgaagacagatgccatgctttgagaagatgtaatgcctgattagtagtattctggacttcatggttttgtttttgttgtttgtttgtttaatatgaaaggttaatccagcacgtatggggccaagtgtaggctcccagcaggaactgagagcgccatgtcttccagtaacctatcagcagacaccagtgaacatggaaaagaacccaagagaggcacctcctgttgttcctcctttggcaaatgctatttctgcagctttggtgtccccagccaccagccagagcattgctcctcctgttcctttgaaagcccagacagtaacagactccatgtttgcagtggccagcaaagatgctgggtaagctgaaggtagtcctagagatcacagtgatgtgagtggcacctgtcaccttctttacatgacctgcattatcaggaacagtatgtaaaagatgaatgatgtctgccttttatttttagataggtatgttgttgaaaaagcaagtggcaaaacattgctcccaatcctttaggcttacttattccatgcttcttttagaatatttattttatactttcgtgaattaaaaattttcagtacctgaaagtcaacagtcactttgtaactgaagaatatacagctgttaggctaaaattccctttgctcactggctttgattgaatacctacagggatcataactgtctagacaattacttgacatgtgttctcatattccttctgtcttcccatagagagcagtttgggattaatacacatgattctgtctctcaaaatgtacctctgcactggaagtttttaccccaattttgagggatttttccagatttcagaaattatagt

SEQ ID NO: 12117 - DNA, 1104 bp, Homo sapiens
ggctgcctctcagcgcccacgagcaccccacagatatccacgctagtgtacaaaggttcccaagtggtggccttttcctgcttccaagggctgcccgggttcccccctctctgaaatagattggttgcttctcattacgtcacaagctgcagaaaaaaaatttaaataaaaagcctctacagctgtgtccttaactcttacctgtggataaggatggacttgcctgcccaacatcctctatcttatgtctttgggtgaaagggaagctggaatgggcagtaggggctgcttggggcagtcaggaccttcaggcttcaggcaaggagacccactgatcagacacctgcatcaaatgttggtgctgacagatcccttagatggcaccggtcctgcccctcctacagtgagatccctgtggctcagggagggaggttgactgccccaaagcacccatcacaaccctaatgaagctgactttcaaccacacttcctatactccaccctgaaccgggtccagtactgcctgcattcccagtccagcagactcttaggagaaagcagtgattaaatgtaagttaaaaggacttggcaccaggaagagtttatgaacacatttgagaagcagacatactaactcttctttacacctttggaaaagcaaaggctttgtgtaattggaatttgattaactgaattaatctatgtgttgctttcttggtcacattataacaaccaccttaatctacatttttttctcatagctaaaaagatttattcctatttcatatggtacattattacatgaaatcttaaaataagttattgattgattgaagcagagtctccctctgttgcccaggctggtgtcagtgacatgaccatagctcactccagctcactgcaggctcaactttctgggttcaagcgatcctcctgcctcagcctcctgagtaaatgggactacaggtgcataccaccacacccagctaaatttttaaaatttttgtagagatgaagtattgctatggtgccgtctggtctcagactcctggcctcaggtgattctcctgccttggcctcccaaagtgctaggattacaggtat

SEQ ID NO: 12118 - DNA, 1286 bp, Homo sapiens
caaacatcaaagctaaagcaatgtttataaagttttatggtataactagggggaaatgagctgcacaaacctcaatgtattttaaatctgttgctgtcatcattaacggtatatgacatataaaagcaagttaaaatttacttttgtaaataaagtttttggtttgtttccaaaactcttgatgattgctttagttttggacttagagaatagagcaggggttgctggagtgaatattgatttttaaagtctttgaactgtggtggtataggtgaagtgactatgcccaaaaatgccaagttttaaaagaagctatgtcataaagttttactttctgtggcaaaagagcgctttagcatttcctcagatgtcacagttgtcctgtctaaaataagtttgtacttctggtgacaatgccagacactcttatgatgtgatcaccttaaacaggagaaggagatttttgccctcagttgctcaacatgaagtactgtggactgaattgtgtcctcccagaattatatattgaggccctaatccctgtgtgactgtattaggcaatagggcatataggagattactaaggttaagtgaggtcatcataagggtggggccttaattcagtagaattggtggcctcctaagcagaggaagagagatttttctttctctctctgccatgtgaagacagtgaggagtcggccgtctgcaagccaagaagagcccttatcaggaacagacttggctagcaccttcatcgtggacctccagcctccagaattgcaagaaaatacatttccgtcgttgaaaccacccagtctgtggtattttgttatggcagcccaggcagactaatacgtgaagcctgctctaaatagataaaataagaaattactacagagggctctttagaaattgtatttaaaaacaagacaatccatatttacctaagatttacagaatgtatgtctataaaaggagggatttctggactagatgatgatgaaaaatgttcatataaaggcacctccagcttcgagttgccaacacaggaggaagaatgctccctgctgttcagatgctgatatgtgtcctgtgcttcctggatggccagtgggatcataagctggtagaagcaagaccttcatccactgacttcatatttcttccacatcctgaactgtggtgtttgactttaaaaataaattaaagcaaatagaaatgtttccattgagattttggcaaaaacccacatgacatttgcgtctgcagagtagacttggaag

SEQ ID NO: 12119 - DNA, 1287 bp, Homo sapiens
tccatttcatttggaaaaaatatgtgtaggtaaaggaaaaattcagagaaaaagccaaaacgttaacaccagttatctttgggtgtgacattccaagtgattgttatgtcttgatattcaatatttgaaattatctctgttgaacttatatttcataatcagggaaaatatttgtatttacagattttttttttctctgagacagcgtctcgctctgtctcccaggctggagtgcagtggcgcgatctcggctcactgcgagctccgcaccccgggttcacgccattcttctgcctcagcctcccgagcagctgggaccacaggcgcccgccaccacgcccggctaactttttgtattttttagtagagacggggtttcaccatgttagccgggatggtctcgatctcctgacctcgtgatccgcccgccttggcctcccaaagtgctgggattacaggcgtgagccacagtgcccagcccagatttttttttaagttacaaacttttgtagtcttctaatgatggctaagctagttctgataataaagaaatgtaacacaacagttacagtgatgtcatctcttcacctgacagacaggtcctcataacctagaaacttgtctgagcgtggtgctgctgtctctcgccatggtcatggctggctcaggaaacctaaaggttttgcagctttgtcgcttcttacacatgaaaacgggtggtgaaatgaactatggttttcacttagcccaccacatggcccttggacttctatttttgggaggaggaaggtaagtgaatatgtatttttccaatgaaaagatctcattggtgagatctataagggtgacttacgttgatcttgaagataacatgaaaaatttaaattctgactagctcttagcttaactagcagcattattcgacttgatgggcttctttgtagtttaaccgtcaacttatggtctactcagtagaattaccatcctctctgacacactgagcatcactgtatttctcagaatagtctgtgctcggttcttcagtgcatcactgcttgtgcccacctggttaaaaattttaccattccactaagctactttctcagaaaggtcacaaacaaaatcgtttaccagatcctgtgacattttcttagttttcagctttcttgatctttttccaacatgtgccattcctgactacatcctttataagactgccctggctttagatgaaccaaaaaccatgtacagaaaagtgtataaatcataggtgcacaggtcaaagag

SEQ ID NO: 12120 - DNA, 1147 bp, Homo sapiens
gtgtttttttcagtagagttgtttaaaaacatgtcttaagctatccctcccgaaatactgtctttcatcaatcatcaagtctgttttttttttcaaatgagttctaggaatcctgcaagtagaaagttaaattatttcattactctccaattatctttttaaatcatcctcaccatgttggccaggctggtctggaacccctggcctcgggtgatccgcccacctcggcctcccaaagtgctgggattacagagtgtgagccaccacacccggccagcaatatagtactttttagaaagatttgtagattagagtcccagtatacattgcggctccaacccatgcctgctttggaaaacatattttctctgtgctagtatagtcaagacacatcagcctatatatcctcatgttcagcaagtgcatgttaactgcttttgaaattattattacaataaagtctgttactcaggtgctctcatcagatgttccttcaggaacagaaactgaggaggaagatgacggcatgaatgacatgaatcacgaggtcatgtcattaatatggagtgaagatttaagggtgcaggatgtgcgaaggcttcttcagagtgcgcatcctgtccgtgtcaacgtagtgcagtacccagagctcagtgaccacgagttcatcgaggaaaaggaaaacaggtgaaagaaaacacgtgcactatctcttgtcatgtttcattgttacatttgtgtcttgtgtatatttgtttttccttcaagtttttagcatttaaaaccctaaagagatttaaaagatactttcaagtgaaaatatgccctgtgttttaagttttcatccaacttcaacaaaccacgtgtgttagcaaaatgtctttggcttttgaggacgtaattgttgtatttcatatcgtcctcctcttgaaatacatataacactttactctttagaaaaggtgaatgtaaaactattttgcctgatagttaccttaagaatttacaaacaaagaaaacactggacttgtttttctgtgtcttgatcaggaatagattttgaggttagtggggtttttagtgtagtttaaacttgtatgagtattttttttttttggatatgatagatgatactccaaataaaaat

SEQ ID NO: 12121 - DNA, 1320 bp, Homo sapiens
agcttccagagagaacagaagcagatcacttatgaatgaatcagaattacatcctgcttctctagagcaacccagaactcaaaggaaatatatcagtgacttcaaagttaaaacaaaaaatattttcctttcgaactctgtacccagccaaactacctcaaggtgaaggtaggaaaaagaatggcattttcaggcatgcaagtcccaggaagttagtgacggataagctccttgccaaagtaaaagagtaaaagccaaagagagtgagaagcggggagcatgttccaatgaaagctgacggctcttgactaccacaaccccgccggtttcaactgcaaagatgaaacagaatttagaaacttcactgtttggcttgaagaccagaaaatcagatactacaagactgaagacagaggtaatttaagaaacatccacagcagtgactggcccgagttctttcaaaagtatctcagagatgttaactgtcgtttaaagattcaagatcgacaagaagctattgactggcttcttggtttagctgttagatttgaatatggagataatgctgaaaaatacaaggacttagtacctgataatgcaaaaactgctgacaatgcaactaaaaatgcagaaccattgataaatttggacgtaaataatcctgattttaagcctggtgtaatggctttggctaacctgcttcaggttcaatgtcatgatgattgcctggtaatgcttaaggcaattcaaattttggttcaggagcacctgacacaggatgcagttgctaaagcaaatcaaacaaaagagggcttgcctgttgctttagacaaacatattcttggttttgacacaggagatgcagttcttaatgaagctactcaaattctgtgactgctgtatacagaagagctcagacagctacagacaaaaattaatgaagccatagcagctgttcaggcaattattgctgatgcaaggacagaccacaggctgggaaaagttggaagatgaacactttaggacttcagcttttcacctatttagtctatttagtacaattgggaaccatgtatacttccggcatgtttggaaatcaatatatcacattctcgggggaggaatcccagaaaattgagtaagttctagaggtttaccaccattacttttttctttaataaagtttaggaaagtagaaaaaaaaaagagtagaagccaagaaagaggacctgggctctaggaaacaggagctggaccacaggaggcatagaggatcctcagaatagtagtaaagatagctggaccccagacccagaggga

SEQ ID NO: 12122 - DNA, 1655 bp, Homo sapiens
gtgtatcaaaatgaagaattcagatggtaggaggttctatagtccttttaaagctgactcttgagtgtcagttgaatatccattaaattggatttggaaataacctgaggaaagtattatgataaagatctgcacagatgcctcttagctgataggtggcaggcctgtgggtttgggttctccctcttttctctggaacatatgacaattccagattaaagaaaaatgttttttaataaatacccttggtctttcttctagtcacctttgaggtagatattgtgattttctggagtatagtatatccgtgtctctgtgtcttaggtttactagatgcaataatacttctctttgacatttgtactgaagtgatttgatattaagtaaaacagttaatgtttgaatataggcatatttataggttttttccgctcccccccaacccaccctttttaaaaaatctatacaaagcccttgtttgagtctcatcatgcacatcaaatcatggagttaggtcttctctgagctcaggggaacacaagtgcacagagagagatgtcttgagggtcactaccaaagaattaccctcattgtccctcactcaggccatgtgtacatgcgatgctgctgagtgtgctggggtgggtggtggccacgtggctcccccagagcacttcctaactggcaagctgggagacccattactggtgaactttgtggaaattagaactgtatcttttacataatcttggcatattacatttcataataaaaacatacatttagttgcatgctacatcactattgattttataattaatttcttaagcttcaaccatgttttataccttatttcgttacatcatatatttgtaatgtgtaatatgaaatcttttgctttaatgtctttttttaaaatgtagaatgttctaaacttgaaaggcaattgaatgtagtatgatgaaaatgtgaatgttttgctgctttcatgaccaaagatacagggctagtggacatttagaataataattaaagctagagtcttgtatgtcttttctttgaaggagttctaaccttgtaaattgagaatgacttcagagaattttgattaagaaaacattaaaatcttaaccggcacaaacactccaatttttttcactgtgaagccgcaagcaattttttttctttttctttcaaaagcctaccttctgaatttatttcttgtttactcatttcagagagggtagtaaagaagatctatttctggtagtcatatcgcttgaaaggtattggtaaatgtgttttcagtcgtgaccatgtggaaagtgaacagtgttggcaaacattaccgagaaaatcatgcttttcaagatgcccttgctttgggatatccttcctagggagaaaaaaaaaaagtagtttaacaattgtgaattccatttcttatttcagtttctgctgcagtaatgggttcccacccactataattcccagcatttatgttctgttgtattctccccttagcccagtaacatttttatctaataccccattccccaagttttgagacagattgaccccctactcattatgtggctctagttgaattttaaaatgtggaatattgggcttgcaggcagtaggagctgcaaatc

SEQ ID NO: 12123 - DNA, 1100 bp, Homo sapiens
tcatccctgtttctgcacagtttcctgaaactggccatcagggcctctgaggcactcaaatcagtttacttttagcatgcccccatcagggtgggtctcactgttagtgaggatacgggtctggtttgatgtttttctaggcaaaatgcttaagtgttctggttatgccattcattcatacgatgtgtgaaatttgcttaaaagggaattttcatgatttgatttagattagtatttaaatatctgctttagatagcaattaattttattgtaaaaataaggaaaaatatgtgaatatgtgaattttttaagcctgagagatgatagaatgttcccatatttttcttgtaaagaaaataatattttaacttacacatcctgtagaaaataccaccttttccccttgtattacagtacaatgtttacattactatactgtcaagctgaaagtataaaaaatgtacatatacattttgagttatgtatcctttttttaaaaaaaagttcgagtctgttgcactaggctgtacatgactaaagttgacagatgctatgctagatttataatcactagttctggtacttgtgtctttgtatgatcaaagcatgcaataagcaatacaaaataccaagccttatacttaaaagaagtttaacatattggttaatatactggttaatatactggttaaacatattgaatgtatataagtggcaaaactagatttttaaggaagtgtacattataatattggagctcagtactgcatgaagagacttcattaaaactaagaaaacatttatttggggagaaattttaggcatttaagaacttgtatttttctattttaaaaagttaaattattccgtaatttggaagaagtttcgttgaatgtaggacataaccgtttgaagggttttcatttgaaaaattgatgtattttgtgccttaatattttgttcttttaataaaaatgctctgaatttgaatgattgattcttgatagtatttattggtgctagattatataaatctgtaggacatatagacatatatagactccaatagatggcaggacataaaattcttaaaacaggag

SEQ ID NO: 12124 - DNA, 1123 bp, Homo sapiens
tgcactggcctctcggcaaaggtggtttccctcatcaccttcctgatggtgtttggtcagtcacctgtcagggtttgtgcgggttgggccccaaaacagcatatgctgctctaagtctgctctctgcatgttttagaaacaaagtggcaagtctgccctgaacctgtaagcatcaaataagcatgagagagaaaaaaacatgatatattgctttacttaataggttgaatatggtaggtctttgaaaatatgatgattcaattttctcaattttctttgctttaaccaaaattctaaatgcagttttgcctagttccctttttttttctttttttacttttttttaaacgtttgtaaaaacctctttgaggatgaggagtcagtaaaattccactccccaagtggccctgccccagacaaaggttgctttccccctttttgttctttttatgcccccaagcactttctgcagtagctagagggacaggtttccttccaggaaggattcgagttcctgtgcctgtgggtattaggagagtatatatcctgcctgaatggggaagtcttctaaaatgggaaagaagtggtttcatctccacacagtgtcttgtaaatctcaacaaatgtgtactgttagaagtggcttccgcttactggattaactaatactttataggcttttcaggaggccacatcactagcagtagggagaacaagatgtcatttgtgttcagtgtaagctgagtaaacaggcccttcctagagtgtcctggaaatcacagcaacccattgaaaactgccctccccaccagaacgtgctacgttctttcttcatgcctatgtgtgctccattcctcatttctacttggctcaagaaaacatttctgcagtcaggtgagacttttacaaaagaggagaaaatcaatgcctccttgaacatgatgagatgtgagaacttacaatgaaaaaggcaataatgatagaaattatttcttaggtacagcaatagttgataggatgtgagggtgttaccttggggtgaagtggagaaggtcccaggtgaattggctctcatggaaatttggaattacaaaataaacgtcctgggggttacccagaatac

SEQ ID NO: 12125 - DNA, 1158 bp, Homo sapiens
gaatgattggttcagaactgttcctttcccttccatgatgtccttgacacagaaggttatgcctggctcccagtcaggcttcatacttttggtccatgtaagtgctacccgttgctgggggaggagtcatggtttatttggaaatgtcagttgcaatcatggttctgtcatttgactgcacagtatcagaggagcctgttaacctctctgtgccttagtttcttagcccatgaaagagatcattgcctgacccagggactacctcaagggcttttgatgaggacaagtgacagtaggaagatgcaagagcctttagtaccaaggttctcaacactgactacatgctggaatgactgtgaagcttttaaaaaatgttagtgcccactcttcccctgtacccccggacagttaaatcagaacctcagacagcaatatgccttgagatgccttgaaccatgcttgagaaggaaggacaaacacattattatcttggaagaattgcataaggcttatgacttaaaaaaaaaaattctttttggaaacacaagcatttctttaaggatgaccggatgttgccgtatgtatttatggcacaagcaggtgttgtctaagcagtttctctgtttgcttgtcatagcagcatttggaaactcaaacatgctttcatttacataaatagtttatgaagctttgacaacaaatgtaaacagacacgaaattataaatctgctaaatatgtattaagggtattaattattgaaagtccctttccccaaaactcaactcctatggcaattatgaactccattttaccaagaacatttaagtgcctcagcatctgtatgatatagtggagcaggtgctgacataggtaccagctgacatgatgtgtcactagctctgtgggatgattgccacatacatggaacacctgggagtgctggaaatgtactgtgatcgaagtgacaaagtgtgttttcattcacagtggaggctacatcaagcaaggggaggtccagccctcttgcaagtgtggtgagaggctctactagcaaagacatgggcaccggagtaggtcccgtgtagcatgcgggtgctgtagagaaaattcagtgacgtacatggctctggttctggacacaaaatctgtactggaga

SEQ ID NO: 12126 - DNA, 1100 bp, Homo sapiens
gccctttctgtaggctgcttgaggcaactgtcttcctccatatagttagctgagagaacagagagcagaagatgcagaaggaaaaagctgcagtgccctttgtgatctagccctgggagtctcccattatctttttcaccacattctcttggtcaagcaggccagccttgattcggcatgggaggaaactacacgtttgtgaacaccaggagatgaggaccctggaggcaattgtgctgtctggctatcatacaaagaatgctttattttagagagtttactttgattcagcaatagcagagtgctaattttccttgggtattaaaaaaatgagagaagataattattagtgaatagataaagtattttagttattagtgagcaattaaaccttttattttctattctaggcacttgtcagcttttctgattatcagatctttcaggagctcatcaaaggaaaagaggatgattctttccttaggaactctgtttctcagatgttaaggattgtaatggaagagggttgttcgacacaaaaacaggtccttaactacctaggtgaatgcttcagagtaaaactcaatgttcctgactggtacccaaatgagcaagctgcggagttcctgtttaagtatgtgtgctttgtctaaactgtttttggaggggcggagggctgtcagtggttctttgtattggttgcagtttgggcgggcgagtcatttgggaatgagaatgaatcttggggtagaatcctggtccttgctagccgggggctacctttgtttttgcggccctcctcacttgtatttttttagtagtcgtgttttattttatagtactttttaacttttattttgaaataatttcagacttccagaataatgtccaaatagtacattggattctaattgtgaacatttcattcatttacatttacttttttactttctgtgtacacagatgtacatttttctttctgtacaatccctgaaagttgcagggattgtatcactttatttctccaaagcaaggactttgtcttatataaccactgtataattactaaagaagccagctccatactggtgctgtccagt

SEQ ID NO: 12127 - DNA, 1151 bp, Homo sapiens
aaaataaaacaaacccattttttttgctcatcctctaagaagcaattcctcatccattcagtctgattatgggattgcagcaattcactcatagcttcaggctctacttctaattctagtggtcttgctatttctaccacatctacaagtccagtagtaacatcagagatcactaatcacagatcaccataacagatataataataataatatttgaaatattgcaagaattaccaaaatgccagcacagagacacaaagggaacacttgtcgttggaaaaatggcattgataagcctgcttgaaatatctgaagtgcagttaaaagaaataatgcctgtacctgttttagagacaaggataatttgatatctgaactgatacagcagctgttgaccccatctggagggaatctggaatgttggatgaagcattctgatgtgattgtgctgtttgtttcctttaccaggggtcactcccattgatggagctccccaccgatcatacagtgagtgctaccctgtcctgctggacggtgtcatggttggctgggtggataaggatcttgctccaggcatcgcagattctcttcgtcattttaaggtgggcttgaggctttgtgaattgtcctatcccttgaccttaggtttttcagttcctttctagttttggggttaacccctgggcggtctagagtgatcaagtggtcagggggtcacaatgtccagaatgcctgtgcattccctctggtgacagaggcttgccttatactggcctcattggttggggtcagtgacagatatttgacccatatacattctttggcagtttcattgaggcacctcagtctgcttatctaactaattttaacttttttcccccttcttaatactagtggcatagaagggatctcaaaatacagatatttcagtaatattcaaaatatgcaaggtagaagttataccccattgcctcctaggttttgaaaatatatttttaaaaagtagaatgacattctttgaataacttacctttgggatttcctcctagtgaagagtatttgttgctttgataatggccattgaaagaattatcctttggcaacaggctgtttgtggtttatattctgttctgtgtttttatttttaaaaa

SEQ ID NO: 12128 - DNA, 1584 bp, Homo sapiens
ggctggcagcgcaggggctgggctgggcgcgcgcgggccgcggaggacccggagccacgtgcctctccttctcgcgcgtcctactggggatgggggtctggagtagccggcagaggctattgcgggaccccgggcgcgtgggtagagcggggtgccccactggccccccaggggcacgcagctattgttatttcccccctcccccgcaggatgaacttgcgtcctttctcttctccgccatggaattctgctccgtgcttttagccctcctgagccaaagaaaccccagacaacagatgcccatacgcagcgtatagcagtaactccccagctcggtttctgtgccgtagtttacagtatttaattttatataatatatattatttattatagcatttttgatacctcatattctgtttacacatcttgaaaggcgctcagtagttctcttactaaacaaccactactccagagaatggcaacgctgattaccagtactacagctgctaccgccgcttctggtcctttggtggactacctatggatgctcatcctgggcttcattattgcatttgtcttggcattctccgtgggagccaatgatgtagcaaattcttttggtacagctgtgggctcaggtgtagtgaccctgaagcaagcctgcatcctagctagcatctttgaaacagtgggctctgtcttactgggggccaaagtgagcgaaaccatccggaagggcttgattgacgtggagatgtacaactcgactcaagggctgctgatggccggctcagtcagtgctatgtttggtaagttctttttatgttttgtcctcttcgtggtgggtgagcaaatttgtatcatgggtggttccatttttgtgcataacctttccgattaacctttctgaatgtgccacttacataatggaattttgatatttacttaataaaactttactatgtttcaggttctgctgtgtggcaactcgtggcttcgtttttgaagctccctatttctggaacccattgtattgttggtgcaactattggtttctccctcgtggcaaaggggcaggagggtgtcaagtggtctgaactgataaaaattggtatgtttaattccaaacggcttcttaattttcgttttcgtcatatgttaccatggcattaggtatgggaggatgtgttctaacgtcgagggacagacccaagaattttgaactcttaaacatttaaagtggtttttggtttctgattttcattatttgatattttttcttaatgtgttctattccagtgatgtcttggttcgtgtccccactgctttctggaattatgtctggaattttattcttcctggttcgtgcattcatcctccataaggtaacctttctcccccgtatgaagacctttcatggagcacacccaatcgatttcaaacccagtggtacttttgcagatgtgattggtgtataggtatgcggccttggaaaattttaaaaagctctttgttctgtgcatttcttgtatgttgtggagttctctgaaagcgagtttttaatactcaagagggcagtcagga

SEQ ID NO: 12129 - DNA, 1099 bp, Homo sapiens
tggcatctttgtcagatgtttagataagatggttggcgtacgcatagtctgcatgttgtatttttagtctttgaagatatgaagtcaggtaagcaacatcctaacatagtctatttcttgacatctcttacaaacgtagagtatagcctatcctcaggtgtgtgctgaagtttatattagggcttttgggtaccttagaatgtgggtattgcaatctttattcaggatgttatcagtcactggtacagttagtcttgttattaaaagaaaaaagaaaaaaaaacaggtagaagttggaattagccttcgtaggaagaattccagatgcaaatgcaggaaaaactctgttgtccttggaaactactctggagagagttattggcactataattcccaaacctaccctgttaaaagattctgtggaaatgggttaacctttataccttttaagatattgatcttaatgatgttttacaggcagatccagttcctaatggtttgcgagctttgccagttttctatgcctgcacagttggaataaacctcttttccatcatgtatactggagcaccgtgtaagtacctatcaaaatatttaaatgtgaatttaaagttgtttacaaaacttgcattaaatgcccaatttacccctttttgctttacagggctgaaatctcctagaaggtggctggcctgcgcccatttcagaaggctgcaggctagtgtacgctgagttaacctagatagtttttcaaccaaagagacctgctcagattctaaatcactacagacctttcctctttagtcttcacaggatccactgataatatgatcatctccttccctttctcctgtctatgctaaaaatgctggaattaatactgacctcaactactgaagtcattagttatatctgatcttcagtaatcagtcatttaggactggtttgctggatattctcatttttctctcccaaatggagatactattgtttctaagtactaaacttccatgaatctgcttgaatgagaagagttgggatgtttaccacctgctctaagtgcacttggaagaagaaattcatgcagctaagaggaaaa

SEQ ID NO: 12130 - DNA, 1403 bp, Homo sapiens
catttttatggcctggtttgtcacagtccccatttctggagttatcagtgctgccatcatggcaatcttcagatatgtcatcctcagaatgtgaagctgtttgagattaaaatttgtgtcaatgtttgggaccatcttaggtattcctgctcccctgaagaatgattacagtgttaacagaagactgacaagagtctttttatttgggagccagaggagggaagtgttacttgtgctataactgcttttgtgctaaatatgaattgtctcaaaattagctgtgtaaaatagcccgggttccactggctcctgctgaggtcccctttccttctgggctgtgaattcctgtacatatttctctactttttgtatcaggcttcaattccattatgttttaatgttgtctctgaagatgacttgtgatttttttttcttttttttaaaccatgaagagccgtttgacagagcatgctctgcgttgttggtttcaccagcttctgccctcacatgcacagggatttaacaacaaaaatataactacaacttcccttgtagtctcttatataagtagagtccttggtactctgccctcctgtcagtagtggcaggatctattggcatattcgggagcttcttagagggatgaggttctttgaacacagtgaaaatttaaattagtaacttttttgcaagcagtttattgactgttattgctaagaagaagtaagaaagaaaaagcctgttggcaatcttggttatttctttaagatttctggcagtgtgggatggatgaatgaagtggaatgtgaactttgggcaagttaagtgggacagccttccatgttcatttgtctacctcttaactgaataaaaaagcctacagtttttagaaaatttgttctcatggttttctttcatactcgaatcacctgggctcctgatcagttagcctaatatcattcttaggtgatgtgaatatcttaacaagtgagagctactgtccaacttaaagctcccaacccctccctgtatgcttcttgtgtgcccagaatatgcaagacattactccatagggactgtggtggcaacttggcattttcccttttagtagcacagcctgtacactttcatgttagcacacgggtgttttttttgttttgtttttccagttttttcttttgatactttttgtttttttttttgagacggagtctcgctgtgtcaccaggctggagtgcagtggtgtgatctcggctcactgcaacctccacctcctgggttcaagcaattctcctgcctcagcctcctgagtagctgggactacaggcgcccaccaccacatctggctaatttttagtagagacaagctttcagcatgttggccaggctggtctcaaactcct

SEQ ID NO: 12131 - DNA, 1500 bp, Homo sapiens
caggtgtgtgccaccatgcccagctaatttttatattttttggtaaagatagtgtgttgctatgttgcccaggctggtctcgaactcctagaaaaagccatctgaagatgaaagctgctctagacatatctcttgtatcaccctatgttaaaatgtcttccctgttttattattgaataagaaacaaaaaataataaagataatttttttaaatgataaggtttttaatgcatctcttgctgtctctcagaataaatgggatgccggaagtgcaagacatgaaatttatcactcctgtacggcgttcgtcgaggattgagcgagcagtgtcccgctacccagaaatgctgcaggaacacgatttagtagtggcttctcttgatgaactgttagaagtggaagaaacaaaatgttttatattccgtagaaatgaggcgctgcctgtaacattggggtttcaaacccctgaatcataatttcttgatgctttttttaaaaaaggtgtttcagaaccaacataagacaagaaatattcttgtccaagtgacctggaaaaaaagagaggcatcatggatgcagattatggacgctcaggacttaagtaattcactgggcttactctcaaattttctctccccatgggaaaatctttgctttatgtgtttaagaccagtttgccagttttacagtatacataaatttcaaacttttgaatatttaccctacaactatgataaatatttatactttattgatctactttaatcccaacatagttttttatatcagaaggttggtcccacaatataatgggacttttctttctgcatccaccttagcagagggcaagttctttcatcgtggaagatctgaactttgacgctagcttgacaggctgaatggaccttgacagatggccaagtcaaaacccctcattttacagatgagtttatgctagctgtgcctttgctcagagatcataaatttatgtgtgatctttgactttcatcacagtatccttgtaaatgagagagaattcttgttttttctatgccaggtctcctcagatgaaacacaatcctgaattggcatggtcgtctagcttttatattcaaacctagttttgcatttgttactcagaaacacttcaagtaacaaaaggggggcaggggagaggggtggggagtggacacttgcttcttcagttctttgctcagctagggtatagctggcctgagaaggcagtgcaagccccagagactgttgtaggttgctttttcttcctcctgggcaactatttgtggaaaggttttaccttagtcattatgtaaatataattgtgtagaaaaacctagtcaacacattttaaattttagctttcttaatatttaagtattatcttaaaacaacattaaatttctattagttcctgcttgtttatcttatttattatagaaaaccatgataatggctttgcatagagaattaggagtttgtcta

SEQ ID NO: 12132 - DNA, 1126 bp, Homo sapiens
taatttttcttttctgtttttttttttttttttttttttttttaaagacaagacagggtttcaccacgttggtcaggctggtctcaaactcctgacctcaggtgatccacctgccttggcctcccaaagtgccgggattacaggcgtgagctaccgtatgcagcctaaatctactattaaaggaaaaagatttgtcaccttttaagataacaagaagaatccaatttattttctaaagatagcttgttttttctttccattcatataacaagtatcgtaagcaattataatgtcactcgtgtttggcacaatatatgtctcatagaagagtcttctaaaggttatgaccactgacagtgatggtcatccaattgaagagattcctgagatagctatttttaaagcgtaacacaaatttagatgagtatgttggtgggtttattatgattaaacatgtaacttaaggcatttctcctttctgcctcagtctcttccagcaaagagctgtttgtcttctgccatctaggattccaaggaagtgggacactccagtctaggctgttttggtggaaacaacctttgttcagtattgagtagtgcatttacttgtaataatacaaataagtcagctgatgacaatggctgaaagggccaggtcatggaaaccaagaagtgagaagcatttcaggggatgattcttttcttctttttcctatatgtcctggatgatttttactggtacagctagagaagatgaatttaaattcaaaaataatagtaccttctgtggttctgtttgagtcttgcaagatattaagaacaactttccgcaactcttgtattggctggaaggaaggaagaaaacatacaaaatcttaaaaacattcatgcaaaaaatttgctaaggaactttaacttcaaatacatgttttataataaaagtttccttttaaaatctcgtctaactataaatcttttgtctagcttgacagttttatagcttcatgagaaaagtaaaggaacagagaaaattctgattaagtgttggcacactcgacttaatgaacagatgtatttaaagttgtccataatgtaatttgtctacatcaaattctattttcctatt

SEQ ID NO: 12133 - DNA, 1147 bp, Homo sapiens
tgaatggagttccgtatttgtgaaactcagagaagctattttctggtagttaactgttcttaaatgtgccgtatgttgtatattactccccctccctgcccgccccgtatcgcgtatctctctaagtataatctgaagcgtgcagtggataccatgaaagtactgagaaaggtggcaagtatgtttaacacattttggtccttttcattgatttgctttgagtttgaagatgaagagtaaaaaacgatgtgatgaatcttaccttgagttattcacgttttcatagcataatttcatggttgtttttaggggtgctgagttcttcacctccttttagactgagatctgccaagttttccggcattgctcttgaggatctcagaagggctcttaagacaaggtagattccacgtttatcctctatgtaactttcacactgaacattagctaacaaaagtcaaatgtttctgttatactaatgttctcatttttaatggttgtttttctaaaatcatctctaatgtgatctgtattttctaaaaaacagactgcaaatggtgtgtgtatttgtcatgaaccgaatgaattcccagaacagtggtttcactcagcgcaggcgaatggctcttgggattgttattcttctgcttgttgatgtgatatgggttgcttcctctgaacttacttcggtatgtacctttggtccaggaatgatgttacattacagccacaatgttaactcttaacctgtagtaactctagccgttacaatctcctgctttctaaaagcagtatcttaaatactattgaatttttaaaaaacgttgaattattgccacttgaagttaaaactgaaaggatgatcctttttattgtttcatacagttttcttgtatcttttagggagggttacttagagagactatgcatattttcttacatttgaaagtgtaactcgtggctttttttctaaattcaaattctttctgtaaatattattttctagtgaaataactgtcaggatgcaaaacaatgtcaccatttagtagaaggttcagagtgcttttggacaaatgagtaaaaataatgagttttcatgtataggtcactgttacaatgcccatgagtggttgcatccacatttatg

SEQ ID NO: 12134 - DNA, 1222 bp, Homo sapiens
tcggctcattgcaagctccgcctcccgggttcacgccattctcctgcctcagcctcctgagtagctgggactacaggcgcccgccaccgcacctggctaagtttttgtattttttagtagagacggggtttccccgtgttagccaggaaggtctcgatctcctgacctcgtgatctgcccgcctcggcctcccaaagtgctgggattacagacagttagttctgtactgtttaatgcaatcttccacatttttagctttaggacagaaatagcctttataaaatatgtaaatcttacaaatcatgctcctaaaagcaaatgtaaacctctaagtttgtcttaataaaatgtagggagtgagctattttattgcataatacaaaattaattttatgtattttctttccacagatactacatttaaaattgaataaagtactccagggaactagttttttttttttcgattaactctttgtttttttgttttttttttttgtttttttgcctttcttctttctttgtgctcaaggctgttcttgccttagctgcatcttggacctcaagacaagtaggagaacggacgttgaccggtacggtaatagacagtggagatggtgtcactcatgtcattcctgtggtaaggctattttacagttactgaacagaacatgaaataacacatctggcaaagttaaattatacgaattaatgttacttttaaaaaactttaaatgctgcactataatttggccatttgtccagttatagctatgttttgctcaccgtttaaaacttttataaacaattcaaaatgtttcttttactgtaggtttgtactgcaattaagaaaattacaaattgcaatatctggaatggaagtatattaatggctttcattctgttttccagttggatgtgtgttagccatttgatgacctcttttattcataattaacagatttcagactggtgtacagggtaactgtataacagttagttttaagtacctgaactttagtagatgctttatggtttgtacttaataaagcatattaagaaaaatgcatcaaattagattgtcagaaataacatttttcttccaaggccgttgtgcttcagttcttaatgatacatcaagttttaaaaaaattatgcctaatgaattcaaaatgactactagaattcatactgtttattattaaatgggtatatagagaaa

SEQ ID NO: 12135 - DNA, 1990 bp, Homo sapiens
aggagtagttttatctgtagttaggcgaatgccgcttctttacattattggtgcaatgaaagtatgggaaagtctcaacagaacagactggacatttgagaaccttccatttttcaaaatttcagaatcctcgcagcaggtgtgtgagacaaggattggggacaggagttaattgctcttttggagttccgataaagatttatagctgattttaagtcatggctgctagaatttctaagctttcatgccatgaatggactaataataaacattttagacttaacatctattttaaagcatcactcttaaagtttatttcaatataccttcaagatggtagatttttgacccttataaaaatacatattttttgttttcagcctgagttctaccaagtatgccacaccaaaaaggattatgaagaaattggacctagcatttgtcgtcacaatccagtgtttggagtcatgtcgtaaaattggcttcatagttattggggttagggaggtggggaagagataatctttctgattacctgttttgtctggatggctggttttgaggttttaaacctgacttgaaatagtaacaccaaacatgattatacaggaatattttaataagtgtatcaccatgcagatgtagaagagagcgaaagtgattgtgtttttctttagattgaatatttgaatcttatgtgtaacaaaaagaagtgggttttagttctttctgtgccctgatattttgtatattaatgaattatccaagattcgatgggatttatcagtgtgtagatagctctataatgcttgaattgtacacttctaagtgtgcagtgcaagagcttgtttatatttcatactttttatactttgaggaaaaaaagtcaaagaaaaattgtatttgagggaaaaaaccatgaccaagtaaaggataaattcaaaaaatagcctcatgagacttggcatacacactcgtgggattccagttattatggagtgcttccatccctctccaccccttccccccaaaaggttttctttgcaagtgcttttggaactaagagctagtatcttggattaactgatgcctgctagtgctttctgattactcgcattctgtttcttgctttaaaagaagagtaaagacaagagtgttggaccagtattgcagttctgtagtgtcatttcttataaaaaacaaaacaacaacaataatttatcaaaattggcatatttaaagcctaacattctaataaaggcacaaatttctttttaatacttgtttcagcctctttaatctctttataagttaactaataaatctattttcttcagacttctgcaatagttctttaaaatcacaacagttagcaagctgacttttgtaatgtgctcaatacaaatacttgtgaacttttaatatgttgagtgctttcattttgataactggatctccatttgatattttcatttgtataactcatttgcagtctgaaaattttttttagtgccagtccctgaacatatcattgaaagttaattttctttgcattttaaaatatctggattatgaagaaaaagtgatgaaaataaattaaaactgaattaccttttctaatgttttttttttttaagtaatgtaattctattttgtttttatgtatgtgatatctgtttctgttgagatttgggagttattgaaatctctgtaatgtgtatggtagaaaatttcttgtgaccttaaaattttaccagttatttatagaaagagaaaatgggaaatgttttataggctttttactagcagtatcagtgaacacttgaactccattattcatgaaaataacacgttaggattggaatacgtctattcaaaagtgaaagaatataaagtgtttagttttttgtttttactctaaagatagaattggggagtaaacttcagtttttgtttagagtggatctgaatatttaaaatcctataataa

SEQ ID NO: 12136 - DNA, 1408 bp, Homo sapiens
ccagggctatggctctgtgtgcttagacagacatagtatggaattgtgctctaagcccacaggcttctccggagttaaaaggaagcaagaacatccttaagttactttttcaaaatatgcgcttcaggaggaaccaggtttccccaggagagagaggctccctgctcaatcagcacagggagttgctagcgggcaggctgcccagtgctgtggaatctccgccagcctctgggttgggggctccctcccacttcttgcttcttatggagtacatgggactgctctgctttaagccgcgatcagagctgttgtgagcaggacaagattgcgtgatcacgaggtgcgtggggagatgctaggacatttgttgatgtctttgacctgtgctccgtctctgttggatgactgggttagctaacaccactagagggaggtacagaatgttaaacagtcgtcagagtcacactgagggttgttttaacagagggcaaattcccagtttgtcaagcatatctctgttagagtccgaagttcatggttttaatggttctagctcgtagcccttaatattttcaggatagctgggtcctgccagtgtccgctgagtccatcagcacaaccagaaggtccagggtccaggcatgggaagcattctctgacaataccgagccctcgggacctcctgaaaccttgagcagaggctggagaagaccttcagacagtccttttactacctcacaaagtgccatgcccgggacctcagacctcagggttgtgacgttgttgatgttgtcaggccccagtacgtctctagtgaccgaagcagacctgcctgaaagggcactccggacagtgagccctggctctaacctgtgccctcatatttctgctgcctcatatggtcttgtttgcccactctgtaggtgactgatcaccctaaaagggaggtaggtatctagcagtagcacagttactttgagcctgaccacttgttctgaagtgcagatgttgaaacatgcattgaggaagaacactttaaggaagcactttatgatttactcatggctggtgttggcctcaaagtaaaagaacatcttaatgcagaacagtacaataaagagccccataggatggatgccatcatctgtccccatggttgggattgccaaggaaagtgccttgttctgtgcatcttcagaatcccccaggccctctcttgatccttttcatgaagtccagagcattccttctattacaggctgaagatgcattgtaaaaggtaatgctataatagtattccctcttctcaataaatgtgcaaaactggagaatctggtgctgatctgcagcatacttgacaacacagggaataccgtggatgttccacgccagccttacatccgtcccc

SEQ ID NO: 12137 - DNA, 1859 bp, Homo sapiens
atatggataaatatatatatacacacacacatattactgcaatctgtgattgcttcatctgtaaatcagttgtaaacctttacatatttgacttaaataactgtaagatatatatgtactacattaaaaagtgttgattaatagatgaaatttttaaattaattttttaaaacatgccatacattgtatcacaatgttaatgtgccaagatattgttcctgtcatgcagagtataagaatgctttgaacaatttgtagacttagtgaaataaaataagaggaaagccaaaaacaaacaaacaaaaagcatatggggagctggtattttctctttagcttactgttgtgcctttttatttttctaatcacagcagtatgagttatgagtgccctaatttgtggttagtttctaatttaatgttgtttcatagagtttggagtgttttgatacagggtgaaaatgaacttctggtttcaaacctgcgttactggagacagcccaaagagtaattttctgttttgacaggttttactggaagtatatgtgatgagcagaagaggttatcagcattaaattgttttggttctaaatttggaacagtatatataattaaaagtaaggaacattagaggatttaattagaataaatacatgttttggaaatacagtgacctcttgcagtgtcacaaaagtgcaaagtgatattagctgtcatctgcaatacagaatctcattgcttttgcacatggagcatataggaaactccaaacagatcacaatgaggtttctaaatctgttgggttctgtcttctattgggttctgtgaagcaaaccactgtagctttagctgggttcagtcatatgactcgttggtggaatgcctaggtttttcatcttacatgcagtcttgggggtggatgaatacataatttctcatgtattcgtgtatccattagtgaatagttcaagtctgtttaagagtgtattgagatggcattctctgcatgttaaagatcttaatggcaaccagcacctcttaagtatggtttaaacatattcttagctaattttttccattagtttttgaaattggtggcagttgtctgatccacaagggcaagatcttctgagtactctggggtgtgagtatgtgtgcacacgtgtgtgttggagtgagtgagagaatgtgtctgtgcatgtggccatgctttcctagaatgtcaagtagatatttttacactttgagttttaaagcaattactatcagactgagatcttgtatgccaaactttaatctgcttttatgttttcaggctgaaggtgtgaaaatcctaagaggatttcatattgaatatgtgtacacaatcttaactatcgtggtggaaaacatactactataatttattattatatcttccagataatgttattcatttagaacaaataaggtatattttttagaatcaactttgtaagcactataaaatctttaataagttataaggtctatgatgtgtttactttaaaaattgctgttaaaagcaacacgtattaaatatgtaattatcatctgggttaagagtctgtttttcttctttgtggtaagtcttagaatatggtactgtggattaatctaatgaaattaacatatgtggttgaagttaccaagaaacgatgaaaagaaactaaatatagttgacccttgaacaacaggagttaggggcaccactccccaacatagttgaaaatccatgtataacttttgactcctccaaaacttaactactaatagcctactcttgatgggaagccttaccaataagaaacagttgatgaacacatattgtgtatggtatat

SEQ ID NO: 12138 - DNA, 1156 bp, Homo sapiens
ttttaagtagataaaatgtaatatgcataattatttttgttctgtcttcattgaggcagaggattgggatttagttatagaagcattcaggagataatgtgcgaggagttatttaatacatcccaagataagctagtgttccagatactctggaatagaagtaggtagtatctgtcttgtcagtaacatctgagaaaacatttggtagcaaacccttccctttttacctttgtccttccttttcttgtttcttctgtttttctcatccttcttattgtctatcttactcttcctagcctgtcttacctttattcttcatataaagccaatgtacattcttaggaagttatttggtaaatagcctctaaatgcattaattttttacaagtaaactctttatgttgctcatctagaacataatctctgaaaacaaattgtaggatttgattcatggtttggggtataaaaataaaacttttaacatattatttaatttatttctgcagatccccaagtaagcccttggcacggaaattaatggattgggaagtagtaagcagaaattcaatatctgatgacaggttagaaacacaaagtcttccatcacgatctccaccgggaactcctaatcagtaagtgtgaattttgtgaccaacatcaggtgtgaattttgctaatttctaattattggctgtatatttttatgcctgaagacaaagatacgcaaaaattgaattcttttggtgaaacatgatttttgttgctccagagcattattttctctttgcctgctgctctttgcagaagtaacatggtatagacttgcggaatgagagtagcgcattgaataaggaccctccactctcactctcctcaacagttaactttcgcagttaagagtccctgataaatgaagatctgttagacttaaaatcttgtatggttgttgttgacatactcatttttcatgtggattcccagcagaatttctaggggagcatatattgtttgaaaatgctttgcaagtgattgggattctcttaaacccccagctcaaccatggcttcagcacgttctatggcctaggaaaaggggtttccagcaccagtccccataagcttagctctccctgagctaaaaagcactgtgtgattca

SEQ ID NO: 12139 - DNA, 1156 bp, Homo sapiens
ctttttctggtttattttttggatagattcttagaagtgggattgctgggtgaagaggtaaattaggttaattttcttatatgctgccaaattcccctttatagaggctgcagtattttaacatccctaccagcaacatataagtgagttttgccaacaaaatatattgccaaactgtattttttaaccagtctagactgttagtgaaaaatggtatctttatgcagttttgttttgcattttttaagtaagcaagccaagtgagatgtttgtcttttttggggggagaggggacggttttctgacttttctgatcagttctgttttttatattttatttttcagagtcaatacagatttgtatgtgaagctattttgaaagtttatgaagaaggctttgttaaacccttaacaacatcaacaaataaataagaaagcaaaaagatctgggatatgtgttggaaaactgctttcccttatgttcactgtgccataatgctgctcgcaggaaatggcattttacaaaaaaaaaatgaagaactcaaaaaaactttgaaaacttcagcactgttgcactttatgttttaaaaaatgtcactctttcaaaatctataactcatgtatttgaagactgtttcatgctttgctccgaacaaatagtaaataactgagtatgttcagggtaatttatgaaattttgtggtggtgccatgcaatccccttttggtagaattgccacaaacaaggctcaaaattctcatcatctctgttatacacctgtatcatgaaagcaaaaagaagtaaacatcaggagtcagctctggtcttttgcagtggtttgcgtacttactatactgattaccagattttatttttaaaattttagcaatatcgttcttaatattagccaatacactgcctatggatgcagcacatttttccctgcacaccccctgtagagacctgcctgctgctcagaagaagaaagatggaatttgctgttcccaggaaatgctgcacattgtccatttaccagcatcttatagaaaatataaatatgaatctacaaattctcttggatttaataatgtaacttatatttatcataaggttggcttattccaaatcatgtgatttcacatacttgatgtaaagg

SEQ ID NO: 12140 - DNA, 2036 bp, Homo sapiens
caattattttatgtggattggggttttaaaagattcatttcctagcagtttctgaatatttctgtaagatcttgataaagtttagagtcaaatggcagatattttggaaagccatttagtatgaggggaagagtacacattttaaatctttggtataatctaaacgatgtcatttcagacattcaaaactcataataataaatttcaggaaatcaagctcctaaacattaatagccaagataccaaataaattatcatattaaaatatttaagtttatttaaagagagaagtaaacataaacttatgtcaaagagaaattctcttaatctatttcctgacttcacagtcaaaacagtataagatagtgaagtaacttataatcttatttggtcattctgttctataaacagacaaatataatttaggctgctatatgacatgataaattaaaaactgagaaagtaaaattatgtcggggtctacacattaaatgactgttttggcagtttttcacctgaatttaaaaataaaatttgtctgttctatctgtatggacagaatatgacaaccatagaccaaaagatatcattgtatagatgtaaagagacaaaagtcatggttggcatgttctttaatttagggccttgtttatacttgtgagtttaataatttcttggcaatgagcactgctgcctttttaaatcatcaatgcctgtctttaaatgccaatcattagaagtttagaattacatttaaatttctcatatatgaatttttcatctgggaactacccactgtcgtcatttttatgtgcagaaaagatcctttttgaaaaccatatttattgggatcttatttaaatttaaattatcctttacaacttcttaaaatgaatatgctaatagataagactttatccattacatctaagaactttttaacctgtatatcaatctaaataggtttctagaaataatcctagctttcatacaccatgtagttctagactccgtccatatcagtgtaacattgtgtgataaaatgccaaatgtcttgtatctaagctacgctcccactcttccagccacccctacctcccaccttgacacccttaagaaagcaatgctgacttttattctgacaagtggaaatcaatagtggttaatcaagtggattttgtaaatgctaagaagtgtttgtgaaaaccttccctttctgagttaggattgttttttcctgttcatttcaggtgttttattgagcatctgatttgtgtcagcaccatgtaaatatgatgaggagtatttggaatagactttacattcaccagaaaattgatagtatttgttaaaccaatgcatccattcaaaatagaggcagagtaaacagcctaagaaatgatttcctttctacagtctgctaggagaaagaggtgagaggggagtggttgatgattttaatcaagagtaaagggaacatttattacatgaaatctgacttcagttgtgcaaaggtatgttaagacattaagacaattgctggaaggtttcaaatatgtgtacacacacatagagctacttttgtgtgtttatttatatgtatatttcacaaaggctaatgcccacagaggaaaatgattattttaacttctgggttatcatctgctggcagggtctgatcaggtctagagtatttaaggaaaagtctcctgtcttctatctccactagaagtactgcagcttgagagctgaaaggaacttgaaaaatgttatccagtcttcacttagcccatttttatcggcattaggaaatagggttcagcaatggttattgatttagcagtctggtcttatatgatctgctttctaattatctatctagtattcctatattatactggaacttcaataaattataacctatgtgaatatcataaattcttgtgaatttttgtctatttccagtagagaagcatactcagccaatgttttcacttaataactatgacaaccttaaaggatgtcacttaagttag

SEQ ID NO: 12141 - DNA, 2905 bp, Homo sapiens
tttaatttcattgtttaaaggagataaaatgttatttgtgtgtctttcatgctgtaaagaaaatgaatgtatctttcaaatgtcattagaattatggcttgattctaaggatactctatttgttttaaagtctacacgggattgaaaagaaagggaagagtattacacttcattgtacaaaatgtaattttagaagaaaaacattttcattataaacaagagcaatcattgaagcattttcagatataatgtacattctttttcattttgctttgcctctagaatagaaacttttcagaaaatttgcacatactgtttgtaagtataaaataattgaattctagacttttggagtgtggaagggtgtttgtgtgtgaaggtaataaatgtgttgctgcatgtgtttaccatagagaacgttgccaggctttgtcaaatgaggacattgttgtgagggtgtgacttttgtgaagccagaaaactgtgcctaagattcattacagtgagtatgtgcagaggcccctgacccagtaaatgctttttgcctttttattcccaatgtcttggacagttgagacaacttggcccaactctgaattgtagcagtgatgtcttatatgcttacgagtttatattaattcagctgaacaagaactacatcttaaaccacctttgtaggtatgattaatacgtgcaacagctgctttaaaaggtggtatttattattcatcactcatgaaacttgactcagtgaggacttcattatttttatttctctttccacgtctccaactttttaaaaatcactaatttaactctttgttaagtactcaagtacaaagtgatctcttctttcatgaactttgctataactgttgaaaggattggtgtcaggctctctcaaccctgggagtttccaaaatttagcaaatattacttgtgataagcttaaatgccacatcgctaagtacaattattaccaggaatccgtcaagggggagatagccccgctcacacccttagacccaaacaggtgctggttcatgctttctccacaaattggcagttgggtacttccccactgtcatcacagttgagctcattttaacatatattcaaagaagctttttagtttctactcctgaattgtagtgttcaagttatttgccttcctgggtaagaaaattttaacccaagtctgggattctctggcacctgtcttttcccatcttttaatgagttggcaagattaggtcaaatttcaatgctaaatttgattttttgaattttaaatagttgcactttatttcatgctgaccaccaacttaatttatacattttaaaataaaattatcctagaagtgttgtaaacgtgggaaaattttaattagtgttggaggtcattagattggacccaggtttaaatataatgatctcttcacagcttatttgatgtttaagagcaacttgtgtgatcttagctttgcaggttttctgtaatttatgtagcacaataaaggataaccagttgactgtgttactggactctgagttctcacagctagtttcatctaagcttggtttattatcatttctgctttggatttttttgtgcatcacatgaatacttagaaatccatttgttttcagtgtagtacctagggtgaagtagatgctgcacaagtaagtttaagggaataaaagtcccgacactttatatacatgttgaggggcacgatttaagagactgaaacagtttacattaaactgtttttattttctgccagtagactctatctgcttaaaaaaataaaaattgttcaacccagtgttctccagcatcaggacattacagttgtaatctatgttgtaatcttttcaaataagaaaagctactccttattctctacagtgtaggcttaattttagaaccgataatttactatatctgcattattgatatttttaagtagtagttttaaaaataattatttctatgtggagggtgttttaatttgggattttttttttcttgtaacaggtgctatttgtaaatatgaaggggaaaagtcacttagttaaaagtctagcttatgtcataattaagatacaattattcatttcatgtttgattctattaaactagtggcaaaacagaattggtcccttagttttttagattacctttccccctatatcacaaaaatatctctttccatatgatctcataattgaggcaaagaagctaagggtttatttaaaatgtgtataagcttgaatttggtcaacactgcataatttgaaatcactctgcatttgtcactgcagcttactgtatgcttgaaaggccttgtgtgtttgtcttaattttagtgaaaaaattagaatttctgccattcatgtacaaaaaaattacaactacagcaaacaagataaaaatgctggtttgcattaatactgttttagtcttaagagcaatttatattatgtgaaatgctgttacacatattttgttggccatatttcattttgagaaacagttgttcaggtacaaacatgacaaacaactctagctatgactcttaatgttcaattgcaaaataaagatgtgctttagtaatctaaagtacagaagttttgaagattattttatgggagtttttcatgggcttttctaacagtggttatatttagtaactggttatcaggaatggagagaatgacaagtgtaaaatttatttctggagttattgactcacatagtggctgtatttgaggaaagggagtaggtgaggaactaaaagggatttagaagattaaatagtgtctgaagaggccgggcgcggtggctcacgcctgtaatcccagcattttgggaggctgaggcgggcagatcacaaggtca

SEQ ID NO: 12142 - DNA, 1144 bp, Homo sapiens
cttgggcacttaggtcagttccatattttgactgtagtgagtagagctgcaatgagaatgagaggcagatgtctttttgatatattgattttctttcttttggatgtttacccattagtggaattgctgaaccatatggtcattctctttttagtttttgaggaacctccatactgttctttaaagttgctgtactaatttacattcccaccagcagcgtaagagggttaccctttctatgggtcctcaccagcatctgttattgcctatcttttttattaaaaaaccattttaactggagcgagatgatgtctcatcatagtttggatttacatttccctgatgattttgagcattttttcatataccttcccctacatgaatttgttgcacttctttcctaagccctttctttgaaaatcctgcctgtacctgtacaggtcctacatgatgtgaatttatctttttcttcctagtgctgtgttaaatgagaataatgtgcccctccccaaagagtctcttgagactctgatgcttatcacacctgccgacagtggttctgttctaaaggtaagaatacttttacttcttaaaatttttgccaaagacagttttgaattgaatcttgcagtataaccaagggcatctagtgattactgagtgacactgggacttaagatgtgagaagagcagccgagcacaggggctcacacctataattccagcactttgggaggccgaggcatgtggaccacttgagctcaggagttcaagaccagcctgggcaacatggcaaaacctgtctctaccaataatacaaaaaataagctgggcatggtggcatgtgcctatggtcccagcttctcaggaggctgagacagaaggattgcttgagcctgggaggtggagattgcagtgaactgagatcacactactgcactccagcctgagtaatacagtgagactgtctcaaaaaaaaaaaaaaaaatgtgataaaagcattgagccacagttctctagggagaatcctgttgccacactactcacaagaggatcttagggtttcttctccagtttgtatgtactttgtttatattttgggggtggttttgaatgttggctatgctttcactcatttcctttt

SEQ ID NO: 12143 - DNA, 1110 bp, Homo sapiens
agaaaaataaagtatagcaatgtccatctgtaattctaatacccagaaataacgctatttagctttataattttcgaatgaacaaggtaaacctcggttgccatggggaagaaggatgatgtggaaaccatattggtaaagttgttaatccctcgttatggagaactgatcttaagctatacctcctggaatttgctttctagttttctgtcctgcaatatgtatataattaagcactaatttgtactgcttagcataaaagaacatccagtcttagatccttaaaacttcatggattggactttcctgggctccttataacataatcgtgtgtccaggcaaacgcacactagtgtctgactggaaagctcaggaattttaatcttgcactgtttcccagggagctgtagtgattggaacccacgtttgcacaaaacatttttgcagaaggaaagtcaacacttcttgctggctgcctccccttagccattatgctaaaaacagcttctgagtttcactggtggggctcttgccagttcttaattataggacatattttctcaaagctgaaggtgacacctagaaccaggggcttgacccaggacatgatggaatgagcatcaaattttcagtgtcttggcaaccgtagatgtcctacagggttaccgttgtgctgctcaccacagagcagctgaggcattatgccttggaagacctaaatctcccatccagttcaggaggtgacaacatccttattttaaacttcctaaaattaggaattaggtagttggacatagtctgtgacctttatgtcgttggatacctgtattcttgacagttagaatattggtagggactttgttaaaattcacttgaatttcaagctcagaggaaactttgtctcatgccctgacatgaagtggcaaacacggaagttcatacttgaatgctgaattggccccgacagattaaatgcgtgttggggattggtttcctgtcatagctgctgctgctgccatgcgcagagctgctgtaacagctcttcctgttctgctcccctgagaacagtgtggtggggagaggcagggctgaggtggtctacgaatgtgg

SEQ ID NO: 12144 - DNA, 1175 bp, Homo sapiens
atctgttatatgcaaaaatatgtcttacccttcatcacacttattgtaagattttatcattttgaaagcagctgttaggccgggtgcagtggctgacgcctgtaatccgagcacttggaaggctgaggtgggcattgcttgagctcaggagttcaagacccgcctgggcaatatggggagaccctgtctgaatttaaaaaaaaaaaaagctgctgctgcatggcagtgacagtacgatgattctgtccttggcttgagcagttgtgtgatacgagcagttgtatgagagatgtttgctttgtataattagaattttttaaggttaatttttcttatttgccccagagctattgtttctgttgacatatggtttataaaaatcagtttgactttgtgctttaaaatgtaactacatatcctgcttagtcaaattatttcattgaatccttaaatgctgtgttcacagtgtcaggttaacaaaagaaaaaaatcattaaatggctctttcttcactattctttttactctttactcctcacccccaggtgttctttgacctaatgagagaaatcagaacaaagaagatgtcagaaaacaaagacaagaatggcaagaaaagcagcaagaacaagaaaagttttaaagaaagatgttgcttactatgagtgtcaaggtgacggatgaagccagctgctcctaaggacacagggctgggttggtaaagagaaggctatggttgacttcttgcttgtgcttcccactctccccgacttcattcactcaaacttctttaaatggggaaaaatatttgtgactctgtggctggcagaagaaataagcccatgcaagtggaagggctgctttgtcaggaggttgtggaatttctttcttctccccttcttccctcccaaaagcttagctatgtataaagtgccacagataggaaacagctgttaattacaaagagaaagaattgtcatagcatcttattttgttcctagttttataacattaccatccttcgttttgaactacagatgttgtagtgggttttggaggagggagtggagtaagatgccctcccacttttatcagtttagtagtagtactgagaaaaatcccttcagctctaagaacactgaaaaatccaccgattttttgggtaagcttcttgg

SEQ ID NO: 12145 - DNA, 1202 bp, Homo sapiens
acagtaggttaagacagggccggggtcagacactagggcggcctgaccccctcagccttgctcctaaccactccgccatcctgcctccccgggccaggactggcagcctcgggctctgttctccttcccagcccgggagagtgcaggtctgagctgtggcagcttagagagtgtatacgtgtgtgagtgtgtgtttgtgtgtgcgtatgtgtcacgggtgtgtttgtgtttaggcaaatggggaaagaaaacaacacccgcattctttttcagccccgtagacatcactgcatggtgaaggaatgtggattcagtgcagcaggttgtgtttcttttttttttttcttcatggcacataaatacctttgggtttctcggttctcagaaaggcatctattactcaggtcttacttagcagttatcactgaagagggaagcctggagtgagcatgtgggcgggcgtgccacacacactcataacgcccccttcagctggaaggcagactccttttgaatccagatgagcagatgtcttgagaccaagaagatccacttgccgagctccagctgggggctgagagctcgccctgtcctgggagcaggcatcttcccctctttcttgcagagaagcagagaccaccatccccactgaaatatagggacccttgcccagtgtgaaaggaggaagggaggaagacagggagggaaggaggaaggaaggagagagagaagctcagcacagctccaggcagaacctgtgggagtttttccagcagcgtggggtgtgtcgtttgctccccttcccagcaggaggagggagtttccagcaggcagagtggtgtgggatgagggacatggctggtggggaggcctctggccccatggcgggtgtcctattcaatagatggtatcactgtccactacactacagacacagcagctgcagcctggagacgttaagcctgccacccgggttcccagctggtaagtggcagagccagtcctgggtcgtttccagcctggaactctggagcttgccagtctgatgcacgtttattggagatgtggttctctcctctcccagcgatgtcctgtgaaggctctttggaggctttctgtcgtatttctgagctgtgttacagcttctggacaccagtgaggtgaccccaccccacctctgtccatgaacgtcagggtcatag

SEQ ID NO: 12146 - DNA, 1236 bp, Homo sapiens
tctgtcagggcttcttgcctaatcaagggatgcattttaatttatgcaaatgggggagggatggtggcagggagtcacagacatccatcaccccatttcctagcagcagtcattcatcagtggggccttaaagataatacactttttgtttcaggcaattacttaatcttgacaaactcctgtgttaagcagggctattagcggggtccatcattaatcagcgcagaaccaagtgggtgctttttctgaactgcaatcactcttggggacccggggtgggccctttgccatcctcgccgccctaattacacaagcagcatgctaacaaccagcatcccacacgtgttgcaggggcgccaagccacgggcagaagaggggcccatttttaacgccagtcagaatgttttcggagccaggcagaatgatacatgggggttattagcagccaccaggaacacagctggggaaacagataactcccctcccctgggtccctcccggacttgcctctgacttcgctgggtacctgggcagcacttagatgccgctgcatggcagacccattctgttttaaggggttacatttccttttggaaagaccacgaatgaagtgaaaataccaaggctggccttgtgtttcctggagtttgttggtgctccacctccttaccagggcctgggtcacagagtactgctccctcctccatcacacacctgtgacccttattacaccaatgcctggcccaggctgccctgagggggagtgggcacccaggagaacaggggatgagtcgggcaaagactgggacctgggccttcccccggcctcatttcttcttcctggtccaagaagagctcataccgccctaccctaccccacccatgtctggaatttcagagaaatgggcatgaggtctggctgtgacacagattagccatttgactgaaccagggcaagttactgaacgctcctgtgcctcagtttcctcatctctaaagtggagataatagtaacaataccttcatcaattgctatgaggatgaaatgagttaacaaatgcaacatgctcaggaaggctccagtgtgaaggaagccctgtgcactggctgttagaaccactgcggtttccagtctccaaggaagggccagtgcgtggctgactcctagaaactgctctgtctcctactgcggccccgagcagcatggctttctctcctcggtcctaaattaattt

SEQ ID NO: 12147 - DNA, 1369 bp, Homo sapiens
tttgggtttgaatctgaatgctatactggatactctgctccggaaagatgagctttttattctactacttggaaggaaaaggaattcctggtccacctgaattcctctatgaagcctaactcttgaggtctctaacataccttgtcatagaggaaaagcacagattatacctggatgattcaggagcacattctgattccaggtttggtagagctggctcttctactccgtaaagccgagtctgggactggcagcccatccaagtgtatatgaatgaataaagcatccaagtatatatgaatgaataaagtatgtaagtatcaccagaaaaaggaaagaaaaaatgtactccttggggcaagcccagaagctgccctggcctctccagaccgtgtttacagtgtttgcatgtagaatgtagcccttcctgaaaagaagacttgtttctaaatacctcggggctgctggagccgctgtgggttagggatggactgaggcctcgaggagtgagggtgcacccggggcccagcctcaggctgccctagggatctctcagtaggaagaggaagttgcgtgtttacccaatcctgtttctccaatgcaacgtccacccactttaccaccaaaaactccagggcctgacggcagcccggtcccccagcactcaccagcagcccagtgttctccaccaagccacagtgtgcatgcctggtatcctccggattcccttccttctgcccgctgagtcactgggcagagaatgatgacatgtgtaggtggtgtggttgggggtggaaaggggaaggggttgatcctcaggactctgagggagcatcgttgaattttcctgttcagtgtgaccaagacccacctggaaatggaatttggaactggcttcaggagacatcattcctgaacacactgtagggtgaattggtgcatcttccccaccatacacacacacacacacacacacacacacacacacacacacacaccccaaaccttttcatggggaatgtgtggcaaccttgccaaacagcaccactcagagtgtgactctgactgtgaccttggccttaatgaggaacttcttaggagagtttgaggacaaggccaacatcgtcatctgggctcgctgcgtcccagcacatcaaactctgtccagagacaaggccaactgcaaatgaaagccagggaacattgctaagggtctgtggctctgtggtggtgttcatcgccttcctgagataggatttcccttgccagtcccaacctgtatatattctgtacagaagacatccctgaatatactgtaggtgagtcgtccagccaaatttatatctccaaaacatttttagctttttct

SEQ ID NO: 12148 - DNA, 1398 bp, Homo sapiens
ttctctggagcctgcaagcctcttcccatgtgtccagctgctcttcctgctacaaaggggactgctcacagtggcctcagcttggtggttttgaggggccgccccccggccctccataagggtatcctgggcctgagaattctgcatctgccattggaggatggacagcctcaaatggaaggagtcccacgggagatgggtccgaggtccggctgtggccatccagccccctgtggcttgtccagcctctgtgcacccctggtgtcttcactccaggggcagacagcagccactgcagttcctttcttcgtgagtaacagtagtgatagcagctggggctaacaggctaggctttgtgttctgcgcatttggtcagcttctcactcgatcctccctaaagcaatggggaggcccccactagcccagttttcaggaagtcaactgggaggttagatgggggccagggtcccacagctactgatggcccgagccaggttgagcttcctggtgtccagtccggatcccacttgcagatctcatgctctcagataggtgggacaagttcttttgtcacagtgctggctctgtcctgaggcctcattgctggctgggtgtgctctgctgggaaaagctttgcggggcttgcttggttaaccacagaagagaaggggactgtttggggtgcctctctgcagcctccccgtgctgggtggaagcacggttactgtgttctctaatgttcatgtatttaaaatgatttctttctaaagatgtaacctccacacctttctccagattgggtgactcttttctaaaggtggtgggagtatctgtcggggtggtgtggcccttggatgggtcaggtgggtgtgagaggtcctggggaggtgggcgttgagctcaaagttgtcctactgccatgtttttgtacctgaaataaagcatattttgcacttgttactgtaccatagtgcggacgagaagtctgtatgtgggatctgtgcttgggttagaatgcaaataaaactcacatttgtaagaaacctctgtggctcaggccttgagttgttttgcttttttgtttgttagattctggtaaaatatacaaaacataaaatttaccgtcttcactatttgaattgtacatgtcagcggtattaagtacactcacattgttgtgcaaccatcacaccatccctctccagaattcttaattttttgttgagacagggtcttgctctgtcacccaggctggagtgcagtcgcatgatcactgctcactgcagcctcgacctccccaggctcaggtgattctcctaactcaacctcccaagtagctgggactacaggcgcgtgccaccatgcccagctaatttgtttgtattttgtagagacggg

SEQ ID NO: 12149 - DNA, 1147 bp, Homo sapiens
tcaaggggttgggtattactgacgagctttggctcaaaatatagcaggaccaggtcttttgttgataagtactgtttgtttattaatatgtcattaatggtatttcttttttacactctacaagtgaattagggagtctcttgttgacccctttgttgcaggaatgtgcgtcgggctaggttatccatgagtttctttattcctaatgcagttagaaagacctttctccttgagctctttgactcccagaaggtaccccagtccccagtgtacttagaaaggatctcgaacattgctggacgtcctcatagtactcacaaagggctagccttgaatgtcactcgcccagtcttcagtctcctgacttagagatacaatcacgtcacaggtctcttggcctcaatctgaaaactgctgccgccgcgccgaggagactcgcatgccgccaccacctcactgggagggcgccgagcccaccgtcgccccctagaccctgacagctgcagctgccttgccttgccgccgcctccctgcagggcccctgttccaatgaaaaacagaacacaaaagagcagagcacctaagcctgtctctgcctccctgtctaccggactggccagggcccaagacccccgctgctccactgcggggctgggcgggctgactccctgcttcctccaagctgctgcctcccctgcagccagggtctgggcagggtgcagccggtcctcggggcacgcagcttccttcaagtacactgtgtgtgcttcccggacctgcggcgatgccacgggcctgccttttctatgcgcctcactagcttaccaccctgtgcaggtaatgcaactgactttgtctcatcagtctttttctttccctgccaccctttatttatcaagcgtaatgttacactttaaaggacagcaaataagaactttgtagaatcccaccaggactttgctaacaataatgtttggaaataaagaagtgctctgaaaaaatatcagccaccaaaatagttatgttggcactgtgttcacacgcatggtccccacacccccaggttgggtgggtttttttgttttttgggtttttttgggggggggggctttttcatgttacatccatatctgtatttatatcttat

SEQ ID NO: 12150 - DNA, 1185 bp, Homo sapiens
tattgttgtcttaaagatggggaaactgaagcaaaaggcctaggaggctttcagaagtcatgcagcccagtcagtgttggcaccaaggttgtgatctgtctgtcttcctgtaaagtctacgcactttactagaggccatactctttcccttctactacagagtgctttgcttatttacctaatggaaaactgcttttctgtttttatttccctaatctataagcacaggaaaagtgtgtgtgtgcatgtgtctttttacacttaactctttgttgtagattttgtttggtgtgactcacagtcatttcacctttctatttcttcctcaatcactcccatccctcattggacctgtcagaagaagcctgtgaggaggagatatgagccgtatgggatgtattctgacgatgatgccaacagtgatgcctcaagtgtttgctctgagcgctcatatggctccaggaatggtggcattccccattatctgcggcagactgaggatgtagcagaagttctcaaccactgtgctagttcaaactggtcagaaaggaaagaagggcttctgggcctgcagaacttactgaagagccaaagaacactgaggtgaggaccacagcaagaatatgagctaagtttgaatctcctgttggactcttcaggggtttaaagggatttcctataattaatggagtctaattcctataattaatggagataccaagaggtctgcttgcaggaacaggcactaaaggtaccaagatgactaagacacagtccttgccatccatttgctttgccatccatttgctttgaaatatctggcaaatatcctttttttctttactttttttttttttttgagatggaatctcgctctgttgcccagactggatgcagtggcacgatcttggctcactgcagcctccacctcctgggttcaagcgattcttctccctcagcctcctgagtagctgggactacgggggtacaccaccacgcctggctaatttttgtatttgtagtagagacagggtttcaccatattggccaagctggtcttgaactcctgacctcgtgatctggctgcctttgccccccaaagtgctgggcttacaggcatgagccaccgcgcccagcccatctggcaagtattctataatttattaagctgataaaagatgtagg

SEQ ID NO: 12151 - DNA, 1207 bp, Homo sapiens
gttgacattgccacaaactgtacctcctgtctctgatcctttgatgagacagtgaagacatcttggtggcgttttgagcagcagctgcagcagtgtgatggtggttagtggtgggagagtggcatgttccagaaagaggagggctctaggtaagagggcgtggcacagttatgtcatttcatgaggagacgccctagatgtgagcattttttccttatttcacttcttcgtagtaagcagaaacatggtccatttctttggggtttatagtcttcaataacaagaaaacaaatgtaattgatacattacaattgagatcacttgtagtttccttcggcattgcctgaactctcttcagggaccaggagaaactgtttgtcagttttttatgctccagcatttgttaaaacttggtatttgttttcaggaaagcaaaacaacatcagattttagcaatgtattttcaaaattctatgtagtccttattcatatttcctcctttatcactaaagcttctacagttagtaccaaatctgtgtcaacgactgggtccctccagcgatctcgaagtgatattgatgtgaacgcagcagccagtgccaaatccaaagtctcctcatcttcgggcacgacgcctttcagctctgcagcagctttgcctccagggtcatacgcatccttaggtaaccacacccctgtcaccctttccctcctgcactgctctgcaagagatgactcttaacctcttagcaaaatacaaacccatgattgaggcaagtctcactgttgtggggctactatttaaatctaagtagcttcgtgcacttgctgctgatcagccagccacccttgttgagtgtccctttcttcgatgcatcatccgttttagtgctgagtaagtacacagtacactcatgctcggagggtgtgtggcactgagcacgtcctttcctcaactcttcctcttcctccatggcaagcccagccacctcccatattgtcaaagctaagttttttccccctctgacactggtgggagcagagccagcaggttcagtgagggattcaccaaaggtagtcagtgtcattaggtgtttctcaatttgagaatataaccagagctggcagggataatcgggttgggttgtggggaatggcaggaggaatctgaaggaatgtgatgagctcatgaatcagcataaccatg

SEQ ID NO: 12152 - DNA, 1210 bp, Homo sapiens
cgggaaacaccgggagcctgttagcagccggcctgcggggcagcgctcccgcccacccgctccggggaggcctagacatttccggcccagacgcagtccgagagtccagacgcatgccgactggaggaccaaagagattagcacgaagaaggatgatcttccacaaaaagagctatgtacagctataatggaaaatactcggtgaggagaaacgaaataaaaggcaatacagcgtagccaaacccgggttagctgcgggtggagttcaagagcgcgccgcggtcccgcccccgccagccccgccccggcgagaaaagcgtatgcaaattttcgagcggccgacgcgcggtcttctgggtaaaaccgagccgccgcttttgcgacccttcgggagcctcagaaaacaaagaattggggtgtcgtcgaaagctgtggaggctggaggtaagctagctaccagaccgactagggcgaggctcacgaattaattaccacaaccctaccaggtattggcgcttcctgcttgcagcccagggactttctattataaccatccttttcttggggttgcgctactgtccaatgagcgcatagtgagggcagtactgctaacgcctgaacaacacacccgcatcaactagagcttttgctttattttggtgcaatttttggaaaaatgaaaacctgttttcatagacttatcagttcaaacagcagtaattcgtaaataaactagtactttgtggttaaaccagtagagggtgcacaagacgcgtggttttagtgtcgcaagtaaagttctttcagtttttgcggtgattaaacgggaaggatttcaacagaacttcacccctttaactttacgccgatcatcaactgttctgtaacttccttatgctgagtcagcccagtagtctaggtcaagtttcaataggagacgaagtttcagtaggtctttgcacctcacataaaatgtaatccaggtcgggcgcggtggctcacgcctgcaatcccagcactttgggaggccgaggggggcggatcacgaggtcaggagatcgagaccatcctggctaacacagtgaaactccgtctctcctaaaaatacaaaaaattagccgggcgaggtggccggcgcctgtagtcccagctgctcgggaggctgaggcaggagaatggcgtgaatccgggggggtggagcctgcagtga

SEQ ID NO: 12153 - DNA, 1969 bp, Homo sapiens
ctgagaaggagccatgttgtaacaagcccctgttttctctttcctggtacagtcgaggctgtctgtcaacagcgtgactgctggagactactcccgacccctccacatctccaccttcatcaatgagctggattccggttttcgccttctcaacctgaaaaatgactccctgaggaagcgctacgacggattgaaatatgacgtgaagaaagtagaggaagtggtctatgatctctccatccggggctttaataaggagacggcagcagcttgtgttgaaaaataggaggctctccttgctcctggccttgctgacctcagcggttgccaggaaggggtgagcacagagtgcctcttacggtagttaggatgctcagttgctaaacactgcgctttattttcttaaccagttgtggtgtgagtatcagaattgaaacacttttttgggggtaaaaaatatagcctttacatggacagaattttttttgttgtttcagtgaatatgcctgtaattcagtgtatttcagttccgtcagaaagtgtaaatgttagtttcttggtaaagtccttttcttgcttaccttgactgttgatgtactgattgagaagttcattgtctcgtttgtgattcttccagatgtgatgcttgatattttctatatgcgagttagccatccacacccaggcatagcctggatacagtataaaaatagataattaaaaagatggttgccaagcaaggaaaacttattttatattttcccttccttattttaagcattgtgagtaaatcagatgttgaattcttttgccaagggaattatagctgcaggttctctctcactgccatcaaactgtaaaagattaaactgcgaagtcaagctcaacagattattttggaaagtttttgtattaagggatttagtaacatcattttgttttccaccaggcagggagtagggcttagtgttttaaaacacctctgctttctgatgttgccttaatattctgctattgcagcaattaaaaattgtcttcatgtacatttggaactaacacgtgatgtgatatattcctaaactatgaaacctttttcctagtagtcagctagatcatttgttctgggagtataaagccacccacgtaagttaataagcaaaatcctgactattatgttgttagagaaaaatgctttgctttgtctggaagaaagataaaatagtgaattataaataagtcaggccgggcgtggtggctcacacctgtaatcccagcacactgggaggccgaggcagggggactgcttgagctcaggagttcgagaccagcctgggcaacaaagtgagactccatctctatataaaaacaaaaaccacgaaagcacacacaaaataaatcagtgggatttggtaatgtgttttagagtaagaaatttcaggttgttggtgactatcccaacagtcatgttttaaatgtacagtttggggcaagtcatgtaaatactgttggtggtcttccccacacgccccaattttcaggtagtactaagagtatgtgccaggaaactcttgctattgaattgagatgattaaaatggtgacttaatccgtagttattttgcacccactgaaaggaaagtgctttccagaataatatgaagtatctaaaagtgtcaccttttcttgcctgatcaacaatttgggcttcctgtttgtacaaggggccatttggcatacctttcacagcttttatcaggccaagttaaaggctgactacattttttcatcatgaggaaagcagttgaaatgaggcatgagttactgtgcattgggattttagaacaattttcttgtgacagctctttttgtgaagttaggttcttaaaagtgcccatgatggtcacttaaaatgtgcagtaatagcactgccaggatcaagcatgaaaggcttttaaattagatcatcccac

SEQ ID NO: 12154 - DNA, 1361 bp, Homo sapiens
tcttctatttgaaaatgaaaggagattactaccgttacttgactgaggttactgctggtgatgacaagatagggattgtggatcagtcacaacaagcataccaagaagcttttgaaatcagcaaaaaagaaatgcaaccaacacatcctgtcagattgggtctggcccttaacttctgtgttctattatgagattctgaactccccagagaaagcctgctgtcttgcaaagaccgcttttgatgaagccattgctgaacttgatacattaagtgaagagtcatacaaagacagcatgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttatgatttatgacaggtttatgttacttctatttggatttctatatttcccatgtggtttttatgtttaatattaagggagtagagccagtcaacatttagggaggtatctgttttcatcttgaggtggccaatattgggatgtggaatttttatacaagttataaatgtttggcatagtacttttggtacattgtggcttcacaagggccagtgtaaaactgcttccatgtctaagcaaagaaaactgcctacatattggtttgtcctggtggagaataaaagggatcattgattccagtcagaggtgtagtaattgtgggtacttttaaggtttggagcactttacaaggctgtggtagaaacataccccatggataccacatgttaaaccatgtatatctgtggaatactcagtctcattgtgcacacctttgactacagctgcagaagttttcctttagataaagttgtgacccattttactctggataagggcagaaacagttcacattccattatttgtaaagttacctgctgttagctttcattatttttgctacactcattttatttgtatttaaatgttttaggcaacctaagaacaaatgtaaaagtaaagatgcagtaaaaatgaattgcttggtattcattgcttcatgtatatcaagcacagcagtaaaacaaaaacccatgtatttaacttttttttaggttttttgcttttgtgatttttttttgatacttgcctaacatgcatgtgctgtaaaaatagttaacaaggaaataacttgagatgatggctagctttgtttaatgtcttatgaaatgttcgtggataatccaagcataattgttaagaacacgtgtattaaattcatgta

SEQ ID NO: 12155 - DNA, 1160 bp, Homo sapiens
tttctctcagttatatttaaaaccgttgtgtactttgtacaaaggaatactagtcatacttctataaactttacacaataaaatttcattctggtttttggggggctgtctcttcatttcttagaggatacattcttaataggggcaaagattgtttcttgttgtgtgggaaaaaatcttatgatattataggggtttgtgacccttagaggttcaatcctccctcattgtggtataatgaggaatttgtgtggcctttgcccctggttgctgacaaggaatgtctaaaacacttgtggtttcctgagtgatagagcgtctcttgttatgctaacgaggtgactgtatggtgggctttagggtggaggctggtaaccagaaacagctactacagagggttgggccagcaggacccgggagattgagacgcagtcagtgacctgtttgatttaatcaaccatgcctgccaaatgggacctgatgaagagctctggaccccacagctcaatgacgcttcttggttggtgaaagcattggtgtgctgggagggagaggattcccctccatgaggacaggggcacagaagctctgccttccctcccagaccttcccttatgtatcccttcatttgactggccctcctaattcatatcttctgtagtaaaactaatcatagtgttttctagggaaggatagtgctttcctgagttctgtgagtcatttcagcaagttcttaaacctgagaggtttatgagaaccccaaatttgtagctggtcagaagcgacagtagcctggatgcctcacttgtggcttgcatctgaagtgggggcagtattgtggaggactgacctcttaaacccgtggagtctgatgccagctctgggtgtgtcgtatcagaattgaattgcagtacctcagttggggtggaaatggaataccaacaaaatcttattaatgtgtttctcttatttgggataattattttgattttcatttttctctgggatgggggcttataacagagaaaagatcaagaaatactactgtcttcaaggaaatatggatataactgaaaatcactatgccgaaagcttagagcagttgagcagttagaggagagagaaaaattatagcttgtagctatgtttcttgttgctct

SEQ ID NO: 12156 - DNA, 1106 bp, Homo sapiens
gtcattgtagcagctatgttagacttaatgaagtacaaagtctccacccgcactattaaactgtaatttttaaaggtacagaccattttgtaaggtagttgtaaaggagtttgttctgggttaggataagaaagcagaatttcaagacttttttatttccagtagcgtaaacttagaaattagtctgccttttaaaataaataaataaaaattttaaataaatgtcttttatgaaatgtcaatccagctaattgttgactattaaagtgtatcacatgttactttctttaaatctctgtggtgatcttttacattaaattttctgaatcagccagagtcagtcagtacactggcattatgctttgtttatcctataaattactctgaaataatggactcttcaaggaaagaatattctaaatgtctagaatatcccctcacactggggtgcaattatttgaaaaaaatggaaatgcaattttatggacaaaataattgatttttttcttactacagatgagtggtctaggcctatatttggtcttacctcaaactacaaaggaatgacaagagaagaaagggagcagagagatctagaacagatgcctcaacgacgaagaatgaacaggtatgagggaacaggtatgagtaagtggaatacacgttattgttgcagtaactcagttttaagtaagatcattaggaagcctgcaagatgataggatttcctttcctctcagcttgatatgtgtacataattcataatatccttttagtttaaatgtgatagtgtatagtgagggtcctgtcctcctaaccagacctttctgggtcagtttgttggaacagggcctgtttcaggatactgattgcttgtgttgttccatccacttgagaaaacaactttctgggtcccgtttccgagttcctagaagaaaaaatgttatagttttagtttgtattgataatagtggatacagttgcatccaggaggacagggtcattagttacaaatgtggcaattacggctcatccacaaggaaacctgttatgcaaatgaatactaaaatgagtagtactttttaaagattaggaattattttccc

SEQ ID NO: 12157 - DNA, 1218 bp, Homo sapiens
ggggactgaagtatttttatatttcaattattccatcttcagttatttttctttttaaaagacaaagcaacagcaaaacctctcttcccccttcccacccagttacaaaatatgttcattgtagaaaatataaaaatatagaataaacatggggagagagaatcaataccaccttccagcttaatattatttctgttaacaattcggtgtctagacttcttggcttttttctttaatttagataagctcacacagtcactcatgttattgactgtttgccttttacagtgatggtatacactggtgtatttttttaaaataaattatgaacattttaatcatgccattaaatcatctatagggtcatttataataggtgcatcacattcctttaagtacatatgccacactgcaatttattttgtaatatatttgtgttctattaaaaacaaattgtgtcagtaaatgtccttgcagataaatccctttgcacatccattatttcctaatgataaaatctaagacatgagattattgggttgtaggagatgtactttctcatacttttgatacatacagccaaactgttctccagattgttgtcacctccctacatgcttgccagtacggggtattgtgttgggataaacctatgtccatttgagacccaaattgtctccccttatgaacgggtacaaatcactgtcggtgcctctaccccgtctcttctttcccacttcacttccctttgtctgtattcttctgtatccttccttgtttccacctcagaacttcacagaagctggatttgatccagggtagagaaggaagctctgaatgttcttcctcactcctcatctgcttcttagtttatttgttatgtaaaatatccttggggctttgtacagcatccagtttttcaaaaatcatatccatttttttcaaatttacaaattgactttcacgtttatgacttttagtaagttaatctattacacttgtgaagtgagctaatgctctagcacggtggttactgaagtaaccatccttggaatcccatggaccaggctcagggactctctcctgttcttgctgactggctttgggatctaggatgtgttatttaacccttccagcccttctgtttcttcacttgtaaaatggagataatgctaatactttcctcaggattttgtgaagatttaaaaagatgatgct

SEQ ID NO: 12158 - DNA, 1109 bp, Homo sapiens
cgaccaagggaaaccatttggccccgtgaggaatgggcattgtcagtatccgtcctgaacggggcctagtcaggaagcggtctagaagtgtacggtcacggtcgcctcatgaaagtgtgtagcaggtggctctcaggaaaaataccaagtctggatcatccatgtggcagctttgcatagggagaggatagctccgaactggaactgaactgccttctctgcacgcttgaccaaagcagtgatgagggcggccagtacctgcggtgtgcgtggtaggtttaaagaaaagggaatgttttctgctgagtgtttcctttgtccttgggctgctcgagctggacagtaggtaaccactgttttcaaggaccagcccaatttctctggcttggttcggagttcgtttcatccctagctgtgagtgccttttggtctggaaagttggcttgtctcataatacccacagctaggacattctctctgtaattatgaattgtccttgttttacattaaaagagaatgtctttgatcactagagtctgtcggtgttggattatttccactgtgagattcttaaaacttttttgcttcataataataaaacaactcatgttagagaccctttcaacatgaaaggtttgtagttgagacattacatatattttattgtttataataaaaatcatctatacaaaagaagtcctgggtgttaatattttgcacaagatctgttttccatgatgtgttgacatctacaatttcactaactgttgacgttattttctattgagattctggagcctagggagctatgtgttctttttgttcatttcgttcttacttccctgaagcaagagactatatggccttcagtgcaaagacttcagaccaattctttgtattacacttggttgcctcttggctatataacttctgagtgcaaatcattgaacactttaacgaagtattgtagagaataaatcataatggataaaaatcgttttgttctgctttttcttttttaaccatgtgacttgatttatatggaatggtgataacagttgttttatttttgaagacaggcaacaagatagtattcggtcagcttggat

SEQ ID NO: 12159 - DNA, 1413 bp, Homo sapiens
tcctcatggtcactgattgatgatgcaatgtcttctgtttcagggaaatatgcagaggtgtaaacttgtgatggatcaaatcagtgaagccagagactccatgcttaaggttttagatcataaagaccgtgtcctgaagctgcttaacaagaacgggactgtcaaaaaagtgtccaaattgaagcgaaaggaaaaagtctagacccagaacaatcaggagattggaagcaaatttatgaagaatgatggtgggggtggggggagggttttggttttttccaaagtggaacattgaaataaaggaagtgttccttagttcccgtgtgaaagcagaggaacccatgacatccaagggcgtgaaaggatcagagctgactggacatagtgagctgccttcttgcgttcgggtgcacccctgttaaacctgatctgtgtcataagtgactccggatgcatcagtgtccaccagttggaagcaatgacaaggatggctggctggtgtttttcagccttccggtttatagactgtatttatctagtggattcctgcaggccccatactgagcctggactgaaagtatccactcggaccatctgttatctctctacactgaaaataaaacctcttccacccaccccattcggttcttctgcctgaccttcaaatgcccatgttggccttttacagcagtgccacggcaccaagcgagctgccacatctcacactctaaagggtttgaactattagttcttgtcattttttaaaaaaaaccattcccaagtgaaattgttatatcgtctgtcttgcgtgtgtcagaactgggtttttgtggaggttcagagcaggcaacaccataagttgctctcagatccttgttctgaagtacattcttggttatctgtacttctgtagctggtgtgatgctgttaattgtatgtaccacacatctccagacgttaataaaggactcaaagaggtttttgtacttgcgcagtttgcatctttttgtaaagtgaatcagtgccatactgaccctcactgaaatgtttaccctgcttcagtttttcacacattgttgggagcctactttgtttgttgaagttatgctgttcgcatagagttcctcttagagggtagtctaaatatgctacagtggtgaaacctgttggatcttggctcccttaaatacgagcctgtattgtggcccagtgcggataaaaattggtccgattacaggactattaaggctgcagtactgggggcggagctttcgggcgggtggatcctctccacacattgctcttcgtctgaactaacctgagtggaaaggcagctcagatcggcttcctttgggcacaagaccaaccgtctccatctggcctccatgtaacagaccaggaaagatttttctc

SEQ ID NO: 12160 - DNA, 1116 bp, Homo sapiens
tgtttacattattagtgttttcaggactagcctgagagcccaatcagtatttaggaattggttttaaagagaaaaatgagtcctccttgaagggaggaaaatgcccaggacctaactgtgaccctgacagccatccatgtgaacgagtggcctccgttcaagtgattggattttggcttgcaggtggacagtatagtggctgctgagtatgagctagagtacctgttactagaaggtcattgctacgacatcaccacaggccaccactgagcactcctcctcagtgctgtccttgtttgccttttcttgcatctgcagcaaccacaaggaggcatcataaggtcaaagatggttttggaaacacttttcccaatctggaagggtactcctccaaatctaatttgttttaaccagttgttacctgtgtaagggctgtgcactcaagtcctgttgtcacatcgaaaattatctaacactttccttttcaatttcagcttttaccgttatgtcttagaaccagagatttctttcacttcagacaatagttttgctaagggtccaatcgcaaaatttttggatatgcctcagtctccactgttcactctgaatttgaacacacctgagagctggatggtagaatctgtcagaacaccatatgatcttgataatatttatttagaagaggtaagaccatatctattgcttccaaatacctaatcatgtataatacagcagattgaatcatagtctaggtgggcctctgagacatcagtgttcaggtatgatatttttttaaacaacagctttattcacatggaactcatataccataaaattctccccattaacgtgtacagttgagaggttttagtatcttcacggagttgtgcagccatcaccactatgtaattgtaggatgttttcagcatccccagtgaaagccccatactcattagcagtcactcttcatttccccagcccctggcaactgctggtctactttgtatctctatggatttgcctattctgacattttgtctaaatagaatcaaatgtggtcttctgtaactggcttctttcacataacaaattgttttcaagatccatccatgctgt

SEQ ID NO: 12161 - DNA, 1702 bp, Homo sapiens
agaagcccgtaaggcgtttatataccctcaagaattactctcttgagaatatatctgaaagaaataattcaacagaaaaaacaaagttgtatacatgaaaaaatttattttactattacttataagccagaagcatcaaaaacagtttaaacatccaagaatgagctacactgatacatagaaaatgtttagatgctattaaatgataaaagaaaaatcccgactaaaaaaatgcatgcaacgtttactgaaagtaaatattgtatttgtgaaaacaattcagttggagtggggtttacagatagtttccatttttaaaaaatctttaatttagtttttgctttcaaaatacagtacaaaagcacaaatcccaaagatttagtaagtgagataagatgaaggtggaggtacaaagaataggttccagtgatgaaaaatgcccactcagtggtgtttgtaatttgaagatcatctgttttcttttctgtggttctccttttccttaggtcctcagaaacgtgaagaattatgatctctggagaaggacaggaaatcaccccatttgaaaaacagtttttataataaatgctagttttttctgatctgtctatacaactgctgataagccggctgggcaggagtgccacaccttttgattctgagcatttgattctgacttctgtactctggtggccactggatctttgggattaaagctctgttggatttgtacctcagaggaagaccaagtggctgatcctttggactctgtaaagagcattcttctagtcagagggtggaatggcagcagcaactggaagaaaatgagttttttggtgcccacacccaagagcacacacatgctgcactgtctcggaaagcagggccagctagagccaccatgttcttccttacctcagtttacctgcggcctgcgctgcactgcagatgcccaccctgccctgggtctggccggcggaagctctgtccaaggtccacacacctccaggtttacgccaacatccttgtgccctccccaccttctcttccaacgcattaggtgcattgtttaattgaaatccaaccaacaattgtgtgtcaaggctggtttggtgcagtggctgggcaaattaattttgggccaggatgggggtgggttgcagtgagggtagggaaaatgtcaggagtaggaaggttcgggggttaagggaagggaaggaagaccagaactggccatcctcttttataatccattagtagcaccatggctcatttgaaatgaaaatattacacttattccccacccaaccgcagtgaactttctaggtaattgttttgaaaacaatttttgtatctgtgaaagtctttgctttttctttccaccttctagaaaagtctgctaccagtttccttactgaatacagccatactcagcccctctcgcatccagcccgtcagggtcagggtcagggtcaggctccctcaagacgagcaccgcattgtctgccctcttttgcgtaggatttttctctcagacccaggggacattgccttggacttttctctacaaatgccctcagatgtaagaccagaaatgattctgcttgtggaactcgtggctttctgtcctattttccttttatgtgagccctgcaggttgcctttggcgcccacaccagttctgtcttcatgtcgctgcatc

SEQ ID NO: 12162 - DNA, 1911 bp, Homo sapiens
agctcaaaagaggataagagactgaaaaggcacctcagaatggctgctgtgggcagagtctgtgacatgactttccccgccctgcccctctgttcagagcagctggaaagatgggatcagtaagattaaaaaacttttgttcggccaggcgtggtggctcacacctgtaatcccagcactttgggaggctgaggcggacggatcatgaggtcaggagttcaagaccagcctggccaatatggtgaaaccccgtctctactaaaaatacaaaaattagccgggtgttgtggctcaccctctattcccagctactcgggaggcagagacaggagaatcgcctgaacccaggaggcagaggttgcagtgagctgagatcgtgccactgcactccagcctgggtgacagagcgagactccatctcagaaaacaaacaaacaaaaagaaacttttgttcaagctgcatcttcacattgaatgaaagcattcagacgggtgactgctgctgtccacaactgtgggcggaagtgtgccttttcccagtttctcgtccaggaggttgcatagcaaatactcaagtcactgggatatatgctttccaaatgctggcccccatagcacctttccccatgtctttctaccaagcctcttatgtttaatctgtgcagggaagacaagagtagaccatattctctgtgtgctgtgcatgtcctggtgtcactcattgcctcttatctgtcgccattctaatataagtcagcttaatagttgactctgaataatgcaaaacccagcttgcttccagaatggcctaggaccctcctcctcctgccagtttttttttttttttttggttcatgtggcataatcatctttcaaaattaaccaaatgccccagaaaatgatgttaccactaaaatattttctccaagaaggcatactgtaacagaaaagataggtaagatatttttttcccaagaagtaagaattgattgtgctgaatgttcaaactctggaaactgttcacagtatgttgttcttagctgttatttatataaagtgaattattttctctctcaatcatgccatagtggagacttttgtttgtgagtaagtgacagagtaatatgaaataatgtgatatgtcagagtgacatgcagcatcctgagcctgtttttatgttctgtgtacagtggcatttgattgagatcaaagcctgtcacagcctgctgctgggggtgtggggatatgccagagtcctgtgtttggttttagaagtttactgaatgtttcccacatggagaataatggatggcatgttagtttctttaagagtggtaaagttgtacatctgtcattgttgcatttcgaattgaacacatagatgcttgcctgtctgcttgggtgaatgcctcttgggagagcgaagattacgtgcatgatgtatgttaagaaacagtttccggtcaggcacagtggcttacacctgtaatcccagcactttgggaagccgaggcgggcggattatgaggtcaagagatagagaccatcctggccaacacggtgaaaccccgtctctactaaaaatacaaaaattagctgggcatggtggcacacacctgtagtcccagctactcgggaggctgaggcaggagaatcacttgaacccgggaggtggaggttgcagtgagccgagatcatgccactgcactccagcctggcaatagagcgagactccgtctcaaaaaaaaaaaaaaaaaaaaaaaaaaaattaaaacagtttccataaatggagcttaatttgctctgctgtccttaagccctcgtgggtttttttttaagagagtctcattctgtcacccaggctggagtgcagtggtgcgatcttggctcacttcaacctctgcctccca

SEQ ID NO: 12163 - DNA, 3203 bp, Homo sapiens
ccaccttctgttcctgctgagtggctctttgggtggcaccatgcccaggctgtaaacagctggtgaagactgctggcctcaggcggctgtggctctgcgacttctctggatgcggtattggtggctccacccaccagcaggaaaaagtcaggttgtccctccagaggagccaggccaggcgctgcagggcactgtggtggtcatcctgggtagccatgtgaccgtggcatgctccttggcatctctgataccgggttttgaaacgactgagagctaagtgcaggagttggttggcattagaggcgaagcccaaactcctgtagtggggactttgactcagagcagccctggtagcccccctcatgctgcgtcacagccctcacctcctctccccgtctccttgcaggaagttctactacatcaccctgctacgagaccccgtgtcccgctacctgagcgagtggcggcatgtgcagaggggtgccacgtggaagacgtcgttgcatatgtgtgatgggcgcacgcccacgcctgaggagctgccgccctgctacgagggcacggactggtcgggctgcacgctacaggagttcatggactgcccgtacaacctggccaacaaccgccaggtgcgcatgctggccgacctgagcctggtgggctgctacaacctgtccttcatccccgagggcaagcgggcccagctgctgctcgagagcgccaagaagaacctgcggggcatggccttcttcggcctgaccgagttccagcgcaagacgcagtacctgttcgagcggacgttcaacctcaagttcatccggcccttcatgcagtacaatagcacgcgggcgggcggcgtggaggtggatgaagacaccatccggcgcatcgaggagctcaacgacctggacatgcagctgtacgactacgccaaggacctcttccagcagcgctaccagtacaagcggcagctggagcgcagggagcagcgcctgaggagccgcgaggagcgtctgctgcaccgggccaaggaggcactgccgcgggaggatgccgacgagccgggccgcgtgcccaccgaggactacatgagccacatcattgagaagtggtagtggcggtggtggccacggggaggcctcttggggggtgtgggggataaaacaggacagacgacaggtccacccaagactgtcaagggatgagcatcccaaacctgctccacagaggtagctgcgtcctgaaaaaaaacagagcagggatgtagtggggctgggcagggatgggggcttgagaaatcaacaggtgcagcccagtgggtcagaggaaagcgtgctcgaaggatgccatggtcagggcagggcctccagagcaggtgttgtgcctggagctgctctcctggcctccttggatttatcgcaaaaactgaaggtttgcgcaagagacgaggacagcggaaagtggacctgccaggccgggagtgtgtccctcaccaactatgcacacagcactcgctcttagctcctctgtccgggctactaggagtgagaccagcttctggcaactgccccagctccaggccatcccatagcccctcctcttctggctgcccccaatgccccgaggcctggggagcccccagctcacccatctgtagctccctcaaagtcagggcccaccccatctgaggcagagaagactcgagtccagcccccaggaagcctgctcccctctctggcccatggtcctgcttcatgctttgggtcaggaggccaaagctgatgttcaggccccacccactccctacagtcctcagaccaaggaggggtttgggtagtaggcccgagctgcattgccggccttcctcgggccaactggcagcccaggagtggggaggctttggccagggatgctgccacttgtgcgtgagtccgcggctggcccttggaggtgaccatccaggcaggcctggctcagactggaagggctggggaccgagggctcccctgcctctgttctcctttctgacccactgggatttgctagcaggctgccccagccccatcaccgaaacacatactcaagagctcaaataccactgctcccaccagcgtacggattaagttcatcaggcttccatcggctggagcatgggaccatagcccctgcccaggagccgtaccctcggaccacagtggctctgtatggccaggaactgggactcgagctttcagattctcaactagccttggcaaaacagctgtaggtggcctccctgacaacagacactcagccctccccaccctggctctccttgcatttccccatgctccccaccccctggcaaaaggctggccatgctctgttcccagcagccgcgcaggtttccccactggctgcaatggccctaccaaaagccatgttgcatatccgttgtaagcacgtgccctgtgccctgtccccattccttatgccctaggaggccaagctggtgtctctaggagggcccacacaggcaccctggatcccccagagagtagattggtgtgctcaggccgcaggctgactcagaggtagggcagtgggctctgcaggccacctggctggggttggtgggggtcctctctcctgccccagcttccactcagccaccacagttgccacaccatggggtggagacgtgggtcaccacgggcttgggagcaagcgccttctgcagcacaggaagccgaagctggggtcaggtgaggtcgctacccctggaggtctggcataagggccccaccctcaggtctcctacactggccccattttactttggggtccaaggacaggatggtcaacagggcagggtggacagcgtgccagcgccgcgcagggccacctccctgggtggatgcatcacactaaggaagtgagtgccaaggggatttagtggtgtggttctttcaaagggaggtcagggtcaatgggaatctgctcggacactcaacatgggggtgggtgcactccttggaggaggaggaacacgttcaggggattgtgaggtcttgcacaagccacgtggggcaccttggcttcccggcaggaggtggacacccagccagaggcctggctcaaggtgacctcaccttcaccatgggcttcctgggtgcgcgggcctgagcgcaggttgttttgtacatattggaatatgtgttaac

SEQ ID NO: 12164 - DNA, 1140 bp, Homo sapiens
ctcccttctgtcccagatgagtgtttagccacccccaaactatcccttgaccttcatcagcacagaacagagcagcggtgatcaagcaggggatgagggaggctgtcttcccctcatcccctgcttgatcctcacagcggacccccaggcttccgtggcacctggcatggccactgatccctcccctccttgcccaaggcattcccctttggaccctctgggggatcctccctgagccccctcaggctctgggctggcctctgccatggtggcctccatccacttggaaaggggcctcagccttgctaaggatgtggcatcctcagagggcctgggtcttacctgcctctgtcctgtcctccctgcctgcccgtggccccctgagctgtcatctgtgacagcttgtcaccttggctaaggagagtctgaaagcccaagggtgagcaagggcattaggggcacggaccgggcattaggggcatgcttccagttggaaggctggccccaacctgccacctcggtccccagggcaccctttgtccaggagaacctgctgatgtacaccaagttgtttgtgggctttctgaaccgcgcgctccgcacagacctggtcagccccaagcacgcgctcatggtgttccgagtggccaaagtctttgcccagcccaacctggctgagatgattcagaaaggtaagtcctcagcctgggccagcccggtatacgtcaacccagccagaccagggccaggcccttagctgggggtggctggtctttaagagggacccacacgcccagagtgggccccggcaaagggtgctgtggagactcctgggacacgtctgtgtggtgaggtctgaaaccggctggatcctgcctgccctgcagccaccaggcactgggtgggggatcgcaggtgtgcccacagagcgggccggcacggtccaagctgcggccccgtgaccccgctgtttctccctggcaactcgtgttggccgcttcaggaggtgagcctggtctctgccttgcattcatcctggctgggttgggcgttggtttctgtcgatcctcctgttgtttacctcctgcagacactgctaggggctctgtgagccagcagctcccccatccgccctcccca

SEQ ID NO: 12165 - DNA, 2588 bp, Homo sapiens
ggtcagagtgggggtgggggatgtaaggcctgggtccctttcagcggcctctagggcaggagcgtgcgtcttcttcccagtgcagtggtggtttgagtgctgtgggctctggtggggagggggctctgctcctcttcatttgctggtagctgggtcagggcactggcgcccagtgaggatgcccactagcattctgccccagttggttggtggggggacacctgaccactgagcctttggtaaccttattttttatagtaagtacttcttataattttctttttcacatcttattttataagaagtttaggaatatttttgcatggatcattgtaaacagcagattctttattcctgatgtctattaacatagaatgtttactgataagtactttaaattgcttcatgagcacttaatccatcttagtgtctatgtgtgggggcagacatttaccgcaggcacacagtttgtgcccctttcttcaagtctctgttggtaattccatctgtttagtggatggttggcaggattagtaggttctaacggttccaggggttcagctgaccaagtagcagagaagtcttttttcccaattgagtgctaatagattaggataaaatactcacaatgttagtgtatgcttttaaaaagccccacacaacaaaatggaaacatacatgtacaactcctgtgagggctggagtcttggggttcaggaggaggttagaagttacaggcatctcttcaggcttgcttggtacttggcacacacaggatggtgttttaaagagtgggctgcaccccccacacgccatttacatcagcttcataaacacttttcttcctccctgtaacttaaccttttttcccttttatgaagttgagaggctttatgaaataagtttgcattgcacatccgtgcagaaatctttctgactttgaaatttttaggacgtcagctgtcagatacgaaaggtagatatcaggtaagaatctggacttaggaaatagtcacaaaactgtcataggttgtaattttatcaacattcgcttctagtaaaattaaagtcaattaagaaatagaacttgggtcaaaattctgttacaaagcttcataatttgtcccgaagcatatggtggagcattctgagaaatttgctttttgtgtgtttgacattcctaatttgggagtccttcagctgaattactattcttttagaagttgagacagcaggtaagcaaaggacctagttcatgtaaacatggacatcatgatggctatttaaaaaatatttgttctacaccttctcccctgaggcttggggagtgtgttcagccgctgcagtttctctgctcatggaggtcttgtttggatctgtgctggcggctgagcatttagtgtgagccagtgacccatgaacttgccgctctgtgagggccagagtcagggccagtcatggtaatgggcctgaaggcacttccagaaccttttatgtctctcgtgagccatctgttaagaacgttcttcttggtgtggtttgtaggcctacctgtcgctattctgggaaaccttcttgagtgctatgcaaatgtgttcacaggcaatgggggtggtcctgagccttggggtgggcacctggtcagtgagtgtcttgcccttccccagctgggcatacagtaccttgctctttctggtggcatcatctggctgtgatgaatgaggtctaggaaataatttgcatgtgtcttgggggacacaacagtaacgagaggaaatacattattacagcaacttgcgacgtactaatacctgtcagtgttggcccccgtaaggtatgtaaggcacctgtgagtgccagtgagtgctggtgaaaggccaacatgtactagttatgtaagtattggtgtctgctttaaaaaaggagacccagacttcacctgtcctttttaaacatttgagaacagtgttactctgagcagttgggccaccttcaccttatccgacagctgactgttggatgtgtccattgtcgccagtttggctgttgcccggacaggacaggacctccattgggcgcagcagcaggtggcaggggtgtggcttgaggtgggtggcagcgtctggtcctcctctctggtgctttctgagagggtctctaaagcagagtgtggttggcctgggggaaggcagagcacgtatttctcccctctagtacctctgcatttgtgagtgttccctctggctttctgaagggcagcagactcttgagtatactgcagaggacatgctttatcagtaggtcctgagggctccaggggctcaactgaccaagtaacacagaagttggggtatgtggcctatttgggtcggaaactgcatgtttcagaaagtttgtctctttttcctactcattatttgaagaagagagagcctgtggggatagccttatcttggtccacaggactgaagtgaagtcacttgggaaggggagacagaggatgagcggcgtctgtgtagggacccccccccgggcctgcagaagggtggtgtgctcccaggactggcatgacaggtgtctcctcctca

SEQ ID NO: 12166 - DNA, 1202 bp, Homo sapiens
ggtttaaaatgttgctttgaggattttccatcctgtataagaagaatggctttcttcagattataatcgttattaaagctgtatgtacactttacttaaaaactattaacagtttttcatgttgcactggtggtaattttgaacttggaattactgggtgggaattccaggaaccacagagtattgatttttgctgccaaaatgctcttgaagcagatgtccctgtgctcccctggctgcttctggctgaaggggggaggtgtagactgaagcttgggcactcatgtgtgtcccctccccagtccccatcctagtggggccagtctcattaggcagccatagataagcctggaacttggctgtcattagtgacttgatcctggtatgaaatgcatactgggtataaggttgctcaggtattttatttccttggccacaactcccatagatgccaatgttttgatagcctcagtttctcaacgatgtcttttgtttacagtgctacacttagtgtgagtcaagaagtgcttgagttacaagaaacttcttattcaggtttgagtaagcattttacttccatgtgtacttttaaataatccataccttgaagaagttggccaatgatattatatacatgctgatctgattgttcttttcattccttgagtcaacttcagggtcttggatactaaagagaaggagaactgtggttaatgttttggatcatcatttgtgaacaaggccagactttgcccattttaggctatccaggacttaaggtagccatctggatcataagaaggtcctgcagttgagacaaaatgacccaagtgtattttccacaagttttgatcctgtgtaatatttctttttccttccctagtgtatgtagatacaaggcatggaatgcagttccactttctccccagagttgatctttttgtgattgctttcccgtctctagtagtattctgttgtgtctagagaactgattttttcctacatacgcaaattgtacatttgtaagtgaaaatgtcaatacattaaagcattaaccttaaagcatgtttcattgtgacttctgttgtctttaaaaaattactttgtagtaacatactctcagctttttctgctgtcctggatcataagaatgccatttattgaggacctaccaaatgctagtatattgtcacattagagac

SEQ ID NO: 12167 - DNA, 1099 bp, Homo sapiens
ctgctacatattcttcagagaattactgtgacgggctataatgtggggttgattattgacattacatggcttccaagttttaaaataacctaagttttgtgtagtggcaaacaggttctagggctacctctagaacttactagctagtatggtttacagcaattagttttcacagcgataaagggatcagtcactaaccctcctaggaaatatcgattgtgaaagcgccagatactgaagcagtatataaatattaaattagaatattttgcatgccatatagtttcaagttgccttgaaatgaatgggttcacttttatgttcctgttcacagcgcgagtgtatctctatccacgtggggcaggcgggtgtccagatcggcaatgcctgctgggaactgtactgccttgaacatggaattcagcccgatggccaaatgccaagtgataaaaccattggtggcggggacgactccttcaacacgttcttcagtgagactggagctggcaagcacgtgcccagagcagtgtttgtggacctggagcccactgtggtcggtaggtgcctgggcactggatggcagctttcctgagagggtgggagagcattggtaaagccccgtgtgggctcctttgaatcctcctgctgaaaggatgggatagacaggcatatgcccatggcattgttaggagagaaactgaaaggttcgtgatcaaagtgtctgtgagactcggctcctaatttaggaaaacctgacctacagggaaaagctgctttgccagcagtaagatgggctgtgaagagattccctcgtgcgtgcctcagccctgctcaggtggccctgcctgcagggtgcagtggcattggttccctcccgaatgctgtgcattctcttatgctggtgcactagagtcttgacctgcatcttaggcatagaaggtaagtacagaacagtcatttgcttccttcagattcgcagcctgatgtagtttccaaggagagctacaaagaggcagcacctttcagtggccccccaggagatgacagcatcacctgaaagcctgtgggacccaggtcatccagggtgccctgatgggac

SEQ ID NO: 12168 - DNA, 1270 bp, Homo sapiens
ccaagaggcgcttggtaaatggctgtgaaggaggacagattatcctgttgaaaggctgctgagatgcggctccacttgacaatggtgggacttttgtcacaggaaaattagatgcctttggataggtctgagattgttcttatcttttccatatagcaaaaagctaccactcagaaagaaaacagagagttgaaggagtaccctgattgaatgccttccagaaaaaggattgttttgagagaaacactttaatttgcttcagatgattctgtggaggcttattgctgaagtggttccatttcagcacaggtttagctggctctgaagagagaagtgatttttaaaaatcttagggaatacaaagcatttatccattaacctgagtcaccaaccagttttcacaacaaggcagcctaggagctagtggtggccaggatatgttttgtttgtttggctcagtgtttgctgcttgttttttaaagaatttgaacaccgctggactgcttgtgctgtctccagtttctcacagcatgcccacttcctatggggctgctccaggctgcctcccatatttgtctacaaagggattggagtccaaggtgcattgttacagcttgtgggttccatcgaaacatgacacctagttattcccatcctactttgtatcttgtgaccacagaaccctcctaacaaaggtttgtggatggtaggtgactccctgaagctcagccctagtcctagagaaatattacagagtccccctgtgctgatggtaggtcacggaccctagccatctccaaaggacagagtccttttcttgctagtgcccctactgatagaaatgttgaacaaagggccagtggccgttttctagcagtggttaattgcagtgagttctattgtggcagaaaggtttgaaaaccatctctcgcctgccctcacaataacctgaattgtggttcttggttagactagggcaaaggggtggtgacatgagaacacgaaccctggagctggactgctgggttccaatcccagttccctttttgctccttcctaggggtgtgaactgagatgcaggggcagctttttaggggaaggatgtataagttgggtgacagattgatgcaggaaagaggaagaacaattggaaatggctttgacattagtttgaattccaaaagtgggcaagtaaataccaacgcggtgcttggattaatgagagggtggaaatggaaagggatccactagttaacaaagtttaacaacc

SEQ ID NO: 12169 - DNA, 1136 bp, Homo sapiens
tgaagacatttagaaaaaggggaggggaaggttagtaagggtgctaagcggtaagaacaggctctgggggagaaaactaagttattgagtatctagtattcattaggcactttcttttcaatatctcattgtgaagaacccctgagagactggtatccaatgttctttgtatccagtccttgttttctggaagatgagcaaagagattgagagaggttaggtaacttgtttaaggtctcacagctgctacatagtggtgatggagtcagacccatatcttccttgatttcaaagactgtgtttatatgccaccatttgcttttgcaagagtcagaatcagggtactgggttggccttaatggatggaaataatttatataggtagcagatttgaaagggccatgctgtcatctctaaaaaggatttttggggtggcatttgcccattaaagttgccaagtttattaccttttaagtaaatgatttttctcttttttctcccctctcttttgccgtttctctagaatcatgaagaaggttgtaggaaaccgatctggctgcccaactgtaggagacagaattgttgagctcatttacattgatattgtaggacttgctcaattcaagaaaactcttggaccatcctgggttcattaccagtaagtgctacatggtgttctgacttaaggttttttttcccctccttaacaaaggttgcatggttgtgggtagaaaaagcttatcaaatagtatcttttcagctgtatggagtgttgctcattcgtaattgaaattcagattctcagtgactttgtactttctatggctattcgttattttcattggtttcttagaaaacaagtgtcaacctcctttctaccttgactaatgttaatacttagccttcctctcagtatgcgtatgccagtgtcatctatttaatcaaataacaattttgataaaatatgtacagtgtcatttcttgtgttccgtgggttttagatcatgattcgcttttcttaccctttacctcatcagtattcttgtcattcctggaagggaaatctgggaatacgttatctgaatgctggggtcttgcactttttaagataagcccattaagattagtatgtctgt

SEQ ID NO: 12170 - DNA, 1538 bp, Homo sapiens
tggggacctggcagctcaaaacagatggcagcagaacaaaagaaacttttgctttggaagcacagccaaactccccagggcatcgtcatagatggcacctagagcatgggctgcctcagtcagggggacgtgcctgtgttgtccagagagcccagccagggacgaaaaaggagatgaggcccctttcctccatgtccccatgcccagacacataccttggccgtaatttcttttagaatccctttgggaaggaaatacaggattgagggattttggagtttctggtaaactcaccctccctccagccccgctatgaggaggaaagtagagatgaaagactcacgctgttcatggacttggagaggattatctttgagccaagatttggacaggagtgaagtcggtccttaagaatttgtggcgcgaccggagctgggctcctgacaggtgggcttgtgttgtgtcccctctgatggcaccaaagtccagggaagggggctcttgatgtctgctgggggagtgggggcagctcaggatgaatgcagtgccctgtcctggctactcacctgagggtgtagctcgcaaaggtgggaatctggtgctggcttttccttcaggcaggatcactctgacttgttgagtaatcagtcatcaggttggcctggtcagacacactggaccccaccttccaaaccctggacccccccatgctctgcctttgtataagttcccaccccactgaatcattgctgccatgctctgtacaagtttgtaagtttctgaaaagcccctgacatctccatgctgatgcaagtgagaccccttctgcctaatgtgagcggttggcgtcctccacttggcctctgctgggcgcctcagtcgctcaatgatgtgctctgtgccggggcttccaagcacccttcctgctaacagagggcggcccagtggagcctccgctgggcagaactgatgggcaaggcgtaatggctggtagctttcagaatgtgagggaaaggaagaattccgcttcatggggactagagttagtgtggggcctttaagtctgggaagttacattctgcttctttctcaattgctacacaaatgtgcagccagccttttttcttaggcccactgagatccctgctcagtgcgtctcaattgtatctccagtctaagaggagggtggggggcacccggggcctcctccactccttaggtggcccccaagcacatctgccaggtagagtaccatggggaggcctctgccctgagcatcatcacaggggcgcctccagacctggctgagaatagcctctgcttgggcctaggaagaagggcagaagtccaaaggaaaccttggtgagtgagtgtgtgtgtgtgtgtgtgtgtgtgtgtgtgtgtgtgtgtgtgtgtgtatgagcctgtgcatttcttttaagcaagggcagtttcctgcagtaggagggcagatgactggcatccttgctgtaaggaagagctttttccttgtgaatgggcctcttggctgtacccta

SEQ ID NO: 12171 - DNA, 1526 bp, Homo sapiens
cactgctcattacagtttgcttttttgtgtgtttgctgtgcgtttggagatattagtcagtttctttagtgatatttgtttccttgatgtgccttttcgtttttctttggggtttttggaatccggatgctgttgaagggcaatagcagactcctccagctaagagacaggacatgttcttgagccactgtagctgttgaagctggacaccagacgctccctataacccccccgccaggccatagcgtgtatgcatgtgcacttccacccacagaggagggtgtgaagccttgagaacctcaagaaagggctggattctgccatacctttgggtctaccttgggactgctggttgccaacgtgtcaaccagcctgtgttccctgccacccacgcacttgctgaggtgtggctgaggcagaatcatgtgaatgggtgcatccaaggagttcagggccctgcttggagaagaaatactttagcatcatgaaagggaaagaacgtgcaccccttttttgtttctttagtgaatgcaagatttaataaaagtgaataatgagcttcccctttgggagtggagcccagtgcagctcactgacagggttgacatcagtatgatgtgttggactgaaactgtatgtctgtaggtaggtgtgtgccttttagggcagaccacggtggccaccccatttctccaaggtggtttacctagcttgtgtatattagacattgccaccctcacctctggccaaaaattcttgatttaaaaagaaaagtctattttgttaacgacaggctctgttgtatgtgttactatcccaagcctggattattttatttatttaaaagtattttaatttccatattggctttattctaatcccatccatccctgtggagctgcagagcatcttcatgtgagtagacggatggacataaatagattcatgctcatttaggaagctgggagtttcgtgaagctgagggtgagttcctgtgattcttgttcgcttcaacaaaaagtgggagaccaagtttttatagcaaaagaccaaattagctgtagagtcttgaatgcagaaaaaaattaccctagctttcttagcacttagggttttgtgaggattcagtgtttagcacagtgcttggcacatagtaagccctagtaaatgttaaatattgttattagtgtttcgtaaaacttgagaaatagagctgagctcattcccttcctgttgattcaaaaataatacctacatgaaaacatgattccaagttgattgaatgttgtaggaattactggtttagagtagcccagttctcggcctaccctgctggttgggatcttactgtattcttgaatgcactggtttgaaaatatgccagacttcagcccccaaggaaacaaggctgcaagaatttatgaactccagctggaaaaggtaaaggtgacctttggctagccacatactggaccttaccccactgacgtctttcagaacattccaagggttttcctcaaggaaca

SEQ ID NO: 12172 - DNA, 1116 bp, Homo sapiens
tatgaagtattcctgaagcggcttaaaatttttttttgcaaaattaaatgattgtgaaataactcataccttttctctgcacacacagatacatgtatattttagccttggtaatttatatgcttctctgtggtcctggctcatcctttttgttgagtcatcgcatggcaggagtgcaagagagtgaacccagtcctgcaagatccaaggcgctttcaaaccataacaaattctaaacttaggtgtatagagtagaataggttaatatattaacaaatgtgcattgagtgtttgcattggccaaggcatgcaaatgtctcagtataaaatcagacagattttatatagtttataaactgattttcaaggccattgcagaacaggagttttgtttttagtattaatagctaaaattggttaaggtaattttttaagtgaaaatccaattagataactgcattttattataaacatacatatacattctagggagtacatatttacacatgttctagggattaggggaaatgatggaatctccttaccactctacattttctggtgttaacctaatattttacccctaaataagctaaggctctgattgttagtgacatattacatactctttatatggctatacataaggaaatacatgtaacgtgaatttttctctaaattatttggagctgatacagaaaagaaatggatgagaactgtagaagttcacctatttgttattaaaagttaaaagtgaagttaaggcttgtgcttagtgacaatatgcagttcaagcaattctcctgcctcagcctctcaagtagctgggattataggcatgtgccaccacacctggctaattttagtagagacggggtttcaccatattggtgaggctagtctcgaactcctgacctcaggtaatccacctgcattggcctcccacagtgctgggattacagcatgagccaccatgcccggcctcacattgtatttctttttttttttttttttttctgagacggagtttcattcttgttgcccaggctggagtgcaatggcgcgatctcggctcaccaccgcctctgcctcccaggttcaagcaattctcttgcc

SEQ ID NO: 12173 - DNA, 1273 bp, Homo sapiens
attttgtattagacttcaaaatcttttcttcttcttcttcttttttttttaaatccaggagaatgctttattgcaacttttagctgactagatgcttaacttagtaacaagtttagcccttgtaactggctagctaaaagcaaatcggcttgtttctcagatctttgggggatagcaagaaacatttgagtgaatgttgttgaagattttcagtagtatagaaaatgatggcgctcttgtgatatttgtaagtagtaagtaaaatttactttttgtgtacaaatctttgaagtttttgttgtgttgagaactttttgattgtagcacgttaaggctgatagtattgtcttcgtttttttttttttcttacagcaagcaaggatttggcacagacatcctatttcatggctaccaacaggttgttatcctgaccctctttgttgcactgttgtagcacactatagcttcctttaatgcagggccccctcaatgtgtctcttacccttgttgcgacaggagactggaccatctactgtggtggtaccttcctgtttgctttgcggtgtattgtacaagggactttgggcacagaggggttaaatgcacaatgtgaagtgtagtggtgctttctgatgacatattctcgatttgtgagtgcataagtctaaaattggtagcctgaatagcagctaaagattacaaagagctaaacttaacgtagaaattcgagcaacttggtaagtataaagctatttccagtttacaattatagttaaatgacaatttttaaaatttcacgttgatccagtcttaactttaaaatactcattaaagtttttttaataaataaaatttatgtaatttgaaattttttttcagataatacccactagtagcaagttaaaagtagtcaagtcctatccatgcctggatttgcataaacacaatttttcctttttttttttttttaaacaaaaaaaccttccttttcagtttatatagagtaaaaaatggtatgtgtttatggctgaacagataacatttccatcattgaaactgaactggaagaatagtcttaaggagcctttaatatataattctgttctagatttattaatgatttaaatttgtctttttgagtggatcattggggagaagggaccaaaccagctttgtatggtccctaatttcttgtgacactgataagttttatttacaatttcacattggcaaatactgctatattttctcaaatatctgttgttggtattta

SEQ ID NO: 12174 - DNA, 2623 bp, Homo sapiens
catatggactacaaagacacattcgacatgctggactcactgttaagtgcccaaggaatgaacatgtaataatttgtttaggtcaatttttcctttacttttttaatttaaaaattgttagaatggaaaaattccttctgatctagcagtggtaacccctgctgttgctgccactgcttcaatatttgtaagtgctgctttattcttcattctgaaaagaagagattatagtaaacaagtctttatctccacatatgatagtgttataaatactgtaaaagcatggaaggtgcaaaactcagtatttctacaattgcagctaagaacattaggatgaatggctggctgcttctaggaatataagatgcctcaagcattcattatttatgatttgaatactgtagctattttttgttgcttggcttttgaatgagtgtaaattgttttcttttgtgtatttatacttgtatgtatgatttgcatgtttcaatgataaagggataaaacagtatactgacaactgtttacaagaaagtggagaaaaatgtacatacatttttgtatgtttagatattaccgtaaatactcaggattggagctgcttgtaagtataacaatatacagaataactttattttatcttgtcagagtccatcactaatctaaaacaaaggtggcacttttttatgttaaccttaaactctaggccttactggaagccactgataggggacacttcactaccagatgtgtgcagtgcaacagatggtcatatacactgtgaggcactgaaattttgccttcagaggttctgaccagattggctgctgaaatagcccctaactttctgaaggcttgaagaggaaaaaataaagtttacatactcttgatgtgaagtgcatttaaatgtttgttggcttgttgcagttctatgaaacagagctgttaataatggttatgtggattactgtgatttgaaaactaaattcacaataacttacctagtagagatttagtgagttgtttcctttaaagaattttacactacatattttaatagtaaacagggatcacttttcctttagcattcagaatgacaccatattcttaaatatactccttccctgaagcgtgtttgtgtgtgatgccatatttctttttcaggtaaatgtagtcttccttataaaaatgaaattaaacctatgctctcaattcttttatattctaacaataaataaaaaagaaaagattactgactgtgcattgtacctgtatttatagtttatggttatcaggaagctctgtaagaaagaaaaggtcagcctcccaggcaaaccagtagtggaggttttacatttgtttgcacatctcagtatatttctgttgaggtaaagtttgcacagtcatctgacttctgatcaagcattagattttaacttgtttagattttgtcttaaacaccagtaatatggctcttgtttatcagctaatcttgaatttattctgtggtaaatcttttgagttgttgagtatatttgagattgattggattcgacctcttgttgaactgaaaacttaattttttctctgtatttttgttacaaagccactgatacgtgcacaattgtaattaagtatgttgcagttgtaaatattagagtttaatctcatgctctacctttatttagcaattacctaatttgccagtagctttataatttttaaagataattgttcattattttgtcaatgttatttgaacttggggtacttaggagcctctttgtagggactgtgcctaggtagcatgtcctaacatttgttctggtcttgcataacttcagtaatctttgtcattatatgtaactttgttgctctgtatggcataatattgtatccataaacatggtaattttgatacagttatacttttacagtggtacataatccaaggactagtatagaattaagctgagtgcaagatgagggagggaagggctttcttggtaatttagatgtgaaacctctacagagctatcatgtaaaaactacataaggtggttgtgctactgtataattgggggtgataataccaggaattttaataagattttgtaaagaatatccagaaaagtagtgaacttattttcagtagacatagaaaacaatgtgaatatttaaggtctgtgactatagttaaacttcactaagaatttgcagaattgttttgagatgtgtgaataaaggtaattttattgaatcttcattggtgctaatgatggacagttaaaaagatagctagtgtatattgttatgggtcagtacttattagtacttccaaaattgaatttgaaatgctatgtattcacttttcactctgtaaatgtaattctttacaatgactttatttattaaagggcagccagttgtcatttttacaggattgtgtgagctattcaaactcttcaacccctgaacagggtattaagcttccaaaataatgatggggataaatatggaaatcctttttaagttgtatttccattaaacaaaaacccttataattcatactatcatgaatttgctttatccatctcatttgcataacagttcatctgtctgg

SEQ ID NO: 12175 - DNA, 1109 bp, Homo sapiens
taattttgcattccaatttcatgttgacttgatacctacgatggctttttgttttaaaggcttttatcttgagaacatgatgtctgtagttaaaggtattggcgtattccacacatctgtactattcttgagtatgatcgcttagggtgtcaaattgagaaccaggcagatccaccacctacagtaaaaaggaccctaaagtaaattggttgaagaagttagatcccaaagattcttggtgaattttgaagtcttcatcagtatatccatattaaaaggagatgacagaagccaaaataaaagaattatgggctaacaggacagctggattaaaataagcatcagtttcattaaaaagggctaacttgaagataaatcttttgactccagctctttagaggatctgaagtgaccttgatggacagtggaagaaatcacaacatggaattacttgaacaaaaatttattgacttaaagaaaaagaaaaaatccaaaaatatatagagagaacaaaagtaaatatccttcaattatatgattagcttttatctgttcaaaaatagtttgaagtcatatacaccattaggatgtagaacagcaataactcaacaacaacagcagcaatagttgtttttaagggttttgttttgttttttttttgttgttttttttttgacacagagtctctctttgtcacccaggtgggagtgcagtggcatgactgtagcttactgcagccttgacctcctgggatcaagtgatcctcccaccgcagcttctcaagtagctggaactacaggtgcatgccaccatgcctggctaatttttcgtggtttttatagaggtggggttttgccctgttgtccaggcttgtcttaaattcctgaactcaagccatctgcctgcctcagcctcccaaagtgctaggattacagacatgatccactgcacccggcctgaaaacattctattgtgaaaattgtaatctagtaaaaatgaaagaggctcaacgcctgtaatcccaacactttgggaggccgaggtggggttggattgcttgagcccaggaattcaagaccagcctgggcaacatggtaaaccctatttct

SEQ ID NO: 12176 - DNA, 1385 bp, Homo sapiens
ctgtccagttgggtgatcaggaatcaaaccagcatcggaaagacttcccagcaccaagcttgagctgtgtcgtttcgtggagggggcagcgaggatgggcttgagctgttgagagatttctgccctagagatggcctttgtatatgggggggtggtggggggacacaaacacatcagacactccgtcctcacactggcaggacggtgttcatcgcattctcttctgtgaccagcctctaggctagcggctgcattcgtggtctgtgcaaacacttcgtggttctatatatcagcagcaagtgtgcaaaataaaggacctgttaactcagatttctggatattttggtggtagcttctagtcccagaatctgtgtttttaaaatactacatgacattctgtctattcaatcacctggtggtcatctttcttgtactaattaactgttgatgagcattttggatattctaggagaaagcctataatttcacatagtttctctttttcatgtaactgtaacctaaatgtattacttctgataaaactatatatcaaatgtcactgcaaattagttttatatctgtcatgtgagatttgtcttacttatttttcttttggttgccatggaagttatggccctgaaaatcgtctccctccccttctcttgctgtacagcatgcgttctctttttgtggttgctggctgggtactgtatttaatgaagtagagaatagcacttgcaaaaatacagtcttggtacctagagactgtcatgcagatagtataatttggtatatgtgctaatgcattgagtagaggattattttaacacactattttgcttttgtattttagttaaaataatcgatggggatgtgtagcccccccgtgtgaggatgacatcaccacatttctagtttcatggagctcaagatgtcttgtgtctgtgtggctagatggcctctgcttggtaatcttatttttaggcctaaaattcccacttaaatccaaagtaaaaatggttatactgaagcataaaccttgcctgtgtaattttaaaaaattaatagagctgtgcaaaccctgttatttttgtaaaaaaaaaaaaaaatacatatctatatataatatgtgtgtgtgtgtgacatatgcacacgtctctgtgtatgtgaagtaggggaggccctgggggatgacctcccagcctttatgatgcttttctctatgctgctggacttcattcttactggtccacgcagatgcaggcggcctgaggccagtgctgtaccaagtagaagacggttcctaaggacagagtttgtctgttttctaacaaagaaaaattctacaaaggagaggttgggcgttacaaaggcattgtgaatct

SEQ ID NO: 12177 - DNA, 1200 bp, Homo sapiens
aaaggaagaagtatttcaaaggaagaagagaccaccatgtaatcaatctgctatgctttaacagccctattggagataatatctcctcctagagggcacagaaaatgttctgggtggttttggttattataatgactggctgatgcactggcagttcatgcctactttatggatagatctgctaaaacaccaccatgtgtgagcccactcaaaatgccaataacacccccatttacaaacagtgacctagtgcaattcacagtcatcagttcatcacagccttgcattaactcagtgtaaacagtatgcttagacactaacatcttctctagtttaaagcagtgtcaaatcttattcattactgtttttcaggctgagctttttgaaactaatattcattcagaaatatcaatgaaaacagtgtcatggctccttatcattaaaaggaagagcacattggataaattattttcttaactccagcattcaattttgctacatgttttgtcttcattttaacagatattttggtaaaagacctcagtgggattgtagaggggcatcaaatcttaatgaacttcaccagctattaagtgacataatgattagaagattaaagactgaagttttaacccagctaccccctaaagtcagacagcgtattccatttgatcttccatcagcagctgccaaggtgagaaccgttgcttgatttaaagtcttactttaaataattttgaattacactattaaagattatacgtatttcatatttcacagaaggaaaggtttgctttcttaaaataggtttaattaatagagcctatacattggttttgtatttcagcaagaaagcaggaagaattcaattttattcatcagatgcataaaaagatatggtaacctagtggtttaaaaaaaaagtatttttgctgaaaaaagaacttcaattgcaacagagatgtagtattaagaattctaaatatcggccaggcacggtggctcatacctgtaacccagcactttgggaggctgaggtgggcagatcacctgaggtcggcagatcacctgaggtcaggagtttgagaccagctggccaacatggtgaaaactcgtctctactaaaaatacaaaaattagttgagtgtggtggcgagtgcccgtaatcccagctactcgggaggctgaggcacgagaatc

SEQ ID NO: 12178 - DNA, 1230 bp, Homo sapiens
ccatttacatttaatatcttttctaatttactaattctttattctgcagtaaatttcatccaatacattcttaattaaaaaaaaaaattatctccccaaagtttatatagttgtcctgacccgccatttacttgttgtttctgaaataagtctctaggtagtgtattttaacaatatctgattctcctcagtacagttctactatttacttaaatgagtcagtgaattccagttgaatttgccttgttctcaattgagtacaaaaacactatcttgacctaaaaagatagaaagtatttccttctttctttttttcaagtgttgcgtaccataccaagcaaattgcttagaaaataagttctactagattttgctttcactaaatttccctagccaatattgtcattttgattttaataacatggtattaaaaattatgtattgctggtgcggacacagttgcatgaggggtttctgccatcatcagtgctgtgtagcagagttagttcctctccagctcagccgcacaggtttggacatatttgactttttcccctcagtttgaattgaccaaagcaatggtgatggagaaggctagtcccctgctggttgggtgggaatttgtgagacagcattacacactgctgaactaggccccagacatgctgcatagattttatggaaggaactcttcttatgtccatgggggattggattcaaatagaaagctagcagatgcagtttatggacagaaagaaatccacaggaaagtgatgtcacgaaacttcagcaactgccacaccaagattctccatgttgatgcttatgccacactaaatgatggtgtggtagtccaggtgttggggcttctgtctaacaacaaccaggctttgaggagattcatgcagatgttcgtacttgctcctgaggggtctgttgcaaatcagttctatgttcacaatgatatcttcagatagcaagatgaggtctttggtgggtttgtcactgagcctcaggaggagtctgaagaagtagtagaggaacgtgaagaaaagacagcaaacacctcaggtggtacctgatgattctggaactttctgtgatcaggcagttgtcagtaatgacgtggaagaacatttagaggagccagttgctgaactggagcctgatcctgagccagaaccagaacaagaatgtgtatctgaaatccaagaggaaaagtctgagcta

SEQ ID NO: 12179 - DNA, 1199 bp, Homo sapiens
ctggagaaaccaggtgttcgtttcagaacccgttagcgctaaggggaggagccaaccccttaagcagcatgcctcacttcgccccacatggaggataattttcctttacccctaaaaagcactataaatacccactgaggagatctggttgtcttttaaatacctcgagtcagtaaaaactcacgaaactccgcacctcaggctccaactcgtgggaaaaggtagctcttttacaagtgggcaaaatggctgtcctcctagttttaccattggttggcttttgcgtccttcaagggcggttacttaccacggattggttctttttctcttgaggttggaggaagatttggcacggctctccgcggcctgggaggaggtaaaggggtggagagaagacagtttttttcaagcttgattgggcaaaactcatgtcactccggggacgtacaacctatgaatagtcggctgccgctcaaagagaacgaagaggcggggctagtgcgtggtgggaaggggcgggattctgccagccgcggctgccgctggagccggtgtccgggctggtgatggggttaattccctttcgtaagactcttacttgcacccacccagccccgccgtcgccccgccgcgccgcgctccaaccgcctcctcctcctcagtaacgcgggtaagagatgcccttccctcccccgtccagctccccgggaataacgcgccttgctcccctcccccgcccgccaaccggtagcgctaacggagaaggaggcaggcaggggagagatgtggtgtgtggaaaggtggccttccccgccgggtcgtcggcgcttcagccagggccttctgacgtcccgctgctgccagcccgccgttaggtcgggttccgagtgagccaggctcgcctggcccgcggctgcggctccggctgcagctgcagccactgccttgtgcccaccgcccccacccgggggccatgtgaaaagcaaacccctcgaggcctagcggaggaggcaggggaaaggtttccgagtccctgccatggctgctgctgctgcctccgcggctgctcttgcagccccagggactcgggagccagccacagcaggcctgccaagagcgtggtactgctctctcgtgtggctggcgccggtgccccgggctcccccggccgccccacggccgcatcccctggccttgca

SEQ ID NO: 12180 - DNA, 1220 bp, Homo sapiens
tctgccatagtcccatctacatactagtattagattcccatagaagtattcctgttgttactggcattgcatgttctttagaatactgtttctatggagttcagcatgataacaaagtcctgagcctaactaaagatgtctgttcttctgcttcctctccactttattgaatgaggaaataaaaactaaaatgcttttattatccacacattcacagagcaaactctaatatagtaatactaagcagatcaaaatacatttaagttccttcgttgtgtgtaagcaaaaaaaaaaaaaatgcatttaagaatagccacatgttgattattgttaaagttgggtgatgggtacatcaaaattcattacactattctctacattagtgtatgtgtgaaaacttctgtaataaaaagttaaactacaaaaatcatcttttgttttaaaacattaataaatattctagcatcaagattggggtaatactgaatgtatagtttttagggggtgaaatttagctgtataaatcataggctgttgacatttgtgattacttcattgctaagttttacatataagagtcttcatactttgtttcagggacagaatgatgctgctgaaattggaacaagaaattttagatttcattggtaataatgagtaagtcctgacattcaacaagaaaagaaattgtcatcaccattctccttgacttactaagttggtttttcttgtgcttctaggtctccacgtaaaaaattccccccaatgacatcttaccataggatgctattacacagagtagccgcttactttggattagaccacaatgttgatcagagtgggaagtctgtcatagtaaacaaaactagcaatacaagaatgtaagtgtcaagagatgtaactacatattatatatctaaataataatactttatctttctatattacctttcatctgaggttttccacatgttttaacagtctaattaagttttatgataaccttatgtgataggactgaaaaacacatttagtttactgggaacaaaatgcaacagcctggactcaaatatggcatatgaatgaggactggggcatatggtaaaaaaataaaaatccagaggacatagtatcagtgatgtttgacaaccactcttagggatttttaaaattaatttagacagctgtagccagccttagtcaaatttaaaaaaaaaaaa

SEQ ID NO: 12181 - DNA, 1204 bp, Homo sapiens
attgtataatatgaacttggccaatttcacttctacattctaatgttgctttcatcttcatttaaataaatgtcttcattttttaatgtgaaatgttgtaccctactcttttctgcatgctgtgcattcccactagatatattttttaaataatttataatttataatattcaacaatagagttgtcatttttttgaagctttaccctattacataattgctgttgttgatatatataatttccataatgtgtactattgcatcttatttaaaaataggaagtatttttctttgataagtttggcctatgtgtagaaggcttactaatttttgacttcttccttttttagcaggataacctagggtctcagtttagccacatgagtcttgctcgccagccatctgctgatggttctgaccctcatgccgccatgttccagtccactgtggttcttcagtctccacagcagtctggttatatcatgacagcagcccctccaccacatcctcctccaccgccaccaccaccacctcctcctcctcccctaccacctgggcagccagtccctactgctggatatcctgcctctggtcatcctgtcagccagcctgtgctccagcagcagggatatattcagcagccatcaccacaggtatattgctttttaaccttttctttcttgtggaaacctctcacttaagatcagttttaacttcaaagaacttatttttaaattctcatgaagagaatttgtgagagtatataaacaaagcatatactcatctttccgcctctggagattttcacgcacatgctaagcaaccatatgacaggtaaatgctccagttggttggtaaagtatgtgagctttgaggggttttttttctgagaggtatgggtttctaaaaaactaacctaagggaaacacaataaagtgtaaatccactgtaaaagtaaaatggtaagactgggcacagtggctcacgcctgtaatcccagcactttgtgaggctgaggctgactcacaaggctgggcttgagcctaggagttggagaccagcctgggcaatgtagcgaaacttttgaatatttaactaacttttaatttctgaaacagaccccacttggttatgatgtagtatccttcttatatattgtgggattcagtttgctaatatttgttaaagatttttgcatctatgt

SEQ ID NO: 12182 - DNA, 2236 bp, Homo sapiens
aggcaggtggattgcctgaactcaggagttcgagaccagcctggccaatatggtgaaactccatccgtctctactgaaaacacaaaaaattagctgggcatggtggcgggcgcttgtaatcccagctacttgggaagctgaggcaggagaatcgcttgaacctgggaggtggaggttgcagtgagccgagatcacaccgctgcactccagcctgggagacagagtcagactccatctcccaaaaaaaaaaaaaaaaaaaaaaaaaaagatggccctaacagttttaattttgtgtattcgaatggtcatttcccatgtcatatttgggtctgcagtgcttttttacccaacttttttggtaacaggaatgtattgattctgtaccttttctattctagttgttgggaaggtcttggaaattactgaactaccagatggaataactcgcatggaagctgaaaagctttttggggaactctttaaaattggcgccaagatccggtggctccgggacccccagtcccaaccacgtcgtcaccccctctgctgtggcagtggggacaacactgccaaccctgaacgctctaaacccagtgacttggcctccacctacaccgtcttagccacattcccctccatttcagctgcacagaatgcactgaagaaacaaattaactcagttaacaagtttaagctgagaacaagcaagaagcactatgactttcacattttggaaagggcaagttctcagtaacagccacctttggacccttcgcctttatggttcccctgccctctcccatctttgattggcttggtatttggagcttctgttaacattatagagactcctaggatgtgtgttcatggcattatagcttttgaagaaaggccagtgatccagcaaagggggaaaaatatgcatttcaccccacatgactaggaatccacatcagaatgatacagagttagcaggtttttctaaggaaatgccattcaaatgcctcctaacttttatagttattttgttttatatttctaaattcttgtatcagatccaaagctctattgtacagcaaattattcttcaaaatgattataaccagttgcaccctgtatttctttttgcagccagcacaatgtgacccaacttaaaatttgggggaaaaagaatgcaggagtgaaataaccaagtcaaaaccatgtactatctccttgggggttagggatgctaagaagagcccacaaatagaggattactcttcccctgaatctctaaactcagaaacaattaccaaaaaatacataactcttccttgtagggccctttccttattcatttaggtagtgtgaacattaagtataaaataaattatgttcttaatgcctcttaaaccacttacattcaaaggggaacagaaatcattctaagcaggaaaatacttccactttttttttttcaagtatctctctaataactaaatgccacttatttgcattctccttgtggattttttgtcacctaaggaaatgcatttgatgagtgctggaaacttcttaagtgctttacagtttgttttcattgtttgcagcggatcactggacatcaaagattcattgcacttatgaacaaggaaccttcttttcaatttctgtgtaatttgcaaggctgtacaatgtgtgctgatgcaagcctttttcagttcaagagaataaatgtttacaaatataggctcactttgtcttttttttaattaaaaacaccttttaaatgagtcagttttgaagacaataacctttttggaagatttaagtcaatttcagacttacagaagatgaaaaacagtaaaccacctcattttacaaatgtcctaaacatccctttctctgtggcagtgattcctggtggacatgattcgtgttactgtgttgtctatcataaagttattaccaactgtagaaatttggagtatgaacatacttattgtcaggcaactaaaaatagaaggttatgtttggtgagataaatttgtttttagcttatgtattgcacacccaattgtccacttaggctcaaacgctttatagacatcttttccctttggttagccaagcaaagtcaccccgttgggaaatctaaaaggtaggggtctgccaactgcagctttcctggagtctggttatcttccagcccagactagggcttctactatgaaattgaagagcactaggtgtt

SEQ ID NO: 12183 - DNA, 1667 bp, Homo sapiens
ttcctgcttagtgggtgtgggttgaaggtgtttaactcagaaaagtaaagacaggaaataactctctgctaggtccttgcttatatggcaaccactgctagaaccctaaaagaaccaaaaatctgccacagcctgcctccatcagcttcttatttagtatttcatatgcccattagccctatgcttcagatgacacgttttgtttagagctactttgctccaagactcttaagcccaaagtaactggtatgtcactgagtaacttgactcggtgtcagagcattttaactagccactcagatgagaatttatgtttaacttctctttttactcatcagctgcaagcaaaatcttgtagtttttaatcttaaacactgaataaaaaaactttcccctaaattggaatgatcttagttttgctttgagttttgttatctagcatctttttgttgcacagggctctattgaggtcctatgtctctgatttttttttttccccagtattgccctggagctgtctctggaaagtagctggcgaggttaccttaactatcactgaagaaagaaattttctgacacactgatggcatgtgacttgtctcctaagtcagtgaggcatcactttgtttgcataaagtatacggtttgttaaggcctttgttcttgtgagatgcaaaacagctgctagtctgcaacctagttttccctctcacctttaactgacgttttgtcctcaataattacacaaggacctagagtacctataggacaaaaagtatagaataaaaatatgcctttagtcatttggtttttcttaaaaagttgagattcttaatctgacttacatgttactttatccgtatgtctttgttagtggagaccgctaaactaatgatgtttgaaaacagttcctctgttttagattggaagatagcactctagagtggacatacggaaagactgtgactttattttgtaatgggaggaagaaattttctcagagcaaactttctattttttacctgtgaaataacagtgactttttaaaatggtgacagtgttggcaaggaaacagcaacacaggctgcgctgttggtaggagtgaaaaccagtataattcttctgaaaaacatttatcagaaacttaaaatatttcataccgtttgatccagtagcttcttctaaatcataaatgcagacaatgtttaggtaaagacatactcattaagtgttatttattttactcaagaactggaaaccaactaaatgccttctatagaagtaatttttgatgaggagaaatggtacaatactaattaacaacttggtttaacatgtttactgagcatctgttaagtgttgggggaaaaagcagcaggatccagagctataggtacagtgtgatctcagctttgcaaacacattttctacatagatagtactaggtattaatagatatgtaaagaaagaaatcacaccattaataatggtaagattggtttatgtgattttagtggtatttttggcacccttatatatgttttccaaactttcagcagtgatattatttccataacttaaaaagtgagtttgaaaaagaaaatctccagcaagcatctcatttaaataaaggtttgtcatctttaaaaatacagcaatatgtgact

SEQ ID NO: 12184 - DNA, 1536 bp, Homo sapiens
ccagatggcatgttctacctttttttttattagctcagagtgaaaaatttttcagatgaattttcatagattcttctcctaactctatgaaatggtggtatatgaaaaagttcagtggtcataattaaaaattgctgaatgatattaagtatgaaacagacttccaattaattagaagattttgcagagttgtttaaccttaaaattcaagcattacttccttttttgaagttgtatttacaagcatttgatgtaatatatttaagtatttcttaattttccacaaggggtttatggtatgaaaaggtcagcatcctactaggaacagggtttagcagagcactgatagtgatttttaaagtgtggtccttttcctaggagtttctagttgggaaatgaaagaaaatgttgatagcaaacactcggaagaagggtcaagtcttgtatatctggacattggtataatactgcttgaaacctgaggacaaatatttgtgtttcacaggatcatgttctaattgagctcacccaggctggattgaaaggctccacagagggaagtgagagctatgaagaagatccctacttggtagttaaccctaactacttgctcgaagattgagatagtgaaagtaactgaccagagctgaggaactgtggcacagcacctcgtggcctggagcctggctggagctctgctagggacagaagtgtttctggaagtgatgcttccaggatttgttttcagaaacaagaattgagttgatggtcctatgtgtcacattcatcacaggtttcataccaacacaggcttcagcacttcctttggtgtgtttcctgtcccagtgaagttggaaccaaataatgtgtagtctctataaccaatacctttgttttcatgtgtaagaaaaggcccattacttttaaggtatgtgctgtcctattgagcaaataactttttttcaattgccagctactgcttttattcatcaaaataaaataacttgttctgaagttgtctattggatttctttctactgtaccctgattattacttccatctacttctgaatgtgagactttccctttttgcttaacctggagtgaagaggtagaactgtggtattatggatgaggtttctatgagaaggagtcattagagaactcatatgaaagctagaggccttagagatgactttccaaggttaattccagttgtttttttttttttttaagtttataaaagtttattatacttttttaaaattactctttagtaatttattttacttctgtgtcctaagggtaatttctcaggattgttttcaaattgcttttttaggggaaataggtcatttgctatattacaagcaatccccaaattttatggtcttccaggaaaagttattaccgtttatgatactaacagttcctgagacttagctatgatcagtatgttcatgaggtggagcagttcctgtgttgcagcttttaacaacagatggcattcattaaatcacaaagtatgttaaaggt

SEQ ID NO: 12185 - DNA, 1096 bp, Homo sapiens
catgttggccaggctggtctcaaactcctgacctcaggtgatgtgcttcccttggccttgcaaagtgctgggattacaggtgtgagccactgcacctagccggtttattttgtttttcatttttattttttggcagaggagatcatgtgggaatgtatgcttgttttaaaattagtgttaaggctggatgtggtggcccacacctgtaatcccagcacttgggagaccaagacaggaggatcagttgagtccggtagttcgagaccagcctgggcagcatagcaagaccctgtctctaaaacaaataataataataatttttaaaagtgaaaaaaatcagtattaaatgtaagtagtgtatttgtaaatgcttgacaaggggatgttaagggcacaaaaataagattcaggtggtcaatttttcacttaggtcatgctgacagccctgctcctgtgaacgggatcaatggctacaatgaagacataaatcaagagtctgctcccaaagcctccttaaggctgggcttctctgagtactgccgaatctctaaccttattgtgcttcacctcagaaaggtggaagaaggtgaggcttacctggtactgcttacatgctcggtcacttctgtaagctctgttcacataggccacttgtgattgccaaacttcgtgttgttctgtcggaagagaggataagttgttagataaactcactttagcaaagtaaatttgtggagtatcagcatacctgccagcctgaacatttcttcacaagcttattgtcaggcaaagctttgtaggtccttctttttaacattctgggcctattttaataattttgggacctgataacatatgaagcagcacatacaaatgtttttacaaatgcaaaattactattcccttacaatggttctgtttaaaacagctggacccctagggtatattttaacagtaattaattgagcctagaaatctatactatcaaaaggccattgcagactagaaatggagtaaaatcctcatgtagttattggtaaagtgtggcgtctggacactagtacgcttcctacccttaactgctttaccatgctat

SEQ ID NO: 12186 - DNA, 1120 bp, Homo sapiens
ccctgcaaagagtgtgagttaattaattgagcctcaaatactgagcattaatttatttaatgagcactgacatcctgaggtgtaaaagacattacatcttgttccattgcttcagcttgttaagcagcttttagaaatggtcatttgcttaaatactaagccttttttcaggttcataaaattagtaacatggaattcacaagcctccttaatattagtttcttttgaaagacattacaatagtaatttattgtcactggcttctcaaagtttcaaccctctcaggttccctaaatgtttccacctggaaggctcttaaacttaggtttaccgtagctctcatcaaatagaaatgtttctctaacttgagtgatgatctgaaacagatttccaaagagtcagaggacttcattgtggagcaatataaacatctccgccagagagatggttctggagtgaccaagtcttcatggaggattacagtgcgacagcttgagagcatgattcgtctctctgaagctatggctcggatgcactgctgtgatgaggtatcagagtcactttgatatgatgagagcagagataaacagatttgttgcatgtttttaatctttggtatgggacatactagaattcactgcaaatacatttttatgtaactgttgaatgctcatacgaccatggaattcttccctttaaagagcttggtaagcatttgagtgtagttgttagacggagacgatcacgtcatagtttatagagtgcataaagacgtaagttaccatttaatacctttcattcaggaaaaatgtacttagaccctacaatgtactagtaggcctctgcgctggcaatacagataagataatgtagcccctggcctcaaaggaactctcctccttaggttgcatttgtataatgtttgatttttagattgttctttgagccctgcattccacgaggataggtcagtgggtattaacgaggtaaaaggggagtagtacgaaagggcattcaagcgtcccatcttcgcttcaaccaaagcagccctgcgttttcctagttttattaataggtttgatgtaaggtcgtctttgaaaagggggtttggctttttttt

SEQ ID NO: 12187 - DNA, 1099 bp, Homo sapiens
atcatggcttcactgccccttcaacctcctgggctcaagtgatcctcctgcctcagccacctgagtagctgggattacacatgtgcaccaccatgcccagctagtttttttgtagagacagggagggtctcagtttgtcgccctgactggtctcaaactcttgacctcaagctcttctctcacatcagtctcccaaagtgttgggattacaagtgtgagccactgcactttaccctactattgtttttaaagccaatcaattccttcaggtatagttttagagtggggcaatggtatacatttaaacgtttgattttaaatccacctgttcccaaactttcatcagaaacttggtacccattaatacttctttaagtggtatattagagcttgtttttggcgataaatcatttcttattgcctgggatagtctggagaagatattgctgtgactatcaaagtgatttttttgttttgaattaggttacagattatgccattgccaggcgcatagtagatttgcattcaagaattgaggaatcaattgatcgtgtctattccctcgatgatatcagaagatatcttctctttgcaagacagtttaaacccaaggtaacctacccttttgtactgggataaggtataatgggtatattaaagtggaatttaagtaagtgtgttatatggaaattaactgaacctgtcatctaccttagttcctaaattttacaactttttttttttttctggaacagcaatttgttttttcagagagggctgagaaagggaactgtaaaaaaaattctgaataattccattatttgtttggtggtaataaaaagatttgtatgggagaagagttttggataactggataatctagaacattcttttatttcaaacattactaagaacgttaaaattgtttatgcgcctaaatcaatagttgaatctttctttgaaggaaacattggattcatctaggccattatgataaatataaattactgttttacagtgattgatgcattgtattggactaactctgttctggacccaggattcttacctggacataaacccccaaatgcttggcatt

SEQ ID NO: 12188 - DNA, 1167 bp, Homo sapiens
agtgcagtggtacaaattatccacgctgttttttgttttaaagtttcatagttcctctgttattcttctggaggaaatacaaataaaaagatttagtaatctgggaagtaaacttctgagaatgatgaacccctggcagtatcattcagttaacttgattctgtgtcataaatgggagtttggaaaatagttcagtattggaaaaagggagtgaacataatattctcttattttatttgcatctttatgtcagtgattaacattctgctatcgcttatctcttgagcattcaggtagctttttttctatttaactcactggacaaatgacatacccttaagtgtctttgttaactgagggcttactagtttggggagttgtttttttttaaacctttacagtcaataaattgtgaggttgacttcccatgctatgttgtgtttgtaatgaagtttcttctcctttatgctcttttgactgcttctatactaatgattcttcctttgttctctaccattagtttggggggaaagagctcagagatgaggaacagacagctgagagcattaagaaccaaatgactgtgaaagaatgggagaaagtgtttgagatgagtcaagataaaaatctataccacaatctttgtaccagcctgttccctactatacatggtaagaattccatccatttgtaccataaacttgaaatcaaaataatgattataaacagccacaggtgatttctgaaagcacataaatcagactgtgaaagtttttagtgggtctgaaagaggtcatttacaaaaggacaggtacatgatttcacttatacgaggtacctgtaatgtgcaaattcatagagacacggtaggatagaggttatcagtggctgggggaatgggagaaatgagttatttaatggataaagttgctatttgggatgatgacaaagttctggaaagggatagtggtgacagttatacaacataatgtacttactgccactgaacttatacactgaaaaatggttaaaatgataagttttattatgtatttttatcacaattttatttttttaaggaaaagttattttgtcatcttatttcctggccttatgacagagctgcacttaagtgtgtttccatatgcgagactagtctcctggcct

SEQ ID NO: 12189 - DNA, 1094 bp, Homo sapiens
aagtttgtttagatttcaagtgtcacatgttacaaaaacttacttcttaaaatcattaaatttatctaaaattctcacatgttccttcataatctagtttgggatagtaattgtttcatgtctgtttaaatatgtcttccctcttgattctgtcgtttaaactttttaatcagtacatcaaacttctttcctttgtaggtaaggtactcaactgtgtggggtactacataaatcctgaaagactacaataaagtggtgatgtctcgggaacccaccccacctctacctggagatatgtctactggtcccatagcagaaagctggtgttacacacaggtacatgctcttaaaaatccctcactttatgtcacttataaattttacagtatgttgagaatagtattgtgaaacactttgccatagttattagaagtgttagaagactggatcgtaggatgttgaacatgtaacaagttaaaagtattaccgtcatcattataaaagtggttttctgaatctcttaggttaaagtagtaaaattttcctatatgtggaccattaataacttcagtttttgtcgagaggaaatgggtgaagtgttaaaaagttcaacattttcatctggcccaagtgacaaaatgaaatggtaagatttttgtttgctttgaatttttgttttttgtttttgatgtgatcatcagctgctcatgattttgttatcatttttcctgaatgagtattaatgtaatttcatattagattggtagtatgttcctaatagtgtggggaattataaagaactgtgaggatgttgacaggagtgctgtttgtgacattaacacatgatttcagtgttctctctctctctttctctctctctctctctctctcgaatgcttttcaagtattatattcctccatgtgagcttattgttttattttaggtgcctgagggtaaacccaaagggattagatgatgaaagtaaagactacttgtccttatatttgcttttagtcagctgccccaaaagtgaagttcgagcaaaattcaaattttcccttctgaatgctaaaagggaagaaacaaaagcaat

SEQ ID NO: 12190 - DNA, 1230 bp, Homo sapiens
ttgaaaagtattctttagtaaatatcttttaattctatttttcagccaagcaaccgacataatggaaacatcagggtggaagtccatgattcagtctcaccctcatttagtagcagaagcctttcgagcactagcatctgcacagtgtccacagtttggcattccacgcaaacggctaaaacagtcctgaaatcttccatgaacagttgaaaaatggaattgactttcactcctccaggtccagaaggattctaatacacaaaccataagcaagagttgtttctgttattttgtccacagaacagaagctgaaaaagcatattgcttgcatttcaggtggataatttatggtttattcttcagctttaaattagactgattaattcacttcaaggccttaaattatcttcaatgacttgtcttgttcatataatactttaatttttttttattgtgccttgtcattttgaccaaggctatgcaggattgcactagctccataatgcagtaatattgataactgaagatactaagtttcaaaaggatcttccattattttgcaaaaagaaaaatgaattttatagggtttgtcctatgctatctcaaagtttaagttctctttaaaagcacttgtattggagattaccagtaatatctccaatctaagttctataaatatgggagaaccctcttaccttcaaggtaagttatggcaatacactgcttcaattctaatttatttttcatttcagggggcaaatatgcaatgagttggcctagatttttagtgacatttatgatgtttgtcttgtatgttaactgtccaacaaactgtgggtttattctaagtttacaattattgagaactgattgaggttaagatttcatgaagaaagcatgtattgtgtggaagtaatttttttttaatttatactgacctacatttatacgaagaattctgtacatgttaaaagtaaggatgaccaaatgcaaatttaatgagtgggccaattaagaaagatacatatgcacttttactgtgtaacttttgtatgctgaatggtacatatatttttttgcttttgagggaattaataaggtataattaattgtgtcttaacttttcaaagaaatttttagatggaggcaactgggatgtttgtgataatagatgagaaagacatccttgattgtagttaaattggtttggattacagatattcattattg

SEQ ID NO: 12191 - DNA, 1319 bp, Homo sapiens
gctctaatatgtgcatgtattttgcttgtttagtgtatctacaaatacaccagttgtcataactaatcaatcagtttatctattaaaaggttttttaatgtgtttatttatggctagttctgtcaagtgtttgaaatactggaaatcagatcttctcactgaatataggaaggattgcagtttgaatataatcattaaatgactgaaatcacataaatcacattaatatatttttttctctttttaaccagttgaattaagcctcttttatcatgtatgtttctttaccccgctgctattaaacaaggcaatccttttatctcttaaataattatggaatttcagtgcagcactgtgtaatttgaagtcaagagcagctgaactcaaatcatataataaaaagcaaaatatataaattatgccatttagcaattattcagtgtccttatgtctcattttttaagtgcatagaaaaggtgaaatttgttcttttatagacaaatcagtgaagcagagaaagcttgtgatagaaagcagcactactggcaccaaccaggtctctcctgagtctatgctcacctcactccaagatacttgtcttttcaattttgttctctctgtggcccatcttgagacactaagatatcacttattctgagcctcttttaagtatatacaaaggtaatccaatgtcgtggtgtaagttatatctcttttcttttttcttagatgtagtactaagcagctacagtatacatttccctttaggcctctttgcacagtcggaatccttctgtctgcaaactgtaagaatattcctctgatttccagtctcggagaacattacaagtagcattgaatacagataattttgagtgccagctcctcatttagagattataaaataacaacaacaacaaaatcaagacctaaattggtgaactgtaactcagctggaagcatcaatctggagtttttatagtccagagtggttgctgtttattttaaattacttcttatagccagttttcactccatgttcgtcataagattctagaagtatacaactattctacatattggtattcttcacagtgctttataataaaatcagtgcttagtagtcttcactaagtgaaggaaagaaaaggaaatgaataaaagacaaaatgtatgaagttatctctcttccacagaaggtgcctaaatatgtatcacatttagattagtcgttataaaacaacatatttctcacatatcaccttagcaaaatctcatgttagtaaactcagagtgatcttcttcatttactttttgta

SEQ ID NO: 12192 - DNA, 1105 bp, Homo sapiens
gcctcctccccaaaattgcttttacaactaacactgatactaatttaggatagttcatgccttatccttgctaagaaaatggaattgatggtaggcaggtgctaaagtgcttttcaaaacaatattacgttagaatacaattggattcttcctcaaatttatacaggccaaaaagtaaaacattaattttctgaatttccagattaccaatcaattaatcaacaaatagccagtattatgctgtgtatttctgtcaggtcattttaaaatccatgttaattttataaaagaattttttacatgtcactgtcaggagctcactgtgaatgtgttgtcttcaaatggttatttaaccacacagtacactacattttacatatatgtacgtaatctctgggaatagtaaattaattatgttatttataaacaatacataggtcaacagactttaagcagggaggaaaagaagagtaatagcgtctgtgtgctgcagaccattcagaactgtcacgtgtgtccccatggtctcattcattgtattcctagcaattcccttttcaatgttgagttcacctctttatttcacaaagtacttggtctctcaatttcttgatctggttttgcttccatttaaaaactaatcaagaagggaaaatattgagaatgtgcatacaagaaaatcattaatttcctgaagatgaatttctacctgttgtgaacatttaactttctttttaaaagttaaacaaaaataaacaagggatattatgatgaatgtttggcttatgtgagtactagagataaaatttttaaacccagttattcacaatataaaatgttttcaagttagaaaaaatttttagaaatcctgggtattgtatttaactgtagctaaccaattttaaaacttgtattcttttgagaactattattaatagaaaaactttttataagcagtaaaataagaatgttccagtgactacctgtccttatacctagtcttgttaaaactttcttttgcagggtatttagtgtttggtttacagtcagtgcagagtgggcaagttaacagaaagtttgagctagagatactggaaaaaaaaaa

SEQ ID NO: 12193 - DNA, 1155 bp, Homo sapiens
ccgcatattctcactcataggtgggaattgaacaatgagatcacatggacacaggaaggggaatatcacactctggggactgttgtggggtggggggatgggggagggatagcattaggagatatacctaatgctagatgacgagttagtgggtgcagcgcaccagcatggcacatgtatacctatgtaactaacctgcacaatgtgcacatgtaccctaaaacttaaagtataaaaaaaaaaaaaaacatagctaaagaaaaactgcatatgcaaatcataccgtattcatttttttatttaacttggggatggaatggggatagcatacattttatttgtacaatatttaacaatcacttatccaaggtggggttttatggggattttaagctttctgttaaatacttgcagaaaaaatagcaagtacgatttgacagtagtacaataacctgtgcccaaaacacaagaaatacagagtaaagcgaaaataactgcttaccaatattctgagaggtaacaaatgggatatgggttgagactgcataaaaaacgtactgctggttgaatatctgaggtaaatgatgttcaatcaagatgctacttgtatcattttgcccataaatggataaataattttatgcatatcataccaaatgttcctaaaaagtaatctttcaaaaaagtataaaagagaaactggaaagtatctgtgatgaagcttctttctttaaaaaaaaaaaaaaaaacaaaaaaaccagtaatcagtttattccactaaaccaccatctcgccatggttttttttcccctaccacctgcattttacttaaatgtagctgttacttaggggtgaggaaatgcaacagaagagattctttttaaatttcatgatatgattctattttaaattccaaaggtgttgggttttttcctgattgtattttcaaaacatcaccatgaaagatagatagtgcaagttcatgggactaacaatcgtgaagcacagtctctttttctggaattcacaaggtacctagaattcaaacaagaatcacacatcacatgctaaaaaaacttctagcatctaaaatacatacaagagctgtgcagggcatagacttcaaataaagccgaacactggttaatccatcag

SEQ ID NO: 12194 - DNA, 1244 bp, Homo sapiens
agactagaaacaatagcaagggagtgggaactataattaagataatatatttcctgagagtataaaattttattccagtagactagaacttacttctgaatctggtcttcttagagtggacaaagtaaagacatataattacagctctagaaaatacagaaatgcttagttttctgggcttttttttttttttaaaagaatccttattccatgcagatgatttttgaaaaattatgacaatcttttccaggcctttcttggctctgctacttctgaatttactcttttttcatctaatcttttcttcaatgccagtgttcctcaccttccattcaaccctaattactgcagtcacttgcctctttagatggtactttctcaaagggctgtggtgatctttgaatttctaaagccattagcctcttctcaaatatatctttttacaaagtagtttatattgttgaacctcacttctctcttaaaactttgttcccttgttttctagatctctactctgtcttagattctcttccagtctttggtatctttcttaatttcttagtttttctcttttcccacctactacttaaatattaataatccaagattcattttttgaccacatttcacttttcacaggccattttgtttcccatagatcatgtttgatttttatcttctacctttcaaacccttccttctcttctgctaccagttaattctctaccagatgtactcctataaacgtcttaattcttttttcttcataacactcagataattccgacccactttacctcttgtctggacagctacctccagttaggtttttctgccttttctttttgtacattcactttgccagtaattgaaactccagtacgtgactactcattttctgccaatgtgataattttcctgctactcatgctgttccctgtaactggaatgttcttccttcttttttaaatctcttgtctcatccagtttaagcattctttgtaatactttaccttgtatccctaggtacagtaactcatgcacttctgtttttgtgctgcattttgttcatttcactagtatgactgtgtagtagtttcccttattcaagtacgaatttggggttagccaggattgttttatcattgtgtttattgaattaacgtaaagaacaggataagaaaatcagtagactggaaactttattttggttttagtgttctacaaataagaccaacatctat

SEQ ID NO: 12195 - DNA, 1477 bp, Homo sapiens
tttatttaaaagtaggcatattagaaaaagacctgtattttgtgcaatagagtcctcagaaattgttataaaaactgtacagaagcacctaagaggtaaatgtgttgaggcatcagaaaatttgactatgaaaacattattcaacactaatgatttatgagaaatgacaaggaggaaataaaagatggttgtaaagacattattgttcactatgaaaacagtgtgctatgaaaaccagattgctactgggaatgagaaaactgctgaggtttttaataataagctagtgtgtaggtataataccgtcatgctggagaagcattctaacccacatgtctttgttgctgatagtaaaagcgttttccttcctagtgttgccatttacacctgccatccttcacatcttgtgttatgtgttatgttttgatgtcactatttaatgaagaactattcaatgatctcttatgttaaatatatatatggtttagaagatatttgaaattattagtgccttcttgatattcttagtttaaagaatctcataaaactttatgttttatgtgtctaacagtatacttatcccatagggggcttccagcttttcactcactcatcatatttctttttagataactcgacacaaatgaaaattttattttatctatttagcagaaaagtcacacaaagttcataactatttaaaagtacaccatatttattgagcataccttaaataattttgatgggacatttttagtctcattgcattatacagttttgatatcccctacctcagtttacttcatttcaggtctgagttcatgtgcaaagtgtatgtatttcattgatgtatttcaattcatctataatggaaaagaccaacatttacttatattcttgtttcttctgatggtcaagtttagacttatttaatactgttttggtcatttattttttttgtttcatgtatctttgtaatacatctgacctgtactgttactgctgggggtgtcaaagcatataggttaaaaatttattagtgtcagaaaagtgtgagcatataaatagctaaaaaggataaggatacatgtctagaaatgatatgaatatgaccaactagtgtaaactaacaggaagtatgtgcttaataaaaatctaagtagaatttttaaagtattaaacctaataaaattaaatactaattaacgtgcataggtctgatgtgcagctggttatgaaaacggattgattcactaatgaacataactctttcgatgagctaaatattgaagcagtctctaatgccatgtttctttttgccatgtagtgaactgtgtcaactcaatgtaccatcactgtaattgcctagcctaaatatctgtttacactgacatttattcattcatcaaataaccgttgagccttaaaggtaggcattcagaatgagacagtaaatgatagtcacagcttttcctct

SEQ ID NO: 12196 - DNA, 1208 bp, Homo sapiens
aggagggaaaattctatttaggaggctatttcagtaagttgtggaagtaatgaagtgattagaaactggatatatgttataggaactgttcatttaacctttatttaaaaatattttctgccctggtagtaataaaacttgttgaacataattttatctttctttgaaatattcagaattttgtactgttaaagtttgaagtaataaatgcagaagatacttaaaatctgtgatacaaatttatttcctgtaatttggaatttttctttcatctggtagtggtgacaaacacctcaattaatctagcaaacagattaattttttgtaattgaaattttatattctagtttctgagtatatatttaattttgtttaaaaaattctacttacaaaaattgtaataatctaaggtgttatcagtatgagccacgagtattaagagagaatgatgacaatgtaactgtaggtctttggcaaaggaactatttataattgattcttaaagcactttgtgattattaaacaaagtaacttttatataaaattatgcattgattaatattactaaaacaacttatgttgcctactttacattttccaggaacatcatttacagcgagcaatttcagcacagcaagtgtttagagaaaaaaaagagagtatggtcattcctgttcctgaggcagagagcaacgtcaactattacaatcgcttgtacaaaggagagtttaaacagccaaaacagttcattcatattcagcgtaagtttgttaattcattgttttctgtttgtactttaaatttatcaaccagtggaaatcttttcttttgtctaaagaaattctgattttttaattcatacacactgattaatagatatgttaaacattaaagaataaaatccctctgtgcttacatctgaatttggaaatcattttgagttttaagtaacatttggaacatttgatatttatgtagtataggattttgtatagcacttatactttattacatagctaaaaggtggtggattactatacccaaatgagatttcctttttttttttctttgagacagagtctctctgttacccaggctggagtgcagtggcatgatcttggctcactgcaacctctgccttctgggtttaagtgattctcctgcttcagcctactgagtagttgggattacaggcgtgtgccaccaca

SEQ ID NO: 12197 - DNA, 1450 bp, Homo sapiens
tatatgatgtatattttgtaaaattgggaaaatcactaccttgtaaaatagtttatttgtatcatcaatattatttctgttacttgaatagtagatattcatcatcatgcttttgcacttgaatttgcaactgaatggattttaaaaaataattctttaatgggatcatgagcatgaaatgggatcctgcatcacttgttttaactatttattttgccatgtttacattttgtatcttgtaaaaataaatccaactttgtgtctaaaaagttaaagattcatagctaggaaatgaaattcttgtaatttttttctaaaggaactgtaaagttttcacttggttcattttgtttcacaatttgactagatggactttttggtaaatactttagtggcatttcactgtcaaatatgaagttcaaggcaaaatagtattttctattactgtgcaggggaaagggatggatcgatacatgcaaatttaatgtagtaactcacttttccatatattttgaatgtatatttctatttatgataccaatttataaaaaataattacacagaaaaaatggaataggaaaaattatgcatctagcacatttaaactgtgcaaatatgaaaatttttcgaggattacattttatctgaaggctgcatattttaactggctttaaaactgtaacacatcacataaaagatactttaccaggtatgtattgcattatatcattgcaataattattggaagtctagatatcgagccatcccaggtgttgggcggggggagggttgtggcaagattgtcttttcaattttggagagttttcctgtggctacaaggcaagtaacgggttggaaaaagtctgactgtaagcgttggacaccttcatagtgtagtgttttagtgactttttttatacggttcttgtaaattagatacgtgtagtggtgtttcagaatgtttgtttatgcactagttcagacaactttccctgttacttgttcttgataagtgaaaactgcagggaaataaaaaatacatatcaaaacatggacatgctgcatatgtgtttatttcacaatgtgcacacagtataagtgaaaatttaagggagatgatagcacttaacagcacttttcatgttcacatgctttccaagcattaatgaaaagaactataggaagctcatctgtgggctctattgggtttcagataatccaatataaactacctttgatatgaaagttcgtaagatattttacagaatgtaagtaatttgcagtatcgcagtcattgaaatgtcataagtgagcctcattttataaataaaagtttagagtagaattatattgcaagggggttttgtcaagtaagtactgggaaatgtaaatatttttaatgaatacaattaaaaccatttcaaacttacataattttatactttacatt

SEQ ID NO: 12198 - DNA, 1155 bp, Homo sapiens
ttttaaaagaagttgatgaaatgtattttcttgattgatctgttaaatgatactgaaagtgttgccagaataaggttcttagaaattttggaaaattttggaaatcagttctagaggtgatttcattaaacaagattgccttacttggaactccaggctcaggtcagtttgtaaatactcaaaacccaaacccatatattctcgttccttctcctgctcccttttcctcctcctcctcaccccacactagccacatagactctgattttgtttccttgagtggcagctggaggcaataatgtggggcctcagaacttggcagaacaagtgctcccctgctggataaacaggccaacacaatgagtttttccaccaacttctggtctgttggcaagtcaggtagatgcccaagggagctggcaggcacacgtgggtgcttcctgctccaccgggttctgtctgaggaacccagagatggttctccctctctctcatgtgtctcccagcatgctttaactgcccgtgtttgtattttcgcccactaggggaagctgcatgacccccagctcatggggatcatcccacgaattgcccatgatatctttgaccatatctactccatggatgagaacctggagtttcacataaaggtacgtattactgattggtccccagagaagacactgggccccagataacgtttcttatacctcctcctttcaagaagatataaaagatgatcctactaatttaaatgacattcttgtggtaagcagagccctctttattagtgacctaggctaacaggtgtctggagggtttgcttgaaatatccacataatgaaagcaaaagccttctttaggaggaaatcatcttgattgttgcccaaattctaccctttatcctctggatttctgtgggtatgactgaaatgtgtttgtgtttgggttagggcagcattttccaaagtgtgttctgtggaacacagtcccttgtgttattaatggtgggctagcagggaaaagggctgtaaggccaaatgagctgggaaaatgctttcttgaacagtgttaagtttatcacaggtttcaatatgctctgcaaaggggacatgcattagattacatttcccagcttatttgaatgtagacaca

SEQ ID NO: 12199 - DNA, 1216 bp, Homo sapiens
ccgggcacggtggcttatacctgtaatcccagcactttgggaggccgaggtgggtggatcacctgaggtcaggaatttgagaccagcctggacaacatggtgaaacaccgtctctactaaaaatacaaaaattagccgggtgtggtggcaaacccttgtaatcccagctacttgggaggctaaggcagaagaatcacttgaacccgagaggcagaggttgcagtgagtcgatatcgcgccactgcaccccagcctgggtgacaagagtgaaactccatctcaaaaacaaacaaacaaaaaatatgtggcttgtgttatatttgtatctgacagctctggtctaaacatctagaattaaacaaaacttttttgaggagtaaatttctactgtgttttctaattcctatgttctctctttggttctctttcaacagatatgactccacgtagcatgtcaaggactacattaatcaccaattcctttatttttccccccctacagtttccattttttttttatacttgcttactccagccatctgcagtacaccagtttcaggtcttttgagctgtgtagagtttctgtgtgtacagatgtgtgctcggacttttctctttttgagaaatctgaaggagatggttgcagaagatccacttactactgagaaccattaccaccgactcggcctccggggtgttgggtggtttctgggtggttcctggagcctcctctgggcagtgcactgtcccatctgtacgccctaatgtgccattccctagaggggaacaaccaagtgccgtggaggcagatgatcatggtctgcctcaactgtctggtttcctgtaaaataaacacattgttttatatttttagggaacaaaaagtgctgctatagggttcaaagttttccttctgaacacttttccgaaacaaattaccccaaagacacattttgaatatcctggtcacatctttggatctgtaaaatataccttttagtatggcacctgttaaaatgcaaagcaaatttctttggggcagaaaaacaatctgacagtagcagtgtagaatttgttcattcaaatacatctgtgtaaatgcaaaaagtcataaaattcacctccgagctgcttgcttttgaacctgcagcaactagtcttagccggcccggtttgaacatcgttctttcagaagtgctgaaaatgctgcaaagtt

SEQ ID NO: 12200 - DNA, 1161 bp, Homo sapiens
tttctctaaccattttcagcttgagtgggtattgctgaagaaatccaacatcattccagcagttgaaaaaggaagccttcgggagaaagtgcttgtcaaaattttgttctttgtgcttgtgtatgagtaagttgccatgaataagttattattttaacccataattggcgactgtttatatgaattctttctttggcaccaaataggtttcatcttcttaggcacaattagaaaaaatccacatagatggatattttacatttagttattgctttatccaaatacatgaatctaaagctgaatcaacccttacttccagttgtgcttattaagaagatcaatttccaagtagtaaagttttcagggaaactgactgtgctgctatttgttttgacaaatttgggggtaagtcaatgacaaccaaaccaatctcggtggaaactcctatcctatcatgttgtgtgcccaagatgagtgagctggcactgtgccctgaagctttcaccactgtaatgaaatatatgccaggggagactttgggcttttctcatgactgtgtgggtcgaaggtagctcaagtgtgtgtgtgtgtgtgtgtgtgtgtgtgtgtgtgtgtgtgtgtgtatgtgtgtaaagtgctaagaactgtgcattgacatccaaacatttcttgtacaaaatttccctagcaaagcaaacctgctttgacttaatttatttgttaaatgttgcactttgtttatgtatgttttgtttttggtggggaataaggagagagaggacgacaaattctattgaagtatttattttgtgaagatggcaattttgcatttgtttaaatttttttcattctttaattttgttatcagtgccagcccaatatacctgctctaccattatttgcggtctgataaaagggtccttgtggggcaggttttgcaaagcttatcaggtaataacatatgccacataaccttgttgatatgtttgcttctgatttgggaagctaaacattggtgtttgagaggattgccaattattaattgtcattaccactactctccattactttttgtttggaaattgaacaaaggtcagtaatggtttttggctcttgttaatatccatcataaaatagattgttttagattctttccagggt

SEQ ID NO: 12201 - DNA, 1191 bp, Homo sapiens
atgtagcatctagtgactttttaaagccctaacgtttacataaagaagctctagttcttatagaaataacaaagcaaataaaagttcttaacaatcccctctttcgaagtgcatttttttaaagcagggcaggagacatttggactctagctatatgacatactgggaaaggcagagggtggagggaagatttcacttcattgtctagcccagaatcttgagcaagctaaagaaaccatcataatctaaaattgcttcatttaacactaacaatttagactttttaaaccaagcattgaataatggctggataactgccgaagtaagcgccgctccatgaagtctgcttacttatttaaaaattgtgtatcagttttaaatactgttcattgtgtgcagatataaggggaatagggcattctgtagaattatacatgtctagtttgtaaagtgtgtcctgtgtactgcagatgtgtgttctctgggctttatgtatctgtacagtagctttcacattaaaaaaattgtggacaaacttgtccggggggtttgaggggagaatggtggtttatatcaataacgatgctgtactatagtccatgtaacaaaagatctggaagtcaccctcctctggcccacggaaaattttggtaatcttctaggttctaaaatgaagatgtatgggtactctggcagactgcatgttgtataatttgaaaaatactaaaagtggaaaataaaattgaattaaactttggctggtctgtttctccttatttgagccaccctgaaggtatggtcattggagatgtcagtgcctgtgtgaggatgagccattttctggcctcaaaagagttcacttcaagtgagcaggtgccccaatacacagcataagcaaagtcaaccttgaccatttttgcttttactttgcttaaatatctgctctaatttttttttcatttcagaactaagaaaacttgacatttgtcacttcaattctgaaaagatagcagctgttgtaaaaaaaaaagtgtcttattagcttttttaaaaagtaggattgactgaaagctcaatagagcagtgtattcactgaatatctgaatttcttcttgcctgagaacggcattaattctccaccaaatgaattggagccctgtttgcatatgttgaaagattatcagcatcttt

SEQ ID NO: 12202 - DNA, 1245 bp, Homo sapiens
aggagggagcgcgccgcacgcgtgagtaaacagccggagctgggaaagtcgagctctggcagcgtctgggtgctgaggggcagaggcggagagaaccctgtcctgatcttcctaggtgggataaatatcggggtgacagtggtaggccgcggggaaccctcagtctgcccaccctccgccccctcgcggcgagatgcctcgttccccgggcttctcccgccctccgccgatctcctccctctgttgaaagctgcccgggaaagtggtggcgggagcgggcccaggcccgaatgtggcgtgggctcaggtgtctggtgtcgggcgccggaggaggttcgcgctggggtttggtgattcggaggcctggggtgcagacgcggcgtggctgtgaggcccgggcgggcgtgcgggtgtgagggccggactcacactgggccgccgcggggctgtttccatcggtcactggattttctcctcttccggttcgggcctcagggtggccgacatgacggccaggggtcagagccccctcgcgccgctgttggagactttggaagacccttctgcctcccatggagggcagactgacgcttacctgactctgaccaggtgaggtccgccacggggcgtagcggagagtggggcgctctatagtggggagaaagaaggtggttgggaggggcgcgtagaatgaatgtgagttctagaagtctagcaaatgtgaggacgcccgagtcgcggacgccttggggggcgggggagatgtattctaggtgacgttcccgggtactgctgctgctgcgcttgaggtgtgtgtttggaacgagggagcatgcacgtgtgttttgcaagcgagggatttttaaaagtttcggttggaagtagttgttggaggaggggtcttcagtgtaaacctccgatgtgttgggaaaatgtggctacccagagtttttttaacagagcaatacactgatttttattaattgcaaaatgcttcaaagtaattttcatagaaatgtactaaagttttgtaaaaccctttggaaaggcttagcaaatcgttagtaactaggaatagggatccctgttctgtctttttggagtcaggttgtcacaacttgcatgtactcgatgtaaaaacttattctgagggtttttctactttcatttctgatatatattgcattatatattctgtatacccttaaggaccttacctactgggtcaattcatttgcaggagtt

SEQ ID NO: 12203 - DNA, 1341 bp, Homo sapiens
agttagatgatttccattgtaaaggaaacccttatctttagagaagggaagttaggaataaagatgtcaaagttgttaccatctgtttttgagggaaaagctgctgcctgctcttttttatacatggaagtgttagcaacctaaagcaggagttgttcattttggagcagagatgcaggattgaaaacatcttaccaaaaattgtcttgtatgttcaaacctacagtgatatctagttatttcagttgcacaagatatctgatttggtgtctgttgttttattttctctcagtatatcctcccctctaatctgaattttgtgtttttgggagaagtttggtatcagcattggttctctgatctgttctctggatatacatttaattttatgattgatgagtatattgttttctctagttttatatttgagactttaaagagtatcacctattctatacaaaattaaaactgcttgtttttcagaggcaaatgctctagaattgctttcaaaattgaatgataccattaagaattcagacaaaaatgtacgtactagagcactttgggtgatatctaagcagacatttccctctgaagtggttggcaaaatggtgagtatagtttttgggtatgccatcttaactatatgccaattaaaagaaaaaactataatgccaataaaaacagttcaggcttatttcatttgtatttatttggttcgttttttaggtatccagtataattgattcattagaaatactgtttaacaaaggagagacgcattctgctgttgttgattttgaagcattaaatgttatcgtaaggtatgcatttggatgttgtgcaaattgaagaatagttttcataaatttagctgaaggagagggtttttgggatttaaatgagagacagacattaaaaggggggaatgtcatttacaccaaacgactcaaggacaaaaagtaatagaaaaaagatggaagtagatatgtgtgggttactaggttttttgtttatttttactgggaccatgttcaaggtgaagtcttggttatgttcctgctagtaacatacacagttcaggtttgaaaaatatcttaaagtttgtgtaaggatttaaaaaataatgtaaactcataagtgggcttgggttgtttaggaaggcagtcagtgtttagcagggaatagagtaccttcttcatttttgttgtaacaggcatgccaacgcataaactcttttaagtgtaaactctttgatgacatttctgtcttccctgttttttgttctttaaaattttcttgttgagttacttgctttaacttccccactgttgaatgctc

SEQ ID NO: 12204 - DNA, 1161 bp, Homo sapiens
gggatcaatgtactatagatgagcaaaaaaatggtccgtcattcttagtggaaattttttgtttttaaaactaactttcaaaatttaaatttggaacctatcttatgtaatttggtactttcttgcatattagttgttgaaattttatgaaatgtaaaattaaagtttgagatgcattttataattcctaagaaaaaatgaacttgtttttctggaattcatattcatgatccgccaagtagttttcgtctcccattctcatttgtaaagataatgttctagtgatacttatccattaatggtacattatgttatgatttgtttggggtgtcagtcagcaaacggacatgtatttgatgtatctaacatttaaatgtgagctataaattgtaaaagtggacagtgactcctattttcaatttatttgagtttttaattaattcagtttttgtttttagcaccacagagaccttcagattggtccaaaaagaagaatgagcccctagggaaattgacttctttatttaaacttattgtgaaagtgatctattctttccacacactgagcttcaaggaagcacattctgataccctcttcactattggcaactcaatcaccggcattatttccagtgtacttgggcatatttctttgccttctatgatccgaaaaatatttgcaactttaacaagacctctggcattattttatgaaaactcaaagtaagtattttggactaagtagctttgaattaaatgtatacaatttaaatataggtagcaacttttattttttaatcagctgtgttgtagatggtagtcttgacaattttgtggagaggataataaactacacttttgttgaaaagatagttaaaatagtatagaaatatgagagagaaattggaagtctattttgcctgttacttccctttccctttgcttttcaatgcttaccttttcagaattgtttatgcaaacaagcatacctattaaatgcatgatagataggaaagcttacttggcatgctgttttgcaattaattatatggtatgcacttaatacagttggctgtttgtatccatgggttctgcattcatggattcaaccaaccctggatcgaaactatttagaaaaattaataaaatgaatgcaaataa

SEQ ID NO: 12205 - DNA, 1116 bp, Homo sapiens
gttttgccatgttgctcaggctcgtctcaaattcctgagctcaagcagtctgcccgctttggcttcccaaagtgctgggattacaggcgtgaaccactgagcccagcctagttaatcaactcttagctcatccctttgtatatgatggcgattggacccaaagttttctaggtgaacgtatgtaggtaactatttatcttgttataattattacaaaaacataatttcttttgttaatagaaaataagttcaaaattgaactgtaatattaataaccaaagcaaattcacctgataatttgtcgagttataaagagggatatatatttaaggcaacagtgggggttagtttaaaattgtcttaattttaaaaattgaaatagcaacatatattctgtgagttaatatttagtatatgttttgcttttattttttcgtttttcctagttagaaaagctactgggagaaattattgcttgtctgcaattcagctacaccggaacttatgatagtgaacttcttgaacaactctccccactattatgcataatatttctgcacaagaataaacagattcgaaaacagagtgctcagttctggaatgccacttttgccaaagtgatgatgttggtttatcctgaagagttaaagtatgctaacaacaaaacttatatacaactaactattctgttgtgatcatataaattgatactttgattcaaataatcttttcttatggggtattgttacagaggattccttagttgaaatattaccatttggaatacatgataattattaaacattatttcaccttttcattggtgcttagaataatcttgatttcaggagccaagaaaagcagtttaaattatccttaataaaagagacaaggaggacaggaaatagatgattttttttttttttttttttttttgagatagagtctcactctgtcgcccaggctggagtgcagtggtgcgatctgggctcactgcaagctctgcctcccgggttcaagcgattctcctgcctcagcctcctgagtagctgggactgaaggtgcgtgccaccatgcctggctaattttttgtatttttagtagagacaaggtttc

SEQ ID NO: 12206 - DNA, 1102 bp, Homo sapiens
tactaatatttatttcagggaaattcctactttaaccagaaaaccaaaggaggattctaagatgatgattacggtatgtttgacatttcatattttgggctttttagaatcacccttccattatacagtctgttaaactgctgaaatgtctgtaggtcttccctttattaattttaaaatttattgtagatttattgtatgatttccttttaactcccattcagatactagcagaatatcagcagacactagtcagtgtgtgtgtgtgtgtgtgtataaaataaatgtacttggcttttcttgaatatttacaattaggaacacaaactgttaggtatctaccactaactttggaatagttgccatatattgaatgtcagtgattatctttgggttaccgaagttttacactaaagttttcccagaaagtcaaactcgtttgctggttattaatctgtgtgtgtatatatatgtatatatttctgtgcaggaggagcaaatggacagtgacattgtcattcctcaagatgtcacggaagactgtggtatggctgaacatcttgaaaagtcctccctttcgaataatgagtgtggttctcttgacaaaaccagtccagaaatgtcaaacagtaataatgatgaaagaaaaaaagctttaatttcatcaaggaaaacatcaactgaatgtgcatctagtacagaaaattctttcgttgtcagcagtagttcagtttctaataccactgttgctggaactcccccataccctacaagtcggaggcaaacctttattactttggagaagtttgatggttcagaaaatagaccttttagtccatcccccttgaataatatttcatcaactgttacagtgaaaaataaccaggaaaccatgattaaaacagattttctaccaaaagcaaagcaaagagaagggactttttcaaaatctgattctgaaaaaatagtgaatggaactaagagatcaagccggagagctggtaaagctgaacaaacagggaataaaaggtctaagcccttaatgagatctgagccggagaaaaatactgaggaatctgttgaaggcattgtagtcttagaa

SEQ ID NO: 12207 - DNA, 4122 bp, Homo sapiens
gctggattcagaagatcttcataattattcaggaagccaactatttgaaatgcacgagaaactaagttgtatggcaaactctgtaataaaaaatctacagtcacgttggagatcaccatcccatgaaaattctatttagtattttcagagaaaattgaaggtttttttaaacatcactggatttcttgattgaggaaacaagttctgaaataatagcacaatttcaaagaagagactctttgcaaagttgataacatttcaaaccctgaaggacagtgacttattatgtaagttcaattttgtaagttcattatgtaagatccttttttttttcataatatgtattcttggctgctatgcgtggtttttcaggaaatttaattatcttactgagatgtgaaagcaaaactagtaacagaacttacattttatttcatgctttcttaaacccgtgcatattctggtgaaacatgtaaaatactttaagtaaaattgaacatttttatttgaatttttgctgaactgataaaggtgtttatatttttgtttgttggtttgtttaattcatgtttgttgggactgaggtttaggaagtttgttactggttaaaaacctcaaatgaaatgcgaaagaatttgaatttttcctgcatatgtcaactttggacagctttcaagaaaaatgagaaaagtttcaacttctggcggttaaaatattaatgcagaatttactaagattttattcatttgcattagcaaatattcatgcagcagcagttgactgaaaatttattcttatgagacgtatagtattcatttttaaatgcatgattgtacattatgtatagacgacaatgtttttaatttataaatttcattctttgttaattgcatgggtttttctgcagcttattgtgaataccttggttctgttcaatagaaacattttgtatatattaaatactgaaatatcagtatcgacggtggaagtgcttcatgggcttgctgcacatatttgtaggatactgtatctgcaaatgcaacaacaaatagttttgtacttggttaacagtcttagttaaaacatgagtttattttctaaaagtatccagaataagtaaaattatagaaataagaaaatgttacacaactttgctgttcatacccttaccttcttactacttttggtttggaggagggtatcaccactagaaagtgtgcctccttaagatttcttaaaggaaagttagtttcagtatttcacagcaagttggactacaaaatctagagttgatctgctttttaaaccttcatttaaaagcaaacttggaagaaatttgaaactgatgtttttaatatatgtctgtgttgcctaggttttctttttttaaagaggtatgtaattaaaacctttgtaaaatttgccaactaatattagtgcctgacttcccatatttgtttcatctttttaactgacagtatatctcacttcttctttgaatagaatgagtgagtgatctcagttttcacattttattcagaagctaatccctacttagcaaggcacacattctacagcaagtcatagaaagtttaatccttgtgcctccttagctctcgtatattcagggatctctataaaagttggtgtcttttttcatcatcataaattcatcataatcacagatatttttgggtctaagatattcatataccaaggatggttttgtaaagaattctgggatcattgaattaaggattgtggcttgaagtaactaaagaaaaatactaatttccttaaaaggaattataattatgatttacattttacatcattaatttcccaaattatatttaaccgtaaggaggtgcacatgagtttttagcaaacaggtatgaataagcagctatgtatatgtgtttggggcagaggggagcagattactttaacacacttcagaattaaaatcagttcgtttcatgactctgtgccttaacgtttgtgtgaactaaacttgctgattgaatgaaattcttgggaagccgaacagtaatagcagaaaatgtgaccaaatgagtatcatgtacttaaatcactgaattttatataagcacaagtattaattttaaaaacattatagtttaataaagctgcatttaaaaatatttgggagcaaagacaagcatgctaaatcttcattttgctatggctataagcatatatttttggcaacttatttgcaatattcttgccttaaagtttcctgcaaatttcccccttagtaattcccgaatagcaaaacattaatattccatgattagctctactgtgttgtctcactattaaaatggaattcgttttttcagatcttttctaatggttaataaaacaaatgtcagatcataataacactcaaatgtgtcttaattgtcttatgcatatttaagaagaaaaaactagtggcatacaggattgtcatgtagtatctttttttttttttgagacacagtcttgctctgttgcctatgctggagtgcaatggtgcgatctcggttcactgcaagctctgcctcccaggtttacaccattctcctgcctcagcctcccaagtagctgggactacaggtgcccgccaccatgcccggctaattttttatatttttagtagagaaggggttcactgtgttagccaggatggtcttgatctgacctcgtgatccgcctgcctcggcctcccaaagtgctgggattacaggcgtgagccaccccacctggccattttcttttttttttgaggtggagttttcgcccttgctgcccaggctggagtgcagtggtacgatctcagctcactgcaacctccacctcctgggttcaagcgattctcctgcctcagcctcccaaatagctgggattacaggtgcctgccaccaccactggttaatttttgtatttttagtagatacggggtttcaccatgtcagccaggctggtctcaaacttctgacctcagatatccacctgcctcagcctcctaaaatggtggcattacaggcgtgagccaccgctcctggcccatcatttccatatctatgaaatctattttggattttagagtggatttaaattttcaatatttcagtgacctcattgttaaagctgctttgccacttgtacaagtttgaaaaccattgttgaatcatatggagctttactctaattccaaatagttaaaggatgaatcaggttaaataatgctgttggataatacaggcaaaaacaggatttaaacccgcacattaaaagcatgactgaaggcccggcaggtggatcactttggcccaggagttcaaaactgacctgaacaatgtggcgaaatcctgtctctactaaaaatacaaaaaccagccaggcatgttggcgcatacttgtaatctcagctactcaggaggctgagacatgagaattgcttgaaccttttaggcggaggttgcagtgagccgagatcatgccattgcgcgacagagcaagtctctgtctcgcaaaaaaaaaaaaaaagtttaattctaacattgcccatggatttttttttttctgtacagcttgaagataagatagttaaagactctgttacaatttaaacatcataaaaatgtgaagagtaagtggtgaggcaagaaacaaaattgggggaaatggtggggatcgtgaatatataagtgaagttttatttttttaaggtgtaaaggagtgagaatagagtaattgctttttaaaaagaaagtataaatgggttaatttttttcttccaactttgactttaattcagtaagaaaggcctaggtttcatctcatattcttcataattgattttcaagaagttaatttgtcattcagcctaggaggctataaaacagcagttagttggcattattagactaaaacttgggtggggggaggagactgtttcctcattgctgcaacccatggtctatcctattcctaagccattagaaagaccttgtactttgtatagaaacattagagtgaggttttgatttttaacatagtactctcaaactttgatgtgcatatgaacaagtggattctgattcagtagat

SEQ ID NO: 12208 - DNA, 1785 bp, Homo sapiens
atgaataagtcagtctagcagatatgccctgtcattatactgcggacctctggtcacttaattttctgttatattatgtggttgaaaattcctgtttcatcgtaaagtgaaatttgaaagatggagttgaataatatgattctcgaaaagtgagtttttcttggaattctgttaaggtgttagattttcctcacatatttaaataatctgtaagaactaccctgaaagcactaaggaaaatgtagccgaaagttaagtaataggttttaaaaatttatcaaaatttattgatagtttgatctgtaaaacaaattgggtttcgtgctttctgatgtccagttaataagtatattatgtgccaggctttacatattgctctttgcaagtagccgttaaagtgtaagtcattgaagtttgaagatctataaatatttaatatagtagtctaaacagttgtgagaatttactcagttctgaaatagaatgttaaattttccgatgtggtcctaatcatttttttctttacatactaagccttcctttctccaaagaacagttaaaaccaaatgtgttatggtaagctgtaaataccgttggaataaaagataaccgttcatcttacctaaaaaattgaagacaatattttccattgttgatgtcacaagtaagaaaaaaactctaacttttgtactctacttgtagcagagggaatatttttggccacagtgtgccaatttataattgtagataaagctgaatttactgggcagcaagcttatatgctgatagaagttgatgcactgagaagtgatgagttgaagagaatggaaaaggcagattgagctggaattttaatgcatagtacatttagtagagagacaagctgtcctatatactcctgtatacttcagaaatagctgatagcctatagtctctgagagctattctgtacatagcacagtattataattgatgttcataaataccctgagagattatgttaaaatacattattaatactcccacaaaagcagtaagttaataagtatttccaacaaaaggcagctttgtttcttaaacggataaacaacatataactaggaagatcatcttcaaaataaagtgtcatggaactgaaaatagagtatagtctaacaattattttgatacactattgaatagctaacaagtgtctaaagaattttttatttttatagaataggaagtttctaaaagaaaacaattaagagcaaaattggttttgagtatagaaactgaaggatggcagtcttaactcctaagttttttacagagcacagattggtaaactagcatgccacctgttttttgtactatctgtgagctgagactggtttttacattttttaatggtgaaaaaagtcaaaagaaggacattttgtgacacatgaaaacatattaaattaaaatttcagtatccagaaataaagttttattggaacagctgtgcttattgtctttagctgctttcctggtacagtggctgagtttagtagtatagcagagtctgtatggcttccaacagtcaaaatactgcctggccttttaaagagtttgtcaatcccttttatggaggaaggttttgctcatgcatggcatgttagtcaatttagttatttgcttctagctggcagaatgtggtcttgattacttaatttctgttacccctgtgttttccagaatggcttctcctgattttacttacgtgttttactattgctcaaattacagatactaggaaacact

SEQ ID NO: 12209 - DNA, 1198 bp, Homo sapiens
acctgactgatagcacttacaaaaagactgatagatgccaaatcagtcatttattaaccctctaatattgttgtcccgatcatttggtaaacgctaagagagcttagttttacattcacaaagtatttgtatttgataagtcttaaaaatgatttaagttgaagcctaacagaagtacttgttcattcctcagttacctgcaaataatggaaataatggtgcagtcagttttatttgattgtgtaatgctttatactaggggtctcaaacccctgggtggcattagattcttacaggagcgtgaaccctattgtgaactgcacatgcaagagatctaggttgtgcgctcattatgagaatctaatacccgatgatctgaggtggaacagtctcatcctgaaaccatctaccccaacacctgtgtctgtggaaattgtctccacgaaaccggtccctgttgaaaaaaggttaggggaccactgctttatacagtgtttgaagtaggcacacttacagttactatttctggttctttatgactgttgagggggggcagaattctatgtttgattcacagtaaaacttttcatgaatcattgagggttaactgttatcacttgccaatggaaactggatattgaaacatttttttaagaaatgcacttttacctgaaataaaactataaaaactaaactctggtacttgtttttgttggctacattttggttttttgttttgttgttttcgtgagatctgaaatgagtatgaatagtttaattcaaataccacaaagtgtatgttatattcctccacaaacatgaacccttccttttctttttccccttttatggcctgctttttaaccacagaggttttctgatttatgcatagttttatgggttccactggtttctaaatccagaggtggtggtttttctgttgttgttgttgttaatgagttcagtttctcattgaacttgttagaagagaggtttcgtcaaataagggctgagtagatgcaggcaagcttggagaggcagtccacatggtgtgggcgagggcagaggtggcactgccaggctagtcaccagatgaagtaaatgcctcaccccaacatgaccttaacttcctctgcagaaccaagcatgttgatggcagccgaagaaaagctccatagttttaaggaaaacaacaaca

SEQ ID NO: 12210 - DNA, 2281 bp, Homo sapiens
gggttatagtggggaagtggataggggattcattttcttatgtgacattttgccttaagaatataaaagtgctttagcactgatggctggcatttttaatataggcagtgaaagtgactttagaagcatgggatgaaatagagggaagaagagtttttattttctggcctttaaaaagtgcctagtaggtcatttgagacccagagaaatgcacagagcttgagcaaaggcatgaagtccctgacattgttttcctttttgtctcagcatatagtattaagatgcctagaaataggactctattgttccctcttgtataggcactttacatttcttgtcactacagcaaccacatacagtacagacaacctccaaacctgtttatattagtgtaaatagaaaatctatagacaactttctagttttctctggaggcatttttgggaatgtacgtgtaataggctctgctttgtatacaggagataataccacatcatcggttatctccaaactccagtcttctctcaactgcccagttgtatgttgtcatcaatcactttttcaaggctgggtagagacaagtttctcctcgtaactttgacctctcccactctccaaatgtaatctggacctcattgctttcaaggtcagcttccccatagctcaggtatcctttgctctcctgtatcttcatttactattagtgaagagatctctgtcctggaggttattctaaactttctttgtaactattgttatagacaatggtttccaaaccagtggtttctatgtagcttttctagttccttgctatcttctcaccactggcttgaggtagtgatttggactttgctcattagagagcattatcagagatgtggagtccatcagaagaccagcttgcagtgtgtatagcatatagatgccaatattagaattctttaaattatatttaacattttcatgcttcttaatttaacttcacatgttgggaagtagattcagaaagataggagaaatacccagactctaccacttccgtgagctactagttaggcatgggcaggattaagttttatgtgtattatcttcccactaccaagaatggttatgtttcacagaataccagttcagtttgatttggaaaaagatgccaaaccaaatttatatgtagtctataatctaagggcattcttgaaactattgcccacatcccattttttttttcatgtttacttacaaaacagagataaacattagatgtctaaaggagttagtaatgaaaagcctatccttaaaaaataaacctgttgaaatgggctttaaagacatcgaaataatcacttgtcatgcattgactgtaaatgcagatagagaaatatgtctttgaagctccacttacacaaaaataaaacttgtatatcatgctccctcaaagaatgtgcgatagattattttaagaccatgataatagagtaaaaaggaaagaaagccagaaattacaattttggatgctaaaaagtaactttctagttaaccctaaagtcctgtcagattgtgaagaaatgttccaggatacacttggattagttatgcagtatttcttatcaatgtctagcccttgtgtattgttctgaaaactaaagtttaaatctttatgctgttgcttgctagatatcctgttctttggtagaaaattcccatagtctgtactcaagaagtgcctaaaaatggatttgtgttgattttaagcccatctaataaattatatgtattttctatggtatcgtatggcttgtcttaactgatgacacagcctagaggatttctgtcacaatttgtgctttatttgaatacaaagtcttttttttttttttttttttttttttagacagagtctcactttgtcgtccaggctggagtgcagtggcgcgatctcggctcactgcaacctctgcctcctgggttcacgccggttgtcctgcctcagcctcacaagtagctgggactgcaggcgcctgccactacgcccggctaatgttttgtatttttagtagagatggggtttcaccgtgttagccaggatggtctcaatctcctgacctcgtaatctgcccgcctcaacctcctaaagtggtgggattacaggtgtgagccaccgcgcctggcctaaataaaaagtcttgaaatggaagatattcacctaaccctcaacaaaccatgatgtaatgaagcacgaatcacaccattttgtctctttcctaattcaaataggtccctg

SEQ ID NO: 12211 - DNA, 2245 bp, Homo sapiens
tcctctcaggacattgtgtagcctatggtaagtacaaagggagaggaagacattttgaattttaagagctttattatcagtttaaccctccctagttgaatgttattttcttcttgttccattaagtcagaatacaaatcagcacagatattcgaatgtttccaatattttaaaatgtaatgttacttatgaaaagtattttgcttaaggttgtgtgtgtattgtgtatatacctcaagttcaagttaatggcattgatttatgttccagacaaaaataacacaaataataatatccttcgttataaccacaatgagataagtattggcattagtgttcagtgccattttatactttctctctgtgttctctgtattgtactaaccaacctcccaaatcgctgagctgcttgtttaaaaaaaaaaaaaaggaaaaggaaaaagcatgacattgtgtatcgattttttgttgttgaccaaaatcacacacatggaaacatgtaattcaacagagtgggaaagctagcagattcttggcttagtattactaataggcaggattgtacaatgagcaactatcagattattcctttcagtggttcttatggcatctaaattactgaataaattattaatccattaatcagtgaatcaaattatgattacaattatcaaatgaatgctcagcattaattgaaaactgttttgtgaaacatgtctacccagaaaagtagcattctataaatactattaaacaacttagctatattatttttaagtattaaattatatgtcaagcagttaaagtgaatttcagagtaaaagtaaggcatgtttctgagcaacattgataatttcttaatttgcaaatttcttcttattttggtacttggaatatagtgtgagattttttatttctaaattttgttgtatcttctattacataaatgcattgacaattataaaatgcaagtgttttttgaatgattttaagaatttggcttaaaaattgattgatacaacgtattatttgtactaagaagtaacttgacccaaaacaccttttatgtttgcttagggtatattttttcagtgtctgaaagtcaaaggtattcctgtcacaactgtaaacaaacttatcctaaatgtgttaaaacatattcttgggtactctatttatgtatctttcatgccttgaaaatctgaaggttaatccaaactcacatgttttagcatatttgagaaaaaaaaactaccttcaatatcagccttttaaatttcatgaagattttggtgaggaataatagtatatagtttaagtattgacaaaactttgaaagtttctttctttaaaatgggaaatactcaatatctaaatccaggtcaggcatgggatatcagtatttaacattggatgttttatgttttatatttataatgttcaaaatgcaagcataacatttaatatttgtccacatggttttacaaaagtaaatcttaaattactaagcttttcccatatgttctcgtactttctcaaatccctataaagaattacttgttatctattaaaaatctcctttacccaaatctgtattatggtttcgccagacaaatattatgtgatgtagcccagaaaatccacaccttttgtcctttttatgttttaatttgaataatcatgtgcttagtcccttggattactgccacatcagtttaacacgatatcagcacattcccttgtcatcatcaaggtgttggctcagatttattcttaattggatgtttaaagcatgtactaccttgttacagttggtttagtgtagtggattattgacatgacatcatgagaagatgtgtaattttataccacatttataaaacatgattttgttttctacccttcaaggtaaacattaaaaataaggtggtacttgtgtacttgtacataaaaccaaaattatagttgggaaaaaaataaatttatatatgaaaatgtcaaaatcattttaaaagtattattttcaaataaaatggagaagctggtgaaaagtcatattggcaatttttatgtagtttaagtggaattaagcagagggagatgcttttgggtttttaatatgccacttctgagtgaaaacatctcgtggagtcattgtgttcagctctgagaagaacaaagattcatagttctgtacatgtggctggatttaaatatcctgtttttgatactaattttgaaagtc

SEQ ID NO: 12212 - DNA, 1194 bp, Homo sapiens
cataaaaggttttttttttttttttttttcagtccagtttgtttgaagtcaatcttttcatcagaggcagcttaaagatgctttcagttagttttgtcttactttcagatttctctacataaatctagatactcattaagtagccttatgacaaacagtatgagatacttatgacaaactcgctctgtcacccaggctggagtgcagtagcatgatcgacagagtgagtttgtcaaaagtatctcatacttataaacagtatgagataggaggattaaaatattattttaaagaaaccactgtttccccctaaaatgtcataagagcactgaagaacttgaaatatttttttcagagtttctcacacactttaaaagtctaacttttttgtgtgtaagcatttagcttgccagcatatttctttttggctccttaaattgcggttgtgtttgcagtattgtcacttttgctctcactgttatgttgaataataattagcatataattgtctacagaagcaagagcaatctggaaggaacaaaaatgttttctgtgattaacagtgaagaccttgtaaatgcagatgtgtgataaagcatttagtcagtcccccaaacagtcatgccaactgtgaaggaatgtcccacaaaacatttccattccctgaggaaaaacattttctttcctacatgtatctctggtatttagaattgtcactaataaccttttcaagtgattttggctattctctaatgaagatatggtccatttgtttttcttcctgcaatgtggtgtgcagagatgctgcatatcctttttatgggattgcgtgtgaatttgaaccatgagacattcctaataatttgttgtgagatataccaagcatggatgataagtgtgtttttagtggtgtgttgtttttttaaagaggtgattcaagtaccgttgctaagctgtcaacataccaagctgttgaaaaaattgaccatttctttcagaagtaattctcagcctgtggaataatagcaggtgaagacttcatagaaggcgacagattgatagggaggctattgaagcagtttttctgaagcctgcattttgagttagtttatagtgctaatagattctatataactgtgagagtttggtagtaaaccagtagggattgttttctctcctaaaaatttgcacact

SEQ ID NO: 12213 - DNA, 1171 bp, Homo sapiens
aaaagtacacttgccaacacactaggagaaaatgctcagtgaaaattgatgggtaggaataaattagtataagcctaacatattgacttgttaaagcaaaatgaagacagctgtaagatcttttcccccttccatcataccaatgttagtgacttatatattagcaagccttataaaataaaatacaaataatatatcactatttaatttttgctgctcattgttccattattcttttgccagacccattatttgtcattctgtattcttaaagctaacactgagcccatagaaattccattatatttcctttccagttttctttgtttacaaagactttccatactaaggtgcagatgtcttgtaggaacagcaagttatacatgttcgtttatacatgtgaatgtgaatttttcagtcttcaatggcatttctcttttgttttagttttgactttgaaagtgtggagagtactgtggagagctcggtggacaaatcaaagccctggagtaggtccatcgaggacctgcacagagggagcaacctgccctcacctgtgggcaacagtgtctcccgctctggaagacattctgcactgcggtgagttcgtttaatcaggaggcaactttggcaggatgcactgggacagcaggctcctacttcttttgatgattctgggcactgtatctcataaattgccatacagcactttcatttgcaatgactctaaatgaatgtttctttaggagttcatgggatcttcccttgggcaatgtttgataactttaaatagcttctggaaacaccataccttgattcagcatagaaggtgggaaaattctgctgccaagtgatagaacaggatagtctcataggcagataaggttttgaaaccaggggaatgttgacatcctgatggaggtactgtttccagggtagaggcagcacttagagatctgggatctctgccctttgttaccctttgtccttccgctctctttcatttctccagtggtagctcaggttgtgtgctgtgggtgttttcttagccataggtacagaatgctgtagtgataatttttattagtgagatgccattaaccagtgttcctttgattagatatgcttcacttgtcaacctttttttttttttttgagatggaatctcgct

SEQ ID NO: 12214 - DNA, 1252 bp, Homo sapiens
ttggattcttttttcaaaggctcagcccgtaaacctctgagtactgatgtcaactataattgtaatcaatgtcttttcagggtaattgggatacttctggcagcgaactgagtgaaggggaattggaaaagcgcagaagaacccttttggagcaactggatgatgatcaataaattataccaaatatatgtttacagtatgatttaaagtctgattcagaccagggactctattttaagttcaactgaaataacactgggttttaattatatcacaggaaaaaaaaagtgcatttaagtattgttatcgtggactttataaaagcaaaggaaattgaaagtaacttttgattctgtatcaagaatcatattttcatacagtcataactgtctttctgtgaccctttcacagggcactgtaggatggattaaaggtggcaatttactgataactgcagatgtctctactttgttctaaaatctaagtcatgaggtgatttgatttactttatagaagctggattttgaagatctaatgaaaaattttttgataatatagtagtacaaaaaaagcaccagcaactgataaaaattgcttttttgtgcgctacccaactggttaaagccaatgtgatcttttatggtgaaactcctaagaaacaggtggttttgctggaaacttggtagacccttaattatagtggtgctaatgagcactactgtaatataaagccaccattattttttatcaaacatctgaatacattttacaaaggctattgtgagggcattattttgagcatctattttgaggtgatgtttaaaaaaactttaacatcaaatcaaattgtaaattaatttaaatatattgccttaaggacctactaaagaatgtgccaccagactttaagtgatagttgcaatatccttgtctaaaaaaaaaaaaaaagttgacttaaacattttctttaacagttgtcttttttttctaaattcagtctttctcttgcttttttttccctgctattgaggaagtattttgccttccctactcactgagaagtattgacttcgtggtacacattctaaagcatttctgatttgaatatttttgtacatttttatcaattattaaaccttctcttctagtgtgtactagtatttatttctacttaaactgctcagctctaaagaaattgtatgatcactttaaaggtactaaatccctgaaattttgcttcatcttacccaca

SEQ ID NO: 12215 - DNA, 1473 bp, Homo sapiens
cgaagttgtcaagtacagtaacattaaaaaaaagggtagacaaatataggtcatggtttgtctttgttcaatccctgagattcctttttaagattttaaatggaattaaagatccaatatttgaagttgctaaaaaaaaaaaaaaaagtgccttgagcacattaaaggacaaaaaatgatgcattaagatttgcttttagaggcagggtgatttactagatggatgtagtttttgtggcagtgttgaaatacctgcctcttcccctcttttggaaacgtttaaaaattagactcttcttatctgagctgtagtacttgttaaggtttttgatggagcacttaattacctctgtctgctgcaattctaacgattatgatgccatgaagaagagagtaagttggcctgcgttctgaatctgttgcatattttctctttaagctgatgagtgctattcaaaaaggaagggtatctggaagccggcttgctatactaatgaaaactgcagaagagaacctcgacagaagagttccaattccagtggaccgtagttgtggaggattgtgagtctgggcagtaaatccacagccaacaaacatagaaacgacaaatcaccatgtaacaaccagagatgactgaaaccactctgaaataatgaatgtggatagctgccttttttaacactagaaaacattccaaaactttaaggtgttggtgtatttgccagctttatttgctgtactttatttgtatttgccattcagtctagcttttaagtatatttttttctttttctcattttcaatgcacattagttttgcatctgttttgtgacctgttagatgtgacacattctctttttgtttattcccttattctaaatgagttctaaaaacataatattttggcaaaaattgaaaaaagctggagacattttgtgacatgcatacagatagcatgtgttattaaaaagagttgcctattgaaatgatcatgtttctggagaaattaagcttatagacagcatgtgttattaaaaagagttacctattgaaatgatagtgtttctggagatttctcagccccatcttcctccagcttgtctaccttcctcatgcaaacaatattccacatttttatatctagagcatgactggctaactggagagggaaggaaaagtttagatctggttactggagcaagtctcaaagagaaactctgaaagcttccagaatcacaggtataagataaggatagcattgacatttgctgggagttacagtgatagtttcatctcagcagttcatttttttcttcagtcactgctggttttctttgactattatagttgccaggaagatccttgctcttcttactttaaaaccagcatttaagtggcaatttggatgtaataggatgagaccaaatttatctaattattacagtagtaatacatttaagagttaaaaatgtg

SEQ ID NO: 12216 - DNA, 1696 bp, Homo sapiens
gatatacacaatatggtacatttgtgctctctctctctgtttttctctctttctctttctagttagatcaagataacgatgacttgtaccctccctgattctgttacagtagggcccgggcagatctgtgtttgttaaacaggccttgtttgtgcatgctttgctatgaatgaagttcctttaaggacaaagaaaagcacacttttcttcttttgagcatatctgcttttactttaaatctgctaatttctaaaatgtagagtccttcaccaatcccagagactcaatttggaaatgaactgatttcaagccgttactgtgaataaagcaccccagcattttgtataagctcttaattaaacctgtacagcttctttacctgatttaagaaagggagacaagcaataggggggaataagcttcttcaaaattcattccaagcacaaaagaaattttttccctttgcatataaacttgacatcagttgattctgttggggtcggggtgggtatgcagggattgccttttattatcaagtgatttatttcaagagcctttgaggggattcaggtgaaggaacccccatctgtgctggagagttggatactcctttaaatagcccccaccacagtcataacaataatgataatgctggattatttgttaagccaaggttgtctgcctcatatccatcatgctgtttgcaatattcttgctttcaatcaatttatactgagtgtaactttaggatttctgctattaaatgcatgctctctatcctgcttcagtttctggctttgctttgtctgtttcaaaatatgtagcttcctcttttgtacaacaaaaaactcattctcacttttactaaatatactgtaggagtcatcattgatgttatttttctcttatgtatctgtaaagatttttggcatatgaatgtaatattaaagtcaatgatgctataacttgcgatgtttgcatcatgtcaacctttttgaaggagtgaaaaagccctactatgtttttaaatagcaagtgtaagctcagtgctagagtggatatacacaccgcatgttttcatatgtggcacttttatgtatcatgttgggttattgttctagactggactgttaaatactatgtttgaggctgggttgtcatttttataactgtcttggtgttttatggccattatttattacttttgatacacagaatgagctgcatgcatttatagagcaataagaggatgtatttaatgtgccttgtttttaactgaataagaactggaagcatgaatcaataaaactgattaaaatggtctatttgctagcattttgatgttacttgcagtcagataactttgattactgttgaagtttaaaaaaagtttgaaaatatttttacaaactgtgtttttgatgacacaaaagtgaaatatctacagagatagatgtaattttataagactgccagaattatttgtattaatttgttgctgtagcctttagggcatgacttctgtatttgtgcaatcctattctacaattacattcatcctattacaactcagttgaattcttttttccttttatttccttatttatttatttatttttttaaatctaccagagcctttcagcctaagcgttcccaggcacactgatgaattttatcataactaaaatcaatagaa

SEQ ID NO: 12217 - DNA, 1136 bp, Homo sapiens
tacacgcaaaaatcttgagctttaataatgtcttctactttcatttaaaatcattttgtggtggtttatcaatactaattgttttttgtcaataaattttatgtttagatatcaccttcttaaagtgagatttcatgaacatattaggctttaaaagatgatattgctctagcctatagccactgatattcttacattcttttggcgattttactttttttagactaatctctttagtaaggagactatgttactacccctcaaattggagggaccatattgtgtgaaaaagctgataggattttggaaattacaaatattttgttgggagaaacaggttaatgtgtgtgcaagctgcatatgtctaagtattgttctgaattttaagttgggtgatatgctttgctactggtttttatcttactataattgaagattacaaagatgtaacctaagaaatgttaatatggtgccttgattggaaaaaaaaaaacctctccacatttgtagtaaaatgtgaactcagttgacagtcctacacagggtaggactgtggaacaaaacaggtgaacgtgtgtatgttccccctaaatattttcagaattgagaagggatcagcaggggccaggaagtgctgtgccatggctggccatcatggaaataggctgttttttacttcttccggctttttaatgtgtgtttttgtttatagaacagaaaaagtaaaccacaaattgttatatgagacacatgtttaatgaaaagataccaatgattttgcttcttttaaatttcaataacatcaaatgaatgaaagttgtgtctaatggaaagaaaaaatgggtcttttctcttgccttaggctagcatagaaagaagaaaataaaagattattactccaataatctttttgtgtgggtgtttttctcagatgactattttgatattgtagatttcgtgtttgtcataattaaaatgttactgaaatccaccatgaataatgtcccctgaaataagttgccactcaacattaatttttttgtttatttttgtatttagttgaaaggtttcttttgaacttgctcctgcgctactaagcattgctagacaaggttaaagaatcacttcattccact

SEQ ID NO: 12218 - DNA, 1102 bp, Homo sapiens
gaaatatttttccaagtactaaattctaaaaatggtttgtcacacagacattaaatgtaaaatacaatgcaatgaatagcagttttgtaaaaatcacagatgcattatattcaagacccctgcttggattgtgcccctctccctttgcagagtaactaatttgctttgcaaaatccacagtcaccttgcctaatagatacagagggtgtataatattcaccctctaaaatccaagagggtgaatattaagaatttgtaatatgttgtcggaggctcataccttcactcaaaactcattagaggtctattcccaccctggttgcaaatataggccatagattaggtttggaacagactgacttcatattaattagagctaatacgtttattttatttctaaagccacaggatctctatttgtttgattttttaaatctccttttttaggagttctttggaatttatcctcatgtgatgctgtaaaaatgacaatcattcgagatgctctctcaaccttaacaaacactgtgattgttccacattctggatggaataactcttcttttgatgatgatcataaaattaaatttcagacttcactagttctgcgtaacacgacaggttgcctaaggtaaattctttatttcttctttccagttaattctgtgattaaatatgtgtcataggtaaattgattttaggaggacttactttattaacatctatctaagtttccagtttttatttcaaaatttaggccactggactttgttattctgggagaaaaacatcgtgagcacagacttgtggccttaaagaagttatcttgtaaatgactcttctgtgacttactcagaaaggccctttcagtctaagattactgccaaaattccagtgttttccactttaacagcatttttctggtaatcgcattctgattgctaatgtgtttgcagcctgctgtttgtttaaattcaaaatgtgatggttaaaaccattttgcttttaaagaggtgtgtgatttaaacaatcagtttcaagttgtataaataagtgaaaatgagcccaaatacttttttagtcattatcttttacagttaaa

SEQ ID NO: 12219 - DNA, 1135 bp, Homo sapiens
aggcaaatgtcagcagggaaagacaccgctgaacatggctcaaaaggagggtggagttgggagattgagaaggaggcagacatgggacttggggatatagttgtccccagggagggagttggggcatctgttgtcacgccaaggatctgcagtagtgagaagtgaggctcaagcatcatgggtgcagtctgcacggcagcagccctgaagagaaacactgggccggagcctcaagcatttcggtcggcatgaagtcaaatcctcagcaggactgagaagggctctgcatcctgtcatctgggtattccacaaacactctagaatcataattctctcttcagattgtttcaagttctcataaataaaaagtagttctttcatatttcccatttatttcctgtctgtagtgttcagtacagaagtgttttgctctaatgtgccgagttgtttttaattatacgccatgctgggtttcagacggtggagaactgcgtgtgcaccctgaggaacctgtcctatcggctggagctggaggtgccccaggcccggttactgggactgaacgaattggatgacttactaggaaaagagtctcccagcaaagactctgagccaagttgctgggggaagaagaagaaaaagaaaaagaggactccgcaagaagatcaagttagcattttattttatatgagactctcaagtttaatttttctgggagtgaggaatcacatatttggcaagaaaataaattttctgcatagctatagctgagtcccgcaaaggtgaatgttttcaagtattggagatcatgttcattctgcctccatttaacgtgtgctgtttgtctttcagtgggatggagttggtcctatcccaggactgtcgaagtcccccaaaggggttgagatgctgtggcacccatcggtggtaaaaccatatctgactcttctagcagaaagttccaacccagccaccttggaaggctctgcagggtctctccagaacctctctgctggcaactggaaggtaggatgacttccacttatctacacttctttccatctttgcaaactaacttgaaatgttatatatatatgttctgcctcagtcagatcagccctgatggtgaaagggt

SEQ ID NO: 12220 - DNA, 1112 bp, Homo sapiens
tgtcttcttctgcttaccactgtaaataaacaggcctttataaaaagcgattgcacatccactcaattattagcataggggagaactaagaagatgtttacttgcactttagttcatttcttttgtttgtagtgcacttacagtttgtcagttggtaatcgaagttgaaaaagctagaggtaatctctttttggagaggaataagaaaaattcagtatctataaagaaatacctcaataactgtgaaactccccttgccttgtcttagcaagaatttcattattattgcattattcctgggagataacatacctataattttaataccagaacttttacttgtgtcatcttttaaagaaactaacatgttgccaccgttgtcagatgagttgctgtacacctcagctctatacacaaaaatgtgtaactgtacccagttcatacattaagatccagaaagatctaacgaaaagtattgtttggcagcctgacttggtccagattcaaaggtaagttttaaaaagctctaagaggaaattgaggtatttgtgatgcataggaattccattgagaataaaatttactattataattccttcattactcaatgttactgaaaatactcgaacgaaagtaacttgatttgtctacccaattttacgcattgatttacatttgctttcagcaattgacagtaatgttttataaatgaatcatttctgcaagtgacgttgcaataaatgttagctttccccttataatgacatttgtccttttcttctttgccatgggttttgattttttcccctattattgtctctttgggggttttatttttaagagattgcatgccaccagaatctgaacaacaataacaaaaacctagtaccttctggaagtagaatttactcttttgccgttggcaggcaaatacgccatgcgagacctggtcaaccggctccccggcggcaatggccccagtgtcttgtctgatgagaccatggcagccatctgctgtgctctgcacgaggtcaccagcaaaaacatggagaacgcaaaagccctggccgactcaggaggcatagagaagctggtgaacataaccaaaggca

SEQ ID NO: 12221 - DNA, 1729 bp, Homo sapiens
ggtaacaggtgcctccacagctgagcacacagcagggcctccagtaaagaggggaggtttctggggccacctgccctgagatctcaggctttcttgaggcacctgcttctctagaggtcttaggacaggaaactcagcagcctgcctgagaatgcagcttaaaatccttagagtccaatagtaaacgcatagtgtgcaccagaaacagcttttaaccttaaactgcaaatattgaatattgctttaaaaatatgaagcaggaagcccacattaattttcctaacacatgtatttttaaaaaattgcttttatttatttgccttttcattttgtcaacagcatcaacagctgtattatagtcaagatgactccaacagaaagaactttgatgcatacagattgtatttgcagtctcctcatagctatgaagatccttattttgatgaccgagttcactttccagcttctactgattactcaacacagtatggactgaaatcgaccacaaattatgtagacttttattccactaaacgaccttcttatagagcagaacagtacccagggtccccagactcatgggtgtagcatcaagatgcccaacagaggaactctttctttctaaccttgttcagattgaggtgaaaagtccatcttgctgatttgatgattgaaatgtgaaagtgaagtggaaggaatgaatgaagtgtgttttttttttcttttttgaggaattatcagggaagtgaggaaatgtttgggagaggactttctaagctctatttaggtgttagatctaattacttatagattctgtagtctggtgaaggtgtgggtgacgtgatgagaggtttgagaaatgggtgaaatgaaatgggggatatgtaggtcaaatcaaattaaagatgatttttttaatgtgaataaagttatgttctgatagtttgtacagaaaaaataaaatggatgcccatgttttattgctattactaaatgtcaagattgtatgctattatgtcttgtaaatttcttttgttggtgtaaatatggaaatgccacattggttaagtgccatcatttgtaatgcaatgtgtcacttgaaaagagatttgaagaaactgacaacttcaaaaacaaatgagaagcccaaggaactgtgagcaattaaaagcaaaccgcgacaccctttgtctccaccacacatagtgtactttggaagcacaacgtccaggctggtaccgcagcgccatgcccattcctcgcctcattcataggacacttcactgccattttctattcacataaaagaaaaataaatgtggaaatttcatccttggaaatgtgttctctattctttttaaattttctgtatgtatatggaaaagcagatttaataaacacaaatctaactgcatgttggaaacagcttaaatatatccaactattttggacttttcctagttttatatatactttgtgagatggaccacaccaaagaattaagctatgaactttccttctctgacaatctaggtatttttatttcttggaatctatttcaaatctagtacccttcacagttttatcatgtttttctatatggcagcccggccataactaaattgatataactaaattgataccttttttaggcatcatttttaagaactcagtaacttcataagaacagtggttgggcatttatttggttggcaccaatataataaaa

SEQ ID NO: 12222 - DNA, 1115 bp, Homo sapiens
ccatgaagggaggggaccctgagggaacagtggctgcctctccccagctgggtgtgtctgccacacagagcaggtatgtaatctacctgcccagctctcagcacctgagctggcaggcatgagccgccacattccacctggctaggtggctttctgggtgattaagtgctcagaattcaagctcttctgaatgcctttcctttgctttcctcatgcttacatttgttttcttcttgctcagtttgaagcagagaggcaggtatgcatttagacaggggaataccttcgtagaaacacttctgcagaagtagcttgcagtaaaatattagacacctggttagtatcctgctagagtatcttgctagagtttgataatatttatttttctgcctagttgcttaggatgtttaaaaaaaaattatcatgggctgacttttatcttcctttgactctctcctacctcctgctaggcttataaaatgaaagtgattccagaggtagctttagaccttttatttcctggactttgtgccccaagggagataatcagatgcagaggcacacaaagatgaattaattgtactttattttcctttttgacttgttgtaaatcctgcccttttgattttatgctaatactgctttgttgccacctgtatcgccctgctcactactaaattgaaatgctttgaaattgatttggtaataactatttagactgtttcaagtctgggttaatattcattttgctacgttgcctgcaatttttaaaatcatccttaattatagaagccttttttttaaaatctcttgggtgaagagaagaatttttctttatgtatataatttggtaatatgcttaatgtgggaaagaaattcttggcaatgatttgagtcagcaaagagcctgctgtacttttattcagactgtagttggattcttcaggctgttctattggtgtagcaagcatttattggcgcctactgtgtaccaggagcaagcatgttcagtactgggacaataaagataaggcacagcatctattgtcaaaacttgtccacttgtgggactacaaaatggtcttctgttctgtggagagtctgagcaagttgtg

SEQ ID NO: 12223 - DNA, 1207 bp, Homo sapiens
tgcaccgtttctgcattaaccattctgttgtttgttcccactcccccacccccagcaaatgtttttaatttggaaagtatatttaaaggttcaaaggaatttaatgagaaatgaattcttttgtgagtaatctttgttaaaaagaggatacattatctccaggttacataattttactcttaactctgatactttttagacaatttttttcattatcttcctatcagagtttctccctcgctcctcttctctgtagagtgatttagcagcttatttcccctggtaagccacattcttctaatttaccaaaatacattgtatggaacatactttgataaaaatctgtgtggactggaaaactttccattgatcctggggagggcagtgtgcatgttttaattcttcagccccagctgtgcctggcctccttcaaagtattttggtctttcatttcagccacaattacaagttcatccgaaaatgatgaccggagtggctccagtttggaatggaataaagatggaaacctaagattaggggttcagaagggagtgcttcatgaccgcagggcagataactgctccccagtggcagaagaggagaccaccgggtcagcagagagcacgctgcccaaagcagaatcctcagctggagatggtccagtcccttattctcagggctccagctcactaataatgccacggcccaactcagttgcaggtaaggccacacctttccctggaaggattatctcagggataccaaggtgccctgtgttcactgtcttcacatgggaagacactccagatacaagccagcttcgtggccgtgggtcaggcacttaccttttctaagcctcagtttactaatctgtaaacacaataaggctgtacttaatggtctttaagtgatccttctgctctggaattctttaaatcgattatttggactgtcaggctctttgtatataagagaagaaagtataaaaactctcctctcggtttttgttttaagccttagaaaattcattactgtttattacctcctggtaaatgggaattgttgagtgagtttgttaatatcagctcgaggatcttcttaccaaacttacaaacttatttttgtctaattgaggccgattgtacaggcaagagggccgaatttctgtacaatttagttaaaatggagctcacggcttaaaatgtaa

SEQ ID NO: 12224 - DNA, 1101 bp, Homo sapiens
gtgggataaaacttctttaatagctagaaatcaccataaataagaatgctaaacagaattgaaaattatatcaacttaaaattttaagacagcccagaagacattaatgactctcacttatgaaattgtttggcttttgccactttcttccttgcctttgctatatggtagaatcacagaacttacttagagaataaatatgtctattgttcaagagtaacaggtttaactcatgaccaagtgatgtacatccaagtgatgtattctggaaacgatggaattttacagttacagttccattgagtcaaatcccattttatatatacataaaaattaagttctgagtgagttctagctaaatataagtgcgactgtaaacgcagccaatttttttaagcagaatatgagaacacctaagtattctcttcatagcagttcctataaagggattaaacacttatttctgtgttatggttcttattcatatatttttatagcacttttggaacctatatttgtgcttgaaggtgtttttgatatttggaaacagtataagccatttggagtcatgattggtggtcaagtggattcaagctaaaatactaagaccagcattcttagtggcgcttataaattagctctcacctggtttccaaactgcttttaacaatggtagtgctcctggaacaatccttccaagctcctctaaggacaatatttaattcagatactaaaggtaagactggttgttacttttgttttgttgtacaattagtactttatagtcacatgttgtatatattaaatagcccagttttattcagacttgtaaatagaactatttcaatgtagttaatctaaaaacaaaaaagaaaaccccagtcacgatttgcatgttctctgtaagcttcatccatgctggttattgcactgaatgatatattattagggcatgttaacagtataccagtaacagcactttatctcatttatatgaacacctttgaggtgctacttaagtccaagctctgatgtattattcatttgtaaagataaggtacaggaatgaaccttggtttaaaggtatttttatatgaaaat

SEQ ID NO: 12225 - DNA, 1380 bp, Homo sapiens
taattctgccacatttaatgttggagagagagatctatcctagagacattttactgtttaaaaaagtttcctagccatgaagcgctgctactgatttagacaaggtatatggtcattactttctacccctatccttccaagcacttctgatactgcagtggtttttactgatccaccagcacctaaagaggctgtactacagtctatagctaagtggaaggcacattcatccttctccctctgactgctttgatcatcatttattgcatcgcagaactgtaattttccaaagtttggattgggacttttcaggtcctttttggagggcaaaggaagtgtcagcttctctggggaacttgtttttaaatccaaagacttgaaccacattccctgcacttgaacacgtttgctttcatcccttctctcattgtctccttcccatcttagtaccattgtagttatagacatctgcatttttagaagagttttagccatttatttttttaaacagtcaagaactgctgacatactgtggatatagagtataaaacttgaaaaatgcagatgttgaaggaataacaggtatcttgtgctttaatactttatggcaggattgtactataagcaaatgaattaaacagctatgtaaatcataaacaaaaactgaaaatgaaccaaaatgaaaaggataacttccaggcagtatctttctattgtaacctgttatttaaggaaatactaacgatttcttctaaataggatgtaaaacttatttcagattactcttcctcagtcctgcctgccaagaactcaagtgtaactgtgataaaataacctgtcccaggtatattggcaggtatgtgtgtaatctcagaatacacaggtgacatagatataatataacaactggtaatggtggattcatttacattgcttacagttctatgaccaggccttaagggaaggtcagtttaaaaaaaaaacaagtaatgtcttcctgcctatctccacatacatgtaaaaaaaaaacgtgtttgtgcttcagttctgtttttgctcagtaatatagtcaaggaacagtttgtttccaagtacccattgagctgtgtatgcatttttgtttatttcaaataaaatatatttgtattatttgtcatccatactatccatccataccacactatcttctgtatgagatagtctaatagaaatatacctgttttgttctaaaattatatataaaggttaactggctcaaagcatttttagaatgcaagagtgaaatgagaattacttggagagaaatgttttgtcaccagtaactgtagacttctttctgttcttaatcaaagttcaagtttacagaatttggacattttg

SEQ ID NO: 12226 - DNA, 1265 bp, Homo sapiens
gatttgcttttaatcattttaagagtcatttacattgtattatttggcctgttcaaaatcgtctcaatttaaatactagatattattgtatcataccaaataatttctgatcaataaattcagctgttttaattttatcaaataaaattttcataagctcataatacatttcttttttatatatttgtaatgttgactttacacagcagtactggattttaccagtaggaatagaaagagaaatacatttatgttttttctataataatagtaaactctgtagttacaatataacagtattaagtttgaatccagtgcttcgttttggcattcaacataataaatgcaaataataatgctcaaattatttcatgtaattggttatcttcctttcaaaaatagatgttcaagacagagttccttcatattcacaaggagcaagaccaaaagaaaactcaatgagcactttacagttgaatacatcatccacaaaccaccaattgccttctgaacatcagaccatactaagttctagggactccagaaattctttaagatcaaatttttcttcaagagaatcagaatcttcccgaagcaatacgcagcctggattttcttacagttcaagtagagatgaagccccaatcataagcaattcagaaagggttgtttcatctcaaagaccatttcaagaatcttctgacaatgaaggtaggcggacaacgaggagattgctgtcacgcatagcttctagcatgtcatctacttttttttcacgaagatctagtcaggattccttgaatacaagatcattgaattctgaaaattcttacgtttctccaagaatcttgacagcttcacagtcccgtagtaatgtaccatcagcttctgaagttcccgataatagggcatctgaagcttctcagggatttcgatttcttaggcgaagatggggtttgtcatctcttagccacaatcatagctctgagtcagattcagaaaattttaaccaagaatctgaaggtagaaatacaggaccatggttatcttcctcacttagaaatagatgcacacctttgttctctagaaggaggcgagagggaagagatgaatcttcaaggatacctacctctgatacatcatctagatctcatatttttagaagagaatcaaatgaagtggttcaccttgaagcacagaatgatcctcttggagctgctgccaacagaccacaagcatctgcagcatcaagcagtgccacaaca

SEQ ID NO: 12227 - DNA, 1119 bp, Homo sapiens
tgggacaaaatatacttttgaaataaaatgctatatggcacctaattattttttcttttaaaatgccttaagttgcagtctcattttgataatcatttgcttccagtgtttaaaaattaaaaaaagaatggggagaaggttatgagaagagcattattaagtttccaaatttaatttgaattccaaattcacctagcaataaaatctaatttttaaaaagtatataaatataaaatgtataaatgatggatagatttttgtattgatttgcaaaatgcagattatatttgataggctatagtatgtagatattccttttaggaatattacagctgtaaattatatgagacttgccagtcaaatgctatttggtttaaaaaaattattgcaatctcaagttaatggaatatttttaaatcccacattcagagtttaaaacactggttttcaatgtgttttttagtgttgtcacttgtttatagataaatatataaataacctgtttggatcctggtcctttttaactgttccttggtaattctgagcatttatttgatgacttaatatttttcactacctttggagaacagatgaacattattcaccatgaatggatctatactgtgtggtcatgagttgtgtatacttccataacactgtatttttcttctgtcagtacccttaggatacactttaaaacaccttaaggtctgatgttatggcaacaaactactttttcaaacctaaataggaaccatgtaatttctcaaaagtgattgaacagtttgcccacacttagtttgttggtcttatgtaaaacattggctcaaaataaagtacacactgatttattttactgtttgaaatgtttccttttaaactggtgctcaaagaagacatcagacttcataaccaagaattttattacaatttcaaatctcattttaagcaataatataaatgttctaaaacatttgctcacctcttgccagttacctttgcattgtctgtcttaaagcaaaaatataaaatttaagggtggtagttttaatatattctgtgggtcctaagggatgctttgaatttgaagtatatatacttttaataaaattcagtatg

SEQ ID NO: 12228 - DNA, 1213 bp, Homo sapiens
gaatgagaattatgcctgaaatctggcaaaccgaaaaatgttgctattgcaacaaagtggcaaaagctaaaagtaaggatttatcttcaaacataagctgagataacgaatagaagcaaaacgattggctactagctctctctctctctctctattaggtaaatttgaaaaataaaaatgacttggcacttttaaaggtaacttcaccaaagaccgaagagccagtaaccagtagctccaacttgtctcagcatcacatcttctgtgctctttatttttgccggaccagtttgcggttaggagaatgtgccttttttgtacctttgcatttaggttttataattttaattgatgtatggacacacacaaacaaaaaagcatgaaggaagatttggatccaagcagtgccacactttacatcatcactacaagtgttcaagtgtaaagaaaaccaattttgaaactatgaaattcctgattcataaatacacagttatttctactttagtacatataagataattcactgttattaaagctcttttattaaggcaattgcatatgttttaaaagcaatggtaaattaagttgtcttccaaaactgtgtacttgtctggtcagctgtgtatgatcagttatctacctcagagtctattttcttttgtgctgggacaggttgctggccctccctgtttccacagaccaaatcctcctagctcaggagctagggctaagcagttatttctttcaagtattttttagttcttaaattttatgcttgtatttgatgatagatgtcagtgacatttcatagtttcaaaagtccttgctgctctgagaagtgtagattctagtgaaaattacatagtcataagagaaatgtgtttttgtttttgtttttgtttcatttttttaaagttgtggtattattggttctatgctccctggaatattactgctttgtgaaagtccagactgaacgcagcaccctctgtgtacctagtacagttataaacctgggtctctcactacttgatatttttgcattagttaagacagaaatttgatagctcggttagaggggaggggaaatctgctgctagaaatgtctgaactaagtgccatactcgtctgggtaagatttgggaaacataacctctgtacataaaaaaaaaaaaatcagttaaacatcacatagtagacagccattaaa

SEQ ID NO: 12229 - DNA, 1178 bp, Homo sapiens
gttagcaaaaggctcagcagctgagcagaacagtgcaaattggtttttgactgagttcctagttctactgctggtttaattgatatttaatcctttcacaacagtggatcctggtgtccattgttaaaaatgtactctgtgcctggaaaatccaactcccagagctaaggagttaaagagtagatatttacttgaatgctgaaagggtaaaaactggctctgagaaactgtggtaacaaggtgaaaaactgaaagccttatctaccactgctaatgtgcatctcttaatgatagcactcctttgtcacacatattcatttccatgttttctggataatatggtgtacaatttcagggtttctaatggtgctttttcacacctgtgtgtttttcatctcttcttaatttataccccgttagtgtgttgtttcttttcatatcataaatgtattacttgttctgttctgagcatctgaatgccctctttgtttcaggccggagatggttgttggttggtatcacagtcaccctggctttggttgttggctttctggtgtggatatcaacactcagcagagctttgaagccttgtcggagagagctgtggcagtggttgtggatcccattcagagtgtaaaaggaaaggtagagtagattctatctttattgccatctactgccacattctgtttacagatacattaaataaaaatcaattttgttcaaagcaggattcttaattacacagaaagctgctgtctgtttacttaaaaaacaaaaaaactgtacaagttgataactgtgtcttggtattattagcaatttatttagagatttcttctttaatcacttattgtgtaattttcctgaatatttatctttaaattttttgaatttcataaaattaggaaagttaaaccatactcaaagcctgctataaacattttattaatatttaaataaacattgctttacctttattttcaaatgatgaatttggaattggcacaacattttaaaaatctatttaaagggcattgttttgcagacattatgcaggacatattctggaggtgtgttttccaaatattttagacaatgaaaacttgcccaaagacttggtatcaaccattcacgtttttggagtgaggacgcaaatgaatgattaaatatgctaa

SEQ ID NO: 12230 - DNA, 1121 bp, Homo sapiens
ctttgagtggtatgagttcaagcaaggatgactgtgagctctcctatggagcccagtgtagagcctttctggttccatcagttttataagatattcttgacttggaggaagattaaagccagaagtttaatttgttttattgcaaatgaaaatatggagatctgttcttattcatttaaggagcaaattatttgaaaaaaaaatgttcttctacatttattatttagatttctgaattaattttttctacagttatagtttctagagctttgcctcaaactaatcaaggttaatgacaacttggtcagatatgatgccgcacattgttagcttttatcacagaggatggcattgacaatgattccgagaagaatgctggagggattgatcaagatggaacttgagacctgcaattacaataaaaattttcctttgtacttgcagctccttcctcaagtatacttgctatttgttcttttgccatgttgacctgaaacattggctcaaaaagatccatactaccaaggtctgggtatccaggatgtcttcctagatgttattttctcgctgattctttagagcatttcttctacctcgtctacttcagcctgctcactattcaaccaagtttaggtgtcttgttagcatctattttctacatacattcatcttgatggaattgggttgtgataagtggtacttctatccgtgtggactggctaccttccagtaccatactgttgatgattcattcatgccattcagtgtgaagaatgtgacaactttccatcaaacacattgcagattcaatagcaccaaggataacagatcccaactgcagagcatcattttggcatgtatatggagtgtttgtggggagggggaagaggaactctagagggcagggtatataatatcttttataagacagtacaaaaataattttaaaataactccgaatatatttgatgactaatggtccaatttgtcgtgaaattgcagatccatatttcactttcaggaatagacatgctatttcctttcagctatagacaaagcctctttcaggtaagacagtattttaccttacaatcatacaacgtcaagccagactcattgtt

SEQ ID NO: 12231 - DNA, 1160 bp, Homo sapiens
ttctttcacattttacctaccaaatctagatattcaacgtgagtccttaaaacagtcacttctaaattttattttgactcctttcttggctttttcaaactggaccatgagacccccttcctaaacaatgcagttgttttgttttattctttttttccagaaattcaagctgaaacatttgatatgacctgtgttttacctggtgatcagttctcaggctagtctaagtctgtgctgtcttggcatgccttgggtttcctatcctgagagtggtaatgccagtagaatgatgggaaccaggagagtgaatacgaccagattcaaagcctaaaacaatatgtttcagtttacttttatatgtagattttttaaatattcacatctagcctggaattttagtaaatacagatacttgttgtatccatgggaaatgaggtcatttcaaagatgtaagtcacgttggtgactactttcttttacttgtgataaatatatcactatacagggtaattgcttttataaatttgatcctttgcattggcttataattcaagaaatgtcaacttcactgtgtcactttatgtcatctctcataaaagtttctggcaggactaaagtttcaaaggaatgtgatagaatttattttggataacatttgtattcagcatgctaatgatgtaactcctctctttatcattaccacggtgatagttaagttcattcgttaactcattttagtgacatgtgaggccatttaaatatttttaagataatgtatattgattagaaagggttagaaggagacaaatttatggtagaaattagccttgccattgtctaagttaatttatgtgacctgattgaacagttttagttgtaactttagagtagcttctttgttagaggatctctttcctttctcttttggttttctcccaatatttttatctgtcttgggattatcttaaaaggtatttattaatgagtatttggaagaaaattgacctagaaaatgtctcttttaaatttatctaggtacttgtatcaccagagaccttcatcaagtcctactgccacactggataaggccactacccccgacccttcttgtcagggacatggcttcctaataatggttttgctgttgtctctacataggg

SEQ ID NO: 12232 - DNA, 1159 bp, Homo sapiens
tatttctcctttcattgttgttatttctgttataatactttaattgtacatctgacaatactgcctcttttatgttgtatttagaaattaatatacttataaaattaagatttattagccaaacttgaattctagttttaaaactgactgtgaattttatttttcatatatttatgcattacacaccttagctataagaaaaaaagggttttgattatatgcttcttgcagttaatctcgttatttaaacaaaaagttttgggtctgtctttggagtatttgtaacttctaaattttgaaatgactgaattaggaatttggatgcttattcttttagtctgtttgcctaaaaaccaatttacaatctgactgtctcttgggagagggaggtgccttgcaaactttcacattaagaatgtgcctgaggctgctttactctggaatagtctcagatctaaaatttcctctatataaggtggcatatgttaagttttgcttcattggaccgtttagaatgctatgtaaaatgttgccattctgttagattgctaactatatacccatctctgatttggctctccttaagtgataggatttgttattctaaaggtgataaacttgaaaatatcagaatctgagttttacttgaaattttgcagaatacccaggtggagtgaaaattggaagggttttgtgcaatgactaaaaggtaaaacgctgttaaggttcaagaatcaatactttcaacccaagtagccctctgcttgactgtatattatggaactagtaaaccttaggattttgaaaattggagtctaatctttcaaggaggtgggctcccaggatggtaccattgctctttcctagctaaccctagatatggcagctctttaatgtacttcaaaaagcaaatatatattactaaggaaaaaaagttatttataattgccttgtcataattgttaaggtgttctagagccatttgcatacaatttaatgtaatttcattccattctattgtttacacaacgattactcgaagatgactgcaaaggtaaaaggaaaataaaagtgtattgcacaatgagattgttttgcattgtttctttcctcctttagatatcatctgcattactgcaatggcatttagcactttcat

SEQ ID NO: 12233 - DNA, 2001 bp, Homo sapiens
tgctacatttgccaattttcccattcatgtcatgtatctggtccaggattcagttcagaattattgagttgttacacctcctgtagtctcttttaatctagaacagtgtttcttttcccatctgtgactcctttgaagagtataggccagttattttatagaatgtccctccgtttaggtctgtgtgatatttctgaatgatcagattcagtttatgcactctttgatagacatacctcagaagtgatgttgggttcttctctgtatcatattaagaggcacatggtattgatttattcctttactggcaacgttcactttgatcatatgcataaggtgggaccttccagtttctttattgtaaacacaagtatcacttcttaataggatggatttatttacattcactgattacattaaacattaaaagataaagtgaatatatttactgtattgaatcattaatcttttttcaaggaaacatttatactttatgtcatggctctacattcataggctattaatgaggaattttattgatagatagaatgatagaaatcttgtgtataaaaacaccttgttggctgagtgtggtggctcacacttgtaatcccagcacttagagaggctgagatgggaggattgctagaacccaggagtttaacaccagcctgtgcaacatggcaagattctgtctctacaaaaaaaaaatttagctgggcatggtggtgtgtgcctgtgcttccagttacacaggaggctgagttgggaggattgatggagcccaggaggttgaaattgcagtaagccatagtcacaccactgtactccagcctgggtaacagagcaagaccctatctcaaacaaaatcaaacccaaaatgacagtacactggataaagaaaatgtggtacatatacactatggaatactacacagccataaaaaagaacaagatcatgtcctttgcagcaacatggatggaggtggagaccattatcctaagcaaactagcacaagaacagaaaaccaaatgccgcatgttctcacttataagtaggaattaagcactgagtaaacatggacacaaagaagggaacaatagacatgagggcctacttgagggtggaggatagcaagagggtgagaatcgaaaaacaacttactgggcaccacacttattacctgggtgatgaaataatctgtacaccaaaccgccacaacacgtaatttacctgtaaaacaaaccttcacatgtgcccctgaaacgaaaataaaaattttacaaaaaccaaaacaatacaaaccactttgctagcagatttaggcaggaagtggaggtgcacctgctgccccagtctctatgcctggtctggaaacagcaagagctatatctgtatcttttgttgggtgagctgcctaatctctctgagcctaacctgtaaggcagagctgacaatacttacattgtgttgctgtgaggatgagagatgatctgtgcaggatgtctggtgccgtgtttgacacatagcaggtgctcagtcagcagtggcagtgtgattgtcatgtaaataaggagaatgattattgtggctacggaagactggacattttagaagtatgtagtgaaatcaggagtgaagagagtgtcctgtaggtggggtggggtgcagatgggtattgaaggttgtttctgcattgccgttaatttgggtgaaatggaggaaaagcctatggatgcctacagaaagaaggaaaataattacagtagttagttcattgccattgcctattcacctgtcttcatgttttcttttccgatccatcaaggtgctggcagtgggtgagaaccagggctttctttcactacagtaaaccctccctgccctgagaaggggcgtgtatgtgtgaagagcctaagagtagtgagaattaaatacaaacacagccaatattctttcacagctttcagatcactttcatttatgcttccatatttgtc

SEQ ID NO: 12234 - DNA, 5756 bp, Homo sapiens
tctttgtaggcatgctgtatgtaattgacacaagggaacagtatttgcatttgtactgtcttagaatattatttatttttttgtatttgtaaatctgtggacaaaagagggtttcctcactccttttactcactgggctcatgacagtgaaggagatgctccatctgcttctccccctttctcttgctgtagtccaatgtgctatgagcatcagcttactttgtcacttagagcaagcaaaacccagtgcaagagtctcgttcagctctaaataggtttgctttcttttagttacagtgcccattttgaaattgcctatacagtcttagtgaccatttaaaccggacgaactaggtgtttaattttcactcttcatgttcaattagcagttcaaattaaagaagatggttattggagaacttttttgaatggttttgtattaaattgctttgaaatagatttcatttcttgtgcacacagccaagatttcttcaatgggtgtgagctagttgagggttaaccttgtaggttgcagagtgtatttgtttgtttgtttgtttttctctgtgatgaggtcagtgctctgattttgaaggaggatattcactgaagctcatagttataaacaaggaaatcactgttaagaatgggaatttgtcctgtgttctgggaataacataaagagagcaactgatttcagccaggttttgccactaccctataattagtgcagtcttatgttataaaagaaagaagttaactatatttggggacaaaaaaatatttcaagagttgataaagattacctgtgcagtgcagagcactttaatgcaaccagctttcaagaaaaagccctatctagtacttgatgttgatgtttttattttgctgagcaaaataaagccaatgggagaaagactattttaccctttgcttttctccttaaacgtaatccagatgactttcctgttactaaacactgagcagcattacactacaatgcttctttggtttccaggaatttttttcaaatggggctgtttctggaaaaatgaaaaattctattggacaatggcaatatcaacaatgaggaaaattactgaagaataagtttccataagtctcctacatagcagtgttatttatgtacagataagaaaaccatatgtcagccaaagattttatctcttcttctaacttttagtaagaggaaaaagggattataaaacccttcataaatcaagaaggccatcacttagaacgaaccccaaacaaaaatgccataatataaatgtgtgaatcagggctgtgaagacaacagcagaaatgctaacaagcgtgcagaaacaccagagagtgcgtatcctgctcagaaccattcacatttaattcaattcttggaaaaaattaaagctttttgcccacaatttgcaatctgtgggttaatagttaaaagaatgttcccaaccaaaaaattcttaccgtaatattatatcttgccctacttatttacaaaataatatgtttctgttatggtccttagtaataattgaagaggcttagaaatacatctgcttgtttattgagaaaacgatgcaaataattctgcttttagagccttgttattttatttcacaaaacaggcatatgtctaggagtgtaatttgtggatggttgagtttgtaagaacaatcataaaaggacttgttagtctccagaacatctgctaaaatgcaagtatatgtataaggtaatagcatattacagctgaaaattttgagaaggtaaaagtttcttaattaaaatatgaacatatttagcttgctttagtgtctggggcaagtcctctcaatggctaaaattaactttagagatccatgtgttcaggtttagatcatatgacactcgagcacagaagaataatttcaaggaggtcatcttgtaaattaaaggtttagaagaattgcataaaacgtagtaaatggggtctgtcattagcaaaggcaaatctaagcaatcatttttccccccagaagttacttagaaggagaactgggaacacttggggtctctctaactgatggcattcacttcacacagtcgtctatgttatccagagatttttatttcattttacattttagggcacagttctttggggctaattaaaatggggtttgcaggctttttatggtgaagaataatatatctctgtctatagctttcccatggtagcctgataaggctgagagagaaaaatatgtgcagtatctcatcctccccctgtaccaggccatagctttgaagtgtattttgtaaattcaactataggttagtcagaatgctgtttttcgttaattaacttagcctgtgttgatatctcctccttcctggtcacattcaaaccttcccagagtacaaaggggtatgtagaaaggattccagaagaagtaatactttattctctaatgttaatagcttttctggatctcttagtagggggaaagtagaaaatcgagtagaatttggcctcaggtcaataaatgatataaaaacatgtgttctatttatgtatatatatgtatgtttctccaaaaagtgataaaaccaaaatatcactgactcatccctacccatattcttttcataaaacccactcaccaggtacaatagaaacttccctccttgtttgtcagcctcctgttcatgttccccacacacctgaaggtggtagaatcttttcagcctcttagccagtgagctaaatatggctaagcacaggtcataagagcacctaaggccagcatataagccaactacagttcacctttccaaatttggtcctatggatgttgagcatagggaagcaactctcagtattttggattattcaagtgtatgtggtaaaaatgcagatgattgctgctttaccccagggtttattagcatcctacttctgctgggctgcatcattatataatgccacaggcatctagtcaaggtaaagaagccagaaaggttaggcaagaagtgagataaaatcagatcacctttgatcaaaatggttggtgaacctccacatgtccagttctgttgccaaactttccattcagagtatttggtggagtttgaatttgagcaaactaaatgccttcatcttaggtagaaagggcctgaatcttccattttatattcaaacctcattgttatttggcctaagtaaaaagtcagatttcatttccatttacctgagttcgctttaaagagcttttcaaagagagctttatagacacccacaattgtccccaatctcttcatgatgttgcattaatagttgtttttgtccctttcttggaaatgttaatgccaaagttgcctgaacattgggcggttttcttaatttgaagtataaaaattataaagagtaattccaaaggtattaaaagattgtttaacagtatgtgtggtgatgtcattatctccagagaggcttcaagaaatcctttggaaataaaaagttaaatgtttacatttcatgtggtatttcaggtcttcaggttctgattagcttacttttttcctttgtctttggctgatttctgctttgtagataaataataatagccctgagatgtttctaacatttaaataagaaaaaaatcaaatcgaagtcagcctgctggaaaagtgatcacatggcagttgcagtaacttgtatggaaagagaaaatgcaatgagcccagttactgcacttgccactaccatgctgtccatggaaggaataatcagcagttcagttgtcacaagccgcccttgaagaaaacgcagcaaaatattttaaaatgaagatattgcagtccccagagccagtgaaggtttcttttggtaaaatgaaattgtgccattgtcaaagtaccccgtagtgatgagcactgactggttcactggccacattttagttcttcataataataggccacaaaagggctctgtggtttgcctccatgtgcactggcccctccccacccctagggggcactcagtagctgctgagaaggcctgtccacgaggctgttggaacccctccaataaatacttagaggtagtgtatctgatgcttgttttcgtggagaaaattgtattggagaacttaaaacatcacgaatatttttaataggatccgcagacacccaaaggagaagcttggtcttttccaggtatttccaacttgagttcaacccaaagcctttgaaaggaatgcattaccacatgaccacatgctgagaccccatggggtctaacacgggacctaagaaagtctctgcagccagatagtacatggtgtctccacaaaactaggcattctggagattgcccagaaagggatgtgaggggaccgttaagatctgtcttgcttatctcatgcactcacattccttcagcctcctggagttcctgataaaaggaagccagggtgtggacattttttagctattgatttcccaatagcttgtggatcagttgtacacccacacttccttctctgcctaattccgtttttctggaaaaagtagtatgcccatgtatgtgtgtttttcttaacacaggtccatgaaagtttggcttcctggtttgatgtctgttgcgtggcctggaaaccagggagcagcaactattgagatggtttctgtgttcagtgaaaaattctatttcattgagacaattttttctttatccacagtaattttttgacactgtcatcatgaaactacccttaggaaaataagattacctgcaaaaaaaaaaaagaaatgagttatggaataggaacagttatgtgatgattctgaaactttaacttagagcttcattactttaagaatggaaaacaacctctgagtttgatttcccaaagtttcataaagcccctaagctcatgattttcatcaactctttgcccacatagtcatttacctccacagccgtttgttgtcatagaaggggtggtggtgtttggatttgatttttttcaacttgcagtgagaaataggataggtgacaaaaccttacttgttttcttaagacaattcagtgcttgagcatctctgtcagaaatggaatgaaatactgttagccaattagaattattttatgtattgttattgtgttttgctgatttttatatgaaaatataattattcattcttgatctctggaagcaatcattattatgaggatcattttactttggaaacactttcataataaagataagtattaagagtgcagtgtaagtgccctttactgtaaatgctaaccagctcgtgtgggtaaaacatcacatctcacctgatgaggttaataaaggctcacatcatcccagtagattgttacaagcctcgtcaactcccagtatcattgtgatcattgagaaagtaatgttacgttaacttggatagactgtagtatctctttgaaaattaagattaaaacctcaatgctaaattttatgtagcactttattctggaaaacatggtttatagagatcatctgaaatatatcaggttatgcttatttttaaaaaaattttaaaagaggcacctaggataaacacccaaagcacaacacaaaacttcccttctctgtgtatgcacccctcatcggagtttggcccacatcatcttctcttggtttgtacctcactttgctagaacttctctccatctttctctgtctttcctgtgaaatacctct

SEQ ID NO: 12235 - DNA, 1138 bp, Homo sapiens
gctgactggattctgtggcctggatactcagaaacatccagcttggagaggatggtgggggctggtcactaggatgttgttggcaatgccctaaggcagcggtccccaagctttttggcaccagggactggtttcgtggaagacaatttttccatggacagcagggtggtggtgggggagggatggtttcgggatgacactgtttcacctcagattatcaggcattagattctcataaggaatgcacaacctagatccctctcatgtgcagtttacaacagggtttgtgctcctatgggaatctaatgcagccactcatctgacaggaggcggagctcaggcactaatgctcactcacccgcctctcacctgctgctgtgtagcctggttcctagcaggccacggaccagtaccagtttgtagcccagggactggggacccctccctcatggaacctgttcgtagtttgccatgcaagcggacctgctttggatgcttctggggcagctggaggggctgcaaggtgagacccttctctgctagcagcctcttgcctgcacctaccagcctgctcactgggctcagggttggggtgaggttctggggattgaagtggagctccaagctcttttcatggtcaaagtctgtatgctagttcaggctttacctactcagagtgatcttcacttttaatgcagttattgtctgagtaatcaccctcatactcatttgacaggcactctttggcttggcactgaaagctctttttctccatcttctcagccttgttgcctaccactctccaagaggtcatcactgcttgggtcatacttattagaccctcacccatgctaagcttctgtcaagtttttgttcttttttttcttagagacaggtttcaccatgttggccaggctggtcttgaactcctggcctcaagtgatctgcctggcatggcctcccaaagtgctgggattacaggcgtgagtgatcacgcctggcctgtcaagttgttttgaccctacacacaaagcctggtctccctcttcaccttcccaaatcctgctcattcacaaagacccagtgtagtcttataattctttgtgaagacttctctgatgacaccggcctgtagtgt

SEQ ID NO: 12236 - DNA, 2207 bp, Homo sapiens
tcagaagaaattcagaaaaagatgacaagtataaaaacaaagtgaagaaaagggccaaatctaaaagtaggagtaagagcaaagagaaatcaaagagtaaagaaagagattcaaaacataatagaaatgaagaaaagaggatgaggtcaaggagtaaaggaagggatcatgaaaatgttaaagaaaaagaaaagcagtctgattctaaaggaaaagatcaggaaaggagtagaagtaaagagaagtctaaacagttagaatcaaagagtaatgagcatgatcacagtaaaagtaaggaaaaggatagacgcgcacaatccaggagtagagaatgtgatataactaaaggtaaacacagttataatagcagaacaagagaacgaagcagaagtagggacagaagcagaagagtgcgatcaagaacccatgacagagatcgcagcagaagcaaggagtaccatagatacagagaacaggaatacaggagaagaggacggtcacgaagccgagagagaagaacaccaccaggaagatcaagaagtaaagataggaggagaaggaggagagactcacggagctcagagagagaagaaagtcaaagcagaaacaaagacaaatacagaaaccaagagagtaagagctcacacagaaaagaaaattctgagagtgagaaaagaatgtactctaaaagtcgtgatcataatagctcaaataacagcagggaaaaaaaggctgatagagatcaaagtcccttctcaaaaataaaacaaagcagtcaggacaatgaattaaagtcctccatgttgaaaaataaggaggatgagaagatcagatcctcagtggaaaaagaaaaccaaaaatcaaaaggtcaagaaaatgaccatgtacatgaaaaaaataaaaaatttgatcatgaatcaagccctggaacagatgaagacaaaagcggatgagtgagttatataaacttacttccattctgtttcggattttaagtttgagagacttgctaatgaatctcctttatgttgttttccttttcattgtttttggattgttttatgtttgtccttttttttcttaatgtggatttcattgagttgattttttgataatctgcaatctggataatttgtactgctaaagttttaataaactcgacatgagaaaaacactttggtgtagtactgtgtgctgtgtttaactattttatgtatgcattactgtgttgcaacaattagccaatagcatcctaatttgtttagtcagccatttggaatggttgcaatgcattgttgcaaaagcttgtgtttctcatgattaaagtaactttagaagccactagaagacatcttgtatagattttctgattgcgttataaatagaggtttgcagcggtttcttttaattacacagaagcagggtcctaataacctgagatcttaaatcatcacttttgattttatagtaatttgtgctttaaaatagatgtatttatattgcacttcatactctattctttatagttcgagccatagcttgtttcctattaatgcttttcctgtctagttgtgttttacttaactgcctataaaaatcgtaagagtaatttttttcagttgatgtactgattgagcttgagttgctgttatacagcatttgacaggaactataccttggaaaatcagattgtgattctcagttctgtgttgcttttggtttgaagagttttgggaacgttttaattattaattacccttctctaaactttaaaaaaaaaaaagcttttctcattaaaacataccatttgtgcaggtccttaagctatacagattctaaaaattgttagtattgagacattaacttctaagatttctcttttttggcctccaacctatatagaattgagtgttaactctgcatggattttgtttgttttaattgaactgacttctctaactctcatagctgtgagttccaaatggcaagaaaatgcatcttttctatatatgtatcacgataggctatagcatgtttatgactctggtttctttctcttcaggtggttttataccattactgttaatgttattttaacttggcatgtataacattgccatatagagtagagtagaaagttgcaaattttgatagtttacagagttaaacactaaacatatccaaagtccatttagagttttgggtgt

SEQ ID NO: 12237 - DNA, 1121 bp, Homo sapiens
atgtagaattttcatggttattttgtatgaattatttttctgggtaagccatctgccacagaaattgacactatggtgagattaatgttaatgaaatgagcagtagagaagctactggattgctttaaaacattctttgattaaattactacatagttggtaagttcatagttttaagttacttaattgaagccctcagaagttgcaaagaatttatctgataaatctgcctttgcacaaatgtgatactgatgcatggacggctttgcggaatgacctttgatatttgtgcctagtggaaggtatggagctaaacaattaaagaactcttcattatggataggcacatattggatctctggtattttgggtagtggtattaacttgacaattctaatttattttagttagtatatgtagcaagttagtatgtttgttagtagtttattgtacttcattccagttggtaatatagttttcatcacactaaactttttatactaaatttctgtagaagcttgttgggtttgccttcaccagaaggtactttaaatacctaccatagctgatttgttataaagaaacaaaatgggtgttcttctgtttccttttgattatgtttactgtaattatttcattttggatttatacatttacaattgaataaggattataggttgataagctgtttattgtgaaaagatgtgttttgttacaaatacttgttttaaaaattaataagcccccaggaagtacagcattgactggcacaactgcccatagtgagcttcccaactaactgccttcagtggattcgggcaagtgcaaagtctttggcctattgtgtgacaaagaggtatatattaaaggaaaagaaaaatgacatgaataagaaaattccgtcaacaaggttggagtagggagttgttgaggggtttagtttgttttaaaaggtatgtgagggagtggtggggtggatttgtgtttctgactttttttctttaagcaaattccatatgttaccaaaagcacatgctgtatattttcttccccttttgtgtgtatatagtattttgaaagataaatgaattgggtatttgtatgtgggatgtacaaaattg

SEQ ID NO: 12238 - DNA, 1184 bp, Homo sapiens
cgcgcatgctcagagcacagggaccgctccacctcgtccgtggccctgcccacccaggccgcaagagctgccgggacggtccccatcttcttggagcgctttaggctggccggcggcgctgggaggtggagtcgttgctgttgctgtttgtgagcctgtggcgcggcttctgtgggccggaaccttaaaggtgagtaactctcggtggctaatgagaagctacaaaagggtccgctttgctggtgcgcgactgcgcgtttccgttctttactgcttctcgcggcgtccgtccgcccctcgccttcctcacgttcaggccgagcgccgcgtgggccgcagccggaggcggcggagccgagggggcgcgggcggcggcgaggctgcccccgcgaggaatgcgggatcctggggttccccgcacgtggctggtgcccaggcagttccgcggttgcttagagacgggactgtggctgccctcatccccattgcgtcttttttttttttttttttttttacctccaccgccttctagtctcaccgaaggcttgtggccatctctgtaaagtttctggggaggtgggcacggggtaaacgccggagggttctgtggagcctatgggactgactggaggccaaagaactttgggccgcagatgtacaccagcgtcactcttttggtctgttagggccttcatcgctcacatcaggtttcagtgtgaaacgggaaaacgtgggtaatatttcatttacagtcgtacattctggaaaagtatctgatgaaacgcagttccaaaattaggccaaataggttttgcagggtctaaatagttattttatttcatcgtttgctttgtagggggccctagatcacggtagtaacttaggagtgtagattgtgatagacaagacaatgcataaaattgagtaatttctctagggggatgtggatcacacagtaccccgttgcaagtgcttcctatgtgtatccatggtatcgaatgcaattgcagtgtgtcaggggatgcttccaggaagtgtacctacatcagttcataactagagtcaactaatggcaatattctcgatgatttgttcacataacttttgtacagttgggatgactgggtggcttagtagagtcctggaggcaagtactttgtaagtagaagacttggtttgtaatt

SEQ ID NO: 12239 - DNA, 1157 bp, Homo sapiens
ataagtgccattcttggattattaacgatttacctcggttatgctgttgtataagtcagggacaggatatttggaagatgaatctagaggtcaggtctgtactaagagaaaagccttttctcattggtgcaaggaagttgttgcatctttttcaacagtatcattattagtaattgtgctcagtattaaactagagcagtacttacgttgaatttaacaaaaattaattgttacgttataggacctgtgaaaagagcaagagaagaaacagacaaagaagaacctgcatccaaacaacagaaaacagaaaatggtgctggagaccagtagtttagtaaaccaattttttattcattttaaataggttttaaacgacttttgtttgcggggcttttaaaaggaaaaccgaattaggtccacttcaatgtccacctgtgagaaaggaaaaatttttttgttgtttaacttgtctttttgttatgcaaatgagatttctttgaatgtattgttctgtttgtgttatttcagatgattcaaatatcaaaaggaagattcttccattaaattgcctttgtaatatgagaatgtattagtacaaactaactaataaaatatatactatatgaaaagagcaaaaacagtttttgattttttttttctttttgtacccaaagcatttaggaaagaactagaatattagctattgacgatgggcctttcccacaggccatttatggtgtctcctaggctggctttgtatatttacacaggaaagttggtaacactagaaataattacttgtcacaaagctttcctttttttttctttttcgagactgagtctcactcttatcgcgcaggctggagttcagtggggcaatctcagctcactgcaacctctgcctcctgagttcaagcgattctcttgcctcagcctcccgagtagctgggattacaggcatgaaccaccacatccggcccagaaagcttttcaataccgaatgtagaccagccaaaatcaagagacttactgatttctttttgtgaaacttgtatgatgctggcaggtcatatcgaagttctgtaaaacaaaagccacctaaggataaaattgtatttccaagcgtttaccacccttgactaaacaacaacaacaac

SEQ ID NO: 12240 - DNA, 1099 bp, Homo sapiens
ggagaattccacttttgtgtgagctcaaatacgcattcaaaagattacatttatattttatccagcttttccaaccattcgtagtgggagaattttcaggtcgtctattttgcttaatcgttacagctggaaatttccttgctgagtacttcatgtgtattctttctgttcatttctctttgttagcactttaaagtttatatattttttaattttcagcttagctctctttactcatctttagccattaggaaaagaaatagtaatgttcattgtgtagagaatagatacctctttggcattttaagcaatttgattaaaaatagcactgcataaaatattgtgacagaaattggtgtctataaattacatttaaaccacagtttgattttgaggctatcatctaattctagttttgttttatttttacagtttaaaacagagtggaaaatttcctggaaatccctggcctccatataagaaaaggacatcactccatcctagctataaaggtcttatgagacttttgcactgtaaaactttacacattgtgctattcactctgctttacaaggtacagtagtaatttgaatagaaagactaagcttagaatttattttcaaataataatcctaaaggataatatttacataaaagtaccacttataaagcaaagtgtatttatgcatttaagatgtatgaagatatgttataatcacatgtatttgaaatccaagttgaacataacagaatagctacagcattctttgtgagaaactatttatcttatctagctaccgataaaagtatttatttatggattctgtagaacagtaagtgaaataccgtggaactacaggaggtgtggaatgagctacagggaccaaacaaccatcagaacccactaaaatgacaaaactagaatggcagttatgtgaggcagtgaatcttaggttggggggttctttttgctttttccctctaatcaggaaagtgacgtggaaggatttgagtgtggtttctatgtggcaagatcaaaaattgtttttgataaacattttaggaactaacaagatgatgcttttacttgcttgttatc

SEQ ID NO: 12241 - DNA, 1226 bp, Homo sapiens
tggctcttttcacattgtaaatatttttcgtacagcttaaatttgccacattcgctgcttagaaaatgttttttaagttggtattccattttttaggtaactccctcagtcttgctggtcatttctaggttcttgctgtaatagtgctgtactggatgtcttgtacatatagctattttttttcttttggattatatccctggaaagaattcccaggggtgggaattacttggtcaaaaaacatgatttacatatgtttatttacatataattatgtaatttatatgctgtcttttaaagaagtgttggaatagctttgaccaactacccagtttcattgtgaatccagaggtgtacagttttacccaaattttgaagaattgaagctcatatgcttgaaaaataatataatcacagttttactctactcattaaaaattatttccaatgtaaattttttataattttcagtgaccagtgtaaccaatattttaattttttcagagtacatgtgatgcagaaaagtcttacgaagtattactgagctttgtgataagtgaactatttaaaggaaagttataccatgaagaaggaactcaggaatgtgcaatggtatgtttctgcaaaaatcagatgtagcggttatttagtaaaaaatttacattttcttgccattatgaatgtaatttttaaaaactctttattgtagactgacttgttcaaattttcttttttaactttaggttaaccctattgcttggtctcctgaatccatggaaaaatgcttacaggacttctgcttaccttttctcagaatcaccagccttcttcagcaccacctttttggggaagatttacctagctgccaggtagataatttgggatatgtaagagggagcttttttttttttcagatggagtctctctctgttgcccagactggagtgcagtggcacaatctcggcttactgcaacctccgcctgccaggttcaagcaatcctcctccctcagcccctctagtaactgggattacaggcacacaccaccaggcccagctaatttttgtatttgtagtagagacagggtttcaccacattggccaggctggtctcaaactcctgacctcaggtgatctacctgcctcggcctcccaaaatgctggaattacaggcatgagccaccgcactagccaagccttgtttttataataagctattttgtttta

SEQ ID NO: 12242 - DNA, 1113 bp, Homo sapiens
gtatgatattaatactttttttttctttttgttctaggcgaggcaaacctctctacatttgtaaggaaagatacaaagttcttgagcaacagtggatttctcatacttttgatcacatcaataaaagatggggtccacattacaatgggctgtgactctccacctcagcattgcatcgtatcatcattttcgctacgaatttatttttcaacaataagctttaacttaatttgggggattaacacttttgctgagggagaaaaagaaaacatacattatgaagcctttccaaaattaggtgcttggtaatcacgttaatggtataattttttttttttaatatctggagaacattaataacaagttaaattattctttagtggtcattttttaagtgcacaattaataagaagcacaacttgttcacaaactcattcagaaatgattctcccaacaatgcgtatcagctattcattgatacttagagtgggtgtgatttatttgacattttactgcttctttctgtctgtgtgttttaatttgcatctgccaagcataatgcatcttttttcctctgccattcttgtgttgattggagaatttttctgtatgtaattagaaaaaaatgtaaaacatgatttatgtgaaatactgtatagtaaaagttggtctaatagtagaactttaaaattttttcttattgtgaggaatctgttaaaagtttaaagctttgctgaaaactgaattcattctcaggaatttcataaatcttctccccaggtaaataattgaaatagctgtaaaataagtagatagctgctgttaatataatacagtacattttggggggcatatgtgtggttggggggtccttaaaaatcaaaatttgccatttcagttggatgaattactagaggtaataacaaatcttactatgaaatcaagaggtttaagaacatacactgggcagatgttgattccgtgcatgcccaccttttattaccaaacaaggttttgtttatatgattgtattagaaatgctcagacttccccagaaatgaaccataaattttggaacttcctttcagctcaagaggttcagctatattgtat

SEQ ID NO: 12243 - DNA, 1938 bp, Homo sapiens
tatgtccctactaacagaacttgcaaacacatgtagagaagctgataaaattgcaaagagaaataaacaagtatacaattatagttggagattttgacacccttctttcaataattggtaggattaagtggacctaaaatcagtaagatatagaagatttgaacaaaactatcaaccaacttgacctaattgacatttatagaactccccatgtaacaacaactgaatacatattctttacatgtgcatctaaaacatttaccaggatagaccatagtctgggcactaaaaagtacaaatatgtttaatagaattcaagtcatacaaagtatattctctgatcacaatggaattgaattagaaagcaacaacagaaagatctctgcaaaatccccaattatttgaaaactaagccatacacttctaaatacctcatgtgtcaaagaataaatgaaaagggagcttaggggtgggagaggtatcggcaggggcagcgctgccgccggggcctggggctgacccgtctgacttcccgtccgtgccgagcccactcgagccgcagccatgtctggggacgagatgatttttgatcctactatgagcaagaagaaaaagaagaagaagaagccttttatgttagatgaggaaggggatacccaaacagaggaaacccggccttcagaaacaaaagaagtggagccagagccaactgaggacaaagatttggaagctgatgaagaggacactaggaaaaaagatgcttctgatgatctagatgacttgaacttctttaatcaaaagaaaaagaagaaaaaaactaaaaagatatttgatattgatgaagctgaagaaggtgtaaaggatcttaagattgaaagtgatgttcaagaaccaactgaaccagaggatgaccttgacattatgcttggcaataaaaagaagaaaaagaagaatgttaagttcccagatgaggatgaagctctagaagatgaagacaacaaaaaagatgatggtatctcattcagtaatcagacaggccctgcttgggcaggctcagaaagagactacacatacgaggagctgctgaatcgagtgttcaacatcatgagggaaaagaatccagatatggttgctggggagaaaaggaaatttgtcatgaaacctccacaagtcgtccgagtaggaaccaagaaaacttcttttgtcaactttacagatatctgtaaactattacatcgtcaacccaaacatctccttgcatttttattggctgaattgggtacaagtggttctatagatggtaataaccaacttgtaatcaaaggaagattccaacagaaacagatagaaaatgtcttgagaagatatatcaaggagtatgtcacttgtcacacatgccgatcaccggacacaatcctgcagaaggacatgcgactctatttcctacagtgcgaaacttgtcattctagatgttctgttgccattatcaaaattggcttccaggctgtcatgggcaagcgagcacagctccgtgccaaagctaactaatttgctaatcactgattttgcaaagcttgttgtggagatgtggctggacaggtttgccatcagagtggatataccattgtattaaaaacaagataaaaaagctgccaagatttttggcgagtggttggttggtctgaagtccttgcaagacgctgatgctcaagctgttgacatactcattgcctactttaacacctgtcagagaaacgtgatatggggtaaggaggtgcttttttaaaatagttcatagacttctgtaaaatgcaagataaattaaagttattataacagtgaaaaaaaagaaaagggaacttaggaagtatttagaactaaatgaacatgcaagacacaatattcaaaatttgcggaatgcaactaaagttgaactta

SEQ ID NO: 12244 - DNA, 1298 bp, Homo sapiens
cccccactgccaaggcccccaccaccgttgaggacagagtcggcgactccaccccagtcagcgagaagcctgtttctgcggctgtggatgccaatgcttctgagtcaccttaactttgaaccattctttggaattggcgtggtatatttaaccacgggagcgtgtctggaaacgcaaactatcattaatttcatactagtttgtaccgtatctgtaggcatcctgtaaataattccaaggggaaaactaaacgaggacgtgggttgtatcctgccaggttgagtggggctcacacgctagggtgagatgtcagaaagcgcttgtattttaaacaaccaaaaagaattgtaagggtggcttgctgccaggcttgcactgccgttcctgggggtgtgcatcttcgggaaaggtggtggcggggcgtccactaggtttcctgtcccctgctgctccttccgtaagaaaatgaaatattctatgcctaatactcacacgcaacatttcttgtactttgtaagtcgtttgcgagaatgcagaccacctcactaaactgtaaacggtaaagagatttttacttttggtctccgtgagtcgcatctctactaaggtttacacaggaattccacctgaagacttgtgttaaagttctacagcgcgcactgttaactgaacgtctttttcttcagcctatacgcggatccttgttttgagctctcagaatcactcagacaacattttgtaactgctgctgttgctttctacatacaccttataaagtgacatttcaaaagaaataaggtgccacagttttaaaccagaaggtggcactctgtggctccttgtagtattatagctatactgggaaagcatagatacagcaataaagtacagtaattttactttttttcttgtgttacatctaaattacaacccttaattgccacgtgtgcacttactactctccagtatgtcttattactctccagtatgtcacgcatctttaacttttcacgtcctatgtttgctttctcccatttttaagagatggtaagttaactggaattgatttactgaatgaaattaaatgcagatatccctgtttttgaaataagacaaaagtgcttcctcagttattgccctggtatgagtctgaagatgctcatcccctgcagggaggacgtggctgaggtggcagcaccctcacatcaccctcatgtcactcacccctggccgccctgctggacactcgaggtcaacgccagcccagcactctcccaggaggcccagtaccagccagt

SEQ ID NO: 12245 - DNA, 1612 bp, Homo sapiens
gttaagatagaggaaaaaaattttgtttatttgggggaacactgtaaataacgtttataatacttaaatacatttggttgttactagagagttctaatatgaagggtagtttttcattatttaaaaacacatggaaaaatatgagacatatttctaacatacgaactatagtgcctggatacattcttcagcatttggcagttaatctgctgaaaccaaagtaagaactgaatgacagtgacagttgtgttttatagtaatagaatgtgagagttagaatctttggacaaagttaggctttgtcatttgcctattcagacttttaccaagttgtacctcgagatcacatgtccgttttctttcactggttatattaaagggagagctattatttctaaatactttacacctttgacaaaatgagctgcttgtgttgaaatcagttgaattcactaaattataatattgccagtgttttcaacacgttagaattgataacaggtatttttcttttgttaccaggccttgttcatcaaaacaggtgacagtgagtaaccaaatgcagaccagttctatgcaggataatgataaattcccttctagctctattgtaaattgttgtacagatgtcatatttcaattactaagtttcagcagcttattcttgtacaaatgtttaaaatatggcttttctaattggatattgtattttttttaagtcttcttgaaggcactctaattgctgctaaatgatgttgcttctttgctaaaaaattaaatgacctagaaggtgcaagttgactgtacatcatagatattaaaaagcagacagtcattaacaatcaagatgtaaaagtgatccatgttggacataattgagtttttaaatcagtttattgggttctagggctgtagaacacatagatactagatttttaatttgttcatggttattctacatttctagaaagttcttatcagcaagatggtcccataagcaaatttcttgtggtttgtacagatttgttaaaatgtgaacgttttctaactgcctcgtagggtagaaaccaatatttttcaggatgctgtatttcactcctgtaaggactttttctttattgtcacattcataatgctgatacttacatgtaagttgttcatgttgcagaaaaaggttatacgtaccacggattctctttaatattgtacagttaaactgtatttctgatgttgcaagccattttgttttttcattgtacatagacacattgtctctttaaaatgctgctgaaattgtagagagtatagccaaaacagtaataaacaatgacagttaaaatgtaaagactatgaaaattacattggaagggagctttcaagatggtaggatattgactaactgagctccttcacttaaaaatcagctgaataaattccttaagtatacttcaagacaagtgtaaattgtttcaagctgttaaagttaaacctaataaccattatcaaggcaactcctgggtaagtaacacttagaaccatcaagagtggtttaaggggctggctatacccattcctctgtagagcacagagaaatcctattaaaaaaaaaata

SEQ ID NO: 12246 - DNA, 1196 bp, Homo sapiens
agtgttgaacgttaatttcactcctataatacagcagctgtaaatatttttaagacaagtgtgccagatatttaaattttgccaatcagttgaattcttaaacatttatttgatgctggggaggtagtttttgttttgttttgttataataaagtagaggaactgacagaattaaaacctgcctgttttaacagtcattccaagttacgggtattaatgcatgtatttatgcatttgaagggagagtaaaccattacccctccacacacccccagaaaaacaggaaatgaagtgtgtagagagcaaaacattgagtaaaggtactaagttaattatctaagctagttgaacacacctgaggtgatacagtatgctctcatcagtaataagccactttagtaattggggataggggtggagggaacatttatataattaggaaagaaagcccccaatatttaatgatttttatcttttctccttctcctacccttctccccaatctacacaattattctcaagcaaaaatatgattatggtgcaatagtttcaaaagtcagacctgctttgtctaggtggttattttggttggttggttggttggttggttggctggcttttattttggttggttcatatctcacacattcatatttagaatatgggaaagcatataatatggtgacataataaggataaattcgaaataaattagtaattttctccttaattgtttttttgcactgcccttccttttaattagctttttttttctttttttctttttttttttagacagtctcgctgtgtcaccaaggctggagtgcagtggtgcaatctgggcccactgcaacctccgactcctgggttcaagcgattcacctgcctcagcctctcaagtagctgggactacaggctcctgccaccatgcccggctaatttatatatttttagtagagacggggtttcactgtgttggccaggctggtctcaaactcctgacctcatgatccacccacctcagcctcctgaagtgctgggattataggcatgagccaccgcacctggcccttaattagattttaatagtgccttttgttgatttcacctttccctttcttggtggtaaactttcagaatggcattataaatcgtttgtgaaattaaaatttaatttttttaggacttagagatgt

SEQ ID NO: 12247 - DNA, 1217 bp, Homo sapiens
aaatgtagttagttatataagatatacataaacaaaataattaagtggtaatgtcgcatagttacaattctgggtatgctcagaatagggagattacattaggagagtagtattttttaaactatggacccatggtccattgttggtttatgaaatcaatttaattgctatttactagtgtcacctcactcttttttaagtggactaggataggctagaaaatagatgttgtacaggactcttactactgcattgcagtaagatttggtattctgtgaaacttttaaatatatgaatgtttgtaactgtgtactaaattagatggaaaatatatttcttctgtgagttgcagccaaaagtgttggaaatccattgtaggatgttttgataagttgatgtgtacatttaaaaataaagtctctcaatttcgtctgcttgtagcattcattcctaaatttttaacatcttaactaatcacatatatatatttgtgtgtgtaagtataaagtatacacacatatatatgtgtacatatatatttttttttcttaataggtgcaatggatgagcttcatagtctggatccaagaaggcaagagttattggaagctagatttactggagttgcaagtgggagcactggaagtacgggcagttgcagtgttggagctaaagtgagcaaaattctcatctttatttgacagtctttctttctattaaatgatctaaaatagtatgtaaaggattcctacataacgtgcttaacagcaaatgtaacttttataatgtgtagaataagatcagtgttcataaatgcgtttttaatgtagtataccatatttcaggggcattataatacagcataatatgtttcagggataaaaaggagtttggtagattgtactgcctgtctcccactatgtagtttcttatccttcctgcccttattatccatggtcctatctgtacatctaatccacagtttctaactgctgcataaaactttaatagtgtatatcttttaggccaggagtcctcaacccctgggccaaggaccagtaccagtcctgttagtaaccggccacacagcaggaggtgagcggcaggagagtgagcattactgcctgagctccacctgtttgattcagcagcgttagattctcataggagcatgaactctattgtgaactgtgcacatgcaagggatccaggttgtg

SEQ ID NO: 12248 - DNA, 1474 bp, Homo sapiens
gcctgtaatcccagcactttgggaggccaaggcgggcagatcttgaggtcaggagatcgagaccatcctggctaacacggtgaaaccctgtctctactaaaaatacaaaaaattggccagacgtggtggcaggcacctgtagtcccagctactcgggaggctgaggcaggagaatggcgtgaaccagggaggcggagcttgcagtgagacgagatcacgccactgcactccagcctgggcgacagagcgagactctgtctcaaaaaaaaaaaaaaaaaaaaaaaaacaaacaaaaaaaacacctagatgctagaaacatgctcatgcagaattttttgtccctcacacagatgtagaatgtagagtaagaagacatgttgtgagggttgtggaaagaaaatccaaatcccacccatcaggagatgaggcactgggagccctagatgccatctgtcttttgaacttccacaaaataatgttgcatttcttctggtgcatacagaagtccagtatgctgctcttctgaggatccggcaagatggcagaagtagagcagaagaagaagcggaccttccgcaagttcacctaccgcggcgtggacctggaccagctgctggacatgtcctacgagcagctggagcagccgatgcagctgtacagtgcgcgccagcggcggcggctgaaccggggcctgcggcggaagcagcactccctgctgaagcgcctgcgcaaggccaagaaggaggcgccgcccatggagaagcaggaagtggtgaagacgcacctgcgggacatgatcatcctacccgagatggtgggcagcatggtgggcgtctacaacggcaagaccttcaaccaggtggagatcaagcccgagatgatcggccactacctgggcgagttctccatcacctacaagcccgtaaagcacggccggcccggcatcggggccacccactcctcccgcttcatccctctcaagtaatggctcagctaataaaggcgcacatgactccaaaaaaaaaaaaaaaaagaagtccagtatgctaacagaaagtcgtaataagctgcacacagtggtttgctttgtgggataagccgaacatttttcacttctgattgttgactgtgtgttggttcctctctgttttcccctccactctccaccctttgccttggcttgtgctctgggaggctgacgcctacaactgtgtcatctgactctccttgtcctctggcttccaattgggtttggctgatggctggtgctgactggggattagaaggcaggaagccaggtcagcctatttatcccactgtgactccttgttgggacatggttttgcagtggctgcattcctctttgccacgggactttcaagtgttcccttctccacagctgtggctctcacaggggtccagtaacaccatcaccacttgcttctacgcgtctatgagtggcattggcttcctg

SEQ ID NO: 12249 - DNA, 1127 bp, Homo sapiens
gatgaaggagttaaggtatcaagaaagattaccttatgttccaaagaaaaatacttacaagaaacgagcccccttatgaaccatgcttcaaacactgtttcttactaggaattttgcaagaatacagtaaaaaaaaaattttaaggaattcctctccagcaaaatccatgagatggtgcataggagttatatttacaaagcatcattgttattctctcttgcattggtggtgataatagccaagtcatttctgaggctgtcacaacacacttcacaaacaccgtcttttgttttgaaatgttgtaaatcattgttatagtccccgtaattatggaaaggccattcaggtcaattattactttttaacagaaaaattatttgaaaacaaactgaataatagtgggtaaaatgatcttttatttcattgtatataaaacattgtctttcttttaacagcagattgctgttccccgcaatgatgaatgggcacggtttggccgaacacttgcagaaattaatgcaaaccgagctgatgcagaggaggaagcagctacccgaatacctgcttagttcctgaaaaggggagtgtaactagtggatttgggaaaggttcttaagtagatcctgagactatttgcatgcttctgtctaaatgataattaaaaggaaatttcatggattaaaccatgggtttaatgcagcaaggaaacttacaatgtccctttatatataacatgcatcttgttttggatttgtgtcattttttaatatagctgattgacttcacagaaagcagcttttttgaattctaatacataggtgtatatttggtattagttattttgagttcttttcaacttataacactgtatacagttatttctaaagcacagatgaaataagttctgcatatttttaaataatcacagttccctgttatacagataatgttctcactacccataatatgtaggaacattgtttctccttagccgtagtatgcatacacctatccatgttcattctgacatcctttgttgtctttataattcatgtggtagttacctataaataaaaacaaatatgcgttaacttttcaaattttcatttttactccttacaacttg

SEQ ID NO: 12250 - DNA, 1133 bp, Homo sapiens
gttttgacgctgaagcactcaaagtaatattttaattttctttgttcactagtctcttgagaatacagtgtaaataaatcatataatggtgaaatgacacttttagtaagaaaaatgttggctgtatcctagttatactgaaactcatgaaataggaatacctgtcaccttcaatatctttagttatctttaatatctctatttttttgtcccttgaaacagttcgttttcctgaagatcttgaaaatgacattagaactttctttcctgagtatacccatcaactctttggggatgagtaagtaacttagtaaaatatttgtcaaattagtatggaaaaaaaaattttcattctttttcttttagatttagaaatcaaattttattttcttcttatttttaatgtggtttatcttaaaatatatgttataatggtgtttttttacattgagacaccagttattttaatacctaccatttagtgctgtaaatgcattatttaattctcacagcagtattaatgatggtattattatttgctgctttgtgcattgatagaattggataattgttcatgaacatacaaatggctggagtatagattttaggcaatctgactccagagcccataatcataactactacttttttctgctaccattttgctaaattacttctagtagcatgtattcccctaaagctgtaatagaaagcttaagttgttattctatgatcaaataagcagttgagagaagtttatttatttattatttatttatttatttttgagatagggtctcgctgtgtcacccaggctggagtgcagtagtgtgatcaaagctcactgcagcctgaacctcctgggcataagcagtcctcccacctgagcctccgagtagctgggactacaggcacacaccatcatgcctggctttttttaaaaaattttttgtagagattgggtctccctatgttgcccaggctggccttgaactcctggcctcaagtgatcctcccacctgcgcctcccaaagagctgggactacaggcatgaaccactgtacctgccctgaagtttattttttagaaggaactttaaatatatgtcccaggccaggcgcagtggctcatgc

SEQ ID NO: 12251 - DNA, 1178 bp, Homo sapiens
aatttgttattaattttttatatcctttattctttaggcagatgatgttgagggcaaaattagacaaatcattccacctggattttgcacaaacacgaatgatttcctttctttactggaaaaggaagttgatttcaagccattcggaaccttacttcatacctactcagttctcagtccaacaggaggagaaaactttacctttcagatatataaggtaaagataaatctaaatatttattgagtaaagttctatttgcctgaaacctgtatgtagttttgttgtcagtgatttattctaactgcagtaaacaagttttaatcagcattataaaccaagatctattttgtgtgtatgtctgtatctatgttcacatcttaatctgagacttctaaacattttcccacaggataattttgtgttctgcggactttcacttacctttgtgatgagtttcacctgacttttcctggctttttccctaggctgacatgacatgtagaggctttcgagaatatcatgaaaggcttcagacctttttgatgtggtttattgaaactgctagctttattgacgtggatgatgaaagatggcactactttctagtgtaagtacagttctaaagcaacagtagaccttattacctccacaaagccagcattttaattgtggcagcccaattattgggacagtataatgatatttttcccaggaaagaaaaactattgtttatgaggcttgagttttccttcattatgctttgggagaccttgagaatagagctgaattaaatgctgttgtccgttagggccctgaatgtaggcttaaacagtaaaatgagctttgcctgtgttttcttttacttgccacctattcatctttataataggcaagtgcactgaagtgatgtaaagaggtctgatttatccaagttgctgcacaccaattaagtgaattgtacattcagaacatagcaggtgtacccattgggccctcacagagtagcttgctgacactgaaaattcagtcagagaatggaaaagaaaatggacactgcatgggagcgcgactgtaattgacctgcttggctttctgttttatctgcagatttgagaagtataataaggatggagctacgctctttgcgaccgtaggctacatgacagtctataattac

SEQ ID NO: 12252 - DNA, 1312 bp, Homo sapiens
atgaagaataatagcacttaatctcagttgtctttcttcagctaatgtcttctatctattaagcaaatatttgagtgtctatactgcccagagttctttaaagttttggagggggctgctagtcacatgtctgtatttaccatcattggacacaaataccaggtcttcttgttaactctttttagagggtttgcaattcatggttaacattatgtttaagcttccttaaaaaacaaaacaaaacaaaaaaaaaacattgtgggacaagtttgggcgtattcatactattcttatttttaacattggagacttaaaattgtaagactataaggaaatatatttactttcttcgtctaacaaataattgtttgtcacttagaaaaagcagagagatcttgctaagatgagaaaatgtctcagaccagaagaactgacaaaccagatgaaccaaatagaaataagcatgcaacatgaacagctggaagagagttttcaggaactagtggaagattaccggcgtgttattgaacgacttgctcaagagtaaagattatactgctctgtacaggaagcttgcaaattttctgtacaatgtgctgtgaaaaatctgatgactttaattttaaaatcttgtgacattttgcttatactaaaagttatctatctttagttgaatattttcttttggagagattgtatattttaaaatactgtttagagtttatgagcatatattgcatttaaagaaagataaagcttctgaaatactactgcaattgcttcccttcttaaacagtataataaatgcttagttgtgatatgttaatgtgtgatgatatgattcttaaatacttacaataaacctcattcttaaatacttatcattccttccacactttgcttctaagattttacatctgacacctttaaaacatttctttaaggttatcctggtaattttattttttcaatatgatttttctttcttttttaacttttagattcaggggtacatgtggaggtttgttacataggtaaactagtgtcttgggggtttcttgtacagattatttcaacacccagatactaggcctagtatccaatagttaatttttctgctattctcccaacctccaccttcaagtaggccccagtatctgttgttcccttctttgtgtccatgtgttctcatcatttactcccacttgttaagtaagaacatacagtatttggttttctgtgcctgtgttagtttgctaaggacaatggcttccagctccatccatgtcctggcaaaatacatgatcttgtt

SEQ ID NO: 12253 - DNA, 1306 bp, Homo sapiens
ctaataaaactggagggaaaaaaaaaaaagaattggaaagaggccaaggctgcaagtgaataattcagtcgagttgtatcttacttaccattaggttctctcaattagtatataaactgaaaatctaagatatagtcagaattacccttgaaaactacctcaggaaggcacagtgttagaaactgacatattattgcttattacatttagtgtggccattttttccttccattgtcacaagtatttggtttcttctcttgagtttcatatgatatccctggcatcataggggcttagaggttgtattctttgaagagggtgtcttttaaacaccagatcatacccagcaagaaatgctgatactatgagagacaggcctattttcctcgttttggtatcccctctttggcttcccctgtttagttgtgtttgtgcgttttgcatgaaccagccataggactctacatttgttctcactcactgcctaagctgttgaagaattagtggactcctagacaaagaataatcccactatctcctagttctgactgatttaactgttaaacgtatattaaattcaaatctccaaattgtctctgtttcatcaacaggttgctcgtgggggccccgcgggcagaagcgcttccactgcagagagccaacagaacgggagggctgtacagctgcgacatcaccgcccgggggccatgcacgcggatcgagtttgataacgatggtgcgttcctttccctcactcagcgttcactccggcagcttgcctgtactgtttccatgagggaggagagtggggacaaacatttattcttgtagagaggacttcttttaattgcatcagacttgactgttttttatttgccctgaaaatatttacttactttacttctgaatcatactgggatgccgcgtgttttgctgctcctcctaaccgtggtttctaaaccgatatggtgtagggatgttgccacctagtgatgtgttgaggttctgcaggaggttgtggaaaaactcatttcatagcaatgaagagaatgaatgagcgtatcttgtattcatcagccaaaagttctcacatgctgttaaaatatttgggagaaagacagttttaaatatcagacccctttggaatgagagctggctaacagagataaagttttccctcctgtctcagatagagacttgttttgttaagggctctggataggtagaagataccatgaggtaggcatgttgacatccagtgtacctggcttcttgtaggttgagcagagcaattagtgtactgaga

SEQ ID NO: 12254 - DNA, 1142 bp, Homo sapiens
ctggtcaaagtgttcttcaaacacaattttactaaaggacagaatggaaatttgatgtgtggcaaagtacatttaaagcttgaattctgcattggtaattgtcacacagggaaatgaactgtgtggaatagccagtcacctacatcgatgccttcctgagtcctgaatggtgtaaattgacaatagttttcgttttcctacaggttcacttcttaaaagagggatgtggagacgacaatgtatgtaacagcaaccttaaactagaatataaattttgcacccgagaaggaaatcaagacaaattttcttatttaccaatgtaagaatcgttgtgtagcactagcaaaaatgattctggcttcatggtggctttgtgttaagaaagtttactggaaacgtattgaggactttgcctttttgttcttgttttcttatttttaatagtcaaaaaggtgtaccagaactagttctaaaagatcagaaggatattgctttagaaataacagtgacaaacagcccttccaacccaaggaatcccacaaaagatggcgatgacgcccatgaggctaaactgattgcaacgtttccagacactttaacctattctgcatatagagaactgagggctttccctgtaagtattgttagagaccagctgagaggggaaaaaaatcaacactgtgtggcaaatgagtggattgtgacctagcgtgtgtttcttttacaggagaaacagttgagttgtgttgccaaccagaatggctcgcaagctgactgtgagctcggaaatccttttaaaagaaattcaaatgtaggtgatgccttcatatactgtattttactgttttaaataccattgcagtgtctgtatgcatggcctgtgttaacagctatttatgtttttttaggtcactttttatttggttttaagtacaactgaagtcacctttgacaccccagatctggatattaatctgaagttagaaacgtaagagttacatcaacctctccattcagaattatttcatgaaaatatgggcagtcaatgaattggccctgatctacctcataaaagaagtctaattgtagtgagaaaactgactggtaaaatacaaccctattgtttccttttcattttcaga

SEQ ID NO: 12255 - DNA, 1101 bp, Homo sapiens
agcaggaggatcacctgaagccagcactttgtgaacaacatagaccctgtctcaacaaaaaaatttttaaaaaaattagctgtgagtggtggcatgcgcctgtagtcccagctacttgggaggcagctgaggtgggaggatcacttgagcctgggaggttgaggctgcagtgacccatggtcacaccacttgcactccaacctgggcaacagagtgagaccctgtctccaaaaaaaaaaaaaaaaaagtatgattgttctcaaaaagataccaggttagatagatagaacagactggctgttagatctatttaactgggtatctttttgagagcaatttgtttagatacacagactggctgtatattgataattgctggaacaggatgatgaatacttaagggttcattatacagtttacttgtgttgataacaaattttttttaagatacattaacaaagaagtaaccactttgtcagaatacaacccagcattttcaagattctggggaaagatcttcaaggaatgtctcttgaagcaatattctgttaagagaaaggatcttgcatcagaaagtcatctcatccattcacaggctgcattgtccaaaatatattcaaaagcagaattagaaccataaactcctggtgtgaactcttgccgctgtatgtagtaatgctgctttcttttctgccctgtaggttcgagtgactgtgtttccctcaaagactgtagctcagtattcgggagtaccttggtggatcatcctagtggctattctcgctgggatcttgatgcttgctttattagtgtttatactatggaaggtaagtcatatctggcatttgaatttcataacaaactttatttcatgttttaaaaaatgggaatcagcactgatagtacgttttctttttcattgcttccttttttctaacattatgaaactcttttgacatagcaaatttgaggaaaattttaccatgaacacctgtatatttaccgaatattttgtatttaaagtatattatttgtacacaataagtttcttcatttgtctctcacacataatttagcatgtttagcaaataacaaatttag

SEQ ID NO: 12256 - DNA, 1225 bp, Homo sapiens
ctgaatctgctaccaaaacagttaatcagtgagtcgatgttctattttttgttttgtttcctcccctatctgtattcccaaaaattactttggggctaatttaacaagaactttaaattgtgttttaattgtaaaaatggcagggggtggaattattactctatacattcaacagagactgaatagatatgaaagctgattttttttaattaccatgcttcacaatgttaagttatatggggagcaacagcaaacaggtgctaatttgttttggatatagtataagcagtgtctgtgttttgaaagaatagaacacagtttgtagtgccactgttgttttgggggggcttttttcttttcggaaatcttaaaccttaagatactaaggacgttgttttggttgtactttggaattcttagtcacaaaatatattttgtttacaaaaatttctgtaaaacaggttataacagtgtttaaagtctcagtttcttgcttggggaacttgtgtccctaatgtgtttagattgctagattgctaaggagctgatactttgacagtgtttttagacctgtgttactaaaaaaaagatgaatgtcctgaaaagggtgttgggagggtggttcaacaaagaaacaaagatgttatggtgtttagatttatggttgttaaaaatgtcatctcaagtcaagtcactggtctgtttgcatttgatacatttttgtactaactagcattgtaaaattatttcatgattagaaattacctgtggatatttgtataaaagtgtgaaataaattttttataaaagtgttcattgtttcgtaacacagcattgtatatgtgaagcaaactctaaaattataaatgacaacctgaattatctatttcatcaaaccaaagttcagtgtttttatttttggtgtctcatgtaatctcagatcagccaaagatactagtgccaaagcaatgggattcggggtttttttctgttttcgctctatgtaggtgatcctcaagtctttcattttccttctttatgattaaaagaaacctacaggtatttaacaacctacaaattgggagttgtctttggactgaatcctcctcttcactgcctgtccttgtaaggatagggaattgcttagcaatgataacctggcattaaaaaaaattctgacagctaagctgcttccttcttagaatatgttttggatgtgggagca

SEQ ID NO: 12257 - DNA, 1161 bp, Homo sapiens
gaccagcctggccaacatggtgaaaccccctctgtactgaaaatacaaaaattagctgggcgtggtgacccatgcctacgtagtcccagctacttgggaggctgaggcaggagaatcgcttgaaccagggaggtggaggctgcagtgagccgagatagcgccactgcactccagcctggttgatcgagactccgtctcaaaggaaaaaaaaaaaggaaaggctttccctggttgggggcagtggttcatgcctgtaatcctagcaccaaggcaggaggatggcttgagcctgggagttggagacaaacctgagcaatatagggagaccatgtctctaccaaaaaaaaaaaaaaaaaaagcagactttcaccaaactatcaaagtatattttcttctgtagagagttcaagactttgatttgtcaataccattgccatcttaatgcgtgaaagagaagtatatttattaaatccttttttgttttgttttgattcacactagatggctatgaaaatgctaggcgtctgtgtgatttgtattatattaactctcccgaactagaacttgaagaactaaatggtaagcctgatgttgtctttttctcaataattagtgctttgattacttgataagggataagaatttaaatgttttaatggaagatgactttttatcaacttcgttggatatgaaggctaaaggatagtaatcatgtaaaaaatatatctataaacatatgtaatttagtcagattctttatgaaaagatttggctttttgtatcacattttctttatttttaattgataactttgattctttgcttattttttattttctgtttagtcatagaaagaaaatgataccaagaaagttacatttgacttttacatgcacttcactaatgtaagacttaccctttttctacttcctgagttgtaaataattttctgttgttgaggacatagactggggttataaaagaggaaagaaagatgctcatctatttgagaatctgtttgtctctgatggttttctttttaccctgattagtgccttttggacaaaaagggtttagatgccttgaagagggattgatgagtctctttttcctgaaagcatggtagtttgacagaaaaaagcatttcctaagatgacactt

SEQ ID NO: 12258 - DNA, 1226 bp, Homo sapiens
atatgttggcactgtgtaccctatttcctttagaaattagtcaaagcagctttacaatgacaatacccttaatttcaaactagagataaagggattcattgctccatcaaatacgaccatcgctgttactactatatgaaaaaaattgctttcctttaaagaaatttatgacagttttttaaatagttctaaaaatatagctgaaactacattttcaaaaatgttttgcccatcatttactaaaattataaaagtgtttgaacagagttttctgctttaatgtaactagttaaaagtgttttgaagtctgactttggaaaataagcaaaatttagttggagtctttaggtcagaatatccttcaaatcccccccaaattgactccattaaaaaaaaaactttaaatgtggttataagaattgtgattctttggcatatttccatcaaattttaaaacttcaaatagtgcatatgtacttgaaaattacactttctcttttctaaaaagctgtatttttaatacaaccctaatgtatttcagaatgcaatgagagccactatggaacaccatgccaacagaggtgtttacccccctattcaagttcatgtcacgctgggtaatgaggatttgactgtgaaggtaaatgtgtttaatggtttgttttcttttttttttttttgtaattgatgaacagacatgcaaaggtaaccatacgcataatttctaaaagacataatctactctcaggggaaaagaatcttgtctgtaatagataataagcacattgcttcattgagctggtggattatagttatcccttgagtcttttctatgcaggtcccccgtcgaggtgattcaagttaaaataaatcttggagacagacaatttatcattaatatctctttgataagtaagatctaaaatatttgggtagttgcagtattatggagatagtattttatatataatttaaaaaattttaaaacagtgctttctaatctactggtttcatttgattctcatgacgtaggtaattttatcctcacttttacaggtgtggagactaagacacagtgattagctcaggatcacacagggcagaaatgctatgggacatgatatccagtcttctgtccccagtgctaggccttttctattacattgttcaggtggcccagtttcttcttttacattttattaaaaattgttttctgtcacccaggc

SEQ ID NO: 12259 - DNA, 2615 bp, Homo sapiens
atctattaagatacatatatcgatttgtatgcttttacatttaaccaacttcttcagttagccaactctgatctgggtcatgttttgtgtaaaatttcagtccagcagcttccaggatggctggggaattactgtaagcaacaaactcagtcaacctgcacatcagtcagtgccatagatttcataaataacacgtttcaaatatacataccatttaaaagtatatttaggtggtataaggattaataagatactaatagaatattatttaatttgtcgtaacctttttgccattgtctattttctcaaataatgaattctaaaaaatgccagacttaataggtcttaggtttttctttttcaggctctgtcaacagactcaatagaaagactcccagtgtataacaaagctgcctggaagcattacaacaccaaccacgaggctgatgactggtgcgtccccagcagagaacccaaagacatgacgacgttccgcagtgcctagacacacttgggacatcggaaaatccaaatgtggcttttgtattaaatttggaaggtatggtgttcagaactatattataccaagtactttatttatcgttttcacaaaactatttgagtagaataaatggaaactgaattccatttgtgcccgttaaacctcctaaaggatgaaattgcacctattttacacttatattttcacagttaattgaacatatttttaaacaactgtagttttgggcaacttttcactttgtggtagacttcagaagtgtggaaatcttcgggtttctataggaaactagttttttttttttaagaaatactttcatttatgtttgctagaaacattttctaaatgatagtgattagctggttagccatcttcctgttatttggaggagttctgccatcttttattcggtagtgacagctgtaatatggtcttcatgtttatcagtgacttgactacaagtaaagcagaaaacagttggcctgtaatcacagaaccagccacccttcggcgtctacatgcattgtcttagctctgaggttaatttaccatttttaaattttattgtaaagaagtgtaatgactagctctctgtggatctatgccaaaatcatgggccatcttttctaagtgtacttctgattaatgcaaggggaaatttttatactgaaaacaaacaaacaaactagcagctactaaaatagagaagaaattgagggcaaagtaatatgtctccaaaactgaactgattgcttgttgagattacctagaaagcttttggaaaaaaatagagcttttctgcatcctactccagatacactgaatcggaatccctagggctagagcctagaaatctcactttttaaaatgcttccaaggtaagtctgatgcctaccctaggttgggaaccactctttcaaagtaaacagtgatgacacagcatttgctaaagtaacatctgtaggttttggtttccacctatttaaagtcagatttatagactcgaggagacagaaactgaatcccacacctggtgcaattagaagcataattagaagcagaagaacaaaatgccacgtaaccaaagcatcagagccatcattgcacgtgtctttttttcttttttcttttttttttttcaagacagggtctcgctcttttgcccaggatggagtacagtggcatggtcaaggctcactgcagcttcaatcttctgggctcaagtaatccttccacctcagcctcccatatagctggaactacagttgtgcactaccacacccagctaattttttgatttcttgtggagatgaggtctcagtatgttcccaggctagtgttgaactcctgagctcaagaaatcctcctgcctgagtctctgaaagtgctgggattacaggcgtgagccaccacacatggcctattgcacaagtcttgacaaacaacatatattttctaaaactatccagatttcattatcagggaaaagtttgcttaggtttattacagcagtccttggcatttgtatggtaatttgtactttacaaatactttgatatattataactctattggtctttgaaacaaagcgatacagtgtaggtggtatcattctctttctcactcagtgtggcccagagttgctcagaattggagcagagcctgagacgtatctgcagatcctgtcatcagctggcaagtccaggagactgtgtcatttagagactgtgttgttagttatccctcaacatcttctaaggtggcaggaaataatattggaaataacattttaaagtaaaaattttaaagtttaaagaagagttttgccacttaaacaggggagctttgtctggaaaatacactgagttgaaacacttcatccttggaaggattatataagatgaacagttgtgataaatgtgtagattagagggatgtgaatgggcagttagtccagtgccctcatttaagaggccaagatcctgattcagaggaggcatcctttgcccagagctgcttagctaatctgaccaaatgttgggaaaaatgtctcacctaacccactattccttaattatggattttgtgaaaaaca

SEQ ID NO: 12260 - DNA, 1222 bp, Homo sapiens
gaatctaagtatttgtttcctaaatgaaacatttgtacaacatttgatgtttttacttatgaaatattctcctcccccaagaaaatttaaactttttctctctatttaaaagctaagaaatgttttaaaggaaaaatgaaattatcttcctttagcttatttttaaggtaaaacagctttttactctgttattgtggtaatggacagaatattacatacaaaaatattctgggagagctttttcctagttggttttaaatcattgtgccacctgaaaggtttttagattttataggagctaatttgtccaccagcattaatgtaacacagtgtagttatgaaaatatattgaaggacaggaagtggacacgaagtgatttttgtaacctgagcagttaatgaatgtgccaacattttctaggaagggacagcaagaatattctgctctgtagttaaaatactggctggcttttgatgtcttcatgcttaattgtgatcactttcttgcactgtgatgtttttacgtgaatatgttgaagtagaagtctaccatattattttataaaatgttttctgtatggcaataaactgaaaacatggatcaacccttcttttgaaaataaactgagtcaatttagccttttaaaaatatagtcatctcttttaaatagaatcctcttccaccatcaaggctcaacattttgtaagcatccaaaaaattggtaattagggggcttgcactaaatttcactatcttcagtagagaggaactgtttggaacttagatttccaatgtgtatattctaatggagaaagcaagaggtagagtttgtatgtttgacttaccttagatttttattttccatacatactgcaaatgattgacttgttgcataaatgaagatcttctgttgtgtgcttttcaaacactgtaaataaatttgaaatttgaataactttccacagtataactgtaaaaaaaaaaaaaaaaagtcttaatttaaccagcattaccctctgcttgtaccaattgaatggcagaactactatagtcaaaaataaattcctatcctatttttaattgatgggatataggcagcacaatttcccttcattgttgaagccaacaagttccgtaacagaactccagaggtaaatagctgggaaaactgttagttttaaggtcccactgttgctctgtgaatgactaatcagaggaagc

SEQ ID NO: 12261 - DNA, 1162 bp, Homo sapiens
atgtaagtctaaggatcaggcaggtaggagaaccctaatgtactataaccaccaccccttacaaccaaggaaactgagacaggttagtcaattgattgcttgggttactcagccaatgtgtagcctaaagtgtcatctcaaccacttactgatggtgtgttgttgaccacctaacctgaatatcattttcccacctatactatgagattaatacctgtttcttgggactgttaatgggaataagatgagatcatatataacatcacttatgaactgtaaaaagctagataaatgtaagcatttactaaatggctgtaccaggacaccagctccataggttatgctgcaccccagtggcccttcaacactttgttgaaatattttgagcttatttttccaagctagaaactacccttgatatttaaggacatgaaagattccttctcctccggcagttacctggttgattttaaagcaccagcatgtgtcttttactttgattagcattctgatggacccactaagcgcttgatgtctcttaagtaaagttgagacttacaccagctatccccgtgcaggtgcgaaattgaggcaactcttgagaggctaaagaaactagagcgtgatctcagctttaaggagcaggagcttaaagaacgagaaagacgtttaaagatgtgggagcaaaagctgacagagcagtccaacaccccggtgagtaccctcccccttcgccgtctttccacatgcggctctaggctgcgcagctgagcatggcagcatggcacctcttcccctgcctcccgccgccccctcctcatttcctgcctcgcgcccgtgtattaaagggcccgcgtgtggactcaagcagcgttcatacctaatttcaattaataaaatgccagagatttaaaagaaaagcttatcctatttctggctccttccttaagaactgttattctgtcagtgtgtttatatattagaattacaataataaaatccgatgtattttcacaccatctgctcagtctcagaacatgcacctcggtgctgattaactccttctagtcactcagtcattaataactgtaactccagcagctcactgactaacagagtctttgatgtgtcagaacttaaccatgttttccttctaaaatgg

SEQ ID NO: 12262 - DNA, 1225 bp, Homo sapiens
aaggaggacaaggcccatgggtgggtgttgaggtttttaaagtgtggtcaggaaaggccccactgataaggtaacatttgagcaagtctgaaaaaggcaaggggatctttggggctaacttcgggatccctgcactttatgtaagaatgtaaacctggagtctcatttaagaatgatcagcaatacgtttagaacatatgaactgaatgaaatggacattttttcttaatttatgtataaatccatatgattatacataaagttctgatgcattaataaaagcagccaaatagggccaaagagaaaaataacaggactctgtactggacctaactttatcattaattaggtaatattttcctcatttctttactgctgccattttcctcaccagtattccagagatggtcatagctcattactctaccaccaagaacctaaaaggaattagaatacagcagaattggcctcagtgaagagcttaaaattgttctcctcgtagaactggactattgatcattaccacgtgacgttggctctattactttctgttcccaatgtccttctagtggtttgaaaatgttaaaacatccctaaaatctaaatcatataatcagaattctatagtgtcccactctatctgtaaagatcatttggaagactttagactctattaattttaaaaggaatatttattagccatatgcagaatttctaatgatgatattgtacagcttctaattcacttttcagatcagtgtttgaaatggcaattatcagtgttggatttagttccaactacttgatttacaaaaatgtacatttagaggttaaaagaaacagtgagaaatgtaaacattcaaaatgataattgaatctctcagttgtgggaataattatcagagacatgcaactgaaaatgtctcacctttcatctttttttcttaattcataaagttatcttgtagaatttgatgagaccctccctagtcattctcaactggggcggtgctgtcaccgaatggtgtttgagagtgttggggctagggcacatttttggttgtcacagcaactggggtggcatttgctgcccagtgccaggaatagtaacattatgaatgccagggacagtgtgctcagtaaagtcttccatccaaaaggggcagggcacggtggctcacgcctgtaatcccagcactttgggaggccaaggtgggcggatcac

SEQ ID NO: 12263 - DNA, 1343 bp, Homo sapiens
atctgcaactgcagtttctgccggcagcgagatggacggtgtgcgactggggtccttgtgtatttagccaaatatcatggctttgggaatgtgcatgcctacttgaaaaggtagtgggtgtttttttttcccttccacatctgaattttatattcatttatgtcttaatgagaagatgatagatgtcagaagagtggttatctctggcggggtggagactgactggaacggggcacactggaagggatgggaacattttctgtcttcacttaggtggtggtaacccgggtgggtgggtgtgtatgaaaaagtcaggtaatatacttgaagatgcgcacacttgaccatagtgatgttataactcaataaaaatggttttaaaaatgaattaggctttcaaaagagaattctttggttgaaaactatgtcctgacacatttccttttgtttttcacagcctgaaacaggaatttgaaatgcaagcataatatctggaaaatttgctgcctgccttctacttctcaaatctttcttgtaaaagtttccaattttttcactgaaacctgagttaaaaatcttgatgatcagcctgtttcataagaaactccaatcaagttaatcttagcagacatgtgtttctggagcatcacagaaggtatattgctagttacactttgccctcctgcagtttcttctctgctcccaacccccatctcacagcatccccctctatttccaatgctcctctccaaccgcttagtttctgaatttcttttaaattacagttttatgaaagcatattttatttacttggtgttgaaatagccctcataaaacctaagcacttggaaacacaataatagtattaactaactagatctattgaatttcagagaagagccttctaacttgtttacacaaaaacgagtatgatttagcattcatactagttgaaatttttaatagaatcaaggcacaaaagtcttaaaaccatgtggaaaaattaggtaattattgcagattgatgtctctcaatcccatgtattgcgcttatgttacaagttgttgtcacagttgagacttaatttctcctaatttcttctgcccgaagggtaagtggtgcgtccagcttacacaatcataattcaaaggttggtgggcaatgtaatacttaattaaaataatgatggaagagctatctggagattatgagtaagctgatttgaattttcagtataaaactttagtataattgtagtttgcaaagtttatttcagttcacatgtaaggtattgcaaataaattcttggacaattttgtatggaaacttgatattaaaaact

SEQ ID NO: 12264 - DNA, 1227 bp, Homo sapiens
atttaaatataccacaaatatatcacctttttgttttcttcatccagacaggtgatttggcttctgcacagttaggaggagcaccaaaccgatgggaggttttgtcagccacacctacaactataaaagatgaagctggtaatctagtccagattccaagtgctgctacttcaagtgggcagtatgttcttccccttcagaatttgcagaatcaacaaatattttccgttgcaccaggatcagattcatcaaatggtacagtgtccagtgttcaatatcaagtgataccacagatccagtcagcagatggtcagcaggttcaaattggtttcacaggctcttcagataatgggggtataaatcaagaaagcagtcaaattcagatcattcctggctctaatcaaaccttacttgcctctggaacaccttctgctaacatccagaatctcataccacagactggtcaagtccaggttcagggagttgcaattggtggttcatcttttcctggtcaaacccaagtagttgctaatgtgcctcttggtctgccaggaaatattacgtttgtaccaatcaatagtgtcgatctagattctttgggactctcgggcagttctcagacaatgactgcaggcattaatgccgacggacatttgataaacacaggacaagctatggatagttcagacaattcagaaaggactggtgagcgggtttctcctgatattaatgaaactaatactgatacagatttatttgtgccaacatcctcttcatcacagttgcctgttacgatagatagtacaggtatattacaacaaaacacaaatagcttgactacatctagtgggcaggttcattcttcagatcttcagggaaattatatccagtcgcctgtttctgaagagacacaggcacagaatattcaggtttctacagcacagcctgttgtacagcatctacaacttcaagagtctcagcagccaaccagtcaagcccaaattgtgcaaggtattacaccacagacaatccatggtgtgcaagccagtggtcaaaatatatcacaacaggctttgcaaaatcttcagttgcagctgaatcctggaacctttttaattcaggcacagacagtgaccccttctggacaggtaacttggcaaacgtttcaagtacaaggggtccagaacttgcagaatttgcaaatacagaatactgctgcccaacaaa

SEQ ID NO: 12265 - DNA, 1603 bp, Homo sapiens
agcaaataaagcagcttttaactagttatatagtctttttctttctgcctggtttgatctgttttgttacagtgacttgctggatgtttgcagacacatcagaaatgtaccataaacagcgtgtaatgaaacttaatgatattggtataattacatttatgtaccaacaatttagtggagaatacattatgattatgtatatatggaaaatctagttctgcccaaatcaagaatactttgcttctctccaagtctagttttgaacttgtatgccttcctatatttcattttttctttttttatatcacccaagtagtataatactttttatatctgctgccaccatttaccccatgtatttagttgtaaactaataacccatttcctctatattttctgtttgcaggctgctggaaagtacagacaacaaggcagaaattatattgttgaagatggagatattatcttcttcaaatttaacacacctcaacaaccgaagaagaaataaaatttagttattgctcagataaacatacaacttccaaaaggcatctgatttttaaaaaattaaaatttctgaaaaccaatgcgacaaataaagttggggagatgggaatctttgacaaacaaattatttttatttgttttaaaattaaaatactgtgtacccccccccccccatgaaatgcaggttcactaaatgtgaacagctttgcttttcacgtgattaagaccctactccaaattgtagaagcttttcaggaaccatattactctcatgatacttcattaatctccatcatgtatgccaagcctgacacatttgacagtgaggacaatgtggcttgctcctttttgaatctacagataatgcatgttttacagtactccagatgtctacactcaataaaacatttgacaaaaccagccttggtgtgtttggggatgtctgtattgactgactgtggtgtgctgaatgcgatacggcacctggtggttgctgattacagaattttaaggcgtgtgtatgacacagtaactggcagtgtggggcagctgcaattgtatcttaaaagtgagtctttcatgggaatcagaagaatagtataccagggatttgtctcaaaaaagttaattaatttatagatcaacatttattgaaagatgatagcaatgatattatgagggatatgagataggtgactgaccacaaagaagaaaattctgtctcaaaaattaaagaattttgtttgttattgttgttctgaccatattgaaaagaggttcacttttaatctttcctttgaaattattaaattgtaaaaactgacccattgatgtctggtgggttatgttttgcttcaattcagcaatgtgtataaaagttcctacactgattttgaaatactaagatcagactttgaaaattttaaaaattctttcattcttacttttcagatatttgagagcagtcgaagtggtagtatgggtaagttaagcacttcttaacattgtagcagaaaattccaaaagaaagactagaacaaattggtaatttggagaccctttgccacttagccttctcttgtgatgatggcctgaa

SEQ ID NO: 12266 - DNA, 2711 bp, Homo sapiens
gtacagagcctgctctttcacagatcgttatggctccttcctcccagtcacagccctcaggaagttgattaaaaacctgcagtacaacagttttagatactcattagtgacttcaaagggaaatcaaggaaagaccagtttccatttatgcgaaatctgtggttgtaaattttttttttttacttgaaattaaatttggctctaaagttggtgtagcagcagttgatcagactgaaaaacggtttttagtctctggaaaaagactgattttgctttttttataaatattattagatttattaatttttctgtgctcaatgtgtaaattgtattataattcattgtgatttatttcacttttaatttgctggtgttttaataaatgggggtgttactgaatctttcttcccacttccatttcttttgaccaccccttaaccctcaactgtgacggtagtagtattatcatttataccaaagttttgcatagtccctgttgactttgtaatgttaacggagtcataaaagcactaggcaagagaaagatagaaatttgcttttaatctttttgccttttattttgcacattatgcaaaaggaaaaacattaaagaacacttttttttaagtgagtgaaaacatggtaaagacatacagtgcttttatgcacattgttaagctaaatcaaggtcatttataatcattttccttttttatttaagattttaagtaaacaaattttagaattttcagcatttcaaaaatgattttatttttcaagtcttaaattcaatattttacacctatgttttgaggctaaaaatatgaaattatataatgtatgatacagggttatcaaatatctaataatttttgaaattagctcttgtttttggtttttttgttgttgtttttacagatttcaggttacaaactgcaaagtttatgcataattaagtatggtatggttgccagaaaagcctaaaattactacttagaaaatttaagactgtttacccccattgtcttgtacttgcgagctaacttgtactattcttgtgaaagcactgtcatcttttagtagcaaattttgataatgtttctcgtggaaaaaaaaatcagtatctatctttagaacaatgtaattataatgtgggaagtgtgcatgaatgagagagagtgtgtgtgtatctgtgtgtgtgtgcgcgtgtgtgtgtgtcttttaatagtttatgccagcaatctttgcttgaatgtttaacgatgccttcagtgtgatgctggccaatagatgattgcagtttaaaatgtcattattgtgcaggcttggataactaacattccatgatgtagcttgtttctgatgagatgattgtaggtacatttttctcattatccaatcatctgtgggatacttagttttctaatgtgccattatctatttttattctgcagttatgttcaaaatacagtacatattttaaaatagaataaattgttaaacataaaattttaaaagtagtagatgtgcgtaagaaaactttgtaaaatagttatgagtcctacccagtagcaacttctggcattcaagcaggattccactatgtaaatatctgtaatgcatttataataagttgtgtagtttgtcctgcatccatactacactatttgctaaagtctcagtgccatctcctaatgagactgacattttaaaagtctgtatggaatatccttgataattcaaggaaatatccctcctgcctaagttccaaactgggaaacattcaaattatataaatgacatttcaggactttaagtatgaagataatgggaattttattgttttgctttttaaaatgagagcatttttatttgataattttttttaaatttttaatttttaactaatttcattattttaaagtaatcagtttttcaaatcatgattttgatatcattattctaaggagttatctcaaaggcacaaaatatgaattctgcaagaaggctattttttattgtagtttgaatgggttaggaaaagcctcaatttttcactcttaagtccttcagtacatttttctttcatcttattacttatgcaagttaaggttctttggtaacagaattcttgcaactgtaaaataaaactacatagatgtaagaagtcatgtaaacggttaacaagcttaccaaggttagcaaaactttcattgtaaatcagtctgtactgagcaaataaaaatcattattagttgtataaacacaaattccattttgactttcaggatgtcatactacttctgtacctagcattttcagtccttatatttgcaatgttacacaaactgtactattttcttttatgtgcagtttgcatgagtaaaccatcagagaataaattctatctttaaattatgttcataatttgcttgttctcttacctttccttcataaagtaacatcaccagataatgattttttttttccttcaggacatttattaactgagaagaacctgagattctttctagttctgtgataaaattcattcattccttttaactgcagggtacttgggccttattcctctctgcactcactttgcatcccatttatatataatgaattatataattatataattcatatgtaattccccacacccctgaactttagtcacagatccacctgcctttggcatcccttgg

SEQ ID NO: 12267 - DNA, 1252 bp, Homo sapiens
aagtgccgttcagccttttcctccaggggtgctttgtaaacacggctgtgctcagggctcgcgggtgaccgaaaggatcatgaactagtgacctggaaaggtgagtaacgatgggcagaggtcagcagggctggagactgtagggatacggagaaagaaggcgctaacatggcgacgtcgctcagcacagtccccaccccccgtttcccatcacctcgggtgctcctgacgtgctccttagcccttggggcgattgtggctgtgctgccacctcggcggcccgcgcggtgtgggctttgggaacctgactggctgggccggaccgttaggtaaccagcgttcgttgttccggcccctccctctcgcgcgctttcctaaggcagaggaaaaaggaataacggctccctcttagacccctccctccgaattatcttcaccctacttgggtcagttcagaggtcctcggggcgcgcgtcgagtcagccgtgtgcgcagggagacctctcccacccacagtccttgggttgggcggggagagggcccactctggtctccccacccagtattcaagcgattgaggaccgtgtattggtgatggtggcggggaggaggatcgggaggcgcggctgaaaatagaatcagggtccctggctgcggtgcagcttgaaggaaagaatggtgtggagaacctaggagctggaagtctcggccttttccgtcctttccgccaccctcacaatcccgctacccccagctttttcccggtggggcggggcttaggtgtgggtgcagactgattctggtattttcccttatttttttttttttaaatctctgggtggacagcagagcgtatgtaaagaaataatttgcttttcatcaatgccctagggaccagggccgaaagggagtgtgtgtacgtgttttctatgttcgctcgtttaaccgaacctaggaggaaaaagagaggaggagctgggaactatttttgtgcccctaggtagtataaaattggctttctttaatggagagtcttaaaactggtgaggccaagagcaaaactactgtgaatatcatggagtaaaagagattactcctgatggaccttaggcatcagaaattttagtgaaagaaatgtttctcttaaaattcaacacctattttaaatagtgatgtaaagcatttctttacatgtaccttcaggttttctaatgctttcctggctattatttaactggtactaagggattga

SEQ ID NO: 12268 - DNA, 1252 bp, Homo sapiens; identical to SEQ ID NO: 12267

SEQ ID NO: 12269 - DNA, 1257 bp, Homo sapiens
acagaggccacattacttgcccaggtcatagctagtaaatgtcagaaaatgaattttaactaagtctgacttcagagtctgcattcctaattgttaagctattttgggaataaaattattagagcacattccttaaaaggatcaatttattttatttaagacctaaactgtcagatcttaaaaggtatagatcatattttcagatggataagaatgtcagaacccatcaaaatgaatgaaaactaaccatttatattgacagacagctccctacctttacaccatattatcaggattgaaggagaatagtgtaagagagatctaggcaaatactcttccagcagacttttcagtttacaaaaatccccacactagtaatctgattctttaacatttaccaaacatgttgaaattaatatttcaaagtaacagtcatatgtggtctcttttagaaacccttcgctgaagcagcagctgttctcatatgctatcctgggatttgccttgtctgaagctatgggtctcttttgtttgatggttgctttcttgattttgtttgccatgtaacaaattactgcttgacatgttggcattcatattaattacggatgtaattctgtgtatcttactgtgactccgaaaactgtagtattggtgtcatgggaatgtacgttatttccaaagtcatttcattaaagatgaaaactttaatttcttctgtgatttgtacttacactaagtttagattatcacaaagaagaacgtgcattcaggcagatgctgtcccattcagaggaagctacagcagttgctccactgatgaaaaatattccaatgtaatttttatgggaattcttttatatagtgttctgcatattgtaattcatagggcttttgtttattcatataaaggataaatatttgggtgttttgagcttctataaaatatgattaattaaaggtagttaatactcaagatggtcttgagtttttaaggtctaacatcagttagaatacttcaaatcagaatcaccttccaagactgacttgacaggtggttctaaaaataaatcacgtcagctttttaggaaatgaagccttaagctagggggtaatgtgacttttgtttttcagtaagtctcacattaagcaattgtgtgcctctaatgaatcttccatgtcttttcagaacaggctcagtccaactagcagctagtttcttacttgaacaagactattaaaaaccaaatatcaaaa

SEQ ID NO: 12270 - DNA, 1462 bp, Homo sapiens
taagtgttggtgttccttaagttctacctagtgtcatcatttcttcattctgcatattctttccctagggtttcttcccaacaccaaaggacttaccatctgtctctctgaatctcagatctccagctttgatctgtttcctttactttagagctatatatttgcctgcctactggcctgtctctcacaatccatatattcaagaatgaacactatactttgcttcaaaccttcagaacattcaaaccgtttatgtttctcatctaatcaaatagagttactctctaagccagaagctgtaaactcatctcttttccctttattcaagctgtcaatttttgtctcctaaacatcttctagttatattctcatttctctgttcacattgcattaataatgatgataaacatttgcattcttattctgtgccaggcaacatgctaactgctgtatatatattattatatttgtactttggcaagaatcctgtgaagatttttatctttggactactagaagagaaagctgagttgtagagagagtatgtatttaagtccgtttgggctgctataacagaataccacagactgggtaacgtgatgaacaaaaatttatttggctcacagttctggaacctgggaaatccaaaggcatgatgctagcatctggtgagggcctttgtgctttgtcatcccatgccagaaggcagaagggtaagagagggcaagagtgagcaagagatggaagttgcaacctcaagctcttttataatgagcattaatccattcatgagggcttcaccctcatgacctaaacatctccattaggctccaccttccaatgcaacagttagcataagttttcaacacatgctttttgtagcattcaaaccatagcaggaagcaactttgcttaaaattgtatacctggtaagtggaaaaagagggatttgaatataggcaaatgacttcagaggatttactcttaatttctgttgtactgccttctaatcttggcctccatcatttcagattaccaaagctgtctcttaactggtttctttgtctccaaccttgtgcacttgctatctattctgtgtgctgcagcctgagtttttaaaaaacagaaaatgaggggccaggtgtggtggtggctcacgcctgtaatcccagcaagttgggaggctgaggcgggcagatcatctggggtcaggagttcgagaccagcctgaccaacgtggagaaacactatctctactaaaaatacaaaattagccaggcgtggtggtgcatgcctgtaatcctagctactcaggagcctgaggcaggagaattgcttgaacacgggaggcagaggttgcagtgagcagagattgcgccattgtactccagcctgggcaacaagagtgaaactccatctcaaaaaaaaaaaagaaagaaagaaaatgaatctgccacgccat

SEQ ID NO: 12271 - DNA, 1445 bp, Homo sapiens
gtttctttttgatgtcttttattttacaactgggccaaaggcacattatgtatataattagtttatatttacacactagcatataggaaatatttctgcacttgaccctatttgaattctgagcattatttataagtataaaatgatgatatataagtgaattttgtgctcttgtttgtattttattaaggaaaatgaaaataatctggcatcagtttcattttgctaaatatctagtcttcttcaaacagtatcttggtgggtgacttggctacctgaaaaatcttaggaggaatagctcacaatacaataaatctgtagattctgcttagagcaaattatggtacttttattcagacttgtttcctttctagttaacagaaatagtgacatttagaggttttaatcagaagttaggtttttctgattcaggaacatcgtaggccagccatttgtaatttttaactttgagaaacaaattttgtgagaataggtagtgggttgctggtagttaattggatttaatatttgtattaaggattaactggaaaaaatgtgtctcagtgctaattcttggacctttaatacagtgtgcttatctgttacggcctccttttatctctcttctccaatattaaaaaaaatggaaatcaaattattatgctgaagggaaaaatatacctgtataagaatggtgtgtttggctaatgtttctaagttgcacacagtttattaacaactgaacaaaacatttttatcatttaaaaatctatttttatgatttaatatctcatatgtgacagtttttttttttttttttttttggaactcaatctgttaacagtctgggacatccggtatagtaaccagagtttttgagcctgccgtattgggcttaaatttcaggtctgtagtcttgggcaagtcacctataaactcactgagattattttttcatctgtaaaatgggaagagttatgtttatttttgaagggtattaggataattaaaaataatgtaatgtgcctagcacactacctgaaaacgatggcatttgttcttattaatgtctttaaaatatgcaaggaccataagtttttcctcttgcagatgaggaaagtaaaaaataatacgaacatgtaattcagcttctcagattcaagccaatgttttttgcatcaacttttctatattgtatgtatgtatataaatacatagattaaggaaataggaaactgaaactctgtggaatataaactttttaaaaataatttcatcaggttttttgtatgttactgacccatatggattttagtaacatcttgcttagtcatgttgttataaaacattcaaattctgatatacattgcttgaaaatgagtgagtacctcagagaaatttgatagactcaaacagatagtatgagaaatatctttgaaagaaat

SEQ ID NO: 12272 - DNA, 1129 bp, Homo sapiens
tctgagctagtgatttgcctcaacaacgtaaacttcctaatgattagcacttaataattgcatataaaatgctttattaattaaacaagtgcacttgaacattttaatatttgtggtgagtaaattaaaaggagtttattaattaaaaaaaattatgtctgcagaatactttatattatttgattacaatgtattatttatggattttttattctttcctttataatgaatagttcgggtgcgttttgtttactcctaaaaggtttctttgcgtattttctaaatgtaatatctcggggaaaatattagaaaagcacgtattagctgaagaatgtaacttgtagtccagctctgcagcttccttaaacttaagaaaaagattgggccagtgacaagaatttaaagacaatgtccaagttgacaattatttttctatagtccatacaaattaaataatctggcaactctggcaaatcgccttgtaaaatgcgtctcattttttaacttgctttcgttttgaaccgcccttgtaatcgcctgaaatcgctagttctttatgcggtggctgccgctgtgttccgttattttcagtaggtgtcatatttatttgtattgcctttgttctgttcgccgctggttttaaaccagcttgctgtgtgcatctcagacgtcggttggtacgtcctccgctgttcttcaggaaagcgatagcctcacctatttgaaacaagccctgagaggaaacgcagaaaaacctgagtgtaaacaactccggaatgtcgctagctccttagtaaataaatgaatctctttctggagctagtgtctttgagcgccgcaaataccccttttccatgaatcactaacaatcgcctgggctcgcacgaaggaaaggactcgctcaaggcttctgtttaataagaaaggggtggggttacacacattccgcgctgtttaaaaaaaaaaaaaaaaaggccgcaggggccccttctttttcagagaggactggctagtctatcttgctctaaataatcttgctaagatgctctgagagctttgatcctcttaaaggactcaagttgtaggcccagtgggggacaacgcaaagtccatgttacaccacagctta

SEQ ID NO: 12273 - DNA, 1102 bp, Homo sapiens
taaaggcaggtcatcgtcctcatcttcctcctcatcttgctcctcctcagtcgcccccagccagcatttacagccgatggccaaagaccaccacacggacctgacgaccttatagaagtggggaccctgggcccatctctccctgcgcaccaggctgagccgaagctgcgggggcaggccgggcctgctgtcacctcgctgggctctaaggtactgtggggtggacctgggacaagcaggccgccctcggactaggttagcatcctgcccgagggcagccccctccctagagcgggatggggatgggagggggggcgggattctctctctaagtatattatatggcaggagctactgagaacataaaatcttggcgagtcattaaacttatgaaaatcaccgctcttggattttgaatttgcaaatgaaggttggatgctttatcccactgtgaatttggacattctcccccactccacccctccagggtgctttgtggcttaataatgtgggggagttgaggcagaaggttggccacccctgtgctaggtgctttcagtggaagccagagagctgggtcaggatttctggactttctgggttgtctatggaatttcatgtgattaaaaaatatatattttgctcccagtggccccacctccaaagaaatgggtctaagaaggaagtaaaaatgggttattttatgtttagatatttgcttaaatatttatttgttgggaaatgtggtacagaaataactgacaccttcatgccaaaaatcttaaaaaggtgaaaggggctgaacttcagggagcagaatcagagatatgtgcacttacttctgaactccacccctccccactctctggaaatgtatataggggggccttaacccttccagaaggaagcaaaggattcactcaaagttgcattcttgaaaatatatttccacatgtgtttttttcagcactgtgcttacaaccagttctgggtgattaaaggaaagggaaaaaaaccaacaaatggtccaacattttccttctggggaaagaaaacaaaacctctatgcactgggtcattagataatgactgaattttctgt

SEQ ID NO: 12274 - DNA, 1459 bp, Homo sapiens
aggtatacttttcttattactttgctaatcgtgaattccacttttatcaacacaattcagaacttgtttccaactggtaggatgaaaattgaacatatgtgacactcaaatgctcaattccctgttgaagaaatgaatgatagaccttatctatcatttatttgactcatgtgtacacccatgtatatcacagacatttttatttaattattcaagaattggcacatgagaagcattatctaattcctctgggaccttccactggcaaaaataaatgcaatgactgtggctaccagatgaattttgccctttttcttatatttgaaagtaatgactttattatttctgaatttaattatttaaattttaagcaaaacagaaaatcactacaaagaaaaaaatgtcaacaaaatcttactatgtagaagaaaccgaccccttccctcagctgccgccaagctgctcggtccttccgaggaagctaaggccgcgttggggtaaggccctcacttcatcctgcgactagcaccgcgtccggcagcgcctgccctacactcgcccgtgccatggcctccgtctccaagctcgcctgcatctactcggccctcattctgcacgacgatgaggtgacagtcacggaggataagatcaatgccctcattaaagcagccggtgtaaatgttgaacctttttggcctggcttgtttgcaaaggccctggccaacgtcaacattgggagcctcatctgcaatgtaggggctggtggacctgctccagcagctggtgctgcaccagcaggacgtcctgccccctccactgctgctgctccagctgaggagaagaaagtggaagcaaagaaagaagaatccaaggagtctgatgatgacatgggccttggtctttttgactaaacctcttttataacgtgttcaataaaaagctgaacttaaaaaaaaaaagaagtaaccatcattaatattaggtgaacatctttcttgacagctctatgtagacactcagatattaggagtgatcggtgcataaataacttggtacatagaaataattttataaaactggatacatattatgcatgctatttttaaataaaaatattaaatttacatttacttagacgtaataagagagagaaaccagatgaaactaacagataactgtttcttcttcactaagagagccctctagaagtatgggagaaaaatatttacaagtttggatttttttagcaatccaaatgtgttgttgaactttattaaagtgttcctaaaattaaaaatataacaaataaatcagttgggcatggtggcacacacctgtagtcccagctactggggaggctggggcaggaggatggcttgagcccagaagctagaggctatagttagttatctataattgtgcctgtgaatagccactgtactccagcctaggcaacata

SEQ ID NO: 12275 - DNA, 2217 bp, Homo sapiens
attgtggtagtggtaccaggaataaaaaattaaggaatttttaacttttcaatatttgtgtagttcagtttttctacattttagtacagaaactttaacaaaatgcagtttcgaaggtgtttccttgtgagttaacaagtaaagaagatcattgttaattactattttgtatgaattttgctaaagttaactgtaaagaaacacctgctgacttgcagtttaaggggaatctattctccccatttccaaaccatgatatgaatgggcgctgacatgtggagagaatagataatttgtgtgtttgcaatgtgtgttttagataaataggattgggtatttaaattagcatttgtgaatttaatagcattaagattaccttcaaatgaaaaaaaatctcaaaatttctatttggtttttgtgcattttcttttaaaatgtaatcatatgattttagtgtgttagacttgctgagtcctagctgtgtttagaacatctctattctacatttaccttggtcaaatttgaactgctgccataggttttgggtgtaaagaatgtttactgccctccatttaaattctgaaaagggatggtggatgttttccctctcctacgttagaaaccattcttaaaaacttttgaaaatatagaaccattaagcctgctatatctgagcaaattagtgggtaccttttttttcttatttaaagcacaagaggcccataaatcttgagttactttaaattcttttttttgatacaagttttcagagcaagagaataaaaatcatgtgttattaaacccctaactggctggcatgctttcctgtttgtattctatacattttgctggatgaaaccaaggatagttcaggtataattgtccaaaataacctaactgcagcagaaatgtagcacagttgcttagtacaggcttctcacttcctacagacctgaattcaaatttggatagtctgagttcttaaattcccaaagaacacactgttatttcttgtgtatatttcaacataaatcatgttgttaccaatttgtttggaaggccctggttgagaagagttttagttaataaggtcatatatacatatattaatataaaccaatgtctactgttttgctccagctagtgcttacagtttcattcgagccctgagtatgtgccctgctgttactctctttggtagttgaacgttgaattcaagtcttttgttttaagaagtactaagcaaacaagcaataaaaaggggaatggggtgtgctagtgtttgaatatgctctcttgttgctctaattctgtgcctctgtgcattaatatttggatgcatgcaatgccagcatggaaattggtcttcacacatactgcagttttccagaaacattcacaaaccaataaatgtaacagacattccatttgttaatgggcatatatgtgaaaagcagtgtagaaaataggctaatattagaaaatggttaagtcctaaataacttcaagtgtggttatataatggacactgtcaatgttcataacttaaacctgggtacctggtcaaaataatgcttgggaaacattaaaattgagctaaattgtctcaagttcttttattcatataaataaagtttaaaggaatgggggagattaacatttcctgttttatgtttgtgaaattgtttgacacaaccttgacagtatcctttaatggcatgaggttaattgtactgttaaccaactttctatgttctggaactagtattatagtgaaaacatttacagtaagttgatgtttacaacctataagcaggtgaaatctgtgtatgtgacctgtttataagttgtattagcttagctcttgtgaacagtgtggaaaagtaagccatgaggagagcgatttaaccacctttaaaggacctaagatgtgctttttaagcacagtgtggatcacagaaactcactaagacaggacttcagcagccttttgtgtttggacaagtcagcataaataaagaatgacaaggcagcagcaagagcttcaactacagagaagtgaaggcataagatactatgatgatagtgagcaactttccaaaagctagttaaatctgcttattacaactgaaatatcgaagaaagtctagcaggaaggagctcttcgccttttggaacatcaatgagagatagttgccacagtcactaggtctagca

SEQ ID NO: 12276 - DNA, 1613 bp, Homo sapiens
taaatatgtattggaaatgagaattatctctgaattatagataataaattatagagataagcctgaagataatgtgggtagggagtttatctaaatttatcacgtattatcatggattaactttgatttatatagtataaacttccttctcatgcagtgtcttaatattgaaaatgacaagctggttgagactaccatggttccaagtccagaagccaaactgacagaagttgacaattatcatttttactcatctataccctcaatggaaaaagaagtaggtaactgtagtccacattttcttaatgcttttgaggattccttcagcagcatcctctccacagaagaccccaaccagttgacagtgaactcattaaattcagatgccacagtcaacacagattttggtgatgaattttattctgctttcatagctgagcccagtatcagcaacagcatgccctcacctgctactttaagccattcactctctgaacttctaaatgggcccattgatgtttctgatctatcactttgcaaagctttcaaccaaaaccaccctgaaagcacagcagaattcaatgattctgactccggcatttcactaaacacaagtcccagtgtggcatcaccagaacactcagtggaatcttccagctatggagacacactacttggcctcagtgattctgaagtggaagagctagatagtgcccctggaagtgtcaaacagaatggtcctaaaacaccagtacattcttctggggatatggtacaacccttgtcaccatctcaggggcagagcactcacgtgcatgatgcccaatgtgagaacacaccagagaaagaattgcctgtaagtcctggtcatcggaaaaccccattcacaaaagacaaacattcaagccgcttggaggctcatctcacaagagatgaacttagggcaaaagctctccatatcccattccctgtagaaaaaatcattaacctccctgttgttgacttcaacgaaatgatgtccaaagagcagttcaatgaagctcaacttgcattaattcgggatatacgtaggaggggtaagaataaagtggctgctcagaattgcagaaaaagaaaactggaaaatatagtagaactagagcaagatttagatcatttgaaagatgaaaaagaaaaattgctcaaagaaaaaggagaaaatgacaaaagccttcacctactgaaaaaacaactcagcaccttatatctcgaagttttcagcatgctacgtgatgaagatggaaaaccttattctcctagtgaatactccctgcagcaaacaagagatggcaatgttttccttgttcccaaaagtaagaagccagatgttaagaaaaactagatttaggaggatttgaccttttctgagctagtttttttgtactattatactaaaagctcctactgtgatgtgaaatgctcatactttataagtaattctatgcaaaatcatagccaaaactagtatagaaaataatacgaaactttaaaaagcattggagtgtcagtatgttgaatcagtagtttcactttaactgtaaacaatttcttaggacaccatttgggctagtttc

SEQ ID NO: 12277 - DNA, 1144 bp, Homo sapiens
tattctgatattcttaaattagatagtgattgctatgttaacacagtgcagatagtatttgcacaatgccaggacctgtatatgctgtttttttacatggagtacctcatttaattattgtagccaacactttatgtattattactattttacattttacaaatgaggaaacaataagcttagacagttaaataatttgcctaaggtaagagaaggaatttaaattaacctctgaataaagacagagtctatgttttaagccaacccctgcataatatgctgcctttgttactatgttgtcatgttgtatagtctgggataagtggacttggtttccagtgtgggtggttgaggggaacccttcttgcttaatcactgtcttaccacttgttgctttgaattaggaagttatatttcctgagaaaatattagtagttcctggagatcagatttctttcttcctttgcaacagaatcgaattctctgggttgatgagaacaatttgacagctcatgtagaggctggcataacaggacaagagttggaaagacaggtatgttatttatttttcttatttttttaaattaacttattctaatatcaattctgatgttatttctttaatgaaagttttcaaaactgtatcccctctatgaatgaaataccttttatgatacattcattcactcaaagaatttgtttagtttctattatgggtcaagcattgagctagattctgaggacatgatagtgaataaggcattgtctgctaccttcaggtagcttagattaggacagaaagttcgataaataattaattatttggagtgaaaattgctatgtggatgctaaatgcagggtattatggatcatcaaatggggctaggtgggaacgagttgggcaaagaaggtatcacatagaacctggcattttttttgttgttgttagtactgagtcagtggcaaaggacacagcatttaaaatgagacttcaggatgagtctgagttagcaaaaaaggaaagaacaatccagaggaaggagcatacatgcagggcttctcagggtgactgttactttttttttttttattttttttgagacggagtctcactctgtcgcccaggctggagtgcagtgacgtg

SEQ ID NO: 12278 - DNA, 1137 bp, Homo sapiens
agtttaggaaattatgtacaatttctgtttttaaatttaagcaaaatgttgatactggagcatattttaggaaatggcccaaataagatagatggaaatagattttagaagggtttctttactggaaatacatacatacagtattggttagtgacttaataaaaactgattaggaaatgcgaaatggtttattaatagacctgtgagttgtattataactcatccagtaataaaaaaaatcctcaaagagattgtctatacaatcccttattcaaaatgctcaggaccagaagtgtttgagattttagaatatttgtattatatatttaccagttgagcatcccaaatctggaaatttcactggaaatcactgcagcatttcttttgatcatcatgttggtactcaaaaactctcagatttgggggcatttcacattttggttttttgcaggatattcaacctgtatatttttatttgtttctagtatactgatattttacttttctttataaaatttataaagtactttaaatctacaatgaagtgtataggacggaacaattccctgtgaatctacttcttagattgcatatcttaatattttggtttcttccaatccctcttttttcccccagaaaactttttacttttctacatgcagtcatcatctactgagttagtacgctggtgttcgtattccatgcattgttagctagtaacccagtttatgttatactatcactcagtcattcacaattttttttattttttaagtcagatttctcaagttgaaatgttattcacaaattttgatgctaaattttaacaaggggaataaatcctttcaataaaaaaattatcaagtcatcagcctttgagtagtagaaatagtttggcagcggctgggcgcggtggctcacgcctataatcccaggactttgggaggccgagacgggcagatcacgaggtcaggagatcgagaccatcctggctaacacggtgaaacctcgtctctactgaaaatacaaaaaattagctgggcctggtggcgggcgtctgtagtcccagctactcggcatgctgaggcaggagagtggtgtgaacccgggaggcggggcttgcagtgagccgagatc

SEQ ID NO: 12279 - DNA, 3752 bp, Homo sapiens
gatacatttgtttctttggtttaaaataagtttgttttcattctgtagtttgttttgtttctacatctatggattgacagatagtattcctaaatctctctcattgtaggtacatcattttacattcagcggttgtcatttcaaattttagtcaggcagcacaaagctgtcaattattccagaggaagctgctgccagctgttttgtattgttgcttcctcttggggaacaaagacagatttggtatcattgattgctcagctagcctctttttaaaagaacgtttctgggaatcagatgtctagggaaggattccactgaggagtgatacacgtgtacattgtttaagagcatagtctagtgtgagtaggccattaaggggaaggatattcatgaaagaatttaggcaacctgttatttagaaagccttcacgtctgtaaggtgcttggcctacttttttttttaaattagtatacatgcataaaaccttgtatcatcaatatacaaattattctgttaggggacatgtttttgttctccatgtttctgtttctattgtggtatgagttgtatttgtatcactgagataacctattgttatattctaattcattgataatatgttttgtaagaaaagctgacatccttcattgcaagtgaagaacaggtttaccatgaaatgaatgcctttattcaacttagagtcctaatgtttctgatttcacattcttgttgctgaaatgcagaagaaacagctacagcaagagcagaaggaaaactcttagacttaatgtctccaattgcaagaattgtttcactaaagaaacagtcatcattcaactactgaatttgaaagcctcagcagtttcaatgacaaaaatcatttttgattttttaaaattaatcccaatggcatgataaattttcatataaaaagtaaagtttcaatttagtttttaataatggtttaatgccttttttgaataactggtttaacctaattttttttaaatgtaatgtattaatgcatataccataatcaaaagtttgaaatatcctgtttcttaaataatgagaacattaatcacatttagcaagcatttgtacattcaaacctggatattaaagtgaaatgattactttgaatcactgtctgccaaggttcatgattcacattttgagatggattcttttcttaatgcaatacctaacttttgataattttttaaaactaatatttgatcagataatgtaagtcaaaatgcagacgatcctttaaaaggatgcattgtctgtgtatgtagcaacagctccaaagtatttttgggcagtttgataccttttatatctgaagtagccttaaccagaaaaatggtaatttaaaattgacaaaatgatatttttaagacttcaaaatgataaataatttttaactattaaaattggcctcaaactaataaatctgtaattaaattagaattaaatatcagtttaacaacaaaatgaaatatttattttttagaagctgcctctcttcattggtcatttatttttaattataaaatttccaacagatctttgctttaagcccttgatatttgacctagttggacacttgatgaggaagttgcctctagaattataaaaatctcagctttataaaatgcatctgttcacgaaggtaatttctttaattggtgatcaaaatataaaattaaggtactaatgtctcactggaagtatatatatatatatatatatatgtatgcatgtgtgtgtgtgtatatatatatatatatatatgtatatgtttctgagtaatttttaaaaaataaaacaggttaataagaagatccattcctttgcatgtgattgttataacattctttcccagggagttcaatttcagcaacctcagaaatccatacttgatattaggaaactgtaaatgtaacacctgaaattattatgttcactattctacatgaaccttatggaaattcatgatttatgtctttgtttttctttttccaagtatatgcaggactccccaaccttgattttataatggtgactgcattttgtaggtggaatcatttctaccgaaatcattttgaaacacaagaatattgatcagtactgtttcactctgatttagtaaatcagaaagcctccccctacccccagcccccactttcacataccttctgggaggtgcctcagtatagacttggtatctgtgaaggactgagttcatgaatatgcacagaagcacttaaaccatgcctcttatttctataatatctgaaaatggcttcataaaagttaagtcaggagaacactgtttacatgacacttcttaactcatttttaatgtttatttttaatttcaaaaacttgttgcctatttggttttcagtactgcataacactgactttcttaaattagtcatagttgcaataatttacttaaatttggtaatgtcacatttgggttggggtttcagtgggaatagtaacttgccgctagtgagaaatggcattgaatactaaagactcaatatgaacaggctttatagacccttagagaaactgttgccttaatgtttggtgcaatttctagtagtgcataagtgaatttagtcttatgataagtaactttgagctgtttttagcttagtaagaattgtggaaaccacatgtttattgtgcccatcattttacacaaagaaaagaggattatattatttcttctaaggaagtaggagttttcttcctaaaagtgcttacatattgtagtactattacttaaaagttatttatgaagttgggagccttctagtttgcctgtgttgatgtattttgaaaacaaaattgcaataaaggatgagcttccatcggtgtgtatggtataccagatacagatggttgcaaggaaaccttttcccccactagaatagtctattagtaactgctaagtcctagcttgcatttttgaaaatgcctttctgcatgttagcacccagactttcctttgtcatattcctttatagctacaacttaactgtagcttatcagagaagctctgtagtcctacactgaagtgtgttcccttggctgttcatatggggctgggtttggttgaacttccattctgtataaatgctagaacacagttactacagattgattcacaaactgcatgtgctggtgcttgaggcagccaaaatggaatgctgtggaaagcatatctatatcttaaaaaacactcagacaggagttaaggacagctttaataatttttttgtttaccacttaatctttatcaactttgattttagttagggcttagctcatggttgaagaaaagtggaaaataacaagtgcccatttaggtttgaagaatccagaatgttttacctttgactttatgagttatagaagcttggctttgctctaggcttcatgttcccaaatgagccatctgtcagtatattcacttaattcttactaatttcagtttcctgtaaaggaaacaacttacatattgatgcttaaatccagaaagtgtaaaaggttttcttaaactgttaaaatatagtgtctgatataaaggatgtaagttactcagctttctgctccctaagccaaacagtgtttgtcttcagtgtgaaatttaactgtaaaaactacttgtaatgtcaagagattatagatcatattattaataaaatggacctgggtctaatat

SEQ ID NO: 12280 - DNA, 1178 bp, Homo sapiens
aggcctggatttagcagtggcattggaatgaagtgaaaggaataaacccctaagtagaccgagggcggagttcttcaaatgaacaagttctggatgctaagacctaggttgctatgaagtcaaccagataaatacttattgtactccaactgtgtgccaggctctatgccaggagctagatatataatgaggaacaggaaagacatgtcccgagggcttgttttcccccactgtggaaatcttacatgtaaatatataatgcaaagtaatatcagattatgttacatggttttgctactgaattgtgtgagcctggacaagttacttaatacttgcagcttcggtttcattaactgtaaagtaggaataatattacctactaaataggtaatacatattattttgtggttggattagttaagcttgatagccgcctaatagctacgcaggagcatgactatcaagtttaattaattcacccattcacttaataagtatttttgactatctactatgtgttaggcactgtgttatactgaagggatgtagtattgaacaaaataattactcttcttcccccacagagttaatcatttagccttatatagttatgctcatataagataatatatatggagttcatagtttagagatcaaatgagataatatttgtataatggtataattgagattaattttcttgttccctttgactatggtatccactcccccaccactgatattatacagttgtgtgatgactactgagagtcagggattgtgggttgtcaccctggatttagcactaagatttttataatttctccttgtattacattccatatctgtagtgagggttctgtttaccctgaggctgaacaactctaggaagtatcttttcttgactttccatttctctttttcctacccacaacaatcaaggtaaatgaaaataatttgatagtgtgagttttgttgatgagaggaactgcaaagcaatattatttgcaaaccagtgccatctagtggaaaatgtgtaattttcttaaattgtcctgactgggcaatctctattctttgtgaaataagactactgattggtgtcctgaaaattttaggctgttattgagaacagttaattcttttctcaaaaaaagataaaagattgcataaaacaa

SEQ ID NO: 12281 - DNA, 1302 bp, Homo sapiens
ttttttgtttgtacaagcaaaacaaagattgcgagtggtgtagtataccatggaggcttaaaaagaaagacaataataagaattgtattgtttttacaaagggatccactttatacatattggacattaatcgtcatccttgaatgtgtcattacagatgaactgagcgccaatggacaatatcaatgtcttgctgaactgtccaccagccccatcacagtctgtcatggctccggtatctcctgtggcaatgcacaaagtgatgcagctcacaatgctttgcagtatttaaagataatagcagaaagaaagtaaatctggagcaacttaaaaaatctttcagtagcacataaaaagttcccctctggccccttcccaagtaaaacttttaccgtagtgtttatgtcttgtttctaaatctcttcatagattccatcaacactccagatttaattatctcctcatagttgttattaagctctttttaatggcttcaactttgtatcagtatactgtatttataaactttgtaccacaagagagagtgtagcacccattttacagtgccatgcacatcagagaaagaaactgcatgtttgttgttgatgatgaaataaaaatgctagcgacagtctttcttactggtgcttaagctcttctttgcacaaagctttataaagggaattcaaaggaagccctttagaattagagtcttgagggacagcactaacaggcctttattaagtatgattgattgttaaatttcagggaacatgattggtctgctgtgtatttgaattcatgtaacaaagaactgttacgatgggattctgctcattttattaaaaagctactgacttgactgtcatcctgttcttgttagccattgtgaataagattttaatgttgataattctgttatttacatatctctaatttactttgaaattcaaaggtgaaaataaaaaatgatggcctaagtaaaatttacaaacatacatgtaatgggttacttccttactttctctaagcgtatgcaaccttgtatttttctttgacataaccatacacaggtgaattactagtttaaaaagcatttgaccatgcatgttggctcatgcctataatcccaactctttcggaggccaaggtgggaggatcccttgaggccaaaagtttgagaccagcctgggcaacatagtgagtccccatctctaccaaaaagaaaatcaggtgtggtggcacactttgagtcccagctactcaggaggctgaggtgggaggattgcttgggcccagaag

SEQ ID NO: 12282 - DNA, 1384 bp, Homo sapiens
aacagcattaaaataggctgaaaaagcaatagttaattaataaagattaaattcaattcagcaaatatttattgactacctattatgtgccaaccatgattctagcagtgaacaaaacaaaaatctctacttcaggcaatttcatcatttatcttatgaattctgatgtttctccttgtggctgttgatactctagtctaaaagttaagttttcctgcatgaaacaaacaaggaaatacaaaattagccagaagctaaaggaatttcatgtccctgaacaggaaatttaaaatgttctttcacagaggactggagttaatattgacaggatgtttaacgtttttatcaatgtcttcataggacctgttcactgttcaaaaaatacacttaatggagatttggcatcagcaaccattcctgaagaaagcagacttatggccaaaaaacaatctgaatcagaagatactcttccatccttctcttcctgaagaaactgaagtgtccaacttcctctaagtattgctatgcaaaagctgctgtaattaaactattgttatagggagtagttttttcccttaggactctgcactttatagaatgttgtaaaacagacaaacaagaaaacaaaccacatacttttgaagtgtattttatctttatatagtttgtttgcaagagtattttcctaataacttcacagtatgaatgtgcatcttttttttttgaacaaatgatggtgtaacattttgacatccataaggacaaatgtagatatttttcttaaaaactctgaggggactgacagcatggtcagggtgtattgtagcttataaacatgaaatcttataaggtttcagtttgacagaagtgtgatatatgtaacttgtgccatggaccaaatggtcactttaccacagctaaaaatgagttacgatagcagcttgatggtgattgtattgtattcctttaatcaaaaaggaaacacaatattctaagtatctttagcccaaataccatgacatattgagcatctttaaataaccagactgtattgtccttcatatgtgaagttgacactactgatttgtcaataccaaattttgggttaaagtgtttaatttttatgtatttattttcttgttgcctcaaaagatgattgcattctaacttttgtgacctaccaaatttaagatgtgtatacgttgttctttacgttgttctagaaaagagattttaatgctgtagtgactttgctcacttacactagagaaataaacaactttcaatggaagagaattttagtgctttttttttcctaaaatagatattaagctgctgttgtaaagtattgtttgcagctctttccaatatctagagacatttt

SEQ ID NO: 12283 - DNA, 1522 bp, Homo sapiens
caatcacattcaccgtgaaagtgctagacactccaggcccacctggcccaattaccttcaaagatgtgacccggggatctgctacattgatgtgggatgcccctcttcttgacggtggtgcccgaatccatcattatgtggtagagaaacgagaggcaagtcgccgtagttggcaggttatcagtgaaaaatgcactcgtcagatcttcaaggtcaatgacctggccgaaggtgttccgtactatttccgtgtttctgcagtaaatgagtatggtgttggtgagccctatgaaatgccagaaccaattgtagccacagaacagcctgctccacctaggagacttgatgttgttgatactagcaaatcctccgcagtcttagcttggcttaaacctgaccacgatggaggcagccggatcactggctacctgcttgaaatgagacaaaagggatctgacttctgggttgaagctggtcacaccaaacagctaactttcacagtagagcgtcttgttgagaaaactgaatatgaattccgtgtgaaggccaagaatgatgctggctatagtgaacccagagaagccttctcttctgtcatcattaaggagcctcaaatcgagcccactgctgacctcactggaattaccaatcagcttataacttgcaaagcaggaagcccatttaccattgacgtaccaatcagtggtcgtcctgcccccaaagtaacatggaaactggaagaaatgagacttaaagagacagatcgagtgagcattacaacaacaaaagacagaaccacactgactgtaaaggacagcatgagaggtgactctggaagatacttcttgaccctggaaaatacagctggtgttaaaacatttagcgtcacagttgtggtcattggaaggccaggtccagtaaccggccccattgaggtctcatctgtctcagctgaatcgtgtgtcctgtcatggggagaacctaaagatggaggaggcactgaaattactaattacatagttgaaaagcgtgaatcgggtacaacagcttggcagcttgtcaattccagtgtcaagcgcactcaaattaaagtcactcatctcacaaaatacatggaatattctttccgtgtcagttcagagaacagatttggtgtcagcaaacctctagaatcagcaccaataattgctgaacatccatttggtaagaaaaataaaaatcctatttcaaagtctctattattaaatgtttcccctgaattttataaaattgtattcatacttaatacctttgtttatatttagtcccaccaagcgctcctaccagacctgaggtctaccatgtgtctgccaatgccatgtctattcgttgggaagaaccctaccacgatggtggcagtaaaatcattggctactgggttgagaagaaagaacgtaatacaattctttgggtgaaagaaaacaaagtgccatgcttagagtgcaactacaaagtaactggtttagtagaaggactggaatat

SEQ ID NO: 12284 - DNA, 1239 bp, Homo sapiens
cagatcaaagtgatcttctacatccatgcacctccacatgcttaattctatctcctccccctcaactgtaacaaatccacaacacctagatattcactaaatcacaaccaccacctgctcctagctaagctttccattgaaaggcttacttgttctgggagaaaacaactcacagattgggatagcaatggttctcattcttgactgggaagtgatagcagaacacaagggtacacataattctagatttatctccatttagagcaaaatgtttctgagcccattaagccataagtccattgggaaagaaggtggtggaaaaggaggcagtaaactttcttcactttctgtttatgcccagtttacatcaactagacccagcaagtatcaaatattatccaacaacattaaagcacagaaataagtataaataactcaactttaatggtggcctggctctgaagtggccgttcctgtaggccacacatttacagaccacaggcaggtgcaggatggaccatggctggaaggaaaaccagaggggaagagagcaagagtggctacttggattctgttaaacaggagggaagcaggaactgacatctgataatgatgttcatttcagcggtgtgctacaggactgtagagtttcagctcataatttgtgttccagggagttacttttggctagagaggcgtcgactcttcggggttgaaccggtagtgtaatttgccctctacttgatagaatggccacttccggttcctatgctgctgcttacacgtcaatcacatcttgttaaggaaaaccgtcagagcacgttggtctccccaaggctacaaaatgtggattcatggttatggaagctattcctttacagtctttccttaaagtgatcttctttattcctctttctctcttctttcctcccctccccctttcttcccgttttccctccttctcttcctcctcctctacttctatttgtaaacctttgtcttgccaaaatcctccctctttgcagtgatggttgggctctacatttgctaaagcgcaagtggagcaggctgaggggttttcccagccccctctggctccgtttctagctccctgtagagctgtgacatttatgaagctgggtctccctgttcaggcccttccagcaggaattctatttatagggactgcctcatgatgagactgtgtttggagccagccggccgggatgacaaatttcc

SEQ ID NO: 12285 - DNA, 1206 bp, Homo sapiens
aaaaggaaatagtaggccaaaccataattaagcccaacactcttatacttacacttgcgtgagcttttattgaatctagtgaaaagactaattattttttgtattatcctgtttccaattttgtggatcacttcatactaaactgaagacaaactcctatataatccttatgtcccctttgtatgccaaagccatttttattagtgatataagagagtggagaaaggaaaatactgataaaagtaaacagaactttaggaaaactttttctgagtaaagcattgtttgcttattggtttatttatttttaattttataacaagctgaaatataaatataagttaaacagtgaccctggaactttttctaatgttctgcaggtaacaaacaaactacctgctaggaattttcttttctttttgaagattctctttaaataatattttaaaaatcagttattagaaattgaattagagatgtaaatgatgtggatatgacccccttattgaattatgtgcatgtaggagtttttgagaaatgaaaaattactaataattgcatggctgatcattattacaagattatttcaggctcacagacataactgtcagttgggttattctcacctcgaacactgtgctataatttaggaacactgcccctgattggcagcagcagatgtccatcaggttgttctaataggatgacagaggccttccttgcatttccaaaacatgtcccatgctcttcagtctctctctcatcattctgtttcacttataattggatttcatatggctgttgtaataaactacagtcgattgtgttaatcaaatagttacattaaaatattaagaatccccaaattcaaaaatgatagtttggagaagacttgaaacagaagataagtaccgtggtaagcttctatgtctgatacttttccttaattagtttattctaaacccaatccaaaggtggatatattaaaatgctcatataaattgtgataattactgttgaatcttagtgctaaaacaagccaactatttgtctaccactatagacatactgtgacaggataatcaaatatattttgccattctaaaatttgtttctaagattattttcctgagcattttaacatcacgttaatcatctctctcaatctcccactgcctctatggagaaaaagaaaaaagacagacc

SEQ ID NO: 12286 - DNA, 1761 bp, Homo sapiens
ttcctgtccctacttgaccctcaaaggcaaccactgttcctttttctaccataagatttttctgttctaaaactttatataaatagagtcacgcaacatgtacgcttttctacaaggcttcatttttttattgctgttcttttttattgctgagtagtattccactgtatgacaatattacagtttgttttcttaatttcctattattgatagatacctgggctgtttccaggattggccattataaataaagctgctatgaccattcttacgtaagtctttgtgaacataggttttcatttctttgcagtaaattccttggattagaattgctgggtcacagggtagttttaaaagaaactgccatacctttttccagttcagttttattgtgccctgtattttgtattttgatgtgcataaaggtgtaaactatttttatgatccatattgaagtattagaagaagtgagtttggaataacaatggcattgttcatggtcaaggatgacaattggaactatctgaggaaagcaaagacctgtctgccccagacagctcctcaaggggttcctatgcctgaaactttagcaatatttcactccttgaaaggttaaagcccaaccatggtgatatgttagctagaagaaacagcactggtttgtttatgttactaactttcaccacccgttttcagtaggtaaagtaagactgatcattgaacagaaaaggttatttctgtgatgaggttgagggggtagtggaaagcatgtattgctagtaagccccaggtacagctatgtgagagagagtcacctggacagggaagtcccccaaatggtggccagaagagcagaaaacggggtgggaaaaattctacctcacagttttgcataggggatagctatgcttttacgggacattttagcgtttaaaaatattttcaatattgtctctttattcaataccacccagctgtagttttttcacactctgatgactctcttatccactcttttacctctcccagctgttctattacatacagcattcacctgtattagtctatagaattataatcatctgtgtgtttctaatgctcattttcaaaaatatgtatggtttattcgatttttcctattaaaattttaagggctgggaaatttggcttctactgtaaatccttataatgttccacacattgtaaatatgcaataaaaatgttaacaactataatggcagcaggttttggtatgtatttctttgatatattgtcactttggacaataagtttgatttctgttaataaaagttgttcataaaatctagggagaattaagtcacactggtctctataagataatctgatgaattctgcatctttgaatcaatttgagttattttttgtaaaggtttaaattgtttctaacagtgttacctaaaacctttcattaaatcaaaaatgtaacttgtatattctgaaataacctggagtcttagaagacagaggcttctgcttccctctcccgtgaccccaacaatcccttcccacaggcttggcacagaagttcagtgctttctctacgtctcatgttgtcagaaataggttctcaccataatagacagtggtgaaatttccattgttcctactgagaagtccatttttaaggcatcaaaggtgaatgtgtatttagggatggaggaggcatattacaacaaagctgtatttaaaataacacaatcatatcatgctataaacaat

SEQ ID NO: 12287 - DNA, 1309 bp, Homo sapiens
actcctcctttcactttaatatttagaggccattgtaggattattgattggcctaatttcagtattattgtgtctcctgggatagagaggcctgaggagaaggagagagacaggagaagccccagtcagcggagcagtcagaatacacacaatatgtattgattaagttcgccatcttatatgggtttgattcatggtgcccccaaacaattacagtagtaacatcaaagatcactgatcacagatcaccataacagatataataataatgaaaaagcttgaaatgttgtgagaattaccaaaatgtgacacagaaacacaaaatgaacacatgctgttggaaaaatgagctgacaaacttgctccacttaggattatcaccaaccttcaatctatgaaaaatacaatatctgcaaagcacaataaagtgtattaaagtgagatatgcatgtaaatatacctaaaattcatggcaaatatatcgaggcaaacagattaatatagtggggactagatatggcaagtaggttttatttcatgggctagctttgattgatagtgaagactgcctggaagactgcattgagaagttagttggacgcagcttctggattagtgggaaaggatactgtgatcattgagcagtgtttattgttatgagtaggagtagtgatggcgttagtgcctgtatttgctgtccctggtgtagacagaatattcagaatgctaaatagcacataggtgggtggcttttaagtttaaagttaggttttgcagggagagatgtggatttgaggaaaaatggctggtgactctttggaattagcagtcagattggttcagctagaataaaaagtctgtagtgcgttaaggagaaaggaggttggtggaaaaagtgaggaaggggttgtagaaagccttaatggatagatggagtagattaggttttcttttttagctcctaaattttttttctcattaatcctctacattatttccatagtctttgtcttagttcagttcctggtcatcctttttattttaaaagttaattattttttgaatagataatacattaatatgtttcaaattttattttttattattttatttttttttcgagacaaggtctcactctgccacccaggctgaagtgcagtggtacagtcagggttctctgcagcctcaaccttctgggctcaggtgatcctcctgcctcagcctcctgagtagctgggactataggtgcatgccaccacacctggttaatttttgtattttttatagactcagggtttatgccatgttg

SEQ ID NO: 12288 - DNA, 1173 bp, Homo sapiens
atatgtgtatatatttatctttctatatgtgtgtgtgtaaaaaaagttttttaaaaacctcctacattgtataatgatagaaatcaagtttggtacattattacttgaccctactcatttcatttagatagcacgtagcctaacctaataaatgacatcaactagttacttggttgtatttcatttagtaatttaatatatgaaaaatctgaaaaatgactaaggattttacctttttatctttaagcaatgtgttctcttttgtttatttttttcctttttagaactctgcagccattctttgaaggattattaccccgagataatccaagaaacactcggtttgccatcaacttctttacttctataggtcttggaggtttaacgtaaggattattctcagaatttatgttcagattataaaattatctcataattgtctttgaaatagaatctaacagattatattttaaattagggatgaactgcgggagcatctcaaaaatacaccaaaggtcattgtggcgcagaaaccagatgttgagcaaaataaatcctccccatcctcttcctcttcagcgtcctcctcttcagagtctgactcatccgactctgattctgacagcagtgatagcagttcagagtcttccagtgaagagagcgactcttcatccatcagtagtcatagctctgcctcaggtattgaagcttatgtgtaatttggcttgctcttttctaataaatatgttgctgatatatatgaaggaagaaaataatttgattgtttatttgtcttagagatcagttgtttaaaagccacaattaatacaaatggtcccatctatcattcttgcagtctgtaatacaacatttataatgctgggattaccttttgacatcctcatcatagaaatgaaaatatttcattcgcagatacttatctgagtgatgactgatatgaaccatccattcataatgtttgtaatctagtttataggagctatcctgatgtttttattttaaataaattttagttttttacttttaatattaaagctgtttgtaattgagatatatcatacattcattgtggatctcagatgctatatgaatttttataaagggaacacatcctcatagctagcacacaaatcaagatataccggtacccca

SEQ ID NO: 12289 - DNA, 1209 bp, Homo sapiens
atggatccaattgtgaaatgatatggagagatagagtaagttcaatctagcatatatgaagtaatttggtaactgacttttcttttaacaagatcaaaagctaacctgctttacactttcatgtctaaggacagccaaccagagagatggcttcacacactagcccactgctaagtgcttttcattcactttcatatttcatcatcaaagcaccctcctgccttatttatagatggggaaacttcaggaagttgagatacctagatatttgcattcctgtcttcctttcttcattcaggtttttctttcattgccacttcctcaaagaagcttttactgattcccatttaaaatagcaactgacttcaactccaccaaaatcactgtattgcccctccctctttccagagcatttgcctatcaaatgttatcttatgtatttacttgtatagcttaattttaaactatctatctctaggtcttctgagcacctgagaaacagagacaaagttgtctcttctgtgtgttgctgttcctctggtgcttagaagacctagaggatcctcaataaatattaactttccaagggaactgaagagcactaatgtgatgctaaagcctgttgccttaaccactatgctataagtcaaatcagttgagaatggagaggaccacaaattattttcagtccagcaagtgttataaacattaattctataaaaagaaaacaattgaaactaatttcttattatattgcatggcaccaaactccccccacttcctttttgaggatcatgagttgtctgtcattgtttctttttattgatatcaattggttaaatataatctggaattggaataaaagaaaaactattataggctttttccagaccatgtatttcaatgcatattattttttcctttctgttcattattctttcagtaattgcacttgttctatttttagtgttatgtaaaattactgtagctcataatttctattttgaagggttcagtgtataaacttagcacatcaatactatctttttagtgttcgcgctcaatggtgtcagttaagagatcaccatcacttttggtgacgtcaatgaaggggtattgcaatgcttaagagaactgttaatccctttccactggtgtcactaacaattgtagtgcttgtttattcatagcaggtacgtgactaagtaa

SEQ ID NO: 12290 - DNA, 1200 bp, Homo sapiens
ctgagtggaagtggttggagagaagttgaaagtaagctcctccctcgcttctctgaaatcagcttgttatctttattgttcctcctaggacaattgccactcctaggacaaggataacagaaaagctcaaatttcacaaaatgtccctcagttccttttaatttctgctttaatctgttcattccttattcttcatcatctgtcttctacttgttttagctgctttacagggaatctcttaaaatgacaaaacaaataaggtgaggaatcacgtagggaatctctgactgtgttcgttggggttagctcttttctgcaactctagcaacttgagacaatgaaccctttataagggctatttattccccagtacacatgtgtaaacatggtaaaataaataatggtttccagagcagaagctgagaaaaaagattttatcacaggaaatcagtaatatgtattcatttataatgtggtgtggactatcaatttattttatattttcatgtttccttttttgccccctttttttgtagtgtttcagaattgttggaactttatgaggaagatcctgaagaaattctttataatcttggatttggacgtgatgaaccagatattgcttctaaaattccttccagattttttaattcatcatcctttgccaaagggatagatattaaagtatttttgagtgctcagatgcaacggatggaagtagaaaacccaaattatgctttaacaagtaagatttttaagtgttaggcatattattttcttaaattatagcatctacagcaagatggtcttattttaaagccttaattttcaggaatagcactggaaagtaaagagattgattaacgcaaaagccatttttacatgttaaaattaagctattttattactccatttatagtggttaatttgcctatttttcccctcctccccaattcctgacttaagtgctaccataacttatttgcagaaccttattgttgtctacagattgcttttattcaagaagaaaagaagtaggagaggagccttgttaatcttaaatgaagtcagtctgtttcaggaactagtctggctaatttgatcagtttcactcatatctttgcttgttttctttctgttagccaaagattccaaaaataggattccaatcctgcattgttcatggatcagttttaagag

SEQ ID NO: 12291 - DNA, 1210 bp, Homo sapiens
ttcttcccattttaaatgtgttaggttgaacaatatgtctttagataccttgctgtcagttggcataaacaggcagtatacctgtatactattttgcctctaaaagattttctcagcaatgagagcacttgtgtctctgctgattaccttacaaagttagacaatactaaaaacatttaagaagtccttccagattatttttttgacatgaggtaaagtatttactagaagttttttaacttatgaaataacattttctaatgtcctcaccttatgaattgtgatatttgtaatctagttagctgaacaattctagaccagtccttgggagtctgatctgggttggatgatagatggactcgattccccactccctctctgtattgcagggagattcacatgaaggtgaaattaagaaattgaatgctatttgtattttttccaaaaacaggaaaaaatgaattccattcatattggtaaatttttgttttattgtttttccaatctagattaaagagtctattgttggggaaatcagacgggaaattgtaagtggacttttggcagcagtatcttcaagtaaagcgtctaattctaagcaagattatcattaaacagaaattataggtaaatttttctgagtttctttgttgagctaaatgtaaatagtaactggcattttattctttgttttgttagtatacaggtttggttctctagttaaattttgagttttagaatgtatgtaatatgttattttacaatgtgaaaatttcacacaagcctatttgaagtgtaagtcaaatcccataatacaaatctccaaggaattacttatattgggtcattctactgaaatttcattatagtaataaatcctggaattggaccttcaaacctgaatcttattttgattataatggtatttcagatgtatagttttaaagaacaagattttgtgaattaatcacaacttccttttttttttttttgagacagagtctcgctctgtcgcccaggctggagtgcagtggcgggatctcggctcactgcaagctccgcctcccgggttcacgccattctcctgcctcagcctcccaagtagctgggactacaggcgccagccactacgcccggctaattttttgtattttttagtagagacggggtttcaccgttttagccgggatggtctcgatctcctgacctc

SEQ ID NO: 12292 - DNA, 1198 bp, Homo sapiens
aagacgtacatagaaacttaggcactttgctatttcttttctaaactatcaaaaactctagcagtttgaaaagcctaatatttatttgtatgtcagtatttttcatttgattccctattagaattaattttaaaacttgaagacttccagacttatccaacttataaataacatatttcttcagactaacatcttaaaacactgacctctatgaggtatttactgtgcaataactgattcatttttttcagagcttgaagcatccaatgatttttccctccactgctgttaattaatgtcacttccaagaagaaaaactgttctgttgtaaaaaatataattgctcttaattcttggggaggttactaatagcagtaggatagaattttatgaggttacctacaactacttaatgtacttacactgtaagccttgttgctttacccaagacaaatgtaattttatcattgcttatgtagtatttttcttttggaaatgtgccttatgttaaacactatgtacttttactttttgcattgtccagacttctttattagatggagatgtttctttttctgtcttctagactaaatagagtatcatccaaataatggggcctatgacttgaatgaatagaaatgaataagctggtgtttgttttttcaaaatggaagtaatttagatttgttctcctcatacataaaatgattttagttcagttttaaccagtgaaaactttgtttttatgaaaaaaaaggaaaatggtttcccatttggttttatatgtgttaaataaatgtgtaaagtaaccaccaaatgttattagaatttttcttctagcatttataattttttcaactcctattgtgtttctttgtgtgtgatattttaatcaaaagtggttgagttgttaacagtgttctttgaaagaatctctaaaaggcttataaatgtttgaaatatcacacaaaggctgatttctaaaatatatatatattaaaacaataaagtatttattttgcctaaagtgttttagtggtttcttaaactgcaacatgaagattttgaattagatttgataggtaacaaatgaggtccaaaagaattgcagcatataacccaatagagtgatactctcttttcctagggaagtgttatgatactttaaaaaaacaatgctttaaaaaatgctgtttaa

SEQ ID NO: 12293 - DNA, 1106 bp, Homo sapiens
accatattagacaataggttctactgtaatccagttcaaactgcagaccccaatagacaaagccttacaacctacctcaagaatattttttacgaatctgaaaggtaggaaagagttatgagtctgtattttcttggttccactgaacaaacatgtttttctagtgtttcgctatattagttttctcaagatattttattttgaaaggtgtaacttttatctcattaaatatttgaaatttaaaaattgtcataatctaaaatatcatacctgaaattaagttaaagagaatacccaatatgcttgaaattatgtaaacctatatagttagtaatatctgctgtgagcaggtaagaactaggatattcttttcttttttattgttatattttggcaaagtatatttcatgtcatgatccattaaataagaatattgagtatttctgaaaaagtaaaatgttggtttgtggtatttcaccttatttttaacattaccaactcatactttctcctttctctatcgcctttacattattattataggatgaactttgataatgttgaagatgaagaaaaagtttaaaagaaattctgacagatgacatcagaagacacctatttagaatgttacatttatgatgggaatgaatgaacattatcttagacttgcagttgtactgccagaattatctacagcactggtgtaaaagaagggtctgcaaactttttctgtaaagggccggtttataaatattttagactttgcaggctataatatatggttcacacatgagaacaagaatagagtcatcatgtattctttgttatttgcttttaacaacctttaaaaaatattaaaacgattcttagctcagagccatacaaaagtaggctggattcagtccatggaccatagattgctgtccccctcgacggacttataatgtttcaggtggctggcttgaacatgagtctgctgtgctatctacataaatgtctaagttgtataaagtccactttcccttcacgttttttggctgacctgaaaagaggtaacttagtttttggtcacttgttctcctaaaaatgctatccctaaccatata

SEQ ID NO: 12294 - DNA, 1435 bp, Homo sapiens
tccattccttacaatggatcttttggaatcttgttttccttatgtcttgctgagaaatgcataccatgctgtctacaaacaaagtgttacatcttctgcataaaattacctacttaatcaagataagcacgcatttttgttgccttggttttacctgtagactgtggaactattttaccttaagacctgaaaaagttttgtggattataaatttctttcatacggttgtattttctgatcattggtttcttaatatggttgtactacagtatacttggttgatttaggttgcacattcactgaattcactgagattattcctataattttaaagtatcatttatttgaaaaacatacattatcaacatgtttttgatatttgataatgaaaaaaatctttgcttgtttatttctgaaaaagaactgtatttagtgattattttagatagtgatattatagtattcatctgtgtgtaaattatttcatatagggaagagttctgatctgtacctatggttcttattgaaaacaacattggatgtgcatttctgtgatgttatgaatacatttctactttattttgaaacatttgccaaactaaatactgtaacactgtataacatttaaaaatgttaaagaactgcttagtattagaagcagatcatttcccaaaattctaagagcagcagcatatgttgttgcttgtataaagcctagcgataatttttagactaacttccatggtgccctgttggcattagcactaccattgtaccctgctgtataataaacaatcttagacatttatcaactgttgatacaaatgttagtccctaaccactttttatatatgttttaaatttttgaaattcaagtgtacctgccataacataaaataaacactagactgtatcacacttcgattgatttctttaagatccttggatattcgttcaataataataaagtttttgtttaaacttagtttgaaatataaaaaataatggtttaggaatgtctaagtacagcattcgataccaggtcagctattatatgatttgtttaaatgttttaaaaaacattttattgaaaaaaataccaaaattagaaaataaaattacacaatacttcttaaaaattaagaacttaaagaaaacttgtatgctgtcaacttgctcattttatctgtaaccaaatagagttatttaaaagaatagggaaaaaaaattgagtgatcatgggactagtgagaatgttgagaactgctgcattagtcagtaatgaatgggaaagacataaaagggcctattgcttaatagttggcatggagggcaaagcagctcatttagtttgaaaactaacccaatgttttgctctttgattggcattgttgaggctgtttctcagcagctttgtatatgaatatcataaaga

SEQ ID NO: 12295 - DNA, 1099 bp, Homo sapiens
gtatttttagtagagacggagttttgtcatgttgcccaggctggtctcgaactcctgagctcacgcagtctgcccaagttggtctcccaaagtgctgggattacaggcatgggccactgtgcctggtcaccatcaagaacttcatagtctataaagtgcttaaagctacatggtactaaaattggataaattattcataaataaatagctagatgttgggaaatgcttcttgaaggactggtcttgaaggttgggtaggattttgatagatggagaataacaaaagaaacatagtttaaaaagcaacataagaaaggcaggataaatgtaagattagaaactcacttaacgatagacacatagaagatgatttttataggaactttggcttcctaaaaaaagactttggaagttgcacctataatgctagttactttaattgccaataataattttagtagaagcagataaactattatggtgtctttccccatagtggttcaatgcacagagaaagacgcaagtttttaagatctgcactgaaggaattggctactgtcctctctgatcaacctggattgctaggtcccaaggtaattcatttaattattatttcaataattgtgccatattaaaattttaaaaaacgtttctaagtgaaattttactgaaatttgagtcagggactacataaaaggatttttatatttagtggagaatgaatttgctgacttgacattcatacatcgtacctccctgcattcttctcccttatatgcatgctctctctcatacatacttacaggttctcttgtgtcctcttctgttagtctcttcactcttttgaattgatattatcacttcttgccaatgacttttcacatagaaagagattaccagttttgtttttaatctttgaataagaataaacacttacttttttttaaacaggcactttttgtttttatggcattatcctttgcccgtgatgaaatcatctggctacttcgtcatgcagataacatgccaaagaagagtgcagacgactttatagataagtaagttagcaacatttaaaaaaatattttctgtatataga

SEQ ID NO: 12296 - DNA, 1469 bp, Homo sapiens
atcagttcttgctggagtaattctggggaaatggctttcatggagaaaaggaaaagaggaagtgtagtatcagtctatgttgtctattgctaatgtggaatggtgttttctgcttctacgccttactgattccagtttttatatttagaaaacaaattaagtgaagcttctggaggtagggctgaaaatggtgaaagaagtgacttggaagaggacaacgagagggagggaacggaaaatggagccattgatgctgttcctgttgatgaaaatcttttcactggagaggatttggatgaactagaagaagaattaaatacacttgatttagaagaatgacaccaaacacatcgctgaaaaaattaagtcagctcagcacgagttgaaattgactacattaatttctttccacctagaatcaacaggatgtttatttcctatgctgattctggaggagttaacctcctgcaaaaaaggcatcttgtccctacatcttctcttctgactttggctacatctcatagtaagttcagagtagttcatgataaattgaaaatataatggtcattgcagaaaatgattgatgttgtaactgtccacccaagtaagaagtgtatctgcctttccatcttttggttttcatttgggcatgtgctattaccagaaacaacaaacttatatttaaaatacccttcatttgacacagtttttaatgagtgatttaatttcctctgtatttgtatgtttagaagactgcctaaaacatgagcactgtacttcataaaggaaactgcgtatgcagattcagtattgtgtatctttggacaattagatggacatttaaaatggaacttcttttatctgacaggatcagctacaatgccctgtgttaaattgtttaaaagtttcccttttcttttttgccaataaagttgtaaataaagaccatcatacattaaaatccaaatatgggcctttttttaagtttttctatgaaaaatttaacatttctagcttgagaattttaaatacctgttataatatcacataggcatgttttcttaatatttactacagaagcatctagagtacttgacagtactacaatgagtttaataacacaaatactaagcttccaaaaagagactttaggagatgttatataaaagagtaacttctgaattgatacaacatcaaccaaattaaatatcacctgcagttgaatcaagtaatgcttaagaattgtttgttgagattcatggtgttaaaatagtacatactactgtaagtataaacaaattcaccagaaaactttgggctgagggtctttggcactaagagcccctgaaaaattagggtgataatacatttaaaatggacacaatttgctaatgacatatttagtactagctacaccttttttattgttatgttttgtattttcaaataatatgttgcttttgttattt

SEQ ID NO: 12297 - DNA, 1148 bp, Homo sapiens
ctggaccgtatctccccgcccccgcccccacgcctcctcaggtgctcagcctgaggccttcgtccaggagcgctgccgctgacccaggctcaggagctgggggcccctgcacagacgcccaggtctcgggacaggcggcgactgcactcacggaagtacgctgagctctcccctgtagaagggcgcctctcctcccccacttcctcctccagctccacagcagcctcccgggccggctcctcctccttccaggtctcctcccagtgccgccgcggctctcaggcctgaggtgcggcgctcaccccggcagtccccagcctcagacgctgcgtggagcggcggagccggagggaagcaaaggaccgtctgcgctgctgtccccgccccgcgcgctctgcgcccctcgtccctggcggtcgctccgaagctcagccctcttgcctgccccggagctgtcccgggctagccgagaagagagcggccggcaagtttgggcgcgcgcaggcggcgggccgcgggcactgggcgcctcgctggggcggggggaggtggctaccgctcccggcttggcgtcccgcgcgcacttcggcgatggcttttccgccgcggcgacggctgcgcctcggtccccgcggcctcccgcttcttctctcgggactcctgctacctctgtgccgcgccttcaacctagacgtggacagtcctgccgagtactctggccccgagggaagttacttcggcttcgccgtggatttcttcgtgcccagcgcgtcttcgtaagtggccgcacttggaactggagccggccccctcccccaccgcgcgcacccacccagcgtttctccattgggattgatttccgagagatcccggcgtctgtctgtctcacccatcctacctctcagagtggtttatatcctgggtggaggaaatatttggggaaatgaactccctttggtacccatcacccagttacaccccgcttctcacctcttaaaattggttaggggcagcgggagagctttgaagcagacctgtgcttaaaaatcggggaaagtgggaaatcaacaaaggctggtcttgccggactccccgcctcctgtgccagtgtcgaggatttggtcaatatcatccccgaacttcttttt

SEQ ID NO: 12298 - DNA, 1050 bp, Homo sapiens
cgatttgatttctgtaggccctccatggaaaaaccattaaaaattctgttttcttttccatggggatgttgagatctggttattatatcttacaaatatcaccatgttatgggtttgcctaaagaatattgagttctagtcatagagtgaatcttttaatattatggatcttatctttctataacaaatcacgataaaaccaaccctttcatttacaaggaactacatgtgtggcaaaagaagaaaaagaaaagaaacataccaaccccttcacaataaaaagcattcatagactcaactattagcctgtttattttcaagacagaagaatctggataatctctttggccatcacacaaaaagaaaaaaaatggcaaattttcaaatgttgaagagatgatagaatgaccttttcttataagtaaaggatttgttttggcagggttgtggagttgctcagtgcttgaagattgtctgccaagttgggagattagacagaggaaagagtgcaatcttgtacgtaaagtcattactgtggactgagacttttatgaatgtaagtagacaggtgcagcatttagcaaacatacccagtgttttcaaataaatataaaaggcctgatatctgggaaatcatctaattgttatttccaaacagaaagaaaatcagaatcattcctattctctgaagtcgtctgcttcatttaatgtcatagagtttccttataagaatcttccaattgaggatatcaccaactccacattggtaagtcattggtttaggcaaatagaataaatttactcaattcaaatgctgtacatgtttttattttgttttttaaagaacgacagcttaacttttttgataatttaaactaatgaagttatatgatagcattataacctagtttaatattatcattttactccttaccccgaagtgattaaagctagaccttttagtttagcatcttgtccagtgtaagagatttcttagtatatactaaattatattggagaaattttaggaattttcgtttacaaagttag

SEQ ID NO: 12299 - DNA, 1253 bp, Homo sapiens
aagaagtatcttgactttcataatgtgttctaagaccaagaagcacaggaacatccctcataatctaaagatgcctgcatagtaaatctggagcctcatattctgattttctgacaagttggctttccaaaaatagataacaagttttggacagcacccagcaagttttctacttcctgacaggaatgctgatgagaaacaaaaatgtggcacttcatctctgccaaaatcactgccatcaaaatgcagtcaccctagatgaccactgtctacttttctaatccctttcttcctggaccatctttagtcttaacacaagataatttgttgccccagtcataaaagtcctccagagaagtgtttctcaagcttgaataatatatagatatctttaaaaggaaaaaaaatcacagacttccaatttgtaagccaaattacttaaaataactttcattttgtatgaaccagtaacatagtaggaataaattcattatgatcattatacaactataaaccaaaaattgtttacaagttaatactatgcaagctacaaactaataaataatactaatttgataagacttcttttgcttaaaaaaaagaaaaatccttattgtaatatgaatttaatagtgactggtgtagggcagcttagtaatgtggtagaaatagcttagacaaacttgagctactctaagttgtgtgtaattctctaccttttttctatttgagtaatggaaaatctttgcagaaatgaaattaagaagtattaatacaaaatggtggctgggtgcagtggctcactcctgtaataccagcgctttggaaggctggggtgggaagatagcttgagcccaggagttcaagaccagcctgggtgacatgcagagaccctctctctacaaaagataaaataattagctcagtatggtggcctgtgatcgtagacccacttattctggaggctgaggtgggaggattgcttgagccagggaggttgaggctgcagtgagctgtaattgtgccactgcactccagcctggatgacagcaagactctctcataaataaataaataaaatctgttgatcaggaaaattccaactctgcctcttctagggacacagtggagtggggtttccagtttttgattatatctaatcaaaagtggggtttccagttttgattatatctaataccactacatggatctgattgaccagtgcattacatggatctgagtgaccagtgcag

SEQ ID NO: 12300 - DNA, 2652 bp, Homo sapiens
attatactcatctgagtgttaaaatatatatctaaagattaatgcagcagtttgattttcttcaaattaggcttccgaagatgagtcaacagttatatatatatgtgtatatatatatatatatatatatatatatatatatatatatatatatattataaatgttttagaaagcaatagttattaacatgtgctttagaattttaaacaggtctaagtatgacaaaccattaccactttctacctttgtgactttgggtgaaatactttaagcctccaaggtattgtgggatctaaataagatgctatgttaaaagtgcttagccaagtgcttgggccaaaatcagcactcggcaaaacagaagctatttttctaaaagataaacattctttattagtagcctgttgttaattatcattggtactggcacagtgtgtgtgtttatatggtttgattttggtaaacagcttgtgttgccctctgaattgctaggtaaaagtccaagaatttttatgttatttaatatttattctccttccctgcaacagatatattggatgaactgaaaaaagaataccaagaaatagaaaacttagacaagaccaaaatcaagaaatagtcaacctgatttcacataacaatgtgtggcatttgttgttctgtaaacttttctgctgagcatttcagtcaagatttaaaagaggacttactatataatcttaaacagcggggacccaatagtagtaaacaattgttaaagtctgatgttaactaccagtgtttattttctgctcacgtcctacacttgaggggtgttttgactacccagcctgtggaagatgaaagaggcaatgtgtttctatggaatggagaaatttttagtggaataaaggttgaagctgaagagaatgacactcaaattttgtttaattatctttcctcctgtaagaatgaatctgagattttgtcactcttctcagaagtacaaggtccctggtcatttatatattatcaagcatctagtcattatttatggtttggtagggatttttttggtcgccgtagcttgctttggcattttagtaatttgggcaagagtttctgcctctcttcagttggcacccaaacatctggattggcaaatcagtggcaagaagttccagcatctggacttttcagaattgatcttaagtctactgtcatttccggatgcattattttacaactgtatccttggaaatatatttctagggagaatattattgaagaaaatgttaatagcctgagtcaaatttcagcagacttaccagcatttgtatcagtggtagcaaatgaagccaaactgtatcttgaaaaacctgttgttcctttaaatatgatgttgccacaagctgcattggagactcattgcagtaatatttccaatgtgccacctacaagagagatacttcaagtctttcttactgatgtacacatgaaggaagtaattcagcagttcattgatgtcctgagtgtagcagtcaagaaacgtgtcttgtgtttacctagggatgaaaacctgacagcaaatgaagttttgaaaacgtgtgataggaaagcaaatgttgcaatcctgttttctgggggcattgattccatggttattgcaacccttgctgaccgtcatattcctttagatgaaccaattgatcttcttaatgtagctttcatagctgaagaaaagaccatgccaactacctttaacagagaagggaataaacagaaaaataaatgtgaaataccttcagaagaattctctaaagatgttgctgctgctgctgctgacagtcctaataaacatgtcagtgtaccagatcgaatcacaggaagggcgggactaaaggaactacaagctgttagcccttcccgaatttggaattttgttgaaattaatgtttctatggaagaactgcagaaattaagaagaactcgaatatgtcacttaattcggccattggatacagttttggatgatagcattggctgtgcagtctggtttgcttctagaggaattggttggttagtggcccaggaaggagtgaaatcctatcagagcaatgcaaaggtatgacacagtgtttcttctcctgagaattcctgagacctatttttgacccttaaagcttttagcattttgattgtaagaatatagcatattttaggtgcatttatcttattttctttactgtgtagttgataacatttttatacggatttctttaaacctcataggtagttctcactggaattggtgcagatgagcaacttgcaggttattctcgtcatcgtgtccgctttcagtcgcatgggctggaaggattgaataaggaaataatgatggaactgggtcgaatttcttctagaaatcttggtcgtgatgacagagttattggtgatcatggaaaagaagcaaggtaattctaatcatttgagtgttcttacggtatttttataaaaacagcagagtgtaaatggagactttaaagtttgttttctctttggagactgttcacatgaataagagcagcaataatagcttggctttgtattataaacaaagtcagaaacagagctgggaagagccaggagagcatttattttctagaactcat

SEQ ID NO: 12301 - DNA, 1216 bp, Homo sapiens
accataagtgttttgcaggttcaggactgtggagcccttctatattggttccatatccctaaagtgtcatttctttagacctgataaagatcagacacagattgaatagttagttaagatcatgctcgtaggctaggtgcggtggctcactcctgtattcccagcactttgggaggccaaagcaggtgggtcacttgagttcaggagtccgagaccagcctgggcaatgtggcgaaatctcatctctaccaacaaatacaaagattagctgggtgcggtagtgctcacctaggcaaaaaaaaaaaaaaaaaatcatgtttgttttcaaggcctccacaaagataccttgtaaaacaatttgaaattatttctggacacaataaacctaatttatttattgagatttagactattttgtagtatatgtattaaaattagtcatgttgtgaaacaatttggttaaattttagctataaaactgtgtataaatcaaagcaggttgattttatttttacatagtggttatattatctgtctattttagatttcctttcctggatgaaaatgttgtctcctttctaaattctctgccgatttgggaaaaagcaaacttgactttaccccgaggaattggtgaaaaattacttttacgccttgcagctgtggaacttggtcttacagcctctgctcttctgcccaaacgggccatgcagtttggatcaagaattgcaaaaatggaaaaaattaatgaaaaggcatctgataaatgtggacggctccaaatcatgtccttagaaaatctttctattgaaaaggagactaaattgtaatgtgattcacaatgtaacaatataaaaataagtttttatataattatataaaagtaagatactctgctgctttactattgtataacatagtagttttaaagttcatttggttgaattttcattttttcctgtcacagagcttctaaaaccatggaatttccttagtgatagggaatatcttttgttgttcataataagccccttttgatcacacctgagtttatgctaatgcgttgacttagggtgaggtctctaaatagcctttaacacctgcagcttgggaggccaaggcagagggatctcttgagtccaggagtttgagaacagcctgggcaacatgatgaaacctcatctctaccaaaaaaaaaaaaaaagtacagaaaatt

SEQ ID NO: 12302 - DNA, 1173 bp, Homo sapiens
acacaaggctgctaaaccaattaagaaaataattaatttctttcaagcaactaaaaaatatatggtaatttaaaggtgtctgcttatttggttgaacaatttaattgggaaagtttgtcatcatttgaaaaaggaaatataaaaggaacaaccatatagccaacctgtggtctggcagaaacaacgtctctagcaatagtaccaaagtaagtaatggagtcttttttttggcaggtctgcagtaaaagataacattttcttttcttagtcctcctgctctcaacccccatattttgcctttgaatacgtgggttttagtatatatagcccaaaatggtaactgtctccagaacagcaaccacattgaattcttgtgacttaggaaagcttcttatagttgctgacattaattgcaagaaataactatatactactttgagaagtaaacatgtcaaaaaaaacaaagttcagatatgggacaaaatttaaaaattcagtaacatttataaacagaattgaatgaaaagagttacagaccaacttaaacatcaattcgtgtcagtaaactgacttttgggggtaatgatcattgttttgtatctcaaaagtattgagtttagaaatcagttgtatgatactacctttgtatgtctgtcttttcccgtgtatttttaaataactggtgatctataatttaataaaatttttcgttggtgtaatattatttcaaaagccctccaaatttagtcatcaaaattaaaatgacatttttcaagtttatttttaagcaactgaattcgtaaaattaaagtaacaaaaagcattcatttttctttattttaaagttcctctcaaaaggcttacatttttttaacatacttcagagatagaagtctccctcttagacatgctttcttcactgctttctcccgtcaatgttttaaaaatatttactcagtagatatttgaagggcccactctgtaacaggaattatgttaggtattgaggatagtttgtagacaagaaaaaccaactcccttccctttggtgcctacattccagtttaaaacaaaatctaaaaatgactattacttggaacaaaataaattgccatgccataaatgctcctgacttcaagtcaggagacataatggcaatttctaaggagtcat

SEQ ID NO: 12303 - DNA, 1227 bp, Homo sapiens
tggctgtttgcagaaaaagatttagaaagttataatgtagtaaacatagatttttatgtaagggagaaagtattaaatattaggttgattcctgccatagaaaagcaaaataagaaaacaaaaaacaaaataaataaataaaaatcaggttgaataatgatacttgctaggttctgcctgactagaacatgtgttactttgtcgctgatggagttctgttctgttctgttttgttttggggccatgcataccaaaggtgtatgtaattcagaagaatttttttagtcaaatttaaacataaattattgtttattgtaaatacccatgataatgaaacagtgaaaagcaaccttaaagatcagcctaacctccttattcaacagttgaatctgtgtccagagaaaacaagggagttgcctgttgcaccataactagaaattagtagagctgaagaatttaaactcttatatccataatgctatgcttccataaaagtaaataaatgtcaaaattctttcacttgtgtttctttctaagtgtgataacagtttaatatttttacatattaaaagtgttttttgacattttataggagaactatggatttgataaaattgaggtgcgagataacggggagggtatcaaggctgttgatgcacctgtaatggcaatgaagtactacacctcaaaaataaatagtcatgaagatcttgaaaatttgacaacttacggttttcgtggagaagccttggggtcaatttgttgtatagctgaggtaaggtaattatattggttattttagtgatttcatattcactgaacattacagttaaaactaacccagtatttggtgaagtatggttttaattatttttattatggtaaaatatacataacataagccgggcgaggtggctcacgcctgtaatcccagcactttgggaggctgaggcaggtggatcacctgaggtcaggagttcgagactagcctggccaacatggtgaaaccccgtctctactaaaaatacaaaattagctgggtatggtgcctcacgtctgtagtcccagctacttgagaggctgaggcaggagaattgcttgaacccgggaaacagaggctgcagtgacccgagatcatgccactgcactcccacctaggcaagatagagtgagattctgtctcaaaaaaatatatatatacataacataaaatgtatcattttaatt

SEQ ID NO: 12304 - DNA, 1197 bp, Homo sapiens
gagttaaggggtcaaagaagcaaagcggaacaattggagttgtctctcttgtctctggtctgacaccagcccttcccctatcctttagggaattaggttaacataaaattgtaaactagtaaatgttcttatcaaagaccatctttttaggatctagtgtatgtggcagctctctcagggaaatttttagataagaattcggaggaatagggaatctacttttattatgacaaagtataaatcaaaccaagatcaacagttggctattcctttttccctttggatgaggctgttttcaaacacctaacatggctatcataaatagatggcaaataacattatttaggcattctgctttcaagcagaatggtctggaagaataatttcagtttttaattttgttttgccattaaacaaaaattataatcattacttatttaggtccacacaatgttgtaacaaaaggatgctttaaaattgtagaccaacctccaatccattttattatctcctctgtagcactcctgacaggccagccacattttgattgaacacttcagtgacaggaagctcattacattttgacgggttcctccttttctgttgttagcaaggccttgtttacgctgaactgacaatcacttaggaagcagtacctgtttctcattagtcctacctggccaatagcgctccaactgtgaacttagaaacaagatttttctgcaaaaaggatctgaaactttagtcagtctgaaaagggtccatgacccaaaaatagttaagaaatgaaaggtctaaagtgatacaaaataatatttttgtctcctttgcttgacagcctttcagatccctgagcctcagtttctcatctgtaaaatgggaataatatactttgtctaaccctagggttactgtgaggattaaattaataatattaataaagtacttagtagaggtgcctaggagtcagtaaatgttagttatcttcaataaatactagtttttatgtttccttccttacctaagacccctctctgtgctaaagatccttagcccaaaattgaattcaataagtcagtttaacccaaacagtgcagggtgcaatgagctgccatcttcaaataaaataatctattgcttaattggcatttgtagtaaatactcagaagttgactaaaaacctcacctccatacccc

SEQ ID NO: 12305 - DNA, 2065 bp, Homo sapiens
tatataatagaaaaacaaccaaacccattcatacaaggatctgaagttataaggttaagggcagaaagtttcccataagtataaaacatttccaggtcatgaagagtagtttaggttgagtgacaaaagcctaggtgtggttgtttttcattcattttgcatctcacaccaagacatttttgctgcaaggtcatctgctgcttaaaatgtacaattaggtatataaaataagtacaatggtgaaaacacaaagccaggtaaagcagcatgccccactaaacttttcagtatacatagggacagacaagtgagttttggttgtatctaaatattttaatttcaggttccttctgtgccctgggccactatttcccaggggtgtgacagagatgcctgccagatccatatcaactagaagtctgatttctgttgctgcccttcctcagcaactatggcagtatacttttatcaccaagcaccactcccttgtccctgaatcacattttaatagagtacaatatcttctgtacaatatttctgaaacacttatgtctgaaatatatgctgtattgtatgttaacccatgacatatatgaactacaaggcttgcataatcagtgagctagtggataaatcaagacaggagcaaatgggagaaagatgaataaacaaatgaaaaaagatgaataaatgaataagagagatgaataaacaaatttacattacatgtgatagttatcatggtatggccttcatgacaagatggatgagaatatcactgataggatattagccttctttcatatctttatattgaaatatgggctttacttcaatttgaaggtctttcatgaacaataaaagagagtagaaggactgtctgagaaggcaggagacatataaaacagatgactgaaagactgactagctcctggaaagggaaacatttggaacatccagagtaagggcaaatgggcttctaccagcacaacaaagagcctccaggtggcaacatggaagcaggttatcagagaaaataaatgtgcaaattccttatttacaatgactcacttaaccccacaaacatgtttcactgctgccttccccagttgtcgcttatgtactgttgttacctttcagttacatgcctttgatcctaaaattctctacttttgttgccttatcagttctttgcaatctgcctgtggttatcagcacttaaagcacaattttgaaggggaaaaaaatgataatcaccttagtcccaaagaaataatttgtcaaactgccttattagtattaaaaacagacacactgaatgaagtagcatgatacgcatatatcctactcagtatcattggccttttatcaaatggggaaactatacttttgtattacatagttttagaaatcgaaagttagagactctttataagtaatgtcaaggaacagtaatttaaaaacaaagttctaacaaatatattgtttgcttaatcacaatgccctcaacttgtatttgaataactaaataggacatgtcttccttggagctgtgggcattagttcagaagcactacctgcatcttaattttcaaaacttaagttttattagcaaatcctcttctctgtaagacttagctatgaagtggtatattttttccaaatatttttctgaaaacatttgttgttgtaactgcacaataaaagtccagttgcaattaactagtgtgagctcttatttaactgaagcaaatgctttctgacagtgtgtactttgaattttttaacaatataaaagacaacattttctgcattgttaacaaatatagagaacaaaaatccatttatacaaataatttcttggatcattcaggtccaatttaggacctttaagagtataaatgtaaatgtatccgatatcatggcatctttattccagatctgttactgaattatttgaaagaaaaatgcttcacataaaacagattaagaactgagaaaacataaagcaataccttctgggctgccatttcctcatctatgagaagggtgcaggacatgatct

SEQ ID NO: 12306 - DNA, 1135 bp, Homo sapiens
atgcaactgcaaacgttacaactgcagccagaacaatggctgggtggatcgcacgtaaagcttgccactaaaaatcaaagcagaggttaacaggaaacctggggggagtgtggaaaagggaaaactgttttagctgaataaaggtgaattatataatttataatagctgtggatgagcacaggagagagaggaaagaaaagaacagtcgaaatgagcaactcaccttaccctctgaccctgattagacaggatcaattgtaaagtgagggcttctccatgacaccatagttctgcccaatactgcatttgggataagaaattctacacttggatgtctcgcttcacaataaaacacagcttaaaaataaaataactgaaagaaatagaattcagcaaatagttattttttgcacttgaactgaaacgtactgtactgtaaattatgactcattttaagtgacctttaaaatcagatgtatttattatgcttgtgtaattatagaaataaagaaatgggtgacaggcttaacctcacctatgaatgtacagtatgtggatttgtgaaactgactgtaggaagtcaaaaacttgtactgtatcttgtgtttacagttctgatttattcctttgaaaagcctgctgttttggaaatgcacagttgacatgttgaaataaaaatgaataccatttttaaatgtttcttaaatgataaagatgtgaccaaacaaaagtcctatactctaatgaatgagaccaaattcaacatgcctttgttatggaacatttactgtgacagcagaatcgataatgcagtcatttccagccttgtgagctgacaccttcatgggtttgtggactttgtgactttttcttcctgtccccaaagtgccatatgctaccttaaaaaatattaaagtgaattcaaattacattttgatttgagattttgtaacccctcttgagatccctcaacacacacaggggtgtcacagagcccaggctggtaatcactgccttaatgacttacttcctactctttctcctatggttgtagaaacagtaaattaccgagtgctgagcttgtgtggatccaaagtggttaactgctaattattgaactattcctcaagtttt

SEQ ID NO: 12307 - DNA, 1224 bp, Homo sapiens
ctgttactgctcttgatagttctgtattttgttgttacccagttcctgctaatgtttgagcttctagttttagttacattgattacttgcttgagttcatattaagtaccatactcaattaaaattgttttattttccagtcttttatattttacaaaaactagagtatgaccttggagtgcatataaaatatagtagattgtaaccagagtacttatttatattttaatgtggctttacacttatttgatagaagaattctttcatggggccggttataaaccctattttgtagaagatgaaagatgatttgattggctgagccctaggatcatgttagtaagcagtgttcttaaaacttatatccatatcttactctgattttagttctcttcttgatgcattatactactttattagcatgtagtgatgatttctaggctggacgatataagcagagtttgttaaaatatggatatatataaccaatgaatagccaatttcttatacctgctctgtataactgtttacaggatcttgtttctctgtgtaatttccataactatgataatttgagacactttgcaaaaaaacttgatcctcgaagagaaggtggtgatcaaagggtaagcaaaattcttatttagataagtatataaaatttttaagaagagaaaaagtgagatttgcctgtataaataaaatcttagtttgttagtggcctcgggtctttgctaatcataaatgagtgtaaacaaattgttgacatataaatccgggatcaccagtattaaatacttaaagattgtttaatagatagttaatagatacagatatttaaatattgctgttttgttatttaaattgaaactagttagcctagtgtcagggatttccccttccattttctgctattttaagcaagatttttagaattgattctgttaaaaaaagaacaaaacaaaacattggaatgtgctgcatgctataaagaaagcatcgttttaatatttgttcgtcctaaattgaagtttaacttcttgcatactgtgtagatggatatgtaaatggaaaaggattatcatattagtgagagaccgtatgaagcctcaaaagttttataagtcactgtagatgaaatatttttttccaccgtgtttaatgcaatattcctaataatcttacggtcctatttgtttgttacgagtttatttggcttcatac

SEQ ID NO: 12308 - DNA, 1129 bp, Homo sapiens
aaagccttttgggctaacttaagtattaaatttatatatttaaataattatattttaagttgtagaggattttcccaaggattttatgcttacttgaatgttctttgaatgttcagatgcatatcctaactggatgcttctcaaggccttactgcatatttgtgttgcatatttatgttagttgcaccagggccatttgtagtttgggcaaccgaatgccttaattggaaaaaaggcattgtggtttcccctatgatctaaattgttacattttaccatttcattccgaagttggttttactttattaaatgaagatttagttttcatatcgtatacatagctgtatagatttcaaaattaggttgttaatttgtgtcacttactatttttgtgttggtaatgctttaaatgcatacttaaaaatgaagtactgttatctaagctactgtgtttagaaaatgttaagaatgagcagaaatttttatagaaaagtataaacggaagaagagataagatactgcgaataggccctcaaacttaaaaaagaaaaaactttgccagttttaaggacatattttgattctttcagtattcttaacacctttttaaacaaagttcttgatagtacccactattattgggtttgttttatgccattattgattcttgatattcaagcatttacaatgtagcatatttgattttcttttttctttctttttttggcatcattaacatttcatttgaaatgcatattgttcttgaagtactttgtttttagcataaatgttgtgcattttatcttagtgtttggatgaaaacatttgtgttgtttagctttcatttgctttgtatatttaataatgtacctttattttccagtatgcctacattttgtattgcacaataaatttattttaagctgattttattgttttttttgttttgttttgttttgtttttataaaagcaacttcaacattttaagtacaaatacagttgggattttaacttagaaaaaattattctttatgaagatactgttaaagtgtttgctattctgaagctgcctcaaagtaaactagaaatattcaaaagggctttatttgattttttaaaatgcaatat

SEQ ID NO: 12309 - DNA, 1316 bp, Homo sapiens
tgagcagaagcacgtttcctcagtggcctcatggtgcggacaccagtctggagggatctcttggaatcacaacccgctcctctcctgtgttcaaactttccctgaatgtttccccatgcaccttcgttaactgtttcatgccctgaggctcgggacagcttctccctcccctttccctcagcagagtcctccaggctgggcccagtgactccaggtccacctgccctcaagtggacgtcaatctctgagctgtcaatccctgagctgacgagggagcaggctggggccctgagggcggctctgaataccctcaggcacctgagttgggctaagctttcgagttaggtagagcttcctagctacgaggcttgctggatcacaaagtggtctctagtgaaaaaggatgcctttaacctcctgcaggttctgggcccagggaaagcttcggactcagcacccacagagcctcacagcaactggcagcccccatgttcacagaggaggaaagatggtgcacccacacagagcatcctgctgggtctccactgcctggggaatgagccctactgccctggagaaaaggtggtagagtcaggctggcgtggaggcaggggctgtgggcagggccaccaggaaggggaacacgggggctgaggagtgaaccctggtgtacaggaccacacttggatcacagtcaggacacgggagccataacctttgagaaaactgcaagcgtaggtgagtgaccgtggggatcatgcaggcagcaagtgcaaatcatttacgtaaacacaggcttaggaaatatttttactgcaagtgatacagcccagaaaacagagtgaacagtcgtgggataaggaggagaaaccaaaatgccccaagtactggcgacaggaagacaccagccacaaagtctacaaaccccagcaggggggcgtcctccacatggcaatgtgccaaaaagggctgctctattgtcaaaagtcctaagaaaccagagacaacatagagaggaaactgatgtccctaccaggtgccgaaattcagccgccagactgccattggtggactcctccatgttcatcacttttgtgtgcgtgcccaaaatgttgaacttcctaaatctatacaatataggaaagaaatgctgaaaagtcttccaactattaaataaataaaaatatagcacagtatagcgtaaagtacgtcacgtacccttttactgtatttctctcattcacatctctgcaaaaaaaatatatataatcacatatgcgtatttaaaatttgaaataagctttaacaaaattata

SEQ ID NO: 12310 - DNA, 1787 bp, Homo sapiens
ttaggtagcccatagactgtacttgcattatacttaatgtttcagtcttaatctgaaatgttccagcaagcatttcctttaagcatcatgtcagtgctttaaacatttcagagtttggaggtttcagattttcggattaggttagggatgcgcagcctgtactcgtcaagatcagtatccattaaaatacaaaagcaagtgttattgtaatcatgagctgttttgtgtatactttaatttgttttattcttttctcctaggttcctggtacagttcagacaggacaaagtatgtgtgaagtttattcagggaaaccagaaaaatgggagtgtcccaacatgtaaacgaaaaaacaaccgtctccttgaagttgctgtcccttaactggcgcctcctctctactttcatggacttgttcctttgtaatagtgcaatttggttttgttttatttggggttcattgtatgtttgggaatcaccaaaggcttttagagttctttggcaaaataaaaatatttgactaatcaatttttattattggaatagttttaacctttcaaatacatgttctgtcctggagcaggattgtagaaactaacagtgtctattttcatgtctgatgtgttcttcctttagtcatcatgttaggtctgtgtaccctaaatcagcatattactcataaatcattaattaatataagcataggaaatggtcttaaaagatactgcattcattcatcagatatttattccatgcctactctatgctaggcactgtgctagatggtatgaaaacttattaggaacctttttgtttttgagaccattgcattctggctggtttgtgctggtttaacgacatctaagaaggtttagaaatggtgagaccaaaacaataactgttaatgatggacagcattattaggaaccctgtagtatgatatttaacaatataggcttcaagaagggctggtcctaagagggggcagaaatgaatgaccaggttaaatccctctacatgtggtttctgtttgaaaaaaagaaaactgacatttgaacaggacttttaatttgtttaaaactctggtaattacttgtaacagtagaaaatagaagtcattcttattttagaaaaagtgacagaagcagtccagtaagattatatgtttctgtttctggtaaataccatatatgatcctcgaaatgataatatctccagaatattgttttcacccaaatttgagtagatattttaaacacctaacaaagtaaagggctaaaagccattcagatagcagtaaaacattctgtatgatgtgcaataaaacatccaagatcttttttgaaagttttatttataatatacatttttgtatgagaaaggtgattggtacagggtgcctattttagtcatggatcaaaatttgtgtaacttgcagggctttctttctttttcttcaaatttacaagggttcattttggaaactacattttaaactttggaatcaaattgtttcttatttgggaggataatgtatatacattggtattatgttaaataataaaattgttctaatttggtgccatttcctgaatcacaactgtatttttgtatctcaagctattttcatatgttgtgtgtcaatgtatcatctctcagaaaggttttacaatccaaacattatatgttctctgtgtaactgaatttcacttatcttttataaaccagaaacattaattgaaaatattttctggggattttctcttgacttgtatttttaaaaattg

SEQ ID NO: 12311 - DNA, 1195 bp, Homo sapiens
atttattttagagtagtgctcctaacatgtattatcaactttgtggattacattggaggaaaatttaaaactggggccttgaatatttattttttgaaactaccatgttaaatactgaagtataatttgggggagttataaagttatgataaacattcatctgattattttaaacaatagttgtggtagataaacatactggaggtgagtcaaattgaattcatatagtaacatgcagtctgaagtcctagttacttaataggtactcagcctggagtgaaaatcctgggtactgactttgagaggagtgagtgtgcatgttgtcaaagtttctgaacacagttcacatagccttattagcaaaagttttaagaaatggctctatcaaagaagcaattgcagctttattcagaaatataaaagtggaatttatgtacatgtcataagtggtacccacttcccctttttactgtagggtggataactcttaggatttaactctttgaatattatctcttgaataaagcatgtgttaatgttaacaaacctacgtaatttttgccctttcaatgacttacagtggagagccagtacatcttaactactgttgtagtgatggtatcaacctcatggttacttagctctgcatttgttgctttgttttttttccacttcaaatcacaaaataagtagattttgttttctgaaaactccatagcatttgaatacaaaaagttgtgccagattgtttgccctaattcactgtgtttaacaaatatttcagtacacactatgtattaggcactgtgtggaaagtgttaaggggtagacaaaataccgaataatctccacaagtttatttgtggtctatagtacttttgtaactggggttacaaaaattatagaaatttttttcctttgttcatatgcatattcatgattataatttggctttgtttgtgattaatgttttcttaagattttcacattatagaatacctcaaaagaagttgtctaaggactgggatagagagtatgtttcataaaattgtagatgtttagaatttttaaaaaccctacaaattagtatatgattgttttatataagtaagataggagcaacactttaaattatttgtgggagaatacagcattaaaggtgattttaaaagaaaaaaatttggaattttagaaa

SEQ ID NO: 12312 - DNA, 1096 bp, Homo sapiens
gaaaatagcaagagaaattgagaaaaattatcagagatataggaagacaatcaaattgtcatagttcctctggaactcaaagaataaatggttcaatagaataattgataaaaccatatactgactgcagttttaatatcaaccattacatttgcaactaggagattatttatgaaattttgagtgttatttcaatttagtggtatgaataaaaatcatattacagggtcaatgaaagcaaggaggttggcaataaaaaagagggaaggaggaggaaagatagtcattaagaggtaaaagcatgaaataggagagaatggggttacagttgtagaagaggagatataattgattttttcaaaaaaatataaaaaaggaagtccttagagaaagcagagacagaattaggggcttggatggttataaataccccagcatatttacacacccatttacagtcataagctttgatatgacttttttttttctttttcaagagatttgaatgtaaaagcaataggcttacaaggtatggcaggctgttgatgagagttttcatcgaaactggcaggaacattgggaaccagctgttggtgtaggtagatcatttaaagtagtttaaacacctaaaggataattttaagactctgtgcttcaggtcatgagaatttcctaagtatttgttccaagaaaattgtatatattttagacatagaaatatttatcagctgttgtgtagcttttcttttctttatgatgtattttgtcagtggattaaggaaagcaatgtgtattctgaaattggttattataatgattattcaatatgtaaaagatgataaagggaggtcctgatatttcacttagttacttggtaaaaacatcttttactaaaatttctatataatatgttattataaactctaatacttacagaaaattatatccctagatatatgaatggaagtcacttgcaataagctctaggcaatgagactttcagttatggtgtagaaattccttctgttttaagaatctgcagattcttacaaaactcttcagtaaagtttcacatttgctaggttgcttctaggtg

SEQ ID NO: 12313 - DNA, 2840 bp, Homo sapiens
ctttcttattgagtttaagatacattagtaaatgtgggaattgtggtgatcggtttttggagtgtcttattggtaataagttgctttatgctttagcataaagtaaaatgtcagaatttataaggtcagtggatagtaactgtttgaaaaatgactaatgtgcatattttaagtgtttgttgtgggggatgaggaggagggaacagagttagtatttcctagcaaaagcataaaatttcttcagtatttgactaaaatacatctggtgggtagcattgtgttcaataaaataattattttgtctgtagttacacttcagtcactaattttcttaagtaggaaaatgtttttaaaaactgttttgagcagaagtattatacaaagtttaatgtgaagatttatttttctagcttccagaaatgttgcatggtgatggtgacaatgaagaacatggcttttgtcctgtggggcaattcatccttcagaatttaggattgctctttggatttgccattatgctggtgattgccctctatgaagataaaattgtgtttgacatccagttttgacctttcccagtaatcactgttgattacgagaatgttaccatgcagctttgcatctgttccttgtactgtatgcacattgctcaaaggaaagtcagtggcttgcactacttacaagtttcatagatttgagcctaaccacaagaggctggtgcttagtactgttttccctgcacgtaggggtcttttaaaaatataaagcttgtgataaagagaggagaatatgggactccatgaaccagtgttgatatgtttgattaagacttttcacaaaataatcatataaaacactagtctctttattagtagaaacttctgtggctatgcagaaatagagatcgaaccaaaaaaaatcatttaaactttaaaaatattttaaatggactttggggagacattttttgtgtgttttaagaatgaattgtagtgctctttaattcagctacatatattcatgtggtgatagggatcaacttgacacaactttgaaactgcataaagtagacataggaactagaggaaagctcaggctgcattagagtatgaatttagcattgggaaaagcccttattcttgaatctagagttactatttttgtatatatttgcatagtgtttaaacctgcagcctaaactactgaaatttgtgattgtatgtttgtgtgagcttcagtttaatgaaagattcataatggttctttgtattattataatacttggtgttggggtgttctttctgttttgttttttactttaattttgttttgattttttttttttttttttggcgggggtaggtgagggtttggagcatgtggtctttttaaaaaattgtaaccctctagaaaatatcaaagaaatgaaccagacgtggtttaaatagttgattttcctattttaacagtaccaactagttaattgggaaatgtaagttctgaatgttcacattgctttaccagtttggcactggaaccaagagcacatgtcgtggctggctacaaggttgtaaagcagaaaatcgaagtttaccatgtctgtaatgtgtacatgaagtgtcaatttagaacagttactaggataaactccattattgccatggctgtcatggtacccaagtgacttggaagatgcatttaaattactcagctgaaatcacttgatcatcttgtgccaagatatgctgttggtgcctgatagggattagtcttttaggtgccctgttctcctaccataattgtgaatgatttgtgagaagtgcaagccatgtttatcctgaatttttacttaataatttgtattactagtcatatgcatgtagctttctgtttacatcctatgccacatggtcttcatttatgccaggtaaactgtatttgaactatgtgcagctagctttgttttaatctgcttggcaaccagtgtagctgctgtaacaatctatcttattgttcaaatatataagagccaaactcttttccattccatctaaaatgttttcatttagtactcttctttcctcctactctatgaacttcaaaacaaaaacaaaactttgagagcagcacatgcatccaggtatttatagattattgccagtgtcttttctgtatgctataagcaagggagcttaggtgttatttctttaatttatgcttgaatctgaaaaattatttctgacttactccatggcctccttataataagtagaagttttatatataattaattttcagcattgggcactgaattaggacagtcctcatctcattgcttggcccttcaagcaacctagctaaaaggtgctgatattttatttagtactgccaacttcaagtgatttagatatctatctatctagatttctgaaccaagatatatttatagttcacttttgggtttttatacccacggtaggattctgcattccagcattaaatctgcttcattttagaacctttataaaagcaatagctggaatatactcccagttttaaaataaatgcctgattgatttaaagcaagtaggttatgctgaagtatataaagaagttttatattctctcaaaaatggtattatctttctttatttgctagattcttacaaatcttttaagagggctgtaacagttgctgctagtattagggttccacatcattctaatgtatagtttcaagtcttaatagacaatctgaattccactacatttcttttggctccaacattccttttagcttgaccagtctaatttaaaatgtgtttgttggaggtcattaa

SEQ ID NO: 12314 - DNA, 1195 bp, Homo sapiens
ttaaatgtgattatggtcctgcaaggtgattcttgctaaaatatctaaacttttgttttgttttaactgaatcattttttaacttaaaaagctggaaaatatcaaatgctgttttttttttttcattgtcaacagtggtgtgtcattttatgtatgttcctaatgcttatggaactcctccaaaataaagttactcaaagagagcaaatatgccagtgtgttttctttagtctttatttcagaacatttccttacatttaagtatgagtcatattaagtttagctgcatttgctcataagtaaattcataattataactttagtcaaatgtatttaaacaaacaaaaaaaaaggtttaagtagtaaaatatgctttctctactcagccagccaacaagaaataggaacaaggaaatgatgtcttctggttatgaattaagttgacataacagtgctacacctcgtccaatccagtgttccttgggttggtcagagggaagagtcatggcaatcacaaaattcgtggaatggccagtggtggataatactcctctccgctcacttgtcttatacaatggagcaacataacttggccgttttggtatatctgccctcttacagggctttagccacatctggaagaaagtacataacacctctttaagtcaaggctgtttgttaaatgtacatgtgtttgagcctactatagtattctcagagtaaggttatgcatgcagatttctgtggcccaaatttattttcaccagcagtgttgttgtgattgctcaaaacattttatagaactctcataactgaaaaaaatagttttcgccttctctttctaaaagcatattttctacctatttatctctcactcagccacaattacctgggaaatgacttttagtgcttacaatgataaaaaaaaaatcagatacactttcaaaggagagaattgccacactgatactgagaatcatgtgcctttatattaattgaaagccagtcccaaaaaattctgaagggatttttatcaacagctgtatagctagagaaccttcccattttaggagactattataaaggagatagatactatatatattatgctgtttaaaatataattgcattcctttataaccacaatctataccccattctttttagtcattaaattcctacaatttgttattag

SEQ ID NO: 12315 - DNA, 1566 bp, Homo sapiens
ttgctctgttagcacttttttctttgactcatttggactgaatttgaaattttatatccactccagtgagattatgatttgtagcttcatatatgacatgtttatattgtaaatgcacttttccatggaataatttagggaagtgttttaatgttaaattactagttgctagcatgttatgatttcatatcctgagatagctctgcagataagaaaatatttaaatatatgacaaaaagtaaaattgtacatgtgagtttacatgttaatgaaataattcaacttcaaatgaacttaccagaatgttttgcatatcaacaaaaaaagtggcttgagttttattatagttggtgtaaactgaacacagtgaagacattggaatttaataggttctctctctaaggtgactcttataccatgcctctatcaacataatttgtttaggaaagcagtatgaagtttaagccaaaataatttctactttatagatgctcaagagacattttacaattgaaaatgtctttcaattacaaatattttgaaacttcgtaagattttcattctctgtggtctgttatatgagagagatcctttaactagagcaaagagggagttagaaacctgatcagggatattctttacaagttggagcagaggaaagagtagcatgccttcgtattttaacgcaaatgtctttttcctcctcccaacctacttgagatctgataaggtctggaagatggagatatttggtatgcaagtgtagagttttttaatcctccagaatttctagagtagaagatacttaggtatagttaaatattctgtatttttagtcaaacatatttattaattgaatatagaagaaaatgttgacacactcagacagcttactgaattttagatgtcttctgcatcttagaatacaagccagtcattcagagttctaaaagtatgcataaaaaattacagcaccggtaggtctattaacacagtgcccgagtcagcggtagcaagactgatgtgatcataaaacatgacatcaggctcgtctgaagttcttgtgtgaaattcctagtgagtgaggaggctcagcttaaagccatctgcagagtggcccctcattgtggtcttttgctgggaccaatgcaagagactagggagagcaaaatgtttgcttatggctagagactatatccagccctaatgatggggaaagttagtccttttcgggtaatcttttatgaattttcacctgatgaccgttatattggtctgttatcatgttacgataactgtgatctcatgaccatgttgctgtatcagaagaaatagtttgacaaatggtaacaacaacctgatgttccccctttagacctttaacttctcaaaattttggtaagtttccaaattctttaataataacttaaaactttttgaataactatcaggtcactttatttgaccacatggtgaattcctttaatgtcttcagcatttgttaaggaaaagttttctctacttgtgtgtgtatgtgtgcacatgtgtgtatgtacaggtgtatgt

SEQ ID NO: 12316 - DNA, 1167 bp, Homo sapiens
aggataatcatggtctctgataaaagatgcccacatttctgtgtactcacagttgttgtatatttttcaatttcaattttgaaagtaaactcaacacattgttttcccattttacctccactacctactcgccagacaaaaatatagatttctctaaaaacacatacaaagaaaatgtctttccttaaaacatgatcttattgacatgaaggtagtttgagcaagggtatgtaataaaataaatggctctcaacctgcatcaatttttatactatagttaaaaaatttatagaggacaacctatgtgttatgctgagatagactcagtaatcatttgtttgcaaattgattatttttttctcatccatccagaaagtacagtgcataacaacaacacttaacaagtgcagaggaacctgtcctgtagtatataataaaaaatgattgtcaccttgctgatctttccatttaaacatgcatgatctccagtactttgtacaatgtatagtatattaaatacatttatgtgtaattttgtgtgtatttttatatggtataattaaaattattacatttatgtgattgtaattcacaaaaagtactacttactatattctgtagagtgtgttgtgaatgtttttacctgtgtttgagcattatggtgtaggtttaatagatgaatatttgccttcagtctctgctcaggtattaatgtgtagtaatttttggtgctttctttttaatctgtgataatctggtgttctgaatgttcaaaaataaatttggttgaatacgcacatggtaaaaagattgcttaccaattgacatactctctataataccatcttggtaaaaactctttaaaaaggatttattggccgggcgtggtggtttatgcctgtaatcccagcactttgggaggccaaggcgggcagatcacgaggtcaggagattgagaccatcccggctaacacggtgaaaccccgtctctactaaaaaaaaaaaaaaaaaaaaaaaaaaaaaaattagccaggcatggtagcgggtgcctgtagtcccagctacacaggaggctgaggcggggtaatggcgtgaacctgggaggcagagcttgcagtgagccaagatcatgccactgcactccagcctgggcaacagagcgagact

SEQ ID NO: 12317 - DNA, 1098 bp, Homo sapiens
tgatgtacattgttgtacaagccattttagtacaggtgtctcatttatgtagttgaaaggtgactgtggaatttcttttgttttttatgtatttccattcagtctctttatatagtcacatgtttcacaggggaacttgtccactggaacctaacatagtacaaccttttaatatgcgtatcttaaaggaaaatattataaaacaagatattaatactaaagtgttaacattaatatgttgttctcatggaagaaaagtagaaaatgtgataggcttagaaattattttttatcagcattaagtgcttcaatttctccccataaagattctaaggaaatttcagttcctcatattatagttttccccataatttaatattactaagtatttctctgcccagtaatgttgatgcagtttgcataaatagccttggaagtaaggaggcaggacagaaagccaaatatcgaaatctctggccttgatttagtgacagtttattctaatggggaccataggtgttattagtaaaaagatagtgtacaaggcctaagttcagtttacattgttctttgaaatgagttcatcttttgtgttgaataattgtattctaagtaggagatgcctgtatttaacataatcatgctttctatataatcaaatatgtatttgttggaatactggtagaaataaccttcccttcctccactgtgcagtggaaaaaaaactcccgatttatactgtatataaattaggaaattatgttacatatttacatttttaaaaatataaaaatgacatattattttgaagtgattgtattatagtttctgaagcttatgactggctataaatataacaacatacccatgagaaaccagaccaaaattgaatatatatcatcactgtgaccttgaacttatagtcatttgggataaaacagagtgtgccttgaaatgataaagagtgccctgcaattttataactgtacattttattatgggtggtcctctcaaattggccccaaatccttgtcttcgaggttggtgaaataaaagtttaaaataaaagttgactggtatttcctttagtatttccag

SEQ ID NO: 12318 - DNA, 1250 bp, Homo sapiens
tctcacatttagtatagtgcattcatttcatcttgctgtttattagcaccctttgtggccaagggaaataaaaggtggtaaaattcagttttcagtttagttcttgaaagctctgggaaatggaggaaacacaaaactatgaattaaactagggctgttgatttctgaacccccagataaatcagttgacccacattttcattttaggtgttaggtccaaattagcataatgtcttgcattattattaggttcagtgtgaaactttacagtgctgcatttgaagtttagtaactggttattattaatcatttgggaaaaatgaaaatgtgttgggactttctatgactaggcatttgttgattatttttcatgattgctttttgttttctcattgtgtaggatttgtgaacttgtatattacaggaaacaagatactttgtaaaatttactggggaaaatccatttggagtgcatgacatttgccaggataagaaagcagtaatatgtttgtattataaaattacaccctgccagaaaactttctttcctagtaaggtaaatgtagaagggacttttacagcatagtaagttgattaggagccaaaattttattccagtttttttttgaactaagaatgttttaaattctgtaatgaacttttatgtttacccattactcatgcattctttcacaatatgtttaatagcctgaggaaataggaaagctgtgaagctactaccattctttacttttaataagaataataggaaagaaaagtcaggtcagtaatccaaatccaaatatgtatactgcaaatgctcaagaagtcacattttttgataaattgtattgagtacagaagaacttatatgaatttattatctgttaataacttagttttgacaacagaataacatttggaaattgtgagaataatcaagctgtttttccattaacagtgtaaattcataacatgtccttcaaaaggtgatattctaagctgtcttaattgtctacggttgataacttttaaataaagtacaggactttctgaaagtgtttggcatgttatgctgccaaaaacaatctgtgttttgaaataccaattaatcagttaatttctgaagactttgtataggacttgatatatgagtcagaatctgtctgtactcattctgtacattgtaactttgaacacttatgaaaaactgtatctgttggtgtgttttgattagttagtgtagattt

SEQ ID NO: 12319 - DNA, 1194 bp, Homo sapiens
aagaactcatccgttttattgtcttgtaatatgaagttagagtgcctttttatatttgtatattctgaaaatgttctgtggaatgttttgtattttttcatttgagtgttatcagagcaatatgataccagtgagttttcatttcaacttttctttgaatgtataaagtgtcttttttcctatttccccttgtacttgcattgaaatgaatatgaaaatgcttaagttttctataggaattgtttgattttgcagtgctaaaatgctttcgtcttacgaaactataaaccataggtcagtattataggggaaaagcattttaagatagtgacaatctgagtgtttgtataaaatgtaattctatgcgtttcttatgtgatctaaaaattcaatgcaaatatcttttatttggtagttttgtctacatattttatgctctagcatgtgcaatatatctttgtaaagcacgatgatacaaatctggtgccagtgttatattttgcataacatatttgtaacagcataaaatattgtttgatgatttcagtgggattttgtctataatgttttcttatgtaaattggagttgaatgactctggtaaatgtcatgactgtaaaaatggggaaaatgacttttagttcagtgaatgactttgaaacaatctgaatcttctcaagcacagtttaatacttttgcaactactgaatgctctaataacgtaatgaagtacttaactgtaatatactatggaaatgcattcagatggttatttttacaaataaaaacggtacaaatattgttggaatttgtgttttaatttttccaatttatgctttttctaaattatgctaatttaaatctttgcaccccctcaagccaaattaactttaaatttagaaaataatcaagataaaagtgtatctccagattcacgatttatgtttgtgttatcacaattagagaaaaaattcaaacatatatgcttgtgtttattatatgtatttatgcttccaacttttttccataaagggttttgttttgttttgttttgttttgtttttttctgctctgttgtccaggctgatgggcagttgtgagatctcggctcactgcagcctcgacctcctgggctgaagtaatcttcctacctcagcctcccgagtagctgggactacagatgtgcaccactatg

SEQ ID NO: 12320 - DNA, 1164 bp, Homo sapiens
agtggtttaagtcttgtccaacacttgacaggtctgctgtgtttagcaagtgaggaatttaactttacttcaaaactgctttctgcctattaggagtgaggatacctaagtaatgctgatagaacaggacaatgttgggcttttctccatgttataagccactactcagcaatgcatcagtaaatacctattcacccactgtatgccagccactgtgcttatatgcaggggatgcaaaggtgcatgagacctgccctctacctttaagaacagtataatggagaaggggagacaaaccttgtgacagattccttatgtactgtgataatacacagtggcagcagctaaaatgtctaggtttgcttagctttgtattcagtaataataagttgatctaagagttcagcataaactgaatgaaatgccatttaatggtagaggaaccaagcattaaggcagtactacacttaattttttaagcaaatatgtaaagtatattttcaaacttttctaatgttatggccccaaatttcttagttttggcctttttactacctatactatttttactgttttgttttgtctccatgtggtagtacttctgtgaactctaaagggaaaaaaaattctgcaagcagcattagtatataactactactgtaagtaaaactgcctattgacactttaggagttcctgcttcagaagcttagttaagaaacagcttgtggccgggtgtggtggctcatgcctgtaatcccagcactttgggaggctgaggcgggcggatcacgaggtcaggagatcgagaccatcctggctaacgcggtgaagtcccgtctactaaaaatacaaaaattagccaggcgtggtggcgggcgcctgtagtcccagctactagggaggctgaggcaggagaatggcttgaacccgggaggcggagcttgcagtgagccgagatagcgctgctacactccagcctgggcgacagagactccgtctcaaaaaaaaaaaaaaaattgactttcaacaaattgatagtgagcattaagggtttccaagttggatttgtaactcctcatcattccttgtatgacaactttctgaatatatgtcactatgtagtaaaattaaacactccaaactcatctttctgttgttagaag

SEQ ID NO: 12321 - DNA, 1932 bp, Homo sapiens
cctgtactttgggaggctgaggcgggcagatcacaaggtcaagagatcgagaccatcctggccaacatggtgaaaccctgtctctactaaaaatacaaaaattaggcaggcgtggtggcacacacctgtaattccagctactcaggaggctgaggcaggcgaattgcttgaacctgggaggcagaggttgcagtgagccaagatcacaccactgcactccagtctgggtgacagagtaagactccgtctcaaaaaaaaaaaaaaagttaattagaaaatatggcttaattgttgagccatagtgaatcttgagtaattaaagcaaaagtcctcaagtggaagctattctaaaggatatattagatatatgaaatgttagatgacttcacatctattcagtgcactgaattagtaatttagtttctaatgggccggtgaatatttcctgtaaaactaagactgtatctttaaggatttttccccctttcttataagaccgcatcttaaaggacttttttcccttccgttgtagagaccttgtacacagacagacggctagtgcagtggtacagcacatgtcacttggggtttatggatttggttgtgaagattcgctgaatcacttgttgaactatgtatggcccaatgtatttgagacatctcctcatgtaattcaggcagttatgggagccctagagggcctgagagttgctattggaccatgtagaatgttgcaatattgtttacaggtaagttaaagattttttttttaatcggtgattttttttttttaaataatactttaagttctgggatacttgtgctgaacgtgcaggtttgttacataggtatatatgtgccatggtggtttgctgcacctatcaacctgtcatctaggttttaagccctgcatgcattaggtatttgtcctaatgctctccctcccctttccccccactgcctgtaagttaaagatttttaaaagattacttagcaagaaaagtagtgtattgaattaagttacttttcctgattatcattagggtatattgtgccatatggtagaacaattgtgtggtgacaggggagtgagttttgtctcttccattgcagcttaagagcagtgtaattagtaggttcccccccccccaactccccaagggaaataattttgaatcatatctttatgttttcttaattttgttaaggttatgtatgttcttaaaaattgaaataatgtaaccgttcaattattttagggtctgtttcacccagcccggaaagtcagagatgtatattggaaaatttacaactccatctacattggttcccaggacgctctcatagcacattacccaagaatctacaacgatgataagaacacctatattcgttatgaacttgactatatcttataattttattgtttattttgtgtttaatgcacagctacttcacaccttaaacttgctttgatttggtgatgtaaacttttaaacattgcagatcagtgtagaactggtcatagaggaagagctagaaatccagtagcatgatttttaaataacctgtctttgtttttgatgttaaacagtaaatgccagtagtgaccaagaacacagtgattatatacactatactggagggatttcatttttaattcatctttatgaagatttagaactcattccttgtgtttaaagggaatgtttaattgagaaataaacatttgtgtacaaaatgctaatttgtgtgtgttttttgaacatgacttgtaaaatgcggaactttgataaagtattggtttatgtggaataagtggcttaatttcattttctgtcacatggtttatagaaagtagttagctgaataaaaactatataaagtgatggcatctttgtcaaaattccattgttgtgttaataatgacag

SEQ ID NO: 12322 - DNA, 1163 bp, Homo sapiens
ttgtgtggaggaaagataaaaggaaaagagattttatatggtttataatgggagactacaattcggatattcccctcaccactcctacctagttctagtgcccattttgacaactcagagaattactcactttaaacatttagttaaatttctttatatttcagaaagtttaagaactgaaaattacatttgaaaattgagttaacttaaaatgtttagaatttgtacagctatgacctctgatcttctcagagtcaacttttttaaactgaccttttaatttatatgaaatttttatatagaaacaacaatgccagtgacttgaaagtattgcattttataaaattactgagttccctgtaattattaatacttaaaagttttcatctttatgcatttttttcttccataaatttttgacttataatgtaacagcttgttgacccatttgtttttttcagccctcatgatgtattggctacacttctgaacaacctcaaagttcaagaaaggcagaacagagtttgtaccactgtagcaatagctattgttgcagaaacatgttcaccctttacagtactccctgccttaatgaatgaatacagagttcctgaactgaatgttcaaaatggagtgttaaaatcgctttccttcttgtttgaatatattggtgaaatgggaaaagactacatttatgccgtaacaccgttacttgaagatgctttaatggataggtaagtgacttgaactaaatacaagaaaataattataactcttccttcattttagaacatcgtgaaatagttattagatgactttttactgtaacatagttaaagaaaaaattgctagcctggagtcttaggacattgtaaatatgacttattattttaaaataatgtgcacgctgtagtgattccccagactttctttcaagttctcccatcccctttaaatctcttttcttatctattgaattaaataaattttgaaaagggttgattgataatcttttgttttcaaaattggtcaaatatagttagaggacatgatgagcagaagctaatgggcagagacctgatctttttagctttttgttgcaggtaaaggacaggtttctcttaagcctttgaattactgaacaatagcctgccagaactaca

SEQ ID NO: 12323 - DNA, 1198 bp, Homo sapiens
ttccttctttattgcccttcttaaaagctgtgtgcaaaagcaagaagtcctggcaagcgagacacactggtattaagattgtacaacagatagctattcttatgggctgtgccatcttgccacatcttagaagtttagttgaaatcattgaacatggtaagttgtaatgtaactttgtctttttttttttttctttaggagacagggtcttactatgttgcccagactggactcaaacctttgggctcaagtgatcctcctgctcagcctccttagtagttgggactagaggtacacacacagcctgtccatgtttaataggacagctgtcctaaaatttgggctactgatttggggagataaatggaaaggcatagctctacaaactatagattttatgatgggtttgttatattatctgctgacaggctatggttcatgttttgcttttacctaattttgtttaatgtgaacatattctgcagtttggctgaatagttgatatattgagagaatctggatgatattgtgtaacttaggtaatgttggggcatagttaaaacctgtgtttggttttgtaggtcttgtggatgagcagcagaaagttcggaccatcagtgctttggccattgctgccttggctgaagcagcaactccttatggtatcgaatcttttgattctgtgttaaagcctttatggaagggtatccgccaacacagaggaaaggtaaatccaccaattaccttttgatttatcttcattaaagttaaggcgacataaatctaaattactaaagtacatatattttttatttaaaaatagggtttggctgctttcttgaaggctattgggtatcttattcctcttatggatgcagaatatgccaactactatactagagaagtgatgttaatccttattcgagaattccagtctcctgatgaggaaatgaaaaaaattgtgctgaaggtaattattccagatttgttaatgtaaactggatatgtttcatggttctaacagaattttaaagtgtttttaaaaatcaacaaaaaaaactgtatgttacacgaatactgtttgatttgtttttaaattttattttttaaaatcacgtaatcagcaatgagtattctcttcatttcaggtcagttgatttattattactatttcttaaccttttaggtggtaaaacag

SEQ ID NO: 12324 - DNA, 1162 bp, Homo sapiens
attttagaacttgatagttttgagtataactgtttgagaataaagaatattattttaacagtgattaaaattgtggttttactcactctttctttttaaagatactcctgggcatggaagtggatgggctgagactcctcgaacagatcgaggtggagattctattggtgaaacaccgactcctggagccagtaaaagaaaatcacggtgggatgaaacaccagctagtcagatgggtggaagcactccagttctgacccctggaaagacaccaattggcacaccagccatgaacatggctacccctactccaggtagaactgtctcattggacataattgtttttttctccataaattatttaattttttcctttgtggtattctgtgtactattaatgtcaacttctagtaagaataaggagatatacaaatttaagtcttggtttgcgtttataatataaaagcaaataataggattgatcttaactgtcttttatctcaatgtatgtaataatacagtcttgtactatagattatataaaaatttgcttttcttggtaggtcacataatgagtatgactcctgaacagcttcaggcttggcggtgggaaagagaaattgatgagagaaatcgcccactttctgatgaggaattagatgctatgttcccagaaggatataaggtagtacatcaaatttgaatgaggtggtatttaggatatacatttattttaaatagtgaaaaaaattgattaagcttgcattggctttgcccaaatttactattgtcattccattctcttagctatttccaggtatatttcagttccatatagagatgaaaagaaatgaacaacatgaaacttttattactttttgaaagacatctcaaagacttgtgtatgggtctatcggttatactttgagaactgctggtgcttcagttttctagcagtcccaggaataagctcgttgagattgtggttattttacttggtgcttcaccaagattttatatacttaagtttatggattgtcagtggacacaaagaatttttttttttttttttttttaaaagatggagtctcactctgttgcccaggctgaagtgcagtggcgtgatttcggctcattgcaacctccgcctcccaggtttaag

SEQ ID NO: 12325 - DNA, 1220 bp, Homo sapiens
aatgaaaaatgaccttgaattacagggcgaaagatgggactgttaagactgtcttcgtaactaagcactgtaaagactgagacagctgcaagggaaagttttcctcgagctcttccagtgaattttgggaaaagggattgaatgtctgaggtctcttccagctctgaaaccgcagcgtttcgtacagtgttcatttttttttaatgggaggggtctcggggtcttgctctgtcgcccggtctggaggcttgagtacagtggcgcgacacgattacggctcacggctgcctcgaactcctgggctcaagcgatgctcccgcctcagcctccagagttgctgggactcagtgtctgttcttaactcccttcgtagaatccactttcctccagggcaaagttactcacttaaggaccttacggctcggctcggggatttcctgggtcaccacgcaggcgacttcagggcccaaccgtgtctcctcccccacccacaatgcacctcgcggttccctctaggtggcagttctgtcacgtgtcacccgacggagcgcgctcccgtttggcgcacgcgcagagtgcagcccccagctatttttctccgtggcggcggcgacgagcggaagttcttgggagcgccagttccgtctgtgtgttcgagtggacaaaatggcgaagatcgccaagactcacgaaggtaagcggtctttccctgcttacgtgttttcttcgttgctagcctaataaaagccttttttcctaggattctgcctttttctatggtttctttcgtaggagctgagcccgcgtttcggggccaagggtcgtctcctccgcgccagcggcgcaggccactgccccgcgtaatggcgtcctcctcttacacccccgacaggcgctttgttcagtgtttgggacctgctacttcagagtagcttctcttctctgaccagagggcctcgtttaagcggcttcctcagtaggattcgtgggcaagggatcggggaagcgggcgtggggagaaggtctcactcgcctctcgacactgtcgtccccatagtttgtgcagaagagggtcagaaaagcactgaaatacggcagccgcttttccggcagactgaatcgaatttggttaaaccgagattccgttactcctacccttgtgtgtcttcaagcgtcagttacttgtttatttttcttgcacgaaacgatttggggataaa

SEQ ID NO: 12326 - DNA, 2465 bp, Homo sapiens
catcttgaatgaagaggccatactaactggaattcttttcgtctttaggttggtgggacaagtgatgttgaagtgaatgaaaagaaagacagagttacagatgcccttaatgctacaagagctgctgttgaagaaggcattgttttgggagggggttgtgccctccttcgatgcattccagccttggactcattgactccagctaatgaagatcaaaaaattggtaaaaagttaccttttaaatgagtttgtggcctgattttagtttttcttagaataataatgttgcagtcccctaaatggaatagcacattcatttcctgaataacagaagtagaatagtgctaatgtcagagctaaacatgcatcacatctttttcagaggaaatgatttgatctgtagtaggattgggatttccctacatcaatatcctcacaacttataaatgtgttacaatatttacaaatgaaagtattaaaattttgctgaaatttctctgtaggtatagaaattattaaaagaacactcaaaattccagcaatgaccattgctaagaatgcaggtgttgaaggatctttgatagttgagaaaattatgcaaagttcctcagaagttggttatgatgctatggctggagattttgtgaatatggtggaaaaaggaatcattgacccaacaaaggtaaatggttgaacactttctaaaaattcttttgttgttcattttgttaatgtatcctcacatcccaaatctttgattttgtcaccagaaaaatagtctaatagcagtagcaacagcaatagctcttgtgcccatcaacaattctcatgtacatttccagcacctagatatttaatactccactaaaaggaagcaggatcccttgagtagcagttgagtccatgcctggaggcaggaaaaaatcaggatggatctggaacaccctgttcctgcctggcagtaagaatactttccaagatacgcagaacagggttttgttttgttttgaagacagagtcgctgtgtcgcccaggctggagtgcaggcagtgacaacctccacctcctgggttcaagcgattctcctgcctcaggctcctgagtagctgggattacaggcatgcaccaccatgcctggctaatttttgtatttttagtagagacggggtctcatcatgttggccaggctggtcttgaactcctaacctcaagtcatctacctgcctcagcctcccaaagtgctggattacaggtgtgagccaccatgcccagacagaaattttcaataagtcttgctcatattttactaagggaaaactaattaattaaatttttttctaggttgtgagaactgctttattggatgctgctggtgtggcctctctgttaactacagcagaagttgtagtcacagaaattcctaaagaagagaaggaccctggaatgggtgcaatgggtggaatgggaggtggtatgggaggtggcatgttctaactcctagactagtgctttacctttattaatgaactgtgacaggaagcccaaggcagtgttcctcaccaataacttcagagaagtcagttggagaaaatgaagaaaaaggctggctgaaaatcactataaccatcagttactggtttcagttgacaaaatatataatggtttactgctgtcattgtccatgcctacagataatttattttgtatttttgaataaaaaacatttgtacattcctgatactgggtacaagagccatgtaccagtgtactgctttcaacttaaatcactgaggcatttttactactattctgttaaaatcaggattttagtgcttgccaccaccagatgagaagttaagcagcctttctgtggagagtgagaataattgtgtacaaagtagagaagtatccaattatgtgacaacctttgtgtaataaaaatttgtttaaagttaataattgtgttagcatttccatgattagaagatactgaaaattgaaagccagttgaagggcaggctggcatgtgtgtaaaacattatcctatctatgatattttcatgtttctctttgttgcagactgaactacattattccattgataatggggaaagacagtttctattttccccggtgcaaggatgtaatctctcttggagctgtaaaatctgggaggttggagggaactccagctcctcagcatggcctttgggctgctgctgcaagcaaggcattgaggcaaatatttttgctgtccttaccttggacagaagtagaggggagaaataaagtccatcatcacatgaaaagtcagtcacttgaaatcctgtacctagaatacctttggctttggtaatttcgttgtgtttggggtacaaaaaaaaggatctatttgatagcacaacggggtgactatagtcaataataattgtacatttaaaaataaaagaatgtaattggattgt

SEQ ID NO: 12327 - DNA, 1097 bp, Homo sapiens
ggtttcaccatgttggccaggctggtctcttaactcctgacctcaggtgatccacccaccttggcctcccaaagtgctgggattataggtatgaggctctgtgcctggccaatttttgaattttttaatagagacaaggtttagccatgttggccaggctggttttgaattcctggcctcaagtcatctgcctgctttggcctcctgaagtttttaaaatatactttctaatatgtgtcaaactataggtattagttggtgtcatcctctaaaaaataaatgtatatattccaaaagttaatgcatatgagaaatgaaggaggaaaaccaactcactggtgaattttaaagtgtattggaaccttggtttcgcttttcatttaaatgtattgcagtcattttttgtatatttttgaaatcttcattatttttacaggtcagaaatgtgaattccaggatgcctatgttctgttgagtgaaaagaaaatttctagtatccagtccattgtacctgctcttgaaattgccaatgctcaccgtaagcctttggtcataatcgctgaagatgttgatggagaagctctaagtacactcgtcttgaataggtaataagcagtggtatttgttgatttatatttctcggtgaaagacagaattatttgtattgctgtttgcagtttccatcatgtgtacctccacatttgatccagttgggtttgtatctagaattgtaattgtgtaaatcaggtgtgctctaatgtatccttatggttgtgtttttgaaggaaccccaaagtctttactattttgatcagctttctcatagaatagactaatttagcacatgggtacctttctgtattttgcaagtgtttacagttgttttgaaggcacatgactgaatcttgtattttttttttttgagacagagtctcactccctggcccaggctggagtgcagtggcataatcttggctcactgcaatctccatctcctaggttcaaacagttctgcctcagcctcccaagcagctgggactacaggtgcgtgccaccacacctgactaatttttgtatttttagtagagacagggttt

SEQ ID NO: 12328 - DNA, 1369 bp, Homo sapiens
tgggataccgcgcctccagtcttgaccttgctgggggcgttcggaaagaaggacacgtgggctcgcgccgagtgggccgggccgccgcccccagcatcgcggccttgctggttgctctgatacagtagccttgggtggatccatggagacactttgctgagcggctttttgcaccgtcaggaatacttttaacttccctggtcacttggatttgtaacttgcctctctccggctgacttggtttctcaggggccacagttggagtgggtctgcccacaaggccgttttcgcggtgaaagattaactcgtttttggcggcagggataggtggccgtggggaaggagccgcatgtgctttgtgctggtgctataggtcaggcgccggccggggcggcctctttagcttgcgctagtggctgatgttccgaagctgcggcgccttccgtcattcaggcgtagtggctggcggaggtcagccaggctcagcatctcacgttgcttgctctgttgcacaggtgggcatgtttgttctgcagcgcaccacgggtggtagttctgatgatctttttgcttccatccccagaaatgcttcggttacccacagtctttcgccagatgagaccggtgtccagggtactggctcctcatctcactcgggcttatgccaaagatgtaaaatttggtgcagatgcccgagccttaatgcttcaaggtgtagaccttttagccgatgctgtggccgttacaatggggccaaaggtaccagtatttttattttattgtaattacggtattattaatagcattttactcacaaatagtcgcactgaactattcaacagtactttcatctccatttttgagagaactcagtttacatgtaagaattctgaagtattggttagcctttttttcttagacatgatcttaaagcttaaactgcttcagccagattttcgaaactattttgttcaatgtgtgatgtaatcaggtagtaacttacagctcaaggtggattcttaaactcgaggtagaatttcgctggcttaagttaaaatttggatcctttcccagtagttcatgccaagtgtagagagaagagtttaacttatcttccataattccttaggtatgtgcttgtagatgctaaatttttttttggtttattgtagtaaaatgtacacaacataaaattaccattaagtgtgcactttggggacatcaattacatttatgttgtgcagtcatcaccaccatccatctccaaaactttttatatggaaaaattgtaactttgtactcattagacagtagcttcccattctctcctccaccccaagatgctagttttacccatcggttttctgct

SEQ ID NO: 12329 - DNA, 1184 bp, Homo sapiens
gataagttatgttaatatttaacagttataaagttagctttagttaactaaagttagcttttccagaatattttcttgaacttttacgttggagtcaggttttagtttaagccactgtgtattatttcaaagtgtaactacagtggtatttttgagtgaagatctgtaattctagtatgagtcgtatcacttagccacgaaatatatttttaatataattggatttgagtgaccatgtttcattagttgtagtgatttaaaagttaactgtttatgttgggtgaactagatatctttgctaataaacatccttccttttttaagggtggagagattcaaccagttagcgtgaaagttggagataaagttcttctcccagaatatggaggcaccaaagtagttctagatgacaaggtgtgtaaacttaataattctaaaaagaagtcagatatttgcaattagttgtcttaactaatggtttttttcacttgcaggattatttcctatttagagatggtgacattcttggaaagtacgtagactgaaataagtcactattgaaatggcatcaacatgatgctgcccattccactgaagttctgaaatctttcgtcatgtaaataatttccatatttctcttttataataaactaatgataactaatgacatccagtgtctccaaaattgtttccttgtactgatataaacacttccaaataaaaatatgtaaatgagtggttaatctttagttattttaagatgattttagggttttctagtttatgctttttttctgtttttcaagtaacctgcagagaattttgggaaacaggattttctacgtaggtgcattttcacactgaatttagctttattaatacatgattgatactgataccaagccatggatttactttttttttttttttttctgagacggattctcactctgtcacccaggctggagtgcagtggttcaatcttggcttactgcaacctccgccttctgggttcaagtgattctcctccctcagcctccagagtacctgggattacaggcgtgcaccaccatgcccagctaatttttgtgtttttagtagagacaggttttgccatgttgcccaggctagtctcagactcccaaagtgctgggattacaagcgtgagccaccacagcaacatt

SEQ ID NO: 12330 - DNA, 1218 bp, Homo sapiens
gtaatgaggcagtaagggtgaaaacattgtacatgttgtgaagaaagtatttaaatccaacttttgaacagatttaacaaacatgaggaacttttttatttagaaggataattttgaagatgaaaatgtattcatcttaattgttttttcaaatttaagggaataatttataccatcttttcagacaagaatgtacagcaaaaataaggggaacagtagtatactgagagtgtgtgtatgtatagtgtatgcctttccaagcttgccagtctttttggctttgaacactgcccatcagctacagtcattactgttccccaacccacaactatcttttaagaagtcttagttcacagtgaaaggaatgatgactttgaaattatggatttatattaatggcactataaaccaatggtaatggtaatttttaaacttgctaaatattgagaaactaaactactaagttaataaattatatatagcagtgtagctgttctctctagatggtgtctcacaatggatttctgttgcttgactattttcttagtgaatatttatactaaggtagtgactgagatttggtgatctggctgagtattttgaaacacattttgaataatatggcttagtgttaacggggacttaaatatgatttttttttcttactcatttcaccttccctgtactgtatgtttggaattgatcataaaacatctccaaaagaaaataatcagtttgtagtcttgcttttgtattcatgttgataatcttactaattgtgaagttgattcactactatactaggtaagacctaagtgaaacagttcctgtttttccttaatactgttttcagaattttgaaaatgtacttatatatacataaatactactaaaaaattaatgagcctggcaaaccattgatttataaaagtaagtgttctaagaggggaacaagacagttctgtgtgataaggaagttaggctccactttttgtttgaattaccctatgtatatccgaaggtaaacttaggcttttctttccaaaagatcgtatagtcaattcattctttttctcctatcacatctgggaaagtagctaacttttaactatttatgttcccataagtaacccttcttttgtgtgtatacatttccttttctctgacttgagatgtcaaatttggatttctagaacagtttctcagttaaattcttga

SEQ ID NO: 12331 - DNA, 1218 bp, Homo sapiens; identical to SEQ ID NO: 12330

SEQ ID NO: 12332 - DNA, 2767 bp, Homo sapiens
aagcaaggcagcacctgccgaaattgaccagagataatgtgaacttctactaggcaaagcaatacatcggtccaaggattttctgctttcatttctttaaaagttttttgttagtttgttttttgtttttgtttttgggtttttttggctttatttttgtctttttatgtctgttttgtttttcttacccttttggacatttctttgttgcacaggatacacctatagactgaataagttcagtatttccgaatcagacatcgccttggcaaagacactaaagcgttacactttatcccgtctctatgactggatcatagtcattataatcacaggagactctgccttcattatccttgcacttaacggaagttacatcaggcaagtaccaggatgaaaagaactatgaaataaatgaaggaagctacaagtgtgtgtgtatatgtatatgtatatatctctatatttacatatatatattaaaattgcatgggacagagactttgcaatccgaaagaatagactgtgaaatgagttcttaaagaaaagacttgtttatgtattaaaaaaaccacttcacagtgagtcgctttggctttttgataaactgcggcctgctctcagggtggggtgactatttttgaattcctatttattttttgtgtttgtccctgattttttttttttaattctatggcttcctatctggcagcttaatgggtaatttttgaggtatgtatttaacaaaataaacgacactgccgaaaaaaaaaaaagtgaagtgaaaacaatcagggcacattaaaatgatacaagtcaaataaatcttaaagacacaatgcacacttaaaatgactcaataaaatgacttgctacgttccgttattcaatttgtcattactgtagtgaacagatgcatttctgtggaattccaaataagtaaaactgaaattcagtgcagagaaaactttgtccactagtgcaagtcttgatcaaatgacattttgacattggacatatggaattcatagtatgagccacattttgttgtgaaatttatttacctgcttgtggcttcaaatctgaaaattaataagcctgctcgtttaaaagttgtttgttgttgctgtttttttgtctttttgttttttactagaaaatagttcagtgtaatattaagttagaaaagaagttgctgcccagttaaaggggctccctctcaaataaatctccatccttccctctcccaaaagacatttctgatttctgcttcactttgggcttcctcttcttcgtacacattccatctacctaatcaaacattttcagtccctgatctctcctgtcccttttcctgggatgacagccctaacaagaactgtttttgaatcgttgtgcagctccaggcaatagagtatgtgaagcgatttcagtagaatcacttactcatcctaaaagaaaacattatcccagttacctacatcgcaattaccttatgtaaagcagaactaatgctgactggatgtttaatgggatgagcattaaagctgcaatctactatagtactccagatctctttcggcttcctatgagaaacaccagaagcattactttccacttctacttacagtaattgcaagaggagacctcacattcaggactggcctagtgaacgtaatccatgctttaaactggccattaaacagtcccacatggttggattttttttttttttttgagttgtgctttcacaaaaccttgtcaaagacctcatgcaatatcactttgaaagttattttctgtttactacacaaacattgtaatataactgttaatactatttatatatttgaaaggtataaaaggtaggagttaaaaaaaaaacctctatgtgtagatattaactcagaacttacaatatacagggagaagacatgttgcaatacaagctaattctagctgctcagtaacctctggagtttttaaagggacattttcctgtactttttcaaataatgatgtttaaaaattatcttgacataagcgtcatatacctttgcaaaaggatggttgtttgcagttagccctggccccatccttcctatttctgtagtatgctgcagctttaatcagaaagtccatggttgctgcttcctgatctccgagttactctttccaaattgtcttcttacactgttgctgaaggtcactctgtacacgtaatggaaactgattttgccaagctcttacaaggtggttcatctatcgatggcatccgcatttggtatcttttacacttcaaccaaaaatttattaggtatttttcaatgctaagtcttgccttttattttttaatttcactgccaagtttgcagtggttctaagtgaatctgtgggcattttagcctgtggtcttgccagatctttgcgaattacaatgcatatatgtctatttattcaatatctgtcatataatatctatttggaagaagaaactttctcttgtagtgcctcttgacaaagcacaatttcccgcctttttttttttttgtgaaatgaaaaaaacaaattgtgttttattgcggtatcaacaatgtgaataaggattaacatattgtaaatgttcttttttccatgtaaatcaactatctttgttatcactaagtgataattaatttttaacttatgtgcattgttaggctgttagaattttttggttgttaaaataaacgcattcaataaatatgactttgtttgtcagttattt

SEQ ID NO: 12333 - DNA, 1162 bp, Homo sapiens
tatgtgagctttttactagaaggtagcacttaatttggcaggagatgttatccttgtcatttcctgataaccattaactacatactacagaagataggaacagctggtgcttttataacaaaggttgattggggagatgatagagcttgggggatctaagaggatttagaatggtcagtggtttctgtcttggctatttaaagaaatgcttacttttaagaattttaactaattgaagtggcaaataattttactttctttcatatgttccatgaaaaaaatctattgtaacatttagcagaaaagaatatcacttttatgctggagcttccatcgttgtatgaaaaaatgtttatattattaacatgccaaaagtatgataattcagttctacatatattagcaataaattgtaccaatgaaaataatgattaattatcacttttatctcttaacagtggaaagagtggaacgagaaaacctttcagactattgtgttctgggccagcgtccaatgcatttaccaaatatgaaccagctggcatccctggggaaaaccaacgaacagtctcctcacagccaaattcaccacagtactccaatccgaaaccaagtgcccgcattacagcccatcatgagccctggtcttctttctccccagcttagtccacaacttgtaaggcaacaaatagccatggcccatctgataaaccaacagattgccgttagccggctcctggctcaccagcatcctcaagccatcaaccagcagttcctgaaccatccacccatccccagagcagttaagccagagccaaccaactcttccgtggaagtctctccagatatctaccagcaagtcagagatgagctgaagagggccagtgtgtcccaagctgtctttgcaagagtggcattcaaccgcacacaggtacaattagcattaaacactgtaattaacagtaatactggggacagaattgagataggttataattatttttatctctttaaaaagctttatggatctcaggacatagaattagattaattaataatccttagttaatgaaacgctattaccattgatccatgcatgaccatgattaattaactaattgattaattttgatgaggtaatggacatctttgaacccaacat

SEQ ID NO: 12334 - DNA, 1208 bp, Homo sapiens
tcataaacattgttattttcaagattgatttaatgtatgtaaactaaattccactatttattcctaaattggtaacagtgctatttgaaaaatagctttttgcctgtatcctaggttatgtatttaaagtgctgtttgcatcaccagagtccagtttatctgtcctcatattaggcatgtgttatagctagtatttaacacatactagctatatgtgttatttatataacacatatatccaagtttctcttaggggctggtagatgttgaatatagattagtccattaaaaatacttacattacttgagaatgtacttcaattttgtgggtatatttattgtgattgaatgggtaggttaaacttttttttgttttgattttgatttaatattaaccattatcttgttgccaaaaattcttctaaatatacacttgcaaattacatagttatctaacacatacttggactgatgtaagatttacattatttgcaatgtctttcctaggtttcagagggagttcacacaaggagtaaagcctgactggaccattgcacggattgaacactcaaaattattagaataattttcttggaaaaatcagcttatggactttagcagttgctgtgaaaaactaaggaagaaaaattttggggtcatttgatcttcacttaatctaagtctgtgaattacttttatattattttgaaatactccttgcagtatattggcatgatacagtaaaagcattttccacagattgttatcaccttctttaaaagaagtcaaaatttaaaaaatacaatagcacgttgttggtgtcatattcaataacatttccaatgctacatataattttatagacataataaagaaggtattgaaaaaactacttacaaatttctttatatattttttaaattgtttgagaaacagggtcttgctctgtctccctggatgaagtccagtggcatgatcatagttcactgtaacgtcgagctcctgggcttgagcgatccccctgcctcagccttcagagtagctgggactacaggcatccaccagcatggctggctaattttaaaaaatttttatagagatttcactatgttgcccagctggtcttgaactcctcaagtggttctgcctcggcctcccaaagagctaggattataggcatgagccactgcacccagcctacttacaca

SEQ ID NO: 12335 - DNA, 1820 bp, Homo sapiens
agcgtgggtcatcttgggaatcaaataatctttctgcagacactccctgtgcaacagttttagataaacaacacatttcaagtccagaattaaattgcaataatgagataaatggtcatactaatgaaacaaatactgaaatgcaaagaaataaacaggatcttcctggcttatcttctgagtctgccagagaacctaatgcagagtgcatgaatcaaattgaggataatgatgactttcaattgcagaaaactgtgtatgatgctgacatggatttaactgctagtgaagtcagcaaaattgtcacagtctcaacaggcattaaaaagaaaagtaataaaaaaacaaatgaacatggaatgaaaactttcagaaaagtgaaagattccagctctgaaaaaaagagagaaagatcaaagagacagtttaaaaatagttcagatgtcgatattggggaaaagattgaaaacaggacagaaagatctgatgtcctggatggcaaaaggggtgcagaagatcccggttttattttcaataatgaacagctggctcagatgaatgaacagctggctcaggtgaatgaactaaagaaaatgacccttcaaactggctttgaacaaggtgacagagaaaatgtactgtgtaataaaaaggagaaaagaataacaaatgagcaagaggaaacatactctttatcccaaagttcaggtaaatttcaccaggagagtaaatttgataagggtcagaattccctaacttgtaataaaagtaaagcttctagacagacatttgtgattcacaaattagaaaaagataacttactcccaaaccaaaaggataaagtaaccatttatgaaaacctagacgtcacaaatgaatttcacacagccaatctttccaccaaagataatggaaatttatgtgattatgggacccacaatatattggatttgaaaaagtatgtcactgatattcaaccctcagagcaaaatgaatcaaacattaataagcttagaaagaaagtaaaccggaagacagaaataatttctggaatgaaccacatgtatgaggataatgataaagatgtggtgcatggcctaaaaaaaggtaatttttttttcaaaacccaagaggataaagaacctatctctgaaaacatagaagtttccaaagagcttcaaatcccagctctttctactagagataatgaaaatcaatgtgactataggacccagaatgtgttgggtttgcaaaagcagatcaccaatatgtaccccgttcagcaaaatgaatcaaaagttaataagaagcttaggcagaaagtaaatcggaagacagaaataatttctgaagtgaatcatttagataatgacaaaagtatagaatacacagttaaaagtcactcactctttttaacgcaaaaagataaggaaatcatccctggaaacctagaagacccaagtgagtttgaaacacctgctctttctaccaaagatagtggaaacctgtatgattctgagattcaaaatgttttgggggtgaaacatggccatgatatgcaacctgcttgtcaaaatgattcaaaaataggtaagaagcctagactaaatgtatgtcaaaagtcagaaataattcctgaaaccaaccaaatatatgagaatgataacaaaggtgtacatgacctagaaaaagataacttcttctctctaaccccaaaggataaagaaacaatttctgaaaatctacaagtcacaaatgaatttcaaacagttgatcttctcatcaaagataatggaaatttatgtgattatgacacccag

SEQ ID NO: 12336 - DNA, 1963 bp, Homo sapiens
ctgaggcgatcaggtcatttgaggccaggagtatgaggccagcctggacaacatgggaaacccagtctctactaaaaataaaaaattagccagttttggtggtgggcgcctgtagttccagctacttgggaaactgaagtgggaggatcacttgaacccgggaggcagaggttgcagtgagccaagagggtgctgctgcattccggcctgtgggacagagggagactctgtcttaaagaagcttcaaagttataaatgggaacttttgccttctgatacataatgtttgactgtttttttccccttttctagaatctgaatctgaagctgaagaaggtgactgaattttgaaactacaccctcagtaaagcaaacaggagttgtagataaaatgtcatgtctcatgtgtcctggttcttacatcttcctacctccctgtatcaagcatgatataagggctttcatggcaaattttattttaactgtttctatggttgctggaaatgttgggtttagtttctaaaaccatgttttaagtagctacaggagctatagatttgaatctaatgttgcattagtcttttcagttatcttctacctcctgtattttctactgtaataatgtaatttaaggccttccacaatgaacagttcactttattccctgggttttctataaacagttttaaggatatgatttggttaaaaaataatttgttataaaaattctgtttgcaaattaaactggaaaagtatccagagtctcaaaaggcaatgatttgtgagataatatggcatgcccggagccctgctcatcaatgaaaaacccatatgtaataatcgaattcatttaacatgaatcttgagtacgtggaccattgcttgcatgttaactttttgttttgttttgttttgttttgttttgcatttttaactccagatatcctaaagctcaattgtttggtctctggttttcatccttagagaagccatggagaacagacttgaaaagtttaggaaatcataatgtggcagaggtggtgggaagaagaaagttgagctttttccccttgagaaacttctgcatttagtttctatctttccaggcaaaacaaatgggtattcttttcatacaaccattttcaaatgaaccttagaaaagtcttaacatttaaggtattttatgcacagaatacacttagattgataggaaagaactcgtaatggagtttgagtaaagaaaatgactgatgtactaaacccagtaaaaattgttgaaaatgttaaaggtcagcatgttctaattgggaatctagatatagcttagatttcctattggcttagagtatttgctataacaaatgaagtgcaatgacaattatatattcctactcggtcatactggactggcttcgttctcttaatatactcagtaatgactcaagcctctggctattaacataccctagttgccgttttttaattgccatgagccaaatacttcttggtatacaattgatccatttattttaatggctgccttttcattttcatcttttcttgctgctacccatctatgtatgtagtcattggggggaaaatgtagccacattttttatgggaagactttgtgttaaaagtgaacattttgaaggtttttaactggtgaaactagcctggaataatgccaccagagactgagtggaaatcgccccttttgaaggtgccattcttatgagccaaaagtttgtcatttaaaagttcattttgagggaataacatgtaatataatttgaaataaaggtatagtaaccttaaaaagaacattataactgattgttgtgaatggggtgaatttgttaaaatgagtaactttgataaagtttttcatgcacaggcaaaatgtattcactagatttctacgtagtgatctgcttttactttgtaatttgtagttctcaaa

SEQ ID NO: 12337 - DNA, 1197 bp, Homo sapiens
caagaaacctgattagttttgatctattgaaatcacaaaagtagaacagggcattttatttttgtataatttaggattaggtatgcttctttgttctaacaagtcatgttttctaacccttctttcactaagcaaaccagaacagatttgaactgttatgggttatatattagtatggagatcagctcagatgacattaaaaatgccgtagtgttattcttgtatgccaaatctttttttccccaaaattagcactttaattttatttactgttataatatttgttttcttagattaggtaggaaatcttaatttggccaccgcctactttgacaagtaaatattacatcatacgattttgcaacattaaattagaacactagaaactaaaaaattatgtttcagtgaatgctacaactaagcattttttttttttaagaaaaacaattgtattatgttttgttgccttgccactttgagtatcttatctgaaaatctgttccttgccatgtttttctcctgttaacataaactatgtgccctgtgaatttctggggactgaatttgaaattgctcctgccaaccgtttgtggcctggcgtgtatctgaatgcctgaatatctccccgctgaatgaatttcgtattctgccctgaattcactcgggtatattgattggctggatgatcttggtgccgcccacttgacgtttccagaagagtcaccgaaggaaaagaaccaggagtgtagaggatgatgaggagggtcacctgatctgtcagagtggagacgtactaagtgcaagatgtatagaatatttttcaacacttattaacttttcagataacataatctatatatagattaagctttcagggatttggaaatctttttttctttctcttttttgtttttgttttatttttccatttcttttggtgggggggattgtatttttgctttctttagaaatgtaatgtttgttatatagaacttccagaacagtaatcaaattaatgaaattagacctaataattatgttttttgatggtgttgaccaataaaatatctagtgataaggaaatttgtagcatcaactagaataatctacattgatagcatttattgtgataagtacattgtttccacttcttgatatgactgagatttatttctctcttttagatgaaattgttga

SEQ ID NO: 12338 - DNA, 1143 bp, Homo sapiens
ctatagaactatgaagattactggatcatatttttttctcttaaccaggagtgcctcagagattctgctatgactttggacttctctgagtctgtgcaatcattttctggagaagcatggggaaaggtggtagactgctgcactttttcattaaaatgagggtagctctttctccacccccccatctcctttatcccgaagacataaatgttcaattacggaggcatttaaatcaagttgtgaccacctccattggagggcaggactcttgattgtgtaattgataatgcactttctcaatggctgtatagtcattattaacgtgtcttccctcttccccacaaggacatataaggtcatttctgtccttcaagtttggccaactaacaaatcagaatctgaggggcatgttctatttcccaggaatgattgacactttggtgctggggttttgtgggggcggggggtagtttttgtttagcttttgtggagattgtgtgtgtgagaggagatttgatttttttttcttcttttcctttgtgagctgatggctgaagtgtaacagtacatcttcaggtaaagagagggatttctcaatctactttctgttatgtcagactataagagaaaccctttcagctgctttctagatgtacctaaattcagtcagacattttggattaagaaacctaaagtcctgatacattacatactccaaggaaatatatcagggacagacaattggctgaaacactgatacttcaatgtgacacatttttatagaacatttctaccagggggtactgaccttgatttctcctacaaggaccacactgcctttgtgtttaatgtaatgcaatttgtgtaccttctaatcatatatctgcagttcctcatttttataaaactttgatatcatgccagtaagctagatgttgaatgtatgtaagtagcatttggtaactgctaagaggttacaaaaacattattggtaaaaaaaatttccttagttctgatctggttggataagattttatcataacttttctgggtctcaggctctgatgtttgaaaaagaagggaatatattgggttttaaaaaagtgtattgtgacttaaactgttataagttatccttccaca

SEQ ID NO: 12339 - DNA, 1216 bp, Homo sapiens
caaaaacaaagggtgaagatggtctctccctttcgttccccttcactcagttgtgctgaggtcaatagagtgtagagtttcagaaaggattccagcaggtttatatgtgaatataagtgtccctgaatggggcaggcattaaatagaagaatccctgctgtttaaatttcccgcatattccaattcacttttaaaaaataccatttgaatttgtatttcataaagtgactctggggtgcttactttagtcaattcttaaaattttttatttgttccctaagaaagtaattactgtttctgttgcctggacagttacagtttccaggaaacatcaggaagtaggaaactgtagggccagagagtagtacaacgttaaattgtccgatttatgtgtattacttaaagctataaattgaactagatcttgccgtgctctgtattgagtataatttgtatacttttttataattaatgactaaatgatcactttggaggcagggtggtgggggtgtattagcagccaaataagcacatctgatcaaaaagaaccaggcttagattttttttaagtacattgatgttgatgttccaccagaaacaccttaagtgtatactgttgtgtaatgtctctagaaaggaatcctgtcttaaaactgggttttgctgttttttgaagtttctacctaaaatcatttttggtatatcctgataatctctataatactagaattgtctgcaaaatatagtaagaagaattggagcctaatagctgattcctcccaatttatctgttatgttttgtcactattcacattttagtcttttctacgataaaaattgtatgtgtactttcatgccagtataggaaacctcaatcttttttttttttcgcctttaagaaggttttcagtgattatacctcaggtatttctgagtgtcctattgtctaataggagaaatatcttcccgagctcagaattaaaagttctcctaaattatgaagatcccaaatcttatgtaaataaccttaggcatgagtccttagggagaagttaatgaccattgttaaagtgcttttttagaaaatgttgtgctgtatgttcttgatttgacataaatgaatagactttggcaagggaggaaataagttaaaaggcagcttacaagagcctattccctataaagggtataattttacacagtactcaaagcttgt

SEQ ID NO: 12340 - DNA, 1126 bp, Homo sapiens
gtcaaaattatgttaggaaattaaataccatatatgaagtgtgtcttgatttgtcgcttatgggtttcttttccattattgttcaccattctttatcaaaaaagcacatgtgtataacttttggttaacttatttgcactaaaagacttcaaattaattgtgtcctacaggatttacatgggtataatgtgaagtcagatatttacagtgttgggattacagcatgtgaattagccagtgggcaggtgcctttccaggacatgcatagaactcaggtaagtgctgctaaaatccctgagctacttgcctttcataagactgcttacattctagataatttctgttaaacatgtttgctatagactcttaggagctttattgttgttactgttttaatattttgcctgaaaagtgttgaaggaaagttctgtttcttttagatgctgttacagaaactgaaaggtcctccttatagcccattggatatcagtattttccctcaatcagaatccagaatgaaaaattcccagtcaggtgtagactctgggattggagaaagtgtgcttgtctccagtggaactcacacagtaaatagtgaccgattacacacaccatcctcaaaaactttctctcctgccttctttagcttggtacagctctgtttgcaacaagatcctgagaaaaggtaatattgatctcttttaaatagcacaaaatgtacatgttttacattttatagaagctttgtaacattgcccttccaggagaatacaaatcttttgatcaaaatattgtctgctctagaaaatatcaatgctaagaacaattagtgggaacaagcaaatgagaagaatactggattcaaaatcagaagaggctgggtgcggtggctcacacctgtaatcccagaactttgggaggccgaggcgggtggattgcctgaggtcaggagttcaagaccagcctggccaacatggtgaaaccccgtctctactaaaaatacaaaaattagccggtgtggtggcatgcacctgtagtcccagctactcgggaggctgagagaggagaattgcttgaacccagtaagcagaggttgcagtgagccgagatcatgccactgcactgt

SEQ ID NO: 12341 - DNA, 1746 bp, Homo sapiens
ttctcccatttggatcctttgaggtaaaaaaacataatgtcttcagcctcataataaaggaaagttaattaaaaaaaaaaagcaaagagccattttgtcctgttttcttggttccatcaatctgtttattaaacatcatccatatgctgaccctgtctctgtgtggttgggttgggaggcgatcagcagataccatagtgaacgaagaggaaggtttgaaccatgggccccatctttaaagaaagtcattaaaagaaggtaaacttcaaagtgattctggagttctttgaaatgtgctggaagacttaaatttattaatcttaaatcatgtactttttttctgtaatagaactcggattcttttgcatgatggggtaaagcttagcagagaatcatgggagctaacctttatcccacctttgacactaccctccaatcttgcaacactatcctgtttctcagaacagtttttaaatgccaatcatagagggtactgtaaagtgtacaagttactttatatatgtaatgttcacttgagtggaactgctttttacattaaagttaaaatcgatcttgtgtttcttcaaccttcaaaactatctcatctgtcagatttttaaaactccaacacaggttttggcatcttttgtgctgtatcttttaagtgcatgtgaaatttgtaaaatagagataagtacagtatgtatattttgtaaatctcccatttttgtaagaaaatatatattgtatttatacatttttactttggatttttgttttgttggctttaaaggtctaccccactttatcacatgtacagatcacaaataaatttttttaaatacaaaatgaacatttatttagtttactattcctgtaatattaaaccaaagaagagaaagaaggaaagtatgggaaaatagtatggagggacaacattgggtgtgtccctcaaagagaatggtgtatattattgaggtcttttttgctcccgcctttaagatagagtataatgaatgccttgactgtcatttaattttttttttcctgttgttgctgcttcctgccttcctccacaccaccccactacatacccctaagcctttttacatcctgctttggatgactattgaaggtattgaataagcatctcttttagagaagtgctgtctgatctatgtttttactgcccttaggagatgaaatccatattcaaaagggactagaagatagtgtttatatttgctgctttttttggtagtgtttcccttgtgaagaatacagtgagtttttgggtgtttggttttttgtttttttttttaaactgatcagtgttttggtattctaatgtaacttatgtagattggtaatccttaaatgctttgggttcaggtgctagggaaagtcagtggatacttcgagattagaagccttgcttgtggagtgttctcagctgaaggcttccctctaccttctaggtaaaccaagcagaggtcaagcagctcccaaggtggcaatgactcagcagctccggcagcaatagactccatgcctgaccctgggatggcctctgaagccactgaagctattctttcctcttgagaagaggctaactttggaatcagattagacagggaagccttcactagccagaaactttgatatgaaagagtccctcgggaatggaaaaggcactttaatacatccaattctgagccttactagaattttttttctttccattca

SEQ ID NO: 12342 - DNA, 1390 bp, Homo sapiens
aaaaacacttcagttttatatagcgaataaactgggaagtgaaattgactcaggaaagtaagatgcataactaaatagacagaatcagaaggaaagacacctctatattctttagattaaagaacacaggattcttaatattagaggagtgtaagtatgggtcacatttggatctctttgcacttttaaattagtggccacgtaattgtagtcaatttaaaaactgcttttatagtctaacatttttctttcctcttacagctgggaatggaggaagaagatgtgattgaagtttatcaggaacaaacggggggtcattcaacagtttagatattctttttattttttttcttttccctcaatccttttttatttttaaaaatagttcttttgtaatgtggtgttcaaaacggaattgaaaactggcaccccatctctttgaaacatctggtaatttgaattctagtgctcattattcattattgtttgttttcattgtgctgatttttggtgatcaagcctcagtccccttcatattaccctctcctttttaaaaattacgtgtgcacagagaggtcacctttttcaggacattgcattttcaggcttgtggtgataaataagatcgaccaatgcaagtgttcataatgactttccaattggccctgatgttctagcatgtgattacttcactcctggactgtgactttcagtgggagatggaagtttttcagagaactgaactgtggaaaaatgacctttccttaacttgaagctacttttaaaatttgagggtctggaccaaaagaagaggaatatcaggttgaagtcaagatgacagataaggtgagagtaatgactaactccaaagatggcttcactgaagaaaaggcattttaagattttttaaaaatcttgtcagaagatcccagaaaagttctaattttcattagcaattaataaagctatacatgcagaaatgaatacaacagaacactgctctttttgattttatttgtactttttggcctgggatatgggttttaaatggacattgtctgtaccagcttcattaaaataaacaatatttgtaaaaatcatactaatgcttattttattttaattgtatagaaagaaaaaaatgcctaaaataaggttttcttgcataaatactggaaattgcacatggtacaaattttttcttcattactgtacagtgatgatgttaatgactttgaagcactgaaagttactgaagtgccttctgaatcaaggatttaattaaggccacaatacctttttaatactcagtgttctgtttttttaaaaacttgatattcctgtatggtgcatatatgatacagttacctaatcatgttgaataaatggg

SEQ ID NO: 12343 - DNA, 1236 bp, Homo sapiens
ggggaaggtgggaatgagttactgtttaatgggtacagaatttttcagtttctgatgataaaattgctctggcaatagatcctggtaatggttgcataacatcataagaatacttaatgctactgaatagtacacttgaaaatggttgaagtgttattttttattcttttttttttaaattttttgcgacggaatcttgctctgtcacccaggctggaatgcagtagcacgatctcggctcactacaacctccacctcctgtgttcaagtgattcttctgcctcagccctccagagtagctgggactacaggtgtgcaccaccatgcctggctaatttttgtatttttaatagagatggggtttcaccatgttggccaggctggtcttgaacttctgacttcgtgatatgcctgtctgctgggattacagacatgagccaccgtgcccagcctgaagtgttaaattttatgttgtgtatgttttaccacaataaatccctttaagttttgtttgtttgtttttaatctactacagccttgttagatgacttggataaagaactaaacaactacattatgcgatgtagagaatggtatggctggcatttccctgaattaggaaaaattatttcagataatttaacatactgcaagtgtttacagaaagttggtgagtaatttgttcatcctttaaggcattgaaagtaaatgaatttgattgcatcctaaaacatgacgtatagcattttgttaagcaagattcccagggtttttgcaatttctgtgtatttgggaagtgtagcagtttagtgtcttaaatttaagaaacaaaatgaattttaacttagattttgatggcctataacatgatattagtacctaatgctaaatagcagtattgccgtctgtactgttaatatacagaggaacttgattgttgattgtcgttaacgtacagaggaacttgattgattgatggtttacttgccttacgaattactggccccagcttcagtataaaattgtctgtgacattattattagtcctgtcttttttaaatttttgccacttatattctgtaataagtgttgtggcatattttgtcctctttttactctgattattttttggaagaaggtggtggggagacatttaatgtctaaacttaaacccttaaatgaggaaaactgttatactaggtcaaacttcttcattttttttgttttgtttaggca

SEQ ID NO: 12344 - DNA, 1188 bp, Homo sapiens
atttttagtagagacagggtttcaccgtgttagccaggatggtctcgatctcctgacctcgtgatccactcgcctcggcctcccaaagtgctgggattacaggcgtgagccaccgcgctcggccagaacccgcacatatttaagattgttacgaggaaaaagatgcacttcttttcagtgacctcatagcacagaactaatgtcactgagtagaaactaaagtttaaaaatattttttaaaaaaacctagtttgagctaatatttgacatgaattgctgtaaaatcttttcagccacagaagtgttggtggtgatatatggccattagattgtggcaaaggttgaaatacgatggatgatttgaattgtatgattcataatagttttataactcctgattttaaaacatccaagttattgaggattttacatctgaacatggaatatagttcttcatgtttttctattagatttctcgaatgctggcagccaaaaccgttttggctatccgttatgatgcttttggtgaggattcaagttctgcaatgggagttgagaacagagccaaattagaggccaggttgagaactttggaagacagaggggtaagaactacatcatgcctattccagaagtattacttgtcaaaagttaataaactgagtaaatttattaacttcatctgctaaacagttttatgatacttattagtatgtctaaagtattctttttgtgcctactgttaacaattgctattatttaccaagaattgatgtatccaactgcatttgccattaggatatgctattcaaaataacaaaacaaaaaatagcagaaattgctgtttgctggcccactgattcactagactgtatagtgtattataaagagattatgacttagaagtgtatttgtaatttttcgttttcttcttagataagaaaaataagtggaacaggaaaagcattagcaaaaacagaaaaatatgaacacaaaaggtgagtacatttaagtgaggatggggtgaatagtttttttaaatgttaattattgacagtaattttttattgtaaacttcaccttgatgtgcccatagttttttcaaatttatttatttgaccaaaattgtgtatgtttattgtgtgtatgttgttttggaaaatgtgcacattgaggaatgattaagtc

SEQ ID NO: 12345 - DNA, 1241 bp, Homo sapiens
agaagaagaaaaggggtaaaaagaaacacattaaggaagaaccactttctgaggaagaaccatgtaccagcacagcaattgctgtatgtttgtttttaattatcggttttcacttggaggggccagttctctatatttcaatctattttctatatcagaaatgagcaggcattttaaaaaatggttttcattgatggagaggtaaaagtgaaatggctttgttgtatttatattataaaaggccatttcccaaatctagaatttattactaaaaatcaagtttgcattgaggggaggagtatgatttgctcaagcttactttttttataggtggggtttttatattttcaatgtgattactcacccatacaatttcagctctttcaaagcattcttgttggctattttcagagtccagagaaaaagaagaaaaagaaaaaaaagagagagaacgaggattaacagaaaggaattacgattatatcacccggacacacatcatgcttaagattcaactgggagcataccagggatgctctctaacgtaatcaagggaaggttcagtaagacaaagtgatttatcatctataacttcaaacctatttgtcttgacatcaactctgttaaccttatgtcatcatttcttagagtctttgatatacaaataaaattttctttgtattttaagacaattttgtgatctctttatatcttaggtagagaatctttggctctttctgtagtttgccatgtgatgattattgttttgataattataactgaaaagtgagagttgttttgaaatttaatcttttggaagtcagtgattaagtggaccaattcaagaccccactctaatgtgtttcttttgcctttttggactactttttattttccacctataatctttctacctctttatttaaataaatatttgtttcttattcaaatttttaaattaggtgagcaaaactttttagttcaaaagggtgggagacagtatccctccctttactgtttgcaattctaaaaggcataccaaaataattcttaaaaccctgatttgtttttaaagtagtcagcctgaagtgacttttttaaaggttgtacaaagtgatcataaagaatggagaatagggaaaaaataagaaaaaaaaaagtgccagtttgtgtatgtcatagacatcatactaaagcccaattcagtaaaagctgttggtggatggaaactagaatgacta

SEQ ID NO: 12346 - DNA, 1239 bp, Homo sapiens
ctttgggaggccgaggcaggcagatcacctgagctcaggagtttgagaccggcctgaccaacatggagaaaccccatctctactaaaaatacaaaattagccgggcatggtggtggcacatgcctgtaatcccagctactcgggaggctaaggtaggagaatcgcttgaacccgggaggtggagattgcagtgagctgagatcgtgccattgcactctagcctgggcaacaagagtgaaactccgcctcaataaataaataaataattcttagattaatcatgcagttaaaccttttttggtggccttttcccccccatgaaatgtctttggtatcctttaccatttttctgtttcttaaaaatatgtttcctgttgatttgcaaaactgtttcatagcttacacgtactctcacatttattgaaattactgcttagtttgttgtttttctcttagttttctttatcatattgtctccttttttgtattcatattgatttataggatgttggtctcacattggagatccccaagagtgtcactatgaagaatgtgtagtaactaccactcctccctcaattcagaatggaacataccgtttctgctgttgtagcacagatttatgtaatgtcaactttactgagaattttccacctcctgacacaacaccactcagtaagtaaagtaaccaacttttctttgtatttcctttctccaaagatttgcaaaatataaaaaaacttaaaaaacattcaaggttgaagccaggcgtgatggctcatgcctgtaatgccagcactttgggaggccgaggtggatggatcacctgaggtcagagtttgagaccagcctggtgaaatcccgtctctgccaaaagtaaaaaattagccgggcgtagtggtaggcgcctgtaatcccgctactcaggaggctgagacaggagaattgattgaacccgggaggcagaggttgcagtgagccaagattgcaccattgcactccagcctgggcaacaagagtgaacctaaaagaaaaaaaaaattcaaagttgttgggagtgagaggtagagttccagcatcataagattacatctggcaaacacctgaaatccgaaagcgatgcaccaggacttccaaggcatcaatatattactaaataactttggtaaaatatagtactggccaggcacagtggctcatgcctgtaatttcagcactttaggaggccagagcaggagg

SEQ ID NO: 12347 - DNA, 1102 bp, Homo sapiens
acattgaagactctatccatcatactgacagcatcgtgaagaatatttcctctgagcattctatgtccagcacacctttgactataggggaaaaaaaccgaaattcaattaactatgaacgacagcaagcacaagctcgaatccccagccctgaaacaagtgtcaccagcctctccaccaacacaacaaccacaaacaccacaggactcacgccaagtactggcatgactactatatctgagatgccatacccagatgaaacaaatctgcataccacaaatgttgcacagtcaattgggccaacccctgtctgcttacagctgacagaagaagacttggaaaccaacaagctagacccaaaagaagttgataagaacctcaaggaaagctctgatgagaatctcatggagcactctcttaaacagttcagtggcccagacccactgagcagtactagttctagcttgctttacccactcataaaacttgcagtagaagcaactggacagcaggacttcacacagactgcaaatggccaagcatgtttgattcctgatgttctgcctactcagatctatcctctccccaagcagcagaaccttcccaagagacctactagtttgcctttgaacaccaaaaattcaacaaaagagccccggctaaaatttggcagcaagcacaaatcaaacttgaaacaagtcgaaactggagttgccaagatgaatacaatcaatgcagcagaacctcatgtggtgacagtcaccatgaatggtgtggcaggtagaaaccacagtgttaactcccatgctgccacaacccaatatgccaatgggacagtactatctggccaaacaaccaacatagtgacacatagggcccaagaaatgttgcagaatcagtttattggtgaggacacccggctgaatattaattccagtcctgatgagcatgagcctttactgagacgagagcaacaagctggccatgatgaaggtgttctggatcgtcttgtggacaggagggaacggccactagaaggtggccgaactaattccaataacaacaacagcaatccatgttcagaacaagatgttcttgcaca

SEQ ID NO: 12348 - DNA, 1246 bp, Homo sapiens
ttgttccagaaaatgtgcattggttctgaatgtgaaaatatttaaagagagaaaggaacactcaagtaagtgtgggcttcagtgggaattatcacaaaacattggcaagtatttttatttaaattattttcaaatttgacttctacagccaagtggaattggtaggctgtagctgttacactgaaatttctagtctttgtaagtgcctcctgaaagtcatttaaaatggaaaaatatttcaatgagcttttccttttttcatatttatggacatgaatattttattggagatcattaactcctagaatttgagattatatttccatacaacattttataaagttatgttgaacttactacctgttatgtgcaggttattatgtaactattcacagattgcttcatatattgctttatcttcccatctaacttcttaaagttaaaatccggacacacatgttgattatctagaccagtcattctggaaattgtaacactcccacataaaccccaggagactttttcagaatgcaatgtttctaaatgtactgttactggcagtttactctccagcatataaggttgcattttaacttttagattatgaactgtgcaaactttacccaaaactatcttgcatgattccctcctaaatatattccttgattaagtaaatctggcaaatcactgtttgagctagttacataaaatttgttatcaagagaaggcttttctacaagtttccagattaacataaagaaaagagggaatcacagggcatttaagtgcaccttcccattactttccttaaatcacctcatagttaggctgggcgcggtggctcacgcctgtaatcccagcactttgggaggccgagacggtggatcacgaggtcaggggactgagatcatcctggctaacacgatgaaacctcatctctactaaaaatacaaataattagccaggcatggtggcacgcgcctgtagtcccagctactcgggaggcagagacaggagaatcgtttgcacccgggaggcggaggttgttgcagtgagccgagatcgcgccaatgcactccagcctgggctacagagtgagactccatctcaaaaaaaaacaaaaaaaatcacctcatagtttatgtctgacttactccaaacctcagttatctgatttgtagtctgtgtcaggaaagttttcttcatatctattctgtctccctcctctttgattttaaattttttt

SEQ ID NO: 12349 - DNA, 1172 bp, Homo sapiens
aaaatcctaggaagttatctgtaaccagtctcttgtctcaggctcttcaccttgttaccaatcctcgtaagtatgtaaaggaaacatatttttaaagaagcttaacagtaagaaaaaattactaaaagatgcaattcaaagataggtcccagtttaacactgaattgcttgacttctgtggcttttctttttctggccacatttatttatttaagcaatttttgtatgccttgttatttcatttccatagagattatattgtatcagtgtttatgtaagctggaatcatcctcagttttttgctgataatttttcaaataaagatacatggataattgtaaaatacactaactcttagggtgttgtagtagctgaaacatggagatgcgtagctgtcatgctttttctgaatggacaggagaaacataagctacggagtattcacttctgaggatgcttttccggaaaaagaaaggctagaaaatactcgcacttcctcagaaccctctttcttgttaacgggtatcttttgttggtgtgttttgctcttacattacagatagactatcatatatgactttatgaataatttcagttattttgcttttgtataagctgtctgaagccttgctatgctgtataagttgtgtttgatggatcagtgtgagtataaaataaagcaaatcacttttcttttgtattatctatggatgccactatgaaagctgacattaagccactaaagagttttctatgaataagtgtaagtaaatgctttgatatatataaacctaaataaaaagattgtattgatacagagacattggagaaggagattttaaggcagttctttaggtttaaaaaggcttgctgtaaaatggtgcgttattccgtttattaaagatcatattaatgacaatagtaattgtgtttttttattttaagaggtcaccagaaattgttagtatgataattagggagtttgcactagaatagtaaatgttctatctaatatgactttcataactcagtatgatacatcaaaaaataaaaaataaaaaaaaataaataggccgggcgtggtggctcacgcctgtaatcccagcactttgggaggccgaggtgggtggatcacgaggtcaggagatcgagaccatcctggctagcacggt

SEQ ID NO: 12350 - DNA, 4062 bp, Homo sapiens
caagaaccatcttttctatgaaaatgactattttataatataccaatgttacattttctgaaacgtagcaaacaggatattcaaaagattctttggtggcctctgtttcttgttccctttctagatgtgtgcttttctcagctgttttcagctttgggaccaaagggattgttgacgttttcccagcaatcttaatctcatgactatgttcttctcccaaacaaggattgataggtaaatgcattgaacaagtatatataaaaagagattaaaaagcaatattcgtacattatgtgatttatgtttttgatgtcaaaagtttgtgctttgggtgaaatatttgtataactgctgttttcttcactactcctgtacacatttcaccatgtggtcagaaaagttgtagtctgaagacaagtgctttaatatgttctcacccatattggaacttgatttaaaagtcagtgagccaaaaggaagctatccagcgttgattgctagctaagagtaaggagcccctttggttttctgtgatatatatatatatcacacgctctccctcctttaccacaggtgtcattctacctttaatcatcactgtatcatagccccaaagagatcctgaaatggctgtgcatggatttcctcctttgcccttgtgatgttgttgtcttgtggatttggttgggctagtagtttgccaggagtgtaatccagtggatagtgatccaaactgtagccgcagaatcctgtgactgacatttttctttgtggtggtggttggccctgagatttgttgcctacagattttgctaatttacccccctaacgcttcacatagtggggaaaatacacaagaagaacttgagtatgaacgataagcacctttgaaaactccatacagttttggattagggctcatcctaatataaatcactgccagtatcacatgacatcagtatgtgatttctgggtatgtggtagtgagattaaggagcagcttttttttttttttttttttgagacggagtttcactcttgttgcccaggctggagtgcaatggcgcaatctcggctcactgcgacctctgtctcccaggttcaagcagttctcctgcctcagcctcccaagtagctgggattacaggcatgcaccaccacacccagctaattttgtatttttagtatatatggggtttcaccatgttggtcaggctgttcttgaactcctggcctcaggtgatctgctcgtcttggcctcccaaagtgctgggattacaggtgtgagccaccacgcccatccaggagcagctctttttttaaaagtgagtttcagcaaacagtattgaataaaagcatccttttcatatcttcatatactactttatgatgcaataatttactgttcctatacatattataaggtagaaaaaagtttttaaatccttataaagaggatgcagtttagaaggttaatatgtcagcttacccagacatattctatcaaggaaaacctagtggtagcaataaatctttggaaaggacttcttatactcatgtacctttaaaacatctaagcaatttaaaataatccctgttgagtttaaattcgagatgcatttaggtaaattggataaattcaacatttgaataaatccgtcaggttttagatggtgggattgatgaactttggtactttctcaatccaaaactaatttatttggaactagtacgttatggcttctcagtcatgaaaagctcagttatttggggtctacattttctcactgagagccttgatattttgccttctttgttatgcattataacttgactgtatcaccactgagtatctgctgtatcagaagttcagaagaaaaggtaaaactgaaatcagaatgggggtagaggaagttaaaaacaagttatttaaaaagaactcttggtttttggatgacttgaattctgttaaatctgtgttcttggccttgcacttccgttcctcttccatctctatccctgctagtcacaatggcattttagaactagaatgccactctgtagaggttttcccttttgctctgttgtgcctatttgtctaattcatatctttctgtggagtttcatatgtccttaatctaaagtaacttaaaattggaatggaagaacaagtttcagaattatttacagtcttatacatagaacttctagtgtaatgtttggttgtaaggagaatgtgaatttgcaggtaaatgaattgtatggcaaccagacagatccctggggtttgggagaaatagagcttgagatttgaaaaaaaggtacaaggtacaaaacaactctaactgccagtgccaaagggctaatttttaagcatgtaagctttaccacagtcttgaaaaaaatattaaccataggttcattcagctgttttatttaacccttagttccctggtggttgattttttttttaaatgggtctccagctttccagtgaaatgtgacactctcaatagaatgcataatgttggtttctaaagttacactccataattattgttattctgtagaaaactgtacagaaggtaaatagaatagcttcaatgggaatataatttaaatttttttaattttataaaaatttatttccattgcattaaaagaaatgggtagcatgtgtctttcagagaaaggagctatttggttattcactttgtcaatcttaggtttttttaaatctttaaacaatttcttctttgtgatgataaaaataatataaatttactgtttctgatcatgactgagtctattacttgtcatggcttttgtacgcaactgtgttttaaaaataccggttttgcctctttggttacatgtggtgagcatggatgtcaagattatttttcaactagattattcaatttgttttatatttcttatacttaatacttatgactacagtccaaatcagtcttttagaaggtgctcttgctaactgtggaatatttgacgacatgaaagtcctttttctttgctttcagtggttggctttcactgaaagaaagtgtaaaaaaagtcagaatttatagctttcactatgtccaagactaggactgggttataaagattttcttttgtgaaggaaaataaaagaaaatttgccactactgcatttactttactattgtaaacttaagattcattccttagtctttggaattttgatgtctcaaaaccagatgagtggaagtgctgaatttgcaaaataaagctaagaatgcttaactctgcactttaagttctactctgaccaaattgaagatgagcagagcagccctgaacagcattttgtttatacagtcttgtttaagaatagaatttttttaactcttcattttttgtctctgtggaagctgtgtaactctttttaaaatgcaatttaaaacattttgttattctaacaattctctcaaaaaacagcatttccaatggtaatcggtattgttacgctgtacttatgtattccctgtacctgaacacttgttgctgcctcacaagaaaatagaacttttatgttaaaaataaagtctgttcttcttgagtttttttctgtgaatttttatgaatattgtccaaattcaagttacatttctttttggactggttatttatctagcttttaagcggtacattgtttttctcagactaatagaaaaatttgtttgtgttcagcagcaagttccttgctacccctcacctgccctagaactgaaagtacctgctctttggggtaagtgctaggcacacattaaaatataagcagcacagagagatacccacgcgtgaggaattcactgcttcagagttttgttagaggtaacttagctggggcagtcacttacattcattataaagtacatgagaggagtttttttgttttaattcttggtaattcagccatattcttcctttgtgacagtggcttatatatgcaagacagtcgttgggtttcaggggacagttgttgagttttggggattttgtctgtatccacacagcaga

SEQ ID NO: 12351 - DNA, 1187 bp, Homo sapiens
acctgtgaggatgagatgtgtcagaggactcagactttggtatagttagaaaaataatatttttctcacttgattctgtgtgaatgtctcttctgatactgttttttaatcagaaagttacagagcaactttcccacaaacaaaccaataaaacaaaaccccacaaaaaccaagagcatgaagaaaagtttaaatccctaattatatactcttttggtttttaggtagaaactggagctatcaatattttcatgtaagtatttcaaggagtagctctttaaaaatggtttctaaattagattttaaaaattcattgtcatctaaatgcatgtttagtcacaatgtatcagtattgtgtttaaaggtgctcagcatcactttttgaaaactatgtttacatatttaaaatgtttaattattttgaaatgtatagggtattaaatacaagcttctaaaattttcagtatctatattggctttctctaacagctctacagcaaagtttgacatgttttttgtgtgtgtcatgtattgtaagttgtaatatctgtaggagtgagttggacattctaaattagcagtaaaaaattcacaattacagctcagcttgtttattcattatagtttccacatttccaacttccaagtgaactttatatatactacagtgaattatagataaatacagccatggtggacctttccctcaatagtgattttttgtacaaacagttagtataattaaaaggaaaagcttttatattttatgcaaggtaaatgtttcctaaatgtcacaaaagtgatagaaaacatagcttttgggatctggtcctgcattagagtttctaattctgagacccaccagcttgtgtttcatcttctttatatcctgtcagaatacatacttaatcatgtgggtatgagaaagatgttgtttaacttgtaccaggtttaaaaaaagaggtttaaaaaatgtctgtgcgtatatatatatatatatatatatatatatatatatatatagcaacttgatgtatagtgtccttgttaccatgtatttttttcattaaaaatcctgctttttttttatacttgttagttttctttttatatttttcttagagatagtggcaattttgttcatcttgaagatgctgaataaacacttgaatacccgagaattttgg

SEQ ID NO: 12352 - DNA, 1211 bp, Homo sapiens
ttcactcccctaatgctagtgcctaaaactgtgcctagcacatagtaggtgtgcaataatatttcctgaacaaatgtagggggctcatggaaagtatttagttgagaggatattactctattatttaacatataccatcatcctattcattttaatttttcttttttatcttccagcagatattttagtgtactcttactctgtacaatgagtaatatggagattagttggaaacacagtgccagtcttccaaatagtttataatctaattaagaatataatcttttgaaagtatattcttctatagtttctcattaaattaccttatcattaaaataactgaaaatattatttttgatataaagtactatgtactttttgaagaattttgtattctaaatctttttacaggttttgcaaattttgcagttccagccagatgcagcacatcaaatatcacagcaagtgggttggcaagacaccttagttaggctttttttaaaagcaaaatttgaaaacggaaatactcttcataagcacagtagagctgttttaatgaaagacaatgataaaaatatgtcaactgaagataccaagaagaactctgatgaaaaaacagatgaggaaaaaatcacctcttttgcctcagctaatgtgtcttcggatcagtggagtttggaggatagacactctttagactcaaacacaccattatttccagaagatagctctgtgggagaattgtctttcaaatcagagaatcaagaggaattctggcatagtaacccttcacatttgagtttagacctcagtggaattgactcatgtgaaatgagtgatagtggaagtcaagtgccagacagtctgcctagcacaccatccccagtagagtctactaaatcgttttctgtgcactctgacagagaaagcagcatcacaaatgatatgggctttagtgatgacttctctttacttgaaagccaagaggtaaaattgcttatttttccaaatgttgtttttattttcatgtctgatatatacttctaatccttagaaatatgtgagcagttgttaacaatttcatattgtattcatgttctaagtttcatgatctaaggtttagaaacctggaagtcactagattgtgagttttttgagagcaaagctaatgtcttactcatcttatgtctctagggcctagtaaagttcca

SEQ ID NO: 12353 - DNA, 1502 bp, Homo sapiens
agttgacttcttctggttttaggagctgtggatctggatgccttaacagatgagaaagaaagaaaagccttagaagggatgattaataattttgggcaaacaccctgtcaattattaaaggtaagtcaacaacttaagaagtagatttaagtcaacttaagaagtagatttaagtacataacaaaatattgcagtcaagatccatgtatatagccagttactctcagtcacagaaagatttctgtttgctcagaaagtcttatattatttccaagaggaaaaactgagtacctattagggtatgccattaaaactgtcctcatgctgggactcattccacatgtaaaacttctaatagctaacatctgcccaaaaaggcacttgctttccagagcccaaacccagtcttaagaatcaaattgctctcggctttcggctcggaggaggccaaggtgcaactttcttcggtcgtcccgaatccgggttcatccaacaccagccgcctccaccatgccgccgaagttcgaccccaacgagatcaaagtcgtatacctgaggtgcaccggaggtgaagtcggtgccacttctgccctggcccccaagatcggccccctgggtctgtctccaaaaaaggttggtgatgacattgccaaggcaacgggtgactggaagggcctgaggattacagtgaaactgaccattcagaacagacaggcccagattgaggtggtgccttctgcctctgccctgatcatcaaagccctcaaggaaccaccaagagacagaaagaaacagaaaaacattaaacacagtgggaatatcacttttgatgagatcgtcaacattgttcgacagatgcggcaccgatccttagccagagaactctctggaaccattaaagagatcctggggactgcccagtctgtgggctgtaatgttgatggccgccatcctcatgacatcatcgatgacatcaacagtggtgctgtggaatgcccagccagttaagcacaaaggaaaatatttcaataaaggatcatttgacaactgaaaaaaaaaaaaaaaagaatcaaattatagaatatttaaaatgtagaatcaaattattaaatattactacatatatttctttccctatactggtatctgaaattaaatcattatcttcctgatgacacacaggtttagattaatggaaattaatctaatggtagttttcaaagatgtcttgatctttttcagtatatgaatttagtgatgtagaatgtacaaaaaaatatatcatttattaactagatatgttcttaagcaatcactgtgtttgttaggtactttacctaatcttcatagtaaaaattcagctatcctcattttttaggagttaaagccaagcctcacagaaggtaatacctagcctataatgcctttgagaaattaaatactttttctatgtttacacaacaagaaagtgactaggattatatgcctgaccatctaactcc

SEQ ID NO: 12354 - DNA, 1182 bp, Homo sapiens
agaatcctgtctaactgttgtgttccttactttgtctctcaccttccctctaatctctctaaagggaacgtaaagactatttaccttagataaatgatgaatgtaataataagatgtaaaaactgaagtaataatagaatgggttggaaaattgaaaaaagagtaagattctctaggaagtcaaaattcttatattttagcttcatggttgctttattaatattttgtttgattatatatggttagaagaaaaatagatgtcaaaaatagagaaaaaaatctatcaagtatcttaactaatgctgtaaatacaggcccttgtgtgagtcacttagactttctggacacaagttcccacatctgtaaaattagaatgcagaactagatgagcattaatttattttccagatataaaattctgtgaattcattataaatccgtgtaattatgtctgtattttttatttcttttctagcttgaatctcagcatcaacccattagccatgcgactgcctatccattgtgtttgtgtcaccaaagaatacagccatattcttgtaggtttagaagatggcaaattgattgtagtgggtgttggcaagcctgctgaggtaaaacctagcatcagtaatttcatttctcatgctgttggggattactttggttctccttcattccaactgattgagaagtcaccattagggataaacaaattaaaagccaaatttgatttttcaaaaggcagtaaataaaaacaggataaagctgttattcaagaatcatgtttatgttattattgaaagcccacctttggcaattctatctaccactctataggaataagacagttcatttcttccaaatctagattcaagaccacaacttagattttcaatacataagagcctttgcaaaagaataaaatataggctcaaacaataaaactactttagttttaacaaatactcatcataactatttgtcagttgttcttttgtaaaagcatcattttttatttgtaactacaaatatccccatttagtgtgcttattctcagtgagtttcctatagttaaatttacttgctaatgatttatcaattattgaatattcagatatcataaatctaactctcactcttaggaaaactttgtagttatactccagtaacttactgattctt

SEQ ID NO: 12355 - DNA, 1170 bp, Homo sapiens
agttcagttgatctggaaaaaaaattatggaccaaatgtgggaaatgtcaggttgttttttggtggaactttacagatgaaaaactatacataataaaacattaatatgggatagtacatcagagtatgattattaattaaaattactcaaatctgtttaggaaaatgtttttgttttattataaaagaagtttcttcagataggcattaaactggaatataaaaaggcaatatttattgttttaatgtgttaaacctcaacatttatcacttgtatttatggataattttttcaaaatgtggtcaaaacaagcttattgaactcagttttcccctcaactttattaataagtaaatatatatatatatatacacacacacacacacacacacacacacacacacacatttttttttaacctgtcactgacttggagctcaaggaaattttattttgaagtggtacgcttttgaattacctttattgtagctacattcatctcagaaaatgtcgggaagtgctgatgatctcttactgtttataaatactcatgttttggtggctcttatttctttagcagcagtgggagtagtggagggagccacccaagtagtcggagcagcagtcgagagaacagtggaagtggtagtgtgggggttcctattgctgttcctactccatctcctcccagtgtctttccaggtaaaacattcatggtgcctcgtcttcacttttcctttctgaatttgattcaatttgtgatttaattatggtgggctttcttcgtaatcaggattttttttctttaggaatcataaatattgggaagtctatatatttgttatttgtaagcaagtgatttgtaagtgtttgctcactttgcacttctctttatgcctttggtgatgtggctcagttgctgctttgaggtttcagatcacactttgttatgagtacaagtttaattccagctagtgttatgacagtgcagtctttggacacagtgggaactcagtgtgagaaccatattagtaacaaaggattgggcagatataaaaagtagttttgacagttaaatttagtggctgtattggaatttagtagtctctgaaaatactaccctcttttctctgaaacagaaaaatctgcttatttgattcgaggagata

SEQ ID NO: 12356 - DNA, 4553 bp, Homo sapiens
agctcagcagggctgtgcttgcctcacaggaatagtcaggtcttcccagattatctgaaggccctggggattccactccagtaaagtagaatgaaggatacaaatgataaaaattacacttttttttttggtttattccccagtattaaaaacaaagcaagctgagtctgaacaaatggatctttctgccatcatttgtacaatgctgagctgtctggattgaaataaaatgaccatttttatgtatgtcaaaggtataacagcataactgtgtagccaaaacaaaatcagattaagactgattcagaaaaatctgggatctttctcaggaatactgtatacccttgggatttctcctcctgcagaatctgtggcattggatgttcttcattgcctgtgctaaggggttaacctcatggcccagtgggtaccctagccccttcttttcttccacttgtatgaagaggagggaaccaacatttaaataccacacttaaccatttttacaattatttcagatggcttttttcctctgtgacactgtaaattctgcattctctcagcacttgagtgcaccaaacgagtgaatgctgaactcacttgcatcccttcatgtttctgtttgtggattataaggatgatgaaatgtgaaagtctcccaacactctgagggtggtgaacgattgccacccgtttgattttaatgtgctgctgcatgagactgcattgttgctaatggccagtgtacccagatgtgaagtgtggtaggctggttcatatgtggaggtgggtgtgtgaagctagacacgaaggtccctaaggttctgaagagacttgaactgtggaaatgctcttagcaggcatcccgaacccctgcttcggtgctgttttgaggagtaggatcttggagttcagaccaactatgactatcatttccttcactatctagaaaaacgctattctactttggaagagaatagtagttattttcaagtctcctgacagtcactgggagtacaaggtttgctaatgtgctctctggacgttattaatggccagtattagttgctgctgtattactgactcgcttagctgtagaaagggtaatactctcctgattttgtatgattggactcttaagtagctgctgttagtcagaattaaaacccatctcagactaagaatataatgaataagattaataggccaaaatatgtatctaatcacattgataaaaattaatataactgacacaataaaacacatttcccccatctgtacaataaatacagcttcaaattcagtggagtctgtagggcagataactttaatcatcactactgtagtcagtataagaaatgctgaaaaaaatccaggagggcttgtctctttgtgggtggtcactgtgatgttgggccagctcctgttcaggtccagagctgctaacgtgggttctactcagtcccagtgacttggccagaatagagctttgccaggtaactgccctgtgctaggtgaaaggggaaaagcagtagctggatatatttcaaatgaggttttgaacaagttcagaaagtggaacttgattgaaaagtgaacaagtgtagtagtgtgtgagaaaattcagatggtgtcggatgcagaagttaatattccacttaatgttatctgagcattaaaaatcatcagcatttaactgagaccccactatagagtttccttatcaagactttttggttttaaagttgtttttaatgcattgcaagttacaatagctattttgcttttagatttttcccagcactttgtatttattagctttcattaacttgcctccagtatacattccacttcgtgcttttcttaggtcatttctacatcccttattccttgttttcctgcagtgtaatggccctgaatgtcctctgagccttcagctccattatggacccaaactagactatacttggataagttaagctcttcttcgtgtactggtctataattagaaaaactgttttaaattagatgttcccattatttatttaaacagctttttgctgagaaagcttagtggattaatgaggcagagggtgttttgaaatccaataaatagttcccacaggctgggtgtggtggcttatgcctgtaatcccagcactttcggaggccgaggtgggtggatcatgaggtcaataaattgagaccatcctggccaacatggtgaaaccccatctctactaaaaacacaaaaattagctgggcgtggtggcgcacacctgtagtcccagctacttgggaggctgaggcaggagaatcactggaacctgggaggcagaggttgcagtgagccgagattgtgccactgcactccagcctggtgacagagcgagactccatcaaaaaaaaaaaaaaaaagttcccacagctcaccactacagaagcagggaagacaactatgcagaaaacagagttagtggcggtcagcaggaatgcagctggtcttttggacccctacgggatgggggcagtgcagaagacactggtgaagtcctttatactgaagacctgtggttgggagcaggggtagtccatgggtctgctgattttttttccctatttagtactaatgtgtgtgtgatctttgttttacaaacagtaccttttgggttttctgcatattttataatttttgtacagttttgaattctatagattgtcttggaaggatactgtgtgatgggtcaggcacacagtaattggagacttttaatgtatgtaatatttcatagattgcatgctattaatcatctgtgagggtagtattttttgttttattgtaagtttccctctttttttataaattaaaagatggttggtattaggaatttcaaatgaatgcagaaaatcttacatgctgtgtactattaatattataacagacgatccaagtccaaaatctgaccaataaagcaaccattttatcaagatagagggattctaatgggagaggggattcttccctcctgaagtttgtgtgtccagtccccttaaaaaaaatgaatagttgtcttttcttgtcatattaatactcgaaagtccatggtggtattaatgaaagtacactttattgttgcctttgaacttacggccaaggcaataaatcagaaacaaaaatagtgccaatgtgtcaaaatcgacatctgagagattcagcctcccatttggaataaatatgaatcttctaagctatcttgtttaatattttccatcatttagctacttcctatctccctcagaggcgcctgctgttcccattttagagttgacagtggcctgctaattttgctatgttcctaaaagttactgggtgtgagacattttcatcccctcctttttcctactgctggtgtttattatccagctagacaatattttatgcatatttaccgtgatgtctggaccgtacctgtgctccttggcagtttatgttgaagataactaaagatttttctctttgggaggcatcaaaatgatggtagtttgcttttatctttttatgttcattttcttttagtaggtgacctttctgcattaagaactgtttttatcttttactaccttttcttttctcctttgtggagacagcatgacatgtcctgaaggtcacctttgcctttgaaaaaggtttgatggaggaattcacaggtgactgacaagtctttgaaaagaatgggatctgctcacttctggtctttttggccgggaactcctgattggtgttaaggtggtaatttcccccatataagatttagaatcactgagtttgagctagatgaaatttttaaaatttctggttgtctcattagactgatgaggtgagttttcttcttcatatgaacagctagttaataacagcagagttctcactcagtgctcagtacttaattttccactgcaccacaactgtcttaactaaatgtgctgtatttttctttaaaagttaagagttctatttggtgttttcaggaatatacgtgaaaagacatgccatgttttggtaaataccatcagagttgtgtaaaggcgtgtactaagtgcaatcttaatttgtggaaataatcttcatttacccctcctaaaactacactcagtataaacactttcccataaggtgtgtgcagtaaaaatgttatattactccaacactggcaggagcacagcacagcagccttattggagagagccttataaaagtgattaaatggaggcattgagctcattacctttaagtttactttgtgctgacctttgttcctgttttgagaatctcatataattattaaaaaaaaaaaacaattaaaacgaaacggcggggcctagctgtgtataaatgatccttgctgaatatcttaaggttttttgtaagaaaaaagaaaaaccaacaaaaaaagcttattttcacattaaaatgaaacctcttttgcaacttaagaattctatggaaaagcagtttttatcatattttgtgtccatgcaccatttttcttaaa

SEQ ID NO: 12357 - DNA, 1214 bp, Homo sapiens
aaaggaaggtggtatttctagttttggcagaaatgaaaagtgtctcacaagagacatcactacccacgtggggtctggctgctttctaccaaagacatttagagaagtgaattgagtcagggtgatggtgaacactacatattttatagatggttaagttgagaattaattatgtttatcatggatggctactaataccaagctcatgattgttgcagcctcaacgtcttaggcagtaaaacttgtctgcagcactaaagggggagaaacccttatattttgcaaactgtccattcgttaaatttattgtaacctaataccaaaaactgccgtttttcatattatttccccacctcctacttttttttttttttttgctacttgtaaaataaccccttctagaaaataagcattaactggaatgtttcaaacaattttgcttcattttactatcagccactagtgaactcttacagagatgtacatttaagataaaattagcttgtgctaagtgttttaaaaacattgtttactgttaaaggggaattgcacattatatttaactgggattgctccctccctcagttctttaaaaaacaagagtcaaggctcacaccaacttgtaggctgtgggagctttgccataggtagatacaatgtagaagtatacttttttaaagcatgaagaagacaaggaacttcattataatgtaccaggtagaggacattattattcaaaggattatgcacagctcagtgaagatgaagttacaatttttctcgcagctttgttgctattattttcttctgcataaatgtatgctcatttcattatgtgccttgctccctgattgtgcaaagctatatatatatatatatatatatagatagatagatagatatatgagagagatatattcagtactactgaggatgtttttctgaggatgtttttgttctgctggattaagttattttccaagttactcttgccagttatgtcagtaaactattgtaatggcttagcacactagtcgtacagtcagtgtaaatgtttttcatttacatgttttcattatatcagcttatcaaatccttaataaaaaaaattcatagatttcatttaaacatggggactttgagtgtttgtggatcggcaccattaagaatctggttttgcatttcatgtcagggtacccaaaacataggccata

SEQ ID NO: 12358 - DNA, 1101 bp, Homo sapiens
ctggaatagcagacatccttttgaacactaatgatgccaggaagagagtaaggctagaggaggagactcattttaaccccagtccagtggcttgtccgacaacaggccatttccctttacattcctccacagacagaaatggctattaaaaatgttttaacctcatgtatgaactgaatttaaaaaaccactaaagtgatactttatacttctgttttactccctagtgggttttctttaatttggatttttgttgggatgtagcttttcctagactgtatttctgtagctctttttctctggtgtattcatggaaagcatctactgccgcacgacactagtactgtgccttctttcactgccctctgctctgcagctctcacccagcttggctgcttcaagtctgtgcagttgacttggctgtactgaaaagtgaacagcatggattaactcatcctgctgctgagggcagtgcaaacaggtgcttattagaggtagtgacttgcttaattagtgacactcctaatttctactatggataatttcaaagtagaatcactctatgcttagagttttggcaccaatgctgtagggcagcagaatctattctcagtaaaataacttatggtttattagatattctgtattggattttaccagcttgacttttactgctcagatgctttctttcccccccttagacgctgtaattctcttgggaagagtaactattcttaaggtttttacagatacccaccttagttgtaaattggatagtttatatttctgggactttttaaatgaaaatgtggaatgttaagttacaaaagacttttcatcagaaaatttcaaacaaagtaaacatggcgttttatagtcctctaaaatctaggtgctcccacccaccaaaggcatatcctgcaaagggctgtgaactatcttggtgaactgtcttgggtcccctttccatgtatgttttcttgtcactgaaaacaaacaacgctgagtttatcaagaaaatttaaattgggggatcataataattccaaccaagtgacaactctgacatcaaggttattaggagctgtacatccaattcaa

SEQ ID NO: 12359 - DNA, 1148 bp, Homo sapiens
gaaaaatcaccagaatgtttggtgtatctataaggcttttgtgtttgtttttccccagttggctgaagttagaattgcttgactgacacttcattgctatacatgaaggggcactttaaatcaggaaaatctctcagcttcatagaacgggtaactagtgcaggatggggaaatgttcacagacatcatctgtatgtggttgtgcatagaaagtaaatacatggcgtaattaactcagctgttctagctgcagtactgctgcagtgatccacccacatttaggatgtgctgacagataagctctttgcctacaatacatggataattagtgctataattctggatagttcctttttagtactgttttatgaagctttatcaacttggcttcatgatcctcactttgattgattttaagaggatggataacacagttatctctgtaatgttctgtcccagtatgtctttgggtcaccagttaccttcttaaaatatgtgctttaggtaggtgttattacatatctgtagacaattggtatatgaaatatacacatcctgtgccccaatatggtgcattatgaaaaacaaaatcattttctaaaatgcattttttgagcattgctctatagaagggaagggtgatgagagaacagaactggcccctgtacaggtgtcattaatctggttgtatatgggttataatatgtaatacaaaaagctcattaagtatgggactacatggagagggaagacagtttcatttatagctactggggctaccaggacccttgctgactgcagcctggttgtgattagttcaggttactaggtgttctgatggagtgggacagtccaagtccagtaactgacattacgttttatgcgtgtgcagtttggtataacgtggagtcagtgctctaacgacacactatacttctatatgcttttttctgtgaattttccttggtacatgagagaaataagtactctcatcaacttatgataaattggactattaggaataaaacaatctcagagcagctcctaaacaagagaataaaaatgggccatcccagcacttataaggggagcacatcttgtaatgaaagtctgtgcctattgttaatgattaccaatgcaaactgcag

SEQ ID NO: 12360 - DNA, 1211 bp, Homo sapiens
agacaaagaaaatctcttccattaaaacctgcatcacgaatccttctgctccaagctctcaaccatctctttcaaactgccagttcctgggctgaaatattatttattcctttcctttccaataaaacaattatttgttccaccatttcccccctcgttcactctccggtgtgtctggcttcgtcctgacagctcggccacggactgtttacatgtctcgctcaccctccaagactctggttcagctccattgacactaaaggcaggcgaattctctcggtgtgaggaatcaattacttccgctgacactctattactggccctcacatctttggactccagatggagagtgaaggtggtggtgaggatggcagggaatttgaagaggatggtgagcggggctgtggggggattgggggagtaggaggtaggtgacagggaggcagagagagacgatggactgagaggcctctggcttgtatttaaagacacagaaagagatctctctccttgactgccccgctggcatccggaggtgactgcatggcaggaagaggcaaagaaaaggaataaaaagagaaaaggaaaagaaaaggcttgtcaaggatatctaaagaaatcagagaggccccaaatacctaagcactgggacagcagatgacagctccaagcagattgacacaggtatacaaaggcagctttgggctgcctggcttcaaacccagccccacgattactatctgtgtgatctctcagggcctcagtatctacatctgttaaatgggataatagtagtaccagtaccagctgtggcggttaaacatagaaaacttagggtaggacctgatgtctggcaagagttcaataaatgtttgctattgttgtctaattttgagagttcctccacgtgacccacaaacatacagttgagtccccagtgggaaaaagtagaaaaatattagagactgccaagatgcttggctacaaagctcgaaaagaggcataaaaaaagtcatgcttttctgctgccctcccaaacctaagcccaactcacatttctttctccttttccttttccttcttctttttagaaaattttattttgacccagctaacatttttcagggattctccttctaggaaaaaaattttgattatgtaaattaaatacaaccatctactctgcaatcaactgagatgagttgtgaggc

SEQ ID NO: 12361 - DNA, 1205 bp, Homo sapiens
agtaaagacctgatactgatgccaggaaggtttccttctacttggcaaaacaattactaggaaataattcaatgtttagctcagttcccctgttctcagtgtccctgatagggtcagtggggactagtgtcatcgacagggatgtgcagacacacattctgagagtccttggttagagctgtaagcacaaatagttaatggccattggatacttaaatatgccaggcaccatcctgtgagctcttagtaactaacagaatccttgcaacagccctcaagaggtaggcacctctattagctcccctttagatctaaggaaactgaggcaaagagcaattaaataatttgcccaaggccctctgactagtaagtggcagagtgaacatgaacacaggcagtctagctctgagtccaggctcttaaccacagtgctgtacacattcaccatgcaaagaaattagtgctgacttagtatttgacagttgggctcttttgcagctcccttcttatagcgggtggtccctggttagcaggtgtcagccatgacctcttgtatcttcctctcctctctgcagatgctccctgctccaacatgctggggatgctctcaggcctcattgcagactcccagatctccgcctcttccacccaggaatacctctggagccccagtgcagcccgcctggttagcagccgctcgggctggttccctcgaatccctcaggcccagcccggtgaggagtggcttcaggtagatctgggaacacccaagacagtgaaaggtgtcatcatccagggagcccgcggaggagacagtatcactgctgtggaagccagagcatttgtgcgcaagttcaaagtctcctacagcctaaacggcaaggactgggaatacattcaggaccccaggacccagcagccaaaggtaggctgttcttggaggcctctgtaacgttaccctcaacagggaggctaagtgtggtacagggagttgagactgatgatgtcccatctaaacagtcgtcatccaactcctgaaatccaataaaacaaatatcgtttgagagattactttgtgccaggcactgtgctaaataccttatttctgactcttttgtttgtttgtttgtttgtttttgagatggagtctctgtcacccaggctggagtgcagtggcctgttctcggctcactgcaacctccgcc

SEQ ID NO: 12362 - DNA, 1733 bp, Homo sapiens
tttctgttggctgtcattgtcatctccaggtacctaaagaaatagaggccacatgggatgcagtgtggcttctcccatccctatccccaacccacctgacccaagagaaggttcccctagcacactcaaacaagacccccttgtcttctggtgtctttgaaatgtcaagataacagccactgggtgtctgcggaaccacctctccagccctaaagcaaatctgtctcatgttgccttataaaagagaagctcataatgaatgtttagcctttatcagttacatccaatcttggaataagtcatagagaataacaagtctgggactgacgtaggaaaaacagtagtctgtttaagttgagaggaggaggaggtggacgagagaagggaggagagggaagaactgaaatgtctcctcacccagggtggttattgggcccaacttgggatggggttgagtacgaaggttaaaaaacatatactttggtattatattggtcattgtaatagcagttgtaaaatatggggggaaaagggatcatttgctttcctttcatggtgttaatgtgtgcctgaatctatagccgctaaaatgtaaggctgtccacctgacttatttaaatattatcagagaatagaaagtaatcactttttaagtgtacctatgtgctgccccttaaaacattcatggcatctggcaaatagacccttgtaggctggcctggcatattcagatgttgccgcatcatcacagagaaggtcaaatgaagatgtaaccattgctgctcatgtgtcttctctaagcaacaaggggagcgggatgtaagagagaagttgctaatgatactgtacaaaggatggattaaataatgaagtcaatttcattgatagaaaatgcaaattttaagattctcagtgtatgaggtctcagcctcgggagcatttattttttactttcctgctaaaaatccactggggaggtataaaattcactccaaagaagtttgcctgggccaaaagcctccaggttccttctgagaacaaaatactaatgattttttttttttttttggctgcttgggagagactttcagcattctttcacgatatccagatatgtcccttcagcacacacactcaactttctcatctggttcgtttcatcctcccgaaagaacggtgctctcccactcttactctatttcaaagagctactctgtctcaaccacagcagccctgccaagaaaaggcaagatgaaaggctagagcatgtgctaccttgagatttcaagaagtgtcctacctcagctgaagatggagaaacggggagtggagaggggatcagcccagggtaccatgtgatgactaatatgccactcattaagggcttttacctcggctgtccacatccagtcatgcatttggggccaggcatgcctgcgaaatgattgacattcctgtaggtgccccatagaggtgtggcattgagaaattatgtctggaaaatacagccagtgtagtgaccagctgagttaccatataccctgatgattccccttctgtaacagaaggtgacaacaactttgtgaactttctatatctttatctgatgccccaagtggcatcatctttatgtacatgccttagttgagaatatgagactgctctaatctttgtgaatgccttcacacttcagctgaggatgtcaccttctctgtcactccccatcctgcaac

SEQ ID NO: 12363 - DNA, 2468 bp, Homo sapiens
acctctgtgatcatatgagggccaaggctgagcagtgtagacagagaccctttgaaatgcatttgtctctcaaatagactagtaaacaccgacttctcctttgggttacaaacaccatttcaacctttcgggagagtcagagctaggatgtacaagaactgattctaaccagaagtccgcaagtactgtggacaagaatgcttaaccatgctgcttcagccttgagagacctaggttcttacacatatgcacacacgcatacacacatgcacgcacacacacatacacacatgcacgcacgcacgcatgcacaccaatttatgtttttattaagtgccttgaaaaaatgaagaaaaatgtattttccctttatgtaaaaattagtgaatatcttatgaattaaggcattcctctttccctaaccccgatggctccattcccaagtaccccaactcactgctgatcctattaaaggaatgagtcctgctacccgagtggtagtcatagccctagatgactctcaactactcttcaaagggaggcatcaggaatagaatgaaactgtgtgaaggataagattgttcgcatcaagatccaaatcttgatttcatattaacgcctaaggattgcctgtgtgctggaaatatatttgaaactcaaccagtatgcccagcctattgcatatcattgtcagaccatttttgctgctgtggtcacccacgatttcatttgtcttatacccaggtgaaaggggaagggtgaatgggactggctggttcctttaaatgttaacttatggaaatgctagttcaaatggtaatgtcacagtgttttgtatgcagagagcaagagttcaaccaacagctgtttattcatgtgtgtgtgtctttgctgctttgagttctctgtatctactgtgtatgtgaatggtcatgtgggactcagtggtggtgttgtgactttgacctagggtccgagtgtcacagctgatcttggcactcggcactcattggcacagtggtagttagaggtgaaaagtagagctgtcaagcccaagggcttagctttagggctcctcctgagttcggcccacagtagaagcaagattttaactagccccttttcctcttcaccctcccatgatgcgcagtgttcagaaagctggtaagtcctagggatttccagaagtagcctgcagaagaaggtaagtttgaaagccactccaggggtcctgatgctgtcatgctcagtgagccattttacagttctccaaagtctagccctgtttcggacctgcacttcacctctaagttatgtacaactcaacctgcatccctctaaaagtcctatatccatattcaccattggctaatttgaggccctgagtgggccttgaatgctaaaaagaagcagggtacgcagggctacatgtagataccacaccaaggctggaggctggtctgtcataagacagaaagaaagacgctgggcccaattttgacttggccaggggacaccttggtgtgtttgttatctttatctgtgggtaggctagctgacccatctccttgagtcattccctttgggaaaccccactgccagtattgatctcctttttgccttgtactgaatgacacattacctccacactctcccggactaggtggtcaacagggccacagggttgctttctgtctttggtggggcaggggagttgacagggatgagggtccaaggaataagcatgaatgacaagaaaacaagggaaagagttaacctgtcacatagcaggttaactttttcagggtttgcagttagaggtattcgaccattcactggctgagccagatcacgggaacttgagagcttttactgtgattcttcaatgtaaaaaataaacaacaatgtcaaactgtgtttatatgatttgtataaagcctttttaagattactatttaaataaacattataccagagatatttttctgcatcgtggttttttttttttttttttttctctgcattgtctttattggagacaaacagatccgggataagggtgaccaaattgtcccactttgcctgagactttttcaggtttttagcactgaatgtcctgttgaaataggatagttccctcaacccattcacaggactcatgatagggtggcttgcttactcagcctgcagctctcaaccccttgtgggagggggagaacacaggagagcaggcgcagaggccaggatgagcacttttgggcaaccggcaggagcagaaccctgtgcgggcctgcggcagagtctaggggtcgcccatgacccctggagccccagagggcctgtgttacagtgcgctcttctagctttgccatccacggatggcttaagtgttaaacagctcagtgtagagtcatgatgacagcctcttgcacccacactcaggttcttgtctagcatccaggaggaat

SEQ ID NO: 12364 - DNA, 1077 bp, Homo sapiens
aaggcaatgaaatattgctctccagatatatatgtatataaatagtgttgatataactgtatatacacatgtatatgtatgagttttaaatggcaatcttttacatttagcaaaatgctgcccctactggaatattgtcactgcagtggcagttgtatgtaatgatttaaaatacattatcaaaagttatttaaagaacatttaaagtctcatctaaagacatccacacactatttatttatcttccttttccttttattgttgtgtttttcttaactgaaagggagactgtcattttaaaaatgccatctgtcccatgagagtaagaaagagctggagattcacttgaggagctttgtgcatttttcctctctctgaagtggagatgttccacagaccagactgtttatttcacttataaagcaatcctaatatttccgttagtgtatgtcagccaccatctcctagatcaacttaattcaccaatttgcctcctcctttcattaataaataatgattattgagatcattttgcctgggggaagttaactactcccatgctgcagggaaatatatcacctaattgttattttgccttgttcaaaattcaaatttgaaagaaggcagctctctcatgaagctgtcttaagcacattttagttaagggccctcccaaactcttttttctttctttctttctttcttttttttttttttttgcgagttccaagttgcatgtgcttgaaatagatttaattcttattccccacagtttaggtatttttcattagtacatcaatttgacacactgaatgcaagactattaaggaagaacgattaaatattattttattttgtgaagagttggcagcagattacatctcaagaacttgcagagagaggaaggtagatggacaatcctaaattgtaagatgttacaaaaaacagtgaagtaagagtactcctgaagactaaaatagagaggctggggtttgagccattttactgagtagcttagctggaacctgatatcagaagtagcctttaacaaaaagcctcttggcaattgtatggtac

SEQ ID NO: 12365 - DNA, 1867 bp, Homo sapiens
ttgtataaatacaccaaattaatcattatgttatcttatgttaaaaggctagctctgatatcatgtgcattttatgttaacctttggattaacttatattatgctatgttcataaaatgacatgagaaacaggaggttctaagatcagcctctcactttcgagcataaaaataagagagggagacagacagccccagacatgagctgtgtttatctattgtggtgatgggaccacagatctattgaatcttttttatgttaattatagatttctttatattcgagtaagaaaatattgttgatcatcttttcttggtgaagttaagaaaaagtataggcctttcataaacaatttttggaaggggctgctttgtttaaggagttggtgggatcatttcaccgtgcatatttcaaagctggggtgatttcatttatttccaaaatttttcaaaaaacttttactcagttctgctgttatttattaacttaagagtgctcccatccccatatttcagctataggaaaattgtgctacccctgattcatatggaattaaaaaaaaatacatccctttattttgagttttaagttgttattttgctatacatttattactggagtatctggtggtctgaaatagtcaaaagtagagttggtattaaatgttccaatgacatttatttttaatacttaaaaaatcatgtactttgaaatatgtcaaagcaacttctgataatatacctgaatttgtagttgtctcttgagcatcatttacttcatcttagatatagtgaagatctaggaaagctctatatgctgttcttttctacagttgtatttttgcagcatctcctggtttcattcactcttgttttgggatttttttttagatctgcatatttcttgtacatatgcatgcaaatgaaagaagggagtttgtactggtgccatttctcccttcagttgctggttaatgggatttgctagaaaaaattctcccggttgaagggtgaaaacagacccttatgtgtatatctgtacagagatgtgtatatgggatgtggtggcactttgctgaatgtgaacttgccttgtcaatggaaagattgaaaagtattatgtttatttatacatttgtataaatctatatatacacgtatgtatatgtgtgtgtatagataaagctatatacatatatttcccttaaaaatgtgtgtgtataataggtaaacagcctttgttaagcaagattaatgtctatggaaagttctggattattctgtaagccagaggaggtgacagtctagagtacatcatcagaacatactaaaatggaagtcctttggattatagttttgtttatggatattacacaatgaatgcttgtctgaacagttcttacttgccagttccactattcttcatcttcaccaccttctactggtcagtctttcatcacttaaaaaaaaaaaaaaaatcacacatcattgtggtttttttcccccttaattctgtctcttctagccagaagcatctggcttaagcatatttcatcaacttctctgttatttcttttaaagatctttatctctgaaattttcccagaagatacaagttttggtaatattatcaataggaattttgagacttgggcattcatctttgtctcaaaaacaaacagaaagccaaccttcaaataaaacaaatttgaaagttttagctcaataatttggggacattttacttaaattacaaaagaacataattatgattttatgatcgatattagtgttaggtttatttccacacttactgtcattaatttgtcatttacatatttttatttgctttgtagtttaatcataac

SEQ ID NO: 12366 - DNA, 2067 bp, Homo sapiens
ttgcccgccgtctttgccgtgccttggcatcctaggggtgctggtgatggtcagtgggcatcatcggtcagcagtgcacgtgtaaggcaatctcctctcctccaggttagttcagaaggtcgctatgggttggtattgcaaaaagatgagtatatgaacactaaacttattaagaggtttgaaattcattaaaaattagttttcagtttcttcatctttcttttcagacttctttaaaaatactgttcttaatctggtatatatagaaatctaatattatggtcttctaaatggtcaacagaactctccagtttaatgaggcaatttagaggattccttgaaagaaaatttcatcatactgaacagtcctcatttgtatctcttttgttaccagtatttacattgttccaaggatttttttcctgacaaaaaatatatttctcgggagtggagagttttttatatatatatatgaaagaacatagatgtttccccccgcccaatacattaactgaatcttcactggcattctgtagaaaagttaaaacagtttaataatgtcttaacatctttatacattttcctatattctggaggaaaccagaatcatgtttagtagattaaagtaacattttaaatactacctttccaataatttgtaataaaataccagtgaaggacatgtttggatatctgttaagcatttttccctgactaatgaattaggaaagaaaacataaaacataaatgaatagttatgtctcttctaataaacagtgtcattaatgctgcagttgtgggtcaaacttagggagccttatttctaaatagcaaaaattctgttttcacttcagcccttatttttttttgttagtttttctctgcactgtgatacagagctaataagaggaaatgtgacgtttcagagagagagcaagcaaattgggtatgacttttttaccctatgttccccaatactggggatgtttggctactttgaacagcagtttttagtgatctaaagtttagatcaatactcgtataagagaaaaatctaactctcagtgagctccatagggcagcacagctttccatcttctctttcgccttcttgcgtctgcccaccacagtcccgaagaatgcacacgcacatatgatctgtacccatcccgcccgaagagtcatagaatcctcttctttcacttgtttcttttttcttcgtttgtttgtttttgtttgtttgttttttaagctggggaccactgaagtaagctctgtatgcacccaaagttccccttggaaaaattttcaacacgcagtgcagaaggctccagtgcagctaaatgccacaccattggttctacctgggggaatagactgatttgccctaaaatgactccaacctgcatcattaaggtacagttggctccagtggattagtgctgaaatgatgggaagtctgacacttgttgacattgtcttcatctgtttggaagggttgaatctgttcctctcaacagtgatagttcttttcactgtatagtattgagtatgtctcagggattccttgtggaaattagggcagtttttaaaataagaaaatagttttaaaagaaactaaaggtgactcatcattgaagagagcggaagaaagaggaaacatttggttttgtagcccacagtgtcttgcataggactttttcctttctcctccaggctctcatctcagcttcagaatacagaatcctttcccatcacgcacagctttaaaacttttatttaaaaatttccttccccaatgagctttcagaatacttattgtagattttaagagaaaaggtatattaatttatgctattaacatcacctcataaattataagttttatactaaagctgtatcgagtgtaatgaattatgttgcctatgtgtttaatagctaaatatatatgagcttttttttttttttttttttttgacaaaacaaactagtgaagcacctttttacactggatctctgccgtgtcaaggtgtatagctatcctttgctaccttgcagatatataaa

SEQ ID NO: 12367 - DNA, 2637 bp, Homo sapiens
atctgtcaactccttgatccatcttttgcttttgaatttttcatgtttacagtagtgattctttggtaagatttgtaaaatgttaagacacttgtagaatcagtgtaccagttgtgaagtgatgtgtaatatctgaaggatacacattttaaagtttctttcaaagcagaatatggaaattagatataaattttattcgccctttggtccttttaaaataattcaagtacttgggtttaagtaaatttgaaaatagctttgggaaatgtttttaaaatgccaggattttaggggttaaagatcatatggggtagtttaggaagtttgtgactatgagatgaatttgtgaggtttcttgcctaccttttttcccccccagagaagggtggaactagattttaaaggcatctctactctgcttttgctgagtagtttcactgtcccttgagataccattggctatttatacctgagtctagtctaattcacatatatatatattttaaaagttgagagaacatacctattgatgtggttcaataattcatttgtcagggaatatttgatcttaattcctttctaataggtagtgattggatgtattttcctacttcctgtatgtaatctctttatgccatgctagttctaaccagtcccttcttttgaaagcttttctttctctgctttttaaaggaatgatggtgatcagcaggcattatgcagataccacgtgcctgaggttatggaggggaaatgtcacatgactgtatgaaatcattatatgccctattttgtatttattgatgtttctttttgtgggccaaaaatatgtttgtaatatatttagtttttttaaaatcatggtaattgattggaagatttatttttaatagctttgccttttttgcagagtgcaaaatttctaaattataacttatgtcataaagcaaaattatatttggtatcaccataaatttctattctgaatggtgagaacagataatttgaatatttctcacctgtgagtctatattagtaagcttttttattttaatgtactgtaatgaagtggtcacgagtagttacctcggctcaaaaatgtcatttagtttgttaaactattttcacaaccatcataagcataactagataactgtccattcccagcagttcagtttagtctccattgtgtatttaaaggttgtcgcagagcagcacattgacttcctcatcagccctttgacaaggaagggaaagtcgtgggtagtcgatttgaactttttctgtctacttgtcccctcatgttagctgcttgaaattcttcagttatgatacaaagctgagtttgcagtaagttgcacattttattgtttgcaattttctgttttatgtgcatttaaaagcccttctctgctttctagtaaggaggcatgaaattatcaggaatgttgctagttacagcttcacaccaaaaactttgagtaaatacattttcgtttggatgcccatgatgaaagctgaggaaagtggttgaggaattatcaacaacaaacttttcctcttattttatctagttcaaaacagatatcaaagtttgcaatttgctttgctcttgctgtttcttatgagtccctttttggaagagaggagaacatctataagcccagagagatctgtgtttttcttttacttaatagagccattctcgtctattagtaggaactttgctattaatatgtatagaaaggaatgaagtggcttttactccagaaatatgaaaattagtatcttttaaaatagcacttatgctatcacaaggcaatactggaatgaaaaacaaatcttatataaggtcctaaataggtagaaactagcttttattctagtgttgaacccaggagaaatagtggcaaagaagtttcactctgtttctgcagttctttgggactatttataaaggccagttagattgtgttactgtgatttaatttacaaagttgctgcagttaatggatacattctgtgctctgagaatctgaattccattctaatgtgtgatattcactggctatgatcagtagtatctgaagaaaagatgggctttttctcctttactctctctacataattattaatattattttaattaaagtacttaagacattgttttttcttctgtaaaaatggcttagcaatttgcacatctgggtaggttatgtagctagtaaacaactcaatagtaagtagcaattatacttaacccaccaagtgacagactatgcaatggaaaaattttctaattatcgtcacatagcttagacagcaaaggattattttctctggtgacctaccatgtgtgatataactgctttataaatgacttcctgagcaatttcatgttggcaggcagtgtggtgtgtctagtgcccctctatgagaagactataatttaatcagaaacaaatagtaggcatggggagcaagttggaaagtgaggttattattttttttccttaaaattggtgttactgtctttagtggcttgaggctaaagaaagctgatactttatctttgccaaataattatttataagatttatttttaaataagcccaatctctcacctgcagttaagaa

SEQ ID NO: 12368 - DNA, 1355 bp, Homo sapiens
tgtcataagagctttgtgaatctccgaatactttaatggcattagaaaatatatatattttttctcataagagaattttaagtgatcttttagactcttgatgagttactttgtatgctatgaatagagaataacaaagccatgtgagaagcagtagctgagcagttatccagggccactcagtaactgaatgacttgcttctgtctggccacccctgtgcatgtacagttcacatatttgcctcatcaaaattacactgactttgaggactgcttgaaagtagtagaggtttgcatgttaagttgctggctgccaagagtcactatagtgacgcaatttttaacattaggattctcatgtagttttatgttctacttttaaaaaatatgtatcatgactgttttcccatgtatgtgtgtattttaaaggtactgcaacagccacttgcaggtacttggctttatcccgaaaaaagagaggaagaaaaagaatgatcctatagatgaggtgaaggtcaggcaccagatggataccatggcctttagcctgacagtgcccacgttggccttgaagatgcccaacggactggatggaatgtccctctctccacctggggcaagggtccctctccactacctggaaaccgaattggaagacccatttgctttcaatgaggaagatgatgacctaaagaaaggggcaactgtgagaaagaagttgcagagcaagttggcccagaatcggcagcgccagagagagacagagattttaaaagttcgacaagagcactttagtccccctcctgcaccttcacagcagcagcctccgcagcagcactcccacctgtcacctttatctacttctttaaaacctccagcgccaccgcagggttcagtctgcaagtcacctcaacctcagaacaccagcctaccaatgcagggagtggcacccaccacacacactatagcacaagcacggcagttgtctcacaagaggcctctgcccctcctgccatccagtagggctcccactgtggacccacccaggactgaccggatcctcatgaaagccacagccttctctccacacttctcatgtataagccgactgcagagactggtgaaactgtgcacccagaaacatcagttggacactgatctgtttccccatttaggtgagttatctattttatcgtatcatagacacataatatgacaaaatgtgttcggttgtgtggagcttccctttcataattaccccatatgtgatgggggtggaatcacaatgaggcagagtggtgcagtgaaagattctgtatttaggtagaccaccttaaaataaacacagtcgtccc

SEQ ID NO: 12369 - DNA, 1188 bp, Homo sapiens
taaaacagcttccttctaagttgatgttattagctgtggccccacataacacctctgcagcttttcacttttagattaattaataattgttgtacaactttttttgtgtttttgagatggagttttgctgttgtcgcccaggctggagtgcggtggcgcgatctcgatctcgggtcactgcagcctctgcctccttggttcaagcagttctcctgcctcatcctcccgagcagctggggatacaggcgtatgccaccatgcccagctgatttttgtattattagtagagatgggatttcaccatgttggctaggctggtcttaaagtcctgactgcaggtgatccgcccacttctgcctcccaaagtactgggattacaggcatgagccagtgtgcctgggcatgttgtaaaacttttaatcagaagtctgttaactttttttgtacttgaaaacaagtactgttttattttctgaacatttcattgtggtctttgctgcgtgtaggtttcttggtgatgcccttttcatctgtttctagttgcagagttttcaaggcaaagatgtggcagcaattgcaggtggcttggtggatgctgaagccctggtagctctcaaagatttgcttaatagagtggactctgacaccttatgcactgaagaggtcttccccactgcaggagctgggtgagaaatatgaagctaggatctaggctttcctttctttttttagttacaagttatgtataaaatgtgacaacctggattctccaacatatcccccagtttattttcatatatagaccaagatcaaaccagaagttgtaggaaatagaggaatccacttatcactaagtatctcaggcacagtggctcacgcctgtaatcccagcactctgggaggccaaggcaggcagatcgcctaagtgcaggagtttgagaccagcctggccaacatggcgaaaccccgtctctactaaaaatacaaaaaaattagccagacgtggtggtgtgcgcctgtaattccagctacttgggaggctgaggcaggagaattgcttgaacctgggaggtggaggttgcagtgagccaggatcacgccactgcattccagcgtgggagacagagtgagactctatctgagaaaaaaaataagtatctgaaatgttcatttaatttagaaatactt

SEQ ID NO: 12370 - DNA, 1242 bp, Homo sapiens
tcatacaaaaaaaagtttgatttcttatactttcagctaactgaacaatcttaaaattacaacacaaaaaaatctgacagctaaaaaagtcaaatcatttttatttacaaagcatgagtatctctaaatattttatcaaaattatattgtgcaaactcttctattcagcttctttttcaagcaatcatcccacctcggccttccaaagtgctgggattacaggtgtgagtcactgcgcccagcctagcttcttttctctaatgaacaaactgaaataagttgagaatgtatcaatctacttgaatttctccatgtgggaggaaaaaatatctttctcaaagtaaatacaatatccagggattgacctaggactattaaagtcagtattatcacattatataagcaactcagattccagtagtctatattcagtaactaatttgcaaatataaaagataattcttcaaaattattataaaatttcctttaaataaactgtaaaagttaaggaaaacaatatagcatatacctggttttatcagagatccactcttcattgatgtcctcatgcatacgtggcaaaatcctcatcacttctccagttcttgtgctaaccacaatattacttccaaccgcatccattacatcaatggattctgtctttctgagaaacacatacggtgtttactatggtgcttttgggaataaagaaagtttctgttacctggtttaccaaaaaattttttttacaattaattccctttctgaattactttaaaaaatgaagcttagaggaactgcaattaaataaaagaaccccccacctttttttttgccctggggtctcactctgttgcccaggctacagtggcatgatcataattcactgcagcctagaactcctgggctcaaactatcctctcaccacattttaaaaattttttgtagagccggtgtctcattatgctgaccaggctggtcttgaactactggtctcaagcaatcctcccaccttggcctcctaaaagctgggattataggtgtgagccactgctcccggcacacccacatttgaacacataaattcctggcacagtaaggaaggctttaaaactattatctgacacagaagctagtttgaaggggctccaactagccaaatctgggacgattcaacaagaggggcaggatttctgtctatgggagattaaggagctcaaaaaaccttcccactgaaaagca

SEQ ID NO: 12371 - DNA, 2652 bp, Homo sapiens
gttgggatattgtaagctaaatttttctgtaaccttagaaggccaagagactgaagccctccattttttcacagaacaggtagaacatggacagcagcaattcaacttttccccacactgccctgccaatgtgcctcgaccttgacctggggggcccacctctggggtgagagggtggctcattcattcagtccttggccattcttctgaaactgccaacaagggtggaagtttggggaagtggactccagttcactaagaatggaactgagcatacttaatgaaatctcaaacagaaatgttcatactgaaagagtaaatcatagtgagtattgaaaataatgtctcacatggtactaatgcttgtcgggtgaggagttgaacatatgacagtgtttacctgggcgcatgtgaaagggtaaattatgattgcaaaagggatctagtgataagtagtgattaaaacaagttattttgtattttctggaaaaggatgttatactagctcaatagtggttgaatttaaatgtttttcaagcctgccaggagtgaagaaagctttgggcaaatatggtcctgccgatgtggaagacactacaggaagtggagctacagatagtaaagatgatgatgacattgacctctttggatctgatgatgaggaggtatggcgtcttctataaagaacatatcggccaggcgcagtggctcatgcctgtaatcccagcatgttgggaggctgaggcgggtggatcacgaggtcaggagttgaagaccagcctggccaagatggtgaaaccctgtctgtactaaaaatacaaaaaaatgtggcaggcatctgtaatcccagctactcaggcggctaaggcagagaattgcttgaacctaggaagcggaggttgcagtgagccaagatcgtgccactgcatccagcctgggcgacagagcgagactccgtcccaaaaaaaaaaaaaaagaatacatcgatcagcaattgtatcaatgtggttaagccaaattgcctggatttgaatcctggctttaatttatatgcctttttcaaattctgactggttgcatgatgaataaaatcaaatcaccatctttcggctgagttcgtgatggatttgcttttttctgattaagccagtcttttttgtgatgaccccactagctttaagcagaggaacaaccagctttctgaagtggattaattttttttctttacaggaaagtgaagaagcaaagaggctaagggaagaacgtcttgcacaatatgaatcaaagaaagccaaaagtaggtcatttgtttttaacttcatttcatgttaatgtaagtaatctttttcaaagcttgaccttgaagtaatttcctccacattccttgaataggtcaatattttaaaacctgtacaggttcttccacagctactggtctgcagctgttcttatggtagcagttgtggcattcctctgtgggaaagaaactgttaacacaaacacctctttcttagcaaaacagaaagtgggtatatatgtgtgacagacacaagatgtatctgtagttttgtttggctaaggagatagtctcaaaacaaattgagatggatttgtttgtgtcttggagtagggtgaaaaaaatacaattcattatttgaataatgctgtttattgtttttagaacctgcacttgttgccaagtcttccatcttactagatgtgaaaccttgggatgatgagacagatatggcgaaattagaggagtgcgtcagaagcattcaagcagacggcttagtctggggctcatgtgagtttaggctttgcctttttttttttgaaactaacatctggaatttgcctacagtttcaacctttcctacaagacttttctaactaggatttttcttaatgctctttttagctaaactagttccagtgggatacggaattaagaaacttcaaatacagtgtgtagttgaagatgataaagttggaacagatatgctggaggagcagatcactgcttttgaggactatgtgcagtccatggatgtggctgctttcaacaagatctaaaatccatcctggatcatggcatttaaataaaagattgaaagattacctttggctcttgagtatgttacataggagggtggtgtatatattcctttcattttgggggaaggaattaaatgaatatgtgattcctaaataccccaaatttggtttggcattgttgttagaaaattgcagtgcaggccaggtgtggtggttcatgcctgtaatcccagcagtttgggaggctgaagtggctggatcgagaccaggaggctgataccagcctgggcaatggggagagatcctgtctctacaaaaaatataaaaattagctggacatggtagtgcacccctgtattcccagctatttgggagactgaggtgggaggatttcttgaacccaggaggttgaaactgcagtgagccaaggttgtgcgactgcactccagcctgggtgccagagcaaggtcctgtcaaaagaaaaaaaattgtagtgcaactttacccacttgtgatgtccttagcagtgcctgatgatgtgatttgttgtaacctagcatctttgcactgggaacttgatgtgagatgtgtgac

SEQ ID NO: 12372 - DNA, 2652 bp, Homo sapiens; identical to SEQ ID NO: 12371

SEQ ID NO: 12373 - DNA, 2652 bp, Homo sapiens; identical to SEQ ID NO: 12371

SEQ ID NO: 12374 - DNA, 1180 bp, Homo sapiens
ttctctcttgcagtgttttaggattaatcagcagctgtagcgaaccctgtaggatcgtccctaaacacttttgccaagaccaaaaatatgaatctgcagacagagcattttgtaaacgatcaggagtccttttccttttttgccagctggtagttagtcaaatgctgttttgtaaataaatcatctgcaggaatcctcatcaggtccactgtaaatgtgtcagtttgaggaaaacaaacaggaaagcacttaccagttaaatttctgtgaggagagaagctattgtcatgcctgggtgtaccttcccggttccagaatgaaatggagggtggtgttcagaacggctgcattcctcattccacttttatctggcttttgaaatgacagtgtagagaagaatgatgttgggttttgaatgtggttcttcccttcccccacccccctccataaaaattcatcatgcaatcctggagaaaagtaagcaatgaacatactgtacaaattaattctttcgaccagcctatgtttgtgtaagaagtttgttttttgaatggaaaccactgctactagctgttctgctgcagactgaaaatcggtaatggatgggggtcacccagccctcctttgtctgggtaggcttttgcttatgaaaaggcaagttaaattagcagagatggaatgttcttcgaatgcatggtataaggctcatcaggagattttactttctgtgattcagtgtgtcctgatagtgaagagatggaatcacatattggttaagtgtgaattttaacgtttatttatttttatttattttttttgagtcggagtctcgctctgtcgcccaggctggagtgcaatggcacaatctcggctcactgcaacctccgcctcccaggttcaagtgattctcctgcctcagcctctggagtagctgagactacaggcacctaccaccacgcccggttaatttttgtatttttagtagatacggggtttcaccacgttggcccggctagtcttgaattcctgacctcaggtgatccacccgcctcagtctcccaaagtgctgggattacaggcatgaaccaccacgcctggccttaaagacttgattttttttttttttttttttttttttgagacggagtctcgctgttgcccaggctggagtgcagtggtg

SEQ ID NO: 12375 - DNA, 1190 bp, Homo sapiens
tgaatgcttactgtgtgccaagctgtttctttgttttaatgctctttacatgtaacaattaatttactcatcaaaacaatctcatgagggaaaatagtgtaagattccctttttttggaggcagaaactgaagcatacaaagttaagtaacatatgtcaaactttttgctatttactactctgataactgaaaaataatatatgattttatttgtttagtttttcatgtttaggggccatttgtatttaagtagcaattggtggagccacctccaccttctgcagtaattccccctctgtggtccatgcagtgttcagcctggggtgactgcctggattccttgtcctttaaggatagtccagaacagaaagcaaataacatttattatgcctctattttaatattttaaacagacattagaatatgtttatgagtttcccccctttcgttttagttcaacacaagatgagacacatgtgaatactgggtcatcgtctgaagtggtgcatttggatgatgctttttctgaagaagaggaagaggatgaggataaggttgaggatgaggatgctaccgaagagagaccatccgaggtttcagaacctattgaagagttacattccagacctcataaatctcaggaaggcacgcaggaggtttcagttcgaccatcagttattcaaaaactggagaagggacagcagcagcccttggagtttgttcataaaattggggccagtgtgagaaaatgtaacctagtagatattggtcaggctacaaataatagaagcaacttggtacgccccccagtgatttgtaatgctcctgctagttgtttacctgaaagctctaacgatagaccagttacagctaatacaactagtttaccaccagcagctcatttggattcagttagcaaatgtgacccaaacaaagttgagaaatatcttgaacagccagatggggcctctagaaatcctgtgccatcatcccatgtagaaactacttcattttcgtatcagaaacataaagaatcaaataggaaatctttacgcatgaattcagataagttggttttgtggaaagatgtaaaatctcagggtaaaactttatcagctggcttgaaattccatgaacgcatgggtactaagggctccttaagagttaaatctccttccaaattagcagt

SEQ ID NO: 12376 - DNA, 1267 bp, Homo sapiens
ccatggtcctgaaatgggttttcaggctgatgctcaattagctgaccagtctcaagtagccgaaatagagcgtcagaaagtggatgttgaccttgagaataagagtgttcagtctagccgttcttctctgagttctgattctccggcttctctttatcattcagctcatgatgagcctcaagaagctttggatgaagtaaatcttaaagagttaaatattgacatggaagttaggagctatgattgctccagctctgagttgacttttgattctgacccgcctcttctgtcagttactgagcagtctcatctggatgctgaaggaaaagaacggcacattgacctggaagatgagagctgtgagtcagatagttctgaaataacttttgattctgatattcctctttattcagtaattgaccaacctgaagtagctgtttatgaggaagaaactgttgatctggaaagtaaaagtaatgaatcttgtgtctctgaaataacttttgattctgatattcctcttcattcaggaaatgatcaccctgaagtagctgttaaagaagtaattcagaaagaagagtacattcacttagaaaggaagaatgatgaacccagtggttctgaaataagttcggattcccatgcccctcttcattcagtgactaattctcccgaagtagctgttaaaaagctaaatcctcaaaaagaagagcaggtacacttagaaaataaggaaaatgaacctattgattctgaagtaagtttggattataatatcatttttcattcagtgactggacgttctgaagatcccattaaagaaataagccttcacacaaaagagcacatgtacttagaaaataagagtgtttttgaaacaagtttggattctgatgtccctcttcaggcagcgactcacaaacctgaagtaattgtcaaagaaacatggcttcaaagagaaaagcacgctgaattccaaggtagaagtactgaattcagtggttcaaaaacaagtttagattctggtgtccctcattattcagtaactgaacctcaagtagctgttaacaaaataaacagaaagaagcaatatgttctagaaaacaagaatgataaatgtagtggttctgaaataattttggattctaatgttccacctcagtcaatgactgaccaacctcaactagcttttttgaaggaaaaacatgttaatctgaaggacaaaaacagtaaatcaggtgattctaaaataacttttgattctgaa

SEQ ID NO: 12377 - DNA, 1653 bp, Homo sapiens
ttttaaggttaaaaggtgtgtgtgagtgaacatcttgagcccttgctgagtgccagagattgttctaagcttttaacctgttatctcatttggtcttcaaaggacctttatgagttagatactgtaattttcgcaatatattaaatgagaaaattgtggcatattgtagtttatagttaatcatcattcccaccccccagttccaagccagcactaatctactttctgtctttatagtatatccttttctggatagttcatatgaatggagtagtaaaatatgtggcctttttgttggcttctttcatttaccccgatgttttgtcattgtgttgtagcatggatcagtattttgttcctttttattgcagaataatacttacagttcgtttttaatgaaaataataacacagacctggtctcctggtagcaaatatgagaaaaccactaggtttgggcctagctgttccctttatgcctctcctatgtgttatccttggtaactgcccagacccaagaccagacaggaccattgccttctagagttctcttattccatacctggatgcttgtgcttcctcccttggactttttgtccctttactacccttcctggcattcttttcactgttctgtgaattctcattttcagtgtcaacacattaccctgtgttctcagtgctttcacagtgggttgctggcaggtaattggaatctgagaattttatccaagttgcccattattctaatctccataagccacagagccaggaactgctgatggtgtactggttgtggcgaacactcttttttgaaaattactctcttacataaccacagcacatgccatcaaaatcaggaaatcagcgttgatctgataaaaccatctactccacagaccttgttcgggtttgggggattattccagaatgttctctcctggtccaggatttgatccaggatctactggcatgactctaattttcttcagtatggagcagttcctcagcctttctttgcatttcatagcaaacttactgaagataactagttttttttttttttttttttttttttggtggaaactcagtttaatgtttctttataatctgcttttgtaggggaggagcaaaaattctgtattcttagtgttttgtaactggagccgtgtgatgtcaatttgagtaaatatgatagaagatatccagtgttggtccttagggaaaaaggttttcataatcacagaagtgggggctctcactgaggttgagttatcaacaaatagttacattttctggcagcattgatggtgaattttatctaattatcttttaactcatagataagacaatcacttattcatacatttactacccctactacgtgcttacccatgtgtgggtgccggggatccaggcatcaaccaaacaggcctctggttgctcaccctcattcactgatatgtgtgagagggaatttcagtagtggtaagtcagtggtcttgcaacgtaattcttgtgctttcaaagatcattcatagactcatatagctaacactcacaggatactgctctttggcattgaccagtccctccactttcttccctgagacccattgcaagctgtttctgatcattgtcaggaaagattgtt

SEQ ID NO: 12378 - DNA, 1164 bp, Homo sapiens
aatattagtttattctaaaaattaaatttgatgccaaaaattaatttgtatctggttgcattgggaagaataatgtcaaaaatgcactaacttcctttgccttgatttggggaatgatggtggtgtataaaaaatgatttagaaaccatcagtatgcaataccacaattttgtgattattgttatcttttgttattcttaacacatctatcttccaaatgcgattgaaaacagggcatgctgtttaaactggctctttggccatagtctttgttcaaaacaggtcaccttttgatgattttacctaaaaacattttataaataactgtagttattttctcctgtgttacctatgagccagcagaaacttttcttctgtgtttatggatttaaaagagttttttgtttgtttttttggtttgtaattatgacattcagcttattacttctttcatatgtaatacaaatgttggccaaaaattggtatttttccatcgactttgaagaactgtagaaaagaagtcaaacacttgtaaatcgtatgttttggtgattctaagtgatactccttgggtttccaatgaacttcaggtacagagggctgttgttaattgtctttcacatttatgccatgttagatcattgatctgagcaaagccccagtattgtttaatgttttcattatctttatctatctccagtccccatcttattttccctgaccatatcctaatgaggcaaccaacccgatgtgttttacacgatctttttattataggtgttcttaaaaattacagtttgtggacatgtaattttatttactaaaaatagtgttatgctatagatctctactcaatacaatgtttaaaggtctgtctgtaaacctgtgtacatttttatatctaaccgtggtagagtaccctatattgtgtctctaactgcttcatcccccagggggagctatgtagattccccgtggctctccacaaccacaagccatattataatgtatatgtataaatcaggatgaatagagcccatttatacatatacatatacattggctgtataggccaatgggctttatccatcctgatttatacatgtgcgttataatatggcttgtggttgtgttgctggtttattgggccagtgtgtacttaat

SEQ ID NO: 12379 - DNA, 1183 bp, Homo sapiens
aaaattaagctttctcggccgggcgcggtggctgacgcctgtaatcccagcactttgggaggccgaggcgggcagatcacgaggtcaggagatagagaccatcctggctaacacggtgaaaccccgtctttactaaaaatacaaaaaattagccgggcgcggtggcgggcgcctgtagtcccagctactcgggaggctgaggcaggagaatggcatgaacccgggaggcggaggttgcagtgagccaagatagtgccactgcagtccggcctgtgtgaaagagcaagactccgtctcaaaaaaacaaaaaggaaaaaaaaaataaagctttctatttgctattgaagtcctttcatagaagatcttactttggtgacaagtatggcaggaaggaatctatccttgtttaaagtaattaattctttcccagaatatttgcttactgttgtataaatgttctcatttggaatatgcatgccacgtgtggagagaatatgaatgaccagcaggtaaggctcttcgcttactcacgtgaagtgttttctctaggaatgctatggattatgctgtaagaaatgttccctctccaacggggctcactgcagcgacgggccctgctgtaacaatacctcatgtcttgtgagttttctgacagtttcatctttcttttaattgacagattagccagatatctcagtgtgtacactgagcatttgtgtagcttgtcacaaatttcttgggtacagtgtacatattagcctggcagttttctaggatcgataaatctcaaattctgtgggccgcaacatttatctctactattattcactaccaaccatcttatcctccaatgcctcattaggaaaatatacctaaactgcttccaaaagagttgccctactaacatagatgaaatccaaattaaattgttgaatagaggggagacaatttctgtggtctttttaataatatgacctacttataacatttttcttcaaaacttaccctaatttattttagacctgaacataaaagctagtgctcatattttcccattgggcttttaaaatcccctgtaaaggcaagaaagtgagataggaaagtaacatatgaatgcacactcatatgtgtatatacatggtttgtgtgtgtgtgtggacagacacagtcttccatctacaga

SEQ ID NO: 12380 - DNA, 1960 bp, Homo sapiens
catctcaaaaaaaagaaaaaagaaaaaaaagttataaaataatgtatatcagttaatttagtattctgaaagcaagggttttctaaggtctttttaaaaatgaggcttcatattttgaatacctttcagtcccagtgtttgcctccataacttgaaaatcggagtagttcaggtggttttgagttctaatgtattgtcatagtggggaaacattgctgccaccttctgtgttggtcttcttcccttagccttcaacactctcgggggacttttctgttctctgttgtgtccccatctttttgtttgtttgttttttaagaaaccaggttgtgcttagtcaatgataaaactagaatttctccctcacattattatcttgtgataagataaagcagtatacagttaattaacagggttagaaatccaagattctttctcttcctctgggaaaatatttagctaaaaatgtcagtgagcccaattgtaagccttaaaaaatggtggctttgagtcgtggatctttgtttcgtttcactgtctcagagcacacaatacatgtgaagggcagccttgttgaagctaatctctgttttcatgggaaaggtaatttgaagccagtccttttgattcctatagaaatatgaaataaagtgtatgtatgtccacacacttgtgtgcacacaggcacagacacacaactgcaaacaatgtgtcttccaactttaacaccaaacttcattttgcctttgtagcgggaaccttggggacctccactcattccaggcccattttccaggattggaaagctgtacacagagaagcagtgacataaagttattcagattctcactctgatagtcatctaccacttggtggtctgaagcaattaatacggtttcccagagaccctaactttctataagtttatccacttgagactactaataaacaaaaaacaaaatgtctaaatactatgacagaaatccaaatattgcagacttatctgaaatacgcttttcaataacttcccaggtaaacatgtatttacttttaaagctattctgtcttgaatttgtaaggatctttgcaaaactgaatgatatattctgaattttgaaaagatgtagcttcttaggcatattttacagtttgagaattttataaacaattactaatggttcattacttttgtaattaaaatacagatttgctgttatgcaatttaaattactttttaattttacctcacatctggtaggaactataacaaattgaattatttatgtatttataagtacgtataagataattatgttttttaaaagtagggtgtgcagaatttgaaggtaaattcacagttatcctcaaatatcttcaatgtgtatgtagatcttaatttcaaatcttatagcaaaaaaattcaatatttagccaactttcaaagcatgtcctgaatagattattttgtatgttagtgaaattagtatgtaatttcctttgttaaaaaatctccattttccctccacacagtgaatatggccacaagcaggctaataggggccgtggccggcaccattctggccctgggggtgatttttggaggcacagggtggggaatagagtaagcatccttgccagtttcagagtgtttctgtgtggtgcctgatgtgtgaggcgatgcctgtacctgactccatgtctcgtcctgttgaccgtgtttcctgtggtagtgcaccttgtggtgtgacttggatgttgcttgtgtcctgtggttttcttgtgtcatgtagaaccttctcctgtctggaacaatgtggggcataacataacactgggtgtgcttccgatatcttcataattaaggcaatagtcccaacacttccattgctcctccactttgtagaagtaattttaaaatacagacttttttttaaaccatttattggcaaaaatgctttta

SEQ ID NO: 12381 - DNA, 1146 bp, Homo sapiens
actaattgaaaggatgaattttaataatccttccttgaagtcttagagataggtaaaaatcaaagaggcctttcttgtaaaacatagtccttgttatcagcatttgttttcatcaatcatttccagttttgttcgtttgtgactatttctaattgtgacaggtaagtctgtgtaagtgtatgtatattttttctaaagatagatttgttattattcctggtttatgagcactagttttctcttagcttactgatttttttccccatcaaattccaagttttagcataattgctcaagaaatatagttttttaaaaaataatgtagtacaatatagattgtctcaacatttcttagtttaattgatagagtaatgttcattcagtcactaagaattccatggacagttttttttttaatttctccttagtttataagtcaggaatcatttttcatgaattatgtgttgattctaatcctagcctgttttctgaagcggacgaagtgcaaatcatatccaaagcatagagtatgtacatggttatatatttttttaatatttgttttgaaatttgattctctgttgaattgtggggaggaaatacatgtaagtagaataaagtttctctaaaacagaagttagcaaacttctgtaaaaggccagatggtaaatagttttagctttcagcctacagggttgtctgtaacaacttctcaacaatgctgtcttagcatgaaagcagccataaacaatatgtaaatgaatgtgcatggctatgttccgataaaacttttttgcaaaagcagacagtggggctagatttggtctgtgggctccagtttcctgacccttgacttataggatatgttttagggtcagacaaatctgtgttcacatcttgccgctatcactcacaaacttctagaagcctgtttcctcatccattaaacaaggatagtcatagttcccacctcatacgatttttgtaaagatcaaaagagatactatatgtcaagtgttcagtactgtgtccagcacatagtaagtgcacaatacggtagctgtttaaactatttttatggctctcattattattattattattattggtgtatctctaaaggcaactgagattcgttctctagac

SEQ ID NO: 12382 - DNA, 1110 bp, Homo sapiens
taaaggcatataaatccaagcaacgctcaccgtagcatctaaaatgcaattaagctaagtaaataaaggcaatttaaatgtttagccgtcttttacacaggatatttacttcctgaaactgcttaactgcctttcccttgtggtaacgaaagtggttggttcatatgactctcttcccatgatcctttgtcacaggtcctagtgccaccaatctcataataggctccatcgctggtgccatcctggtagcagctattgtccttgggggcacaggctggggatttaagtaagcaacgccgcatgtcttcttctcagtggctctggcatttctcttttctgcttacataaccaagttttgagttcctgctacaagagcttaggttctgtcagtcaaactgcaaaaaataagtctttttattcagaaatgggttagaaatgaagaaacacggaccctcaactgtcattttcaggcaagtggaaatgtagaaggaattcatatacactgatttttaaggagaacaacgaagttctttggtagaagacagtccagcttgtaagagcaggcactctgagatacattcatttctacacaggaaatcgaggaaaccatgtagttggaaataagtggatgtaaattgcttgtatctgtttaaaacttgtttgtagtccactgatattttgaaattttcacaacctaagtaattatgcaatcattacttgtatttttcatatgtaacatagtatatgtagctttgtgatttgaaaagctttatagtttaatgaaaacagattttaaaagtatttgtataatcctcgaccaactgaattggttttaaatcagaatttgaaaaatgtggctttgtgacacttagtattttctaatcaaggactaaatattgacctgacaggtaggcctggtgtgttttcatagtgaccttttagtttggattgcacactgcttactgaactaagattgtttaaatagacacactgggtattcacaaataaacttcaattgtgatcaaaatttttaaagctgatttatccaggctggctatttctacactccagaatcattggataattgctttttataccttttcatgctat

SEQ ID NO: 12383 - DNA, 1446 bp, Homo sapiens
gccccacataaagccagaccatggggaggttgcaaccaacttttactgttgccttgtagtgtcttgctggttctttcttttctctttaaacataggagccactttttaggagactggacactgtgagcaaagcattttaacttgccgattttcaactaagctaaattctgcatttgcttaactaacctgaacctgtgtccactctcctttgagtgtactgtcttactgtgcactctgtttttcaactttctagatataaaaaatgcttgttctatagtggagtaagagctcacacacccaaggcagcaagataactgaaaaaagcgaggcttttttgccaccttggtaaaggccagttcactgctatagaactgctataagcctgaagggaagtagctatgagactttccatttttcttagttctcccaataggctccttcatggaagaggccttcctgtaataattttcacctaatgaattagcagtgtgattatttctgaaataagagacaaattgggccgcagagtcttcctgtgatttaaaataaacaacccaaagttttgtttggtcttcaccaaaggacatactctagggggtatgttgtgaagacattcaaaaacattagctgttctgtctttcaatttcaagttattttggagactgcctccatgtgagttaattactttgctctggaactagcattattgtcattatcatcaccattctgtcatcatcatctgattaatattgtggattttccccctctgcttgcatcttcttttgactcactctggaagaaatgtcaagaagagaaggttcgatcctactcagcaaggccccatctgaatcagctgcgctggatggacaccgccttgcactgttggattctgggtatgacatactcgcagcagtgttactggaactattaagtttgtaaacaaaacctttgggtggtaatgactacggagctaaagttggggtgacaaggatggggtaaaagaaaactgtctcttttggaaataatgtcaaagaacacctttcaccacctgtcagtaaacgggggagggggcaaaagaccatgctataaaaagaactgttccagaatcttttttttccctaatggacgaaggaacaacacacacacaaaaattaaatgcaataaaggaatcattaaaaaaaatagtaaatgattttttttccctcagcctgctggcacttaatatcttctaaatgatttggcatgatttttttttctttactaccgatgacaaactccagtggcatgaagatctaattttcaaaagggtaaaaactgcatggcatatatacaacaagctagcaagccaattctcagcaaaacctgcaacagaattcctaaagtgaagatgacagatgaacacaaagaagctgcctgggcctcttcacttaaacatgtccccacacc

SEQ ID NO: 12384 - DNA, 1618 bp, Homo sapiens
agtaaataagctgaagaaatttggtcccggctttgttttaatgtacaaaccggtatgtgatcacttcagtgagcatccctctatagatgggctttagtaaagactgtcccaaagagcccctacttctctaatgcccccccccttttttttttaggaaaagaacatgcagttttactcatcacttcttcatgacaccaaatccattgctaggtttagctcctggtcccttttcagcaagattcatgttatccgtcttacaactttgattttggaaagtattatgtcctaaaaatgcactgcttaacacagtggggtttttttcccccgaggtgtctttaactggggaagtaccacaaacatagagcagagactttaatttctatattctacaatagaccatcaccaaacatcttatcatgttgttgctttctgagtaataggtgctacgcaggtaggcgggctttctctaggactaggtgtacgtttattttgtaataacagggctatctacaaggcctctcagccttactcctggcttcataggacacaggtagcatccctctagtcattggcaatggctctttcagctcggaggaagcttggaggaaactcagattacttggtatcttttcctgttgctgcattgcttagtgtttccttgttgctgggtcctactctctagtagatactaaactgctgtgaagtacaccatacacatttcactaagattccagagccaccttggtgacataacagaaacaaaatcatgttggttacaaaacaaattaaatctctattgttaacttttaagcatttcacaaacaacattgtaaatgtgcgatgttacgttttaaatcagaccacagtggtccccaaatattatgtacatatggcaaatgtcagtgtaactttttgttacactggcaatttcataggtaatcgaacctatgctccaatgttaaattatttgtgtatatgtaaaatacacaagctttaagctatgtgtgtatgaatatgaaagttaatgcaaccatatcaattgtaaaaatggattataattatttttgatggtattaggttatgtagtttcaaactctttgctgtattttgttttgcacctgccattcatttgctaatttttgtggcgtggagattcttttttattaatttgagctcacagcacaagtgtatcactgtttaatgttacccaacaagagttagtgttaagtgatgatcaagttcccatttcacctgctctacttttgctgcattaattaatgacacccggatgaggagacgtgcgctaacttcattgctcatctgggatagtgcatgagcccattgaattagagctgctcctactagataactgagcagtacacataagtgcatgttatgaaacatgaatcacatagagcagtggagttttaccaagtggtgtgtgtggtttttgttttttactatgcaaagatgggaaatgcacaaacttttcaaagactagtgtctgaagaactttacaaacaatacttgaaccctttctttaaagttatcccatcatgttttatagtcattgttgcttccattgttagtttccattttcaagtgctttgtaattttt

SEQ ID NO: 12385 - DNA, 1227 bp, Homo sapiens
ttttttcctgagacggagtcgtggtctgtcgcccaggctggagtgctgtggcgtgatctcagctcactgcaagctccgcctcctgggttcaagccattctcctgcctcagcctcccgagtagctgggactacaggtgcccacctccatgcccggctaatttttgtatttttagcagaaacagggtttcaccatgttagccaggatggtctcgatctcctgaccttgcgatctgcccgcctttggccttccaaagtgctgggattataggcgtgagccaccacccccggtccaagatggctatctcttaacacacttgtaacccatttgtgcacacaggtgtgccgtgactcactggtggatccaaaaaaagctgaagcctacatttcccagagcccctttcagcttgaattccaaatgtgacttagcttcctctatgcagatgtacctacttgaaactgggaaggccaaatgagatagaggtaatgtttctgccaacaaacagccacagagcattttatttttctagaagagcaataacagagaccccagggtgtggtgtggcaggacgaggagcatccattttgctggtggggattgtggctaaaataatgtggctctggagccagcaatgggcagcatcttcatgactttccagcttccaggctgtaagcagagatagcatctcttctggacagccagttatgtgatagtgttctgagagtcattcctggaagtcagactaaaggctgctccttcagcctttccattcatcttgtaagcaggaggcttctgtgcatggccagaaactaacaaaagcacattgtgtctaaactaggttgcagtggtttctgttatcagcaagtaaatcctgattgataaagatactacaatatatgcacatatatatgttatagaatcaataaaaattggatactttgctttaaaagtttgtgaattttgcttttaaagaatttccctcagggccgggcacagtggctcacacctgtaatcccagcactttgggaagccaaggcagaaggatcgtttgagcccaggagtttgagaccagcctggcaacatggcaaaaccccacctgtacaaaaaatagaaaaattaactgggtgtggtggcatgcacctgtggtcccaactactcagaaagctggggtgggaggatcgcctgagcctaggaggtcgaagctgcagtgggccaagattgtgccaccg

SEQ ID NO: 12386 - DNA, 1227 bp, Homo sapiens
ttgtcttagtatgaaaaccttatctgtttctatttgcttcttgcttgcatgataatttctagaggggaaattggagcatcttacctgctgaattggattgaggggcaagagatcatcatttgatgttctctggaatctcgaaggtatgagatagtccttctggggctcttgttctccttcagctagagtaattgaaatcatctgatgtgacccttatgaacctttcagaggtattcagagaataaataacaaggtcagaccttctactaaggcatttctgatacaagccatgacaccattctctctgcaccttccccctctgcctgtcaacgtgtggcctcatggtgttctgtgcctctgatggctgtttctctccctccttcttcctcttgcagacatgccttgaattggaacgctacctacagacggagccccggaggatctcagagacctttggtgaggacttggactgtttcctccacgcttcccctcccccgtgcattgaggaaagcttccgtcgcttagaccccctgctgctccccgtggaagcggccatctgtgagaagagctcggcagtggacatcttgctctctcgggacaagttgctatctgagacctgcctcagcctccagccggccagctcttctctagacagctacacagccgtcaaccaggcccagctcaacgcagtgacctcattaacgcccccatcgtcccctgagctcagccgccatctggtcaaaacctcacaaactctctctgccgtggatggcacggtgacgttgaaactggtggccaagaaggctgctctcagctccgtaaaggtgggaggggtcgcaacagctgcagcagccgtgacggctgcgggggccgttaagagtggacagagcgacagtgaccaaggagggctgggggctgaagcatgtcccgaaaacaagaagagggttcaccgctgtcagtttaacgggtgccggaaagtttatacaaaaagctcccacttaaaggcccaccagaggactcacacaggtagtggtacaagttggccgcacgtggtttcttctttcccctcctgtagcctcgtcatgtgggagggctcctctttgttctgaggagtggcacccctgctgatgaggaggtgatagacaggcgggaggccccaggtagggacaaagaatgactcacttgttaccttaagatctcaagatgtcccaagcacagacgggtttg

SEQ ID NO: 12387 - DNA, 5668 bp, Homo sapiens
aaagtaaataaaagtacaaagcatattttagttagtactaaattcttagtaaaatgctgatcagtaaaccaatcccttgagttatataacaagatttttaaataaatgttattgtcctcaccttcaaaaatatttatattgtcactcatttacgtaaaaagatatttctaatttactgttgcccattgcacttacataccaccaccaagaaagccttcaagatgtcaaataaagcaaagtgatatatatttgtttatgaaatgttacatgtagaaaaatactgattttaaatattttccatattaacaatttaacagagaatctctagtgaattttttaaatgaaagaagttgtaaggatataaaaagtacagtgttagatgtgcacaaggaaagttattttcagacatatttgaatgactgctgtactgcaatatttggattgtcattcttacaaaacatttttttgttctcttgtaaaaagagtagttattagttctgctttagctttccaatatgctgtatagcctttgtcattttataattttaattcctgattaaaacagtctgtatttgtgtatatcatacattgttttcaataccacttttaattgttactcattttattcactaagctcgataaatctaacagttactcttaaaaaaaaaaaaaaaagactaaggtggattttaaaaattggaaactgacataatgttaggttataatttctcatttggagccgggcgcagtggctcacgcctgtaatcccagcactttgggaggccaaggtgggtggatcacctgtggtcaagagttcaagaccagcctggccatcatggtgaaaccccatctctactaaaaatacaaaaattagccaggcgtggtggctggcgcctgtaatcccagctactcaggaggttgaggcagcagaattgcttgaacccaggaggcagagggttgcagtgagccgagatagcaccattgcactccagcctgggcgactccatctcaaaaaataaaaataaaaaaaatgtctcatttgggaaggaaattccttttaaaaaagagttgagacacttagaaaactaatgttttatatttagtcaagagttatttaagaaagtcaagcttgtttaacaacaaaatatgaagatttaagtgttaattgctggatccattttaaaataagattttaattaacatttgtaaatggtatattttcgtttgtaacaaaccattgtcttttttcaaggatgaacagagtttatgaaggagcatcattctaagaattaagtgatgtagtctttatgtttggacagttcaccagattctcaagaaggctttcaaacaactataaagtttgatgtttgtcctgctgagctaatggggaaagttatagcataaaaattgtgtaaccgcatagatatgtcatttttaaaaactggtttaacagaaatcaagcaaagtcacaaatatgttcacaagttggaattatttattgagtcaaaatgtcgaatcgaacattttgaatgaagtaagtgttataaatgaaaaattgcctgatgtttagcagtttgtattctctaaagctttttttcaaaagttcaggctttctacttactgggaagttggtggtcctcttagtccctgataaatcaaggcaatcacattcatgtgagctggatgaatttataagttataaagaccttatccttcataccttgaggatgattgcactggttttgaagtcagttgcttaatgatgaggtgagaaatgtatcctgttgctaaatctgtcttagacccttggtgaaacttgaagatttcagtttataaagataaaatcaagcatcttttgtgcagttttctttttttaatgcaagaatggtggggaggtttgtttgtaagcatgaaactttgagaatctttattaagaaaatgacataatttttaaaaaccttgtagccaagaacatatgtggccacattaccagtaataaatgtttttctctttatattggccaaaagggaataaaaatgtcatcataggaatttgtacatatgctactgatttgcctagaaaatagcaagtttgatattgctcactttgcaaatatagggccatgtggcacttttatctataggacagattaataaaaatgaagtggggaggggtttatttttgatatattactcttatgagttttcaagctttgataatgtttaactgaaaagtggcttagaaagggctagatccaatgtgttcattattaaataattgctatcagatacaattttaagttcattctttttcaaactcaagtaccatattggcaaccataatattgtcataggtgctctcttcatttagatattcttggggggggtggcatttgtataatatatgtgtacatatatatatatatatatatatatacatacagtatataatctaaagctctgagagctcttaagtcaggaatgctgagtattatagtatattgaggtcagatgaaattttacatttttgtgtgttctgttgcattccttctggtagtttctatgactgcattactccagcactcatgattgattttatcttctaattttcttccaagtattttattttttattagttttctttggcttgatacttttaaatatgttactagtcacttgaaagcctctcccccaaaagtatttggtttgtatgctttgtctgtggcagctataacagtggtaagaacattttgaagatagctttttaaaggaaccactgattttttcaaaaatcatcctgggggaggaattttggcatttcatttgagcagggattttgtcagaaaatgtgttttgatggtaggtcagcagcagtgctagtctctgaaagcacaataccagtcaggcagcctatcccatcagatgtcatctggctgaagtttatctctgtctctcaggataaatccctgtaggacaaatccctactatcatttctaccttttggggtgacatgtggaatcatacaaaggcttaggaagaaatacgtttgtttaaaccaggatgctttacttacttgaagtgacttcaatctagatttcttttaatatttaacaaatttttaattctatgatcagccacagtcagctattaccataaattggtctctgtttattttgaagatcacggctgcttcattttgcaggattaagtagggctaatgtatcttaaagttaagatcttgaattaaagtgagttttagaaatagtgttacataccttttcagttgttttcaagaggctttatttttgttgcctttgtagccctgaaagctgttggtatattttttccctcatggacccaatagaaaagttgtatatttatttggattatatttacattctgtcctttgtaaatgtttggtgtaacttgcacttttttaaatgacccagtttgggtattagcaacttaagaaattccctcatcaagtaattctcaactttttagtctttctcctctcttcaaatcatgtgactttttaaatggaagtttttcattgattaaaatattttagcacctaaaagctagccttaaaaacagctgtaaaagaaaaacatcaggaaattagatatgactagcccagttaattaaaagacgggctcaaaccttgttttattctttttcatcttggatgaagattgaagggaaaataactcaagtgcataatatttattttcaatttttaatgagactttatcctcatcacaacattaatactgtacatagtatgccaaaatatccattaatttgtctagaatagtacaagactttttaaagcaattgtcctcacagagaccacatgtaatatactgaaatatgttcatttttaatggctttgttaacatcaaagaaatgctgcctaaatttgatttcagatgaggaaggagaaagtaaagtgtgcatagtaaggctgtaggtgaagagttgtgagataaatagttcactcagttgtacaaagcacaactagaactttttgttgggaggcttacatacatcttgaatattcttaatgtaataatgttgactattaagttggctacacagtcactgtatgtactaggaactggtttccttgacattctagaatcaatggctaggagaggcattaatctttgaggggctgaacatatcatgaagctgagtcagtatggaaaattttcaaataaacagggtgctgaagttccatctgtctcatctgcttatgataagttcttattgattagtgaatgtagcttaagcctttgtatgtgtcctcagggggcagaccgactttaagagggaccagataacgtttgaatggagggattatatttcaggtgttttagcttgaaatttattttttaaaaaaagaaaaatttaaaaaatatataaataaaatagaacaaagccggtgatgcaagttgatattataaacaggcagttttagcacagaaagaaaatactgacctgtctgcattctggtacggtgggtgcaggtcccagctgggtatgacatgatacatttttaattattctcaccagcaagtaaaaggaaaatgaacaatcttttggaattgtctttgaaaaggatcaaagagtaggaaattcacatttgacctaacattacttgcctatagaagtatggcatttccaagcttttgtctgaggagcatctcagagaagtgagagtaaatctgagttagcttaaaaattggtagggaggaagaaaatctctgcaaataatgattttatgtttgttggccaagtgaaatgatctatcattgtgtttgggaggttttattttcttatgtttttaaaattggtaaatgctttatagatgtatttttatccaagtgccactccaatttgtgtatgtaataaaattatttatattaaaagtgggaaataattgtcaacattttttttgagtatagatttattaggggtggcaaagaagagtgctagttagcagttttccatgtaaagttgtccttgactgatttgtccacatgtcagttgtaactcccccactccctgcaaaaggaattatttctaacccagatgtatcacttgaaactttttagaagcaaaataatcagggaagttcctagaaaggtgtttggctttttggtttttgagggttggggtaaagaagacttcccccacaactgtcagcacaaaacagggtattgatttttaactctgatgtttctattggagttgaatactaaataaataactataatgagggaaatacatttctaataaaattccctacattctagaaacatccctgttttaatttttttatctaaatctttttgtgctttatgtgtaaagaaaaaaatgtactgagttacaatgcattttattaacactatgtacataatagctgctttgtgttcagaatagtagcagttgctttgtatattaaagtgatccttgtgaatttgtgaaatattgtcataaagtgctttttcttactgtaatctttgtggtatcaactgtcataatgctctttttacacaaacatttatgtgcagtcacataaacatgcttttaaaaactctgtaagtctcttttttggggatgggatctctatattttgttgggttttttttgctagtagtgtg

SEQ ID NO: 12388 - DNA, 1247 bp, Homo sapiens
gcctttattgcccatgctggagtgcaatgatgtggcctcagctcactgcagcctccatctcccacgttcaagcaattctcctgcctcagcctcccaagtagctaggactacaggcatgagccaccatgtccggctaatttttgtatttttagtagagatggggtttcaccatgttggccaggctggtctcaaactcctgacctcgtgatctgccctcctcagcctcccaaagtgctgggattacaggcgtgagccatctggccagtatcatggatttatgcatatttctccatacttctttgacctctttcccttgctccaaaagagtacattttaaagatgaatgataggatttaagctgcagcttggtttcatttgaacaacaacaaaaaatcagttcgtatacagggattgaatctgtgattttggcttccttttatacaatgctctaaccacatgagcctatcacattcaaatttatgctactcagaacttttaagctattaacttttccatcctaatgtagtgtaaatataaacatgccccatggtgtttcccagaaggttagcctcagcaagtgaaacttacgtacattttccttgtcctgcttgttttaggatgagaatcagaactgttgtatttttctgtactcctgtttatcttccttataattatgttaaatcctaatttatttgctaaaaagctatatacaaccaggtttttcatttgatttcaacagcaagaatacaagaagtgggggttctataatacttgaagtaatggagcacaacacaaagcaggggagttgtaagcagcattttcgaagctcgtgtggactttgtcttgagctggtcatttctggttaggatagttgtatttctcagtttctttcagagccataggcttctcacacagacagagtgtggaagcagtaaaagaagagctatcccatgctcctctttcttcagtggtaaggagtgtgtgcttgtgatacttgtctagcatcaaaggaagaggcagtataggaaacaaagcgtggtccaagtccctcttggagcttttattcttctggcctttgttaaaatgattttatgtgctgaatataccatgttcaattaggttaacattcattttaacatttaaatttaaggaagtttactttccacttgtgtaaagacccgtttattttttcagtaacatactagtagatgaccagtaagtggttcaggatgtttgcagtgattgtg

SEQ ID NO: 12389 - DNA, 1242 bp, Homo sapiens
tccaacctgggcgacatccagaccctgtctcaaagaaaaaagcagaagaaaaatgttcagacaaggttttgtaaaggtttgtagcatttatatttctacaagtatcaaagcttaaaattacactgaacttttggaataccttgtatctccataaaatgccctctttttaaaagtagttacccgcagagctgtgctctatatgctttgattaccgcagtttctttaaaggaagattttgaagagcagtgttaattaacatgtaataaaaggaattggaccctaattatagaaggtgatatgaacagctgttttatcatcctacatgctaccaagctgtaggtgtcccattaagtcctgctatttaagaaatacttacataacccttaggaactcttcaggctttaaaaggcaaggagcaaataattttaggagaccgataatgtcacctaaatttgaaatactaagaagaggttagtgttctcaactatgtgaaatctgtttctcctactttctcaaatctaatcctaggaatcttgcttataaacaaagcatttctgggacaggagtacttcctctattatagcaatgcttcacatcatattgtgctgcagtttccatcatttttaaaggacagagacataaatgataaataatggtatacaaatattacaatctaccacctcaaaaaaacaaatattgtttatggaattcagagtttggagattcaagtattgattgcagttttattttgaaaagaatgctacaatttatgtggtttttatttctcatgtttatattaaaagctaataaactctattttaattaaaatatggctagtgtgtttgtaacacttctatccacatagtgttacatctctgcccagcctagttttaagtcaatcctgatatgtcttaaagcattttcaaaccaaccataagttgatttgatccatgcctctagttaagatgtagtgatccatttcttttgcatatgctcttttcaacctgaagataatttattacacttaaaatcactgaccacaatacttaatggcatagtgcattagatggcatcttgaatagttggttatcgtgtctgagagggaaaagcacattagaatataaaattaagcaaaatgtatcaaagagaaaggaattaaaggaatagcgtagaattagaacaagaggtatttgaggttttcagacaaacaggaaagagaatggaaagacaggaactagaatt

SEQ ID NO: 12390 - DNA, 4026 bp, Homo sapiens
agcggttttgtgttcagccttagctttgtttatagagggaggttcagtttcttttctgtagtgcttgtaataattctcactcctaacagcaccatcgttgtgtcttgaataagttagaggtagcattatagaggatctggcataaatatttgcagtagtgagagcctaagcgatggtgattggtggagcttgaattttaggctggtgagatggcagctttgtgcctgagaggtagtgggtggttcttaagcttcagtgatcccctttttttttttttttttttttttttaaggaacttgtgttataattttggtaaaagtataaacccactccctctggacaatacttagcgacagttgctaaagggggctcctttttaaatgtaaggactgaaatggatatacttctaataagtaaatttccaacacttatttgctccaccccctcccccctcccccctccccctttatcatgttaaacagcctttttgcttttcttattcctcctctcctggagagctgtgattagaaaccacacccacccttgaatgaagtgcttgaactgggggagggaggctggctacctgtgaacaaacattggcccaaataagggaaaataagtgttcctggactttggactagtttatagccagatattccaagagcagcaagacgttgctctctgccgtctctgaaaacaaaagagatgcataacatgcttgcacaaccttttaaaatatagatcagtatagtgctacctctatagttttcttcctcttctgagaaagcctgtatattgatgatcacacacacacacactttgcaattagagaatttggtttgctttactaatctgtttaactattccttcattcattatgaacgcttatattgatgaacatacacacagaggtttctttgctattagaaaattctgtttgctttcctaatctgtttaagcattcattcatgaagagtgtggggccattactggggaaggggggtgacagtgcctcagccagcaaaataccaatgaccaggattggggactaaatttaggaagctaaaatggccagagcaattaacatttgagaaaatcctgtctaggaaaacaacttgagtgtaggcatttgtaattcacttataccaaagttggaaaagtaaaatttaagcctaggacaatttttacttcatggatgttaaatagacaaatgcatagttcccagggggaatttaaacactttactggtgggaagaaacctagtattaaagttgtaaggactctcaaaaacttcacatttattaaaatgcactgctcttacccaatttatcctctgaattaaaatttcagtggattctacaaaacctcgtacaaatagctacagaactttgtgcctattttattcctctatttattcttctaggaagaagcctcttcctagaatcttgaaatagatcccttgactgaatgccaattcctctcctgtttttcaaatgagagaaccttttctgatcaccttgaccttttccctcatttcatatgtcttcccagaaagtagacagactgctctgctgccttcagtcattgtgcctcatttgggttgtccctccttctttgtggagaaatctggaaatgatgcacagtgtatccaaaagttgtgggatgaagtggatgaaagtgatttaattcatttttagaatttttttttgttttgttttagcaacatgctgaacaactaatttactttaaaaataagccagttaaaacaaaggacgctaagcccaagtggggggcaatattagtcaggatctttggggtctaattccagaccaactttcagaagcacttctttgtctctgttctcacctctgctgtccctctcttccctcatcccctaagagagacaaagataaaagcccacctgcatccctaagtcttactgagatcagccaccccaggggagagaaactggatctacttacagccaccccctgtttccatccatatagttacttcccccaatttgcatgtgattatggaaacaagtcatgctcatgaaagcaactgtaaaataaaaggttatggagtagttcagcaacttcttcacagccagctttgtggagctggggaggacttagggcccattggagtctcttatgtgtacagcttcagggctgtccctttcagtttgattttaagcaatgcctcacttcatagcttagggggtaaggattccattcaggtaggttgtctaaaggaactaatgggacctctcagtgaattagctgaccagattttaggaaatctttttaatttctatgattttccttctcacattttgaaatggtaaaattgactggaaataatttttcttggtgccttattggttttccttgcaaacctttctcatattttctcatgaccattgccagtgaccaaggcccatgtgtgtgttgtgtgtaattgtgggcatgtacaagcttaaataacgtgccgacagcactgtttcaaagttggtattcattaggctgttgcctcctgggctggagctgcgctaatcctgacaccggctgccaggagaaaacctcatggatcacacaccaaaccttaataacagcatccgtgacctgcactctccagtacagaatgggaaccccagagctaggaaatgtagttgtatattttaatgaactgctaccccagccaaagaagcttctttcacttttgtgctctacagaaagcccaaggggggtaggagggacagagctttgaataactgctttctaacactaaatgtggccaacaggacagagcacatcacacgtataggcaggtgtgagggacagtggctaagaattgcctgctccctctgcatgctctttcttgtttccaaagtccaatcaagtgatcctgggaaacaaatctgtctggattgcggagggtggttctgaaagaactgccaagacgttaaagaagggtgaagagtaggcagaatataagtagctaacctgagtcaagactctcaaaagctagcagcctgatgacaataggatttatttcagccaggatagtgtctgtctgtgagtgcatcattttaagacagtatgacttcatgttgttacaaactatgtatagtatgtatgttttgtgggttgtatatatacataatatatattatatatatatatgagagatttggtgacttttgatacgggtttggtgcaggtgaatttattactgagccaaatgaggcacataccgagtcagtagttgaagtccagggcattcgatactgtttatgatttccatatatgtatagtgcctatcccatgctgtagtcactgttatgttaaatccagaagttacactagagccagcgatactttatttgtagacaatcaatttgaatccatatgttattactggcagatgatacatgattacagttctgaatctgtaacacttacaaaaggaaacccagagcagcttgatgagtttttgtttctgcttcgttcctgggagtcagtagaaacagcagttgtatgtggttatgttagtctcaagatacttaatttgttgaccttacttcagaaaaattttgtatgtattatatttgtgggaaggtaaaataatcatttgagatttttatcaaatatgaagattagttatttatgaaaaacaaagaaatgtctatttttctttgttcccaattaatgtagataaattttaaaatgcattaaagtaatggtaaagacaataaaaagatgctgtagaagtctttttctcctcatgtttttatagagagacattgctttctaagagtattcgaggagataatacggattctaacttcataatcaggtttttcagatgtacttaaaatataagcagcaaaaattttattagtaagtaaaatcaagcaaattccaatcaccagaaacagaactagttaagaaacatgttttacttgaatatctttcctaggtctcactcctgccgatcctgtgattgtctcatgagtcactt

SEQ ID NO: 12391 - DNA, 1224 bp, Homo sapiens
cggctccgtctggatcatgcggggggctcccgaggaggagagggcgagtgaccggcctgcgccgcccctgttctgggggcgccccccactctgagtcgcccccacctgctgccatgtgccgctgccacgggtacccagcctgtcgctaaactttccgggcgccagcccggctctgagtcgcgcttctcagcggagtgacccagggacggaggacccaggctggctggggactgtctgctcttctcggcgggatccgtggaggtgagaaccttccctttctccctgttcttctcccgtttcctgtgcccttttccgggaagctgagggttctggtctccgggcactgcctgaagggcccagcttggaaagagagggtgggggagtcggtagtttggttacaggaggcggagcggggaggaaaggaaaggggttaacttaagagatttggagacagctcgcggggaccgaactgttgacgcctctccaacagggagtggttgcaatctttcttctcccccttcttttttaaagagtcctttccctggaatccgagccctaaccgtctctccccagccctatccggcgaggagcggagcgctgccagcggaggcagcgccttcccgaagcagtttatctttggacggttttctttaaaggaaaaagcaaccaacaggttgccagccccggcgccacacacgagacgccggagggagaagccccggcccggattcctctgcctgtgtgcgtccctcgcgggctgctggaggcgaggggagggagggggcgatggctcggcctgacccatccgcgccgccctcgctgttgctgctgctcctagcgcagctggtgggccgggcggccgccgcgtccaaggccccggtgtgccaggaaatcacggtgcccatgtgccgcggcatcggctacaacctgacgcacatgcccaaccagttcaaccacgacacgcaggacgaggcgggcctggaggtgcaccagttctggccgctggtggagatccaatgctcgccggacctgcgcttcttcctatgctctatgtacacgcccatctgtctgcccgactaccacaagccgctgccgccctgccgctcggtgtgcgagcgcgccaaggccggctgctcgccgctgatgcgccagtacggcttcgcctggcccgagcgcatgagctgcgaccgcctcccggtgctgggccgcgacgccgaggtcctc

SEQ ID NO: 12392 - DNA, 1168 bp, Homo sapiens
gcctacagtcccagctatttgggaggctgaagtgggtagattgcttgagcccaggagcctgtgcaatatggtgagacccatctcaaaaaacaaacaaaaaaagaagtagaatcttactgtgaatagctactagcctaccctagaagatatatattttaaatctgtttcttaggaatagtagctaaaagaaggaatggccaaaggagggaaagtggttggccgcagcggctcacacctgtaatcccagctctttgggaggctggggtgggaggatcactggagcccaggagttcaagacaagtctgggcaagatagcgagaccctcatctctttgaaaaatatatatatatacttttttttttaaaggagagaaaatgcttaggttgcaaatggagagtattgaacgtggtgatgtaaaaaacttctgcaaaacttgttctgtagctcctgggtcaggtctatgccattttttcttatatctgctcacacagtacagaaatgactaaaattttgggtctgggctgttatatcactttgtgttaagttatttgtagtagctaatgtgctaacttatatatgtgttctttctgttttttggattttaccttttgttttggcataacttatctatatttttgtttacattattttaaaaatatcagtaactgtaataatataaaattgaagttgtattgttgacaatacctctagtttttaaggtcatctgtcacataatttaagtgcaccagttcctaatgtataaagttctctctctctctctctcaataaacaatgcagaaaatactttcctttctcataacaacttgattaaaatactgctcttgagggggtggtgaaagcccaaggtgagccctatatattaattcaaagtcaagatttgagctttattgaaaatgagccacagccaggtgcggagcccaaggcaggcagatcacctaaagtcgagagttcgagaccagcctggccaacatggcaaaaccccctctctactaaaaatacacaaattagccaggcatgatggtgggcacctgtaatcccagctactcaggggaggctgaggcagggagaattgcttgaaccttggaggcggaggctgcagtgagctgagatcgtgccactgcactccagcctgggcgacagagcacga

SEQ ID NO: 12393 - DNA, 1250 bp, Homo sapiens
cctggagctggcaactgactccggggaaccgctttttgctgaaaggctcattccctagtgtatcacttgaggaaatccctcctaaaagtgccagaaactcatgtgtgagatcgtccaaccctggtgaaatgttggcatctaaccccgcagtaaagaagccagttcctaaaatagacctcattttgcaccgcggcaggaaggccacaaagtacttaaaaagccgtcaactggaatgggggtagtgttctttccaggcccgctttttccaaagttaaaagcctctttatatgaaaaccatgtaaactctcagcagccccctttgcttcactgccttttctagggagtgcattagagtcatttttacgtctgtagtgctaaagggtcacctagttaggagctttaacatcggattcgctgagagggtcatcggtttttgattcttctagagtaggcctccaccaagaagggaatacgtctaatacttgggatctgtggtttgcaacacaagtggtatccctcagactcctgaaaagggactatgccgtgacttccttccggctgcagtgagatccgaggtgtttacaccaccctagttgccgaatgcagcctttgctcagctagagtgtgtcctctgacggagcctggcctctgtttttgtctctgtgtgttgtgtgtacacactgaacgtggacatcggatagttcttttctgtgcctcctcagagaggcttggcttccaaacctgggagtttgttctctacccattggctagaaaaggccgtccataaattagtatatccaggtgggactagcacgatgccacgcacactgaacattttctgcagaggggcgttagcagtggaagtagagacacattctggtcctcctttagagtcaagccaatgctgttgctcgtgtatttgtgcacaattattcatctccgttgatctgacacactctcttgaaatcactagattatgaaacagatcttcacctcctgattccaatactgcctggtttcaacacaggggttgttttatttttttacttctcctagtaaatagagatgtgtataatttttgcccattttatttcttgagttgtctgcaccacttcttttcttactctgaaataatgtgaaaacgtgaagttggagcaagaccttgaaagagcctccctcctttgcgtgacctgaatcggtagcggcactctctgtttcccctgcctccgtgtcacttgttagtgatgggc

SEQ ID NO: 12394 - DNA, 1297 bp, Homo sapiens
acaacatacttggtacattcaaccccattgctcctttcccccacacgccgcttccccaagaccccaactcatgatacttccatccatctagagatgtgacatttcagactgacttttgtgcagttagatgtaagcattttacctctcaacccacaccagttcctttggccccaggccacacatttcaccttaatagctcaacaccatacatgcatttattttctgactatacagtagccgcaaccaaggcttgaaaacttgttaaaaggccagggccctattcatgagacgcctgacggtgccttttacccttagaaaagcaggttgacttttcccccactctagttaaagagaatgttgcacacaaaagaaaaagggtggaaaatctcaaacacttggcaacaggcaaacaaatttgatcatctcctttcctcctcctcttggtaaaatacagtatttatattttccagcctcagagaagatagcagaacatgatctttcacaagagaattatagacctgcttattataaaacagatgtgctcccatggcaaagtgccttctccctccgcccccagctccctgtcactgtagcttacttttgccttcgctgtaattaatgtatccgtgattccaactgtcagcgaggccattcctagcacactgcatttggagacctgaagtgcagtgccatctcctccccttgtaacatgtttgccctgcatacagaatttcctctcctagctcacaggcacccagggtcatacctgccgagagtcaagggcgaaattctggatccccgttcaaaacatctttgttttcaccagtccccatttagagggccctgctaaatacgagcagtccctgtgaactcctaaggaggactttccacccacatcattttctgcttattttcaaaagggaaacaaaaaatcgatgtgttatcaccatcagctacccagagctgggtccatgtccagcactcctgtttcctctccttttcgtaccaccctgacagcttggtcggtgccagccacaggcctatgacattctctgccaccaccaccaaaatctgataggacagagtggagccagcttaggagttgggtctgccatgaaaattcaaaattgctgttttcagcccagaataccttggcgcacatgaacgcccttactgttttcaactttaacaaattacttggtgcactgttaggtaattgttccactgcttagaaactgtcgaaacaaaagcaaatctgtggattaccacctctttcagaccaaactaatacctgctt

SEQ ID NO: 12395 - DNA, 1178 bp, Homo sapiens
tacctcaaaaataattgcttataaggaaaaaaattagaagtttattttttaaatgatgtatttttttgcattcctataaagaacataaactttggtataagctttgcaatataagaaaatgatcatattgaattttatgtttatgtacgagaaatttataatcaacatataatagccatacatttaattatgacatatacatacagaggggtttttatgtttgtttctgcctgttgtactctattctgtcccacatttgttcaccaagtgaatttctgtttatcttctacacccagatccaagtgccacctgctttgccaaccctctccccaccaggagagttgatttctccttcctctaagctaccagtgggccccatccatacctcttttgtagcagatgacagggtacatgctgcatgttacatgtggttttgttttaaatacttgtctcatactacacagtgagccacttgagggaaggaactgtatcctatatatctttattaatatacttctagcctaccatatgaaacatagatttttttttctttttaataagcaaagttttttgtttattttaatgttgaattctaaccttgctcctagagagattttaatggaaagtttttagagaggttttatcttccataaatagaaactgagccaactttctatgtattagtagccaatctacatctcactgtcagtgattggtatgtagagattctgaaaaattaccctcatgttatgcattatttaagccactccctctgtatctctgagacattgtgtttccatgtactatttgtttctactgatgacaatgacattataaaatgaactttcatagtcttgtggattaccgtggattaccactcaaggtgaatacagaattggatggatatattggctggagttagctgaagttcaaagttgtaataagagcaactcctttctggtcactgaagcagtatatttgagcttgtttgctagtcagtcagattattctgcaaataatatccttttatcctttttgaatgttgtaatatgtacatgatttagtctttttatttgtttgtttgtttgttagatggagtctcgctctgttgcccaggctggagtgcagtggcatgatctgggcacactgcaacccccgccttctgagttcaagcaatt

SEQ ID NO: 12396 - DNA, 1653 bp, Homo sapiens
taactgagtatgtatggctgtctctactgccggttgcctagagagcctgagtactgagcctgggtcagccccaggaaccctgaacatagtcattgtctatagattttgtagcttactaacatgaatgcgttttcttccagaaacaaatagaatactattttaagtagcatttctaggactttaccactacctgctaccatatcagagaccaactaaattttcttttttttttccttcccgttagtgtgcaacgttctgactacttgaatacatttgagttcatggataaacttggagaaaacttgaagatcaaactagctcaggccaaactttaagttcatacctgagctaagaaggataattgtcttttggtaactaggtctacaggtttacatttttctgtgttacactcaaggataaaggcaaaatcaattttgtaatttgtttagaagccagagtttatcttttctataagtttacagcctttttcttatatatacagttattgccacctttgtgaacatggcaagggacttttttacaatttttattttattttctagtaccagcctaggaattcggttagtactcatttgtattcactgtcactttttctcatgttctaattataaatgaccaaaatcaagattgctcaaaagggtaaatgatagccacagtattgctccctaaaatatgcataaagtagaaattcactgccttcccctcctgtccatgaccttgggcacagggaagttctggtgtcatagatatcccgttttgtgaggtagagctgtgcattaaacttgcacatgactggaacgaagtaggagtgcaactcaaatgtgttgaagatactgcagtcatttttgtaaagaccttgctgaatgtttccaatagactaaatactgtttaggccgcaggagagtttggaatccggaataaatactacctggaggtttgtcctctccatttttctctttctcctcctggcctggcctgaatattatactactctaaatagcatatttcatccaagtgcaataatgtaagctgaatcttttttggacttctgctggcctgttttatttcttttatataaatgtgatttctcagaaattgatattaaacactatcttatcttctcctgaactgttgattttaattaaaattaagtgctaattaccattcttctgcgtttctgtttattggatgccaagcaccacgctacatcctagccataggagtgtaatctgaaaaaattctctgctcttaaaaagtttaccatggtggaaatagataagtaaatagtaagatgtagatcctgcagtgaaaggaaagaggaccaaagagggaactacaggaagaattaaggaatattagagaatagattatgtctatgcacatgctaaggagtttagtcattatcttataaatgattagggagccaatgaagacttttaagaaataagggacttgatcatatttttatttttaaaaatagcactctgggaaactttgataaaaaatggatagtggctttgagaggccaaggcaggcagatcacaaggtcaggagttcgagaccagcctggccaatacggtgaaaccccatctctactgaaaatacaaaaattagccaggtgtggtggcgcac

SEQ ID NO: 12397 - DNA, 1147 bp, Homo sapiens
tgggcgacagagcaagactccatctccaaaaaaaaaaaaaaaaagttgaaataaggaaaataagactgaagaatttatgtgtgtgttgtataactagcttccccccataactttaaaaagctgttgtgtatcccttcttccgaaacatcttaaaatgaaagagctagaaatgatgtgaaaatgcttatttttcttctgcctgctcacattaatgctttacctccaaatttttattaatttaaatcttttctataatttgaatagtaatgtttaaaattgagttggctatcagatcatagttgtagatgattggggctcttatgatttagatagcagtgttttcagtcctttggaatatatgaagctagatttatttactgtttgttttcatagtctgacttttcacagaataggattttctggatatttcgatgctgtttggaatcaacttttgagcttcctgaggaatttagatttttgcttgtttcttttgtttttcagactcatgaaatggccacagatgataagacgtccccaacactggactctgctaatgatttgcctcgatctcctactagtccttctcatctcacacactttaaacctttgactcctgatcaagatgagcccccttttaaatcagcttatagttcttttgtaaatctctttcgttttaacaaaggtaagacttattaaagataagaggtttgattcaggtctgattgtttgaaatgctcctttgtctccagtggctcaccatgatcatatagtggttagtactctgttcagctttaatgctgggtctgtaagaaagtgaaatattaacaagcgatagctttaatcgtaggtctccagggtttactgctgaagagaaagctagaattttcactgtaatatcattaattattggtaactaaaggtctggattaaaagctaaatgttaggccaggcgtgatgcctcacacctgtaatcccagcactttgggaggctgaggcgggtggatcacgaggtcaggagatcaagaccatcctggctaacacggtgaaatcccgtctctactaaaaatacaaaaaaattagccgggcatggtggcaggcgcctgtagtcccagctactcaggaggctgaggcaggagaatggcgtgaa

SEQ ID NO: 12398 - DNA, 1225 bp, Homo sapiens
aggtttagcgagattaagtaatgaacccaaggtcatgtagctagtaagaggtcgagcctgcacttggacctaggtttgtctgactctatggtgctattctagtgggttatggggactgagaataaaatatttgaactcaagatttccctccaaaatcaatttcatcttgtattaataatgttagacgtttcaaaggcacccatccaactaactttatttacattccatatacttaaaaactttttaaaattgtcatttcggcattttatattcttaaaagccatgcactgcaaaaactatcattcataccatttacaccctaattaaaggaagaacaaaaatgacacataatctcattattgcaaggaaaaagattaaatctgcttttaatgttaaagcgcctcattgaaattcccttttactgtcctgaattatttcagtattttcctattttctttatagtttgattcatccagattcctcaaatactcctctttcaacaagacttgtatctgtgcaagaggatgctgggaaatctcctgctcgaaataggtaaactgacaaatgaaaacactgtgctctctgatgtttatttcttttcatgctaataagaagaacaaacggataaaaagggtgggattgattgtcatatacttccgtagctctaaaagctgaattaaactatcattttctttttgctattcagcccttgtttccattctctcagtgactttccagtattctccagtggcttccgggtttggaacctacaccatcctttctcttctggttaaataagacgtgaaggatgtgagggaaggagccatgtggacattttgtggaggagtgtcccaagaaaacaggaataacaaattcctgagaggaaatacacttggcaaggaataacaaggaatcctatgataatggagtagagcagtcttagagttaattataaggactctgtcatttactctgagtgagatgggaagctgttggagagttttacattttttgtcgttaatttttaattgctttgaaaaaatgtcaaacatgcagaaaagttgcgagaatagaaaaatatatcttcatgtatttttcattaagatttactaatttatattttgtccctttgctttctcattttttctttttttaatttttatttatcttattattatttttgagacggagtctcactctctcgccaggctggagtgcggtggtg

SEQ ID NO: 12399 - DNA, 2131 bp, Homo sapiens
ttgaacctgggaggcggaggctgcagtgagctgggattacaccattgcattccagcctgggcaacagagcaagactgtctcaaaaaacaaaacgaaacaaaaaaagaaagttattcttagtaaggaacttcttgtttaatagcatttttgtttattttaaaaagtgatcagaagtagtaaactatctttgaggaaatactgtaaccccagaatatttcctcttgacttctttttgtaacaaggataatttagggatttataaagttgtaaggatttcactgtttttggactgcctataataatagcacattaaccttcacataataagaaatctggacaagttcagttacacagtatgatgaatacttgaattaggaacattgtggaaaatttgctttagagaatcaaggcagtagtttggtatttggtgcttattaaaaatgtggtttgttttgaactggaagcaagttgaccaaggacttatgactaatgtgatgctaagttccacttggccccttttaaaaacgtgtatgtgccttttgaagatacacaaaacactgaggattttagttttgaaatcaaagactattaaaggagctgtacagaggtaaaaaaataaatgtggaacattattaacttactttgtgtctaggaacaatggattttgtatctgatttaaaatgccaacactgttttgtctctgttcattttttctgtgaggatacttaaggttattattcctgtctgtttcctgtactcccctagtcatgagcacttgaagtacaaggtgtctccccctaggtgcaattaggttgtttctttgtttttagtttcaattctatgtgcatagcaggaatgctccacaggaatggcttctgacaataatctgtcctgttgattttgttttccttgcccatgacttgaacaactgtgttttaaagtactgtagtctagtaggtaactttgtggcaaaaattttcaatataatacattctgaaacaatagttgctgccttgcaaaggtaatctctcattttaaaattggacagtattaatgaaggggaaatatacaatttatttctattgagtggtagaactatatgtctggtcccttgctgctcttgtttaggccactatcatagatatatttcaaatattgtactactcagtgttaagtattgaatgactgtttccctttccttcaaggcctagagtatattctgaaaatttaggaatgaggaagaaatcttaatacttccttccttaacatacaacatgagtcccgagaataattgatagtagcaagagaaaactatgtcagtaacatgttgctttgtataaaaatcttatttataaatgtgaagctttttgatgccatcaaaacttattaaaaaataggatttacttttttctaattctgacctaagaaaaataatgagaacaagctgttgcaagctcttttgtagtctattgaatattttatagatattcaaaatttcctacaaactataattttttccatgatttagcagtgagtgattttctagctttggctcttattaggtattgtaaatagtagggttatatcgatatcagcttttgtgatggcattgtggtcatcagcttcatgacattttacccatttgcagtgatcctgtgtaaaactgccaaggaaagtaattacctgtaggagtttgctgagcttgaagagtgaaaactgttgtgaatgagcctgatcataaaacggaccaggccattcattattcctcaagtgttaatatactgacttatgcagtattcaaaccatctagtgcaatgtttttgtttttgttttttttttggtaacacaggtgcagtgtattatagaaaaaataaaaactacaatcattagcagttttaatactgctgtgtcagttttgtaaaaaatgtacattatgtcttttgacatgttgaattttaaactagggaaatgacattgtaaatcatagtagcctcttttaatttaatatgaaaaatgccactatattgaaagtacttaatgtattgtatatatttctctactttggttctagctattttatatgattgacatgttatttaaaagataactgccttgaacttttggagacttg

SEQ ID NO: 12400 - DNA, 1148 bp, Homo sapiens
tcgccctttgcccctgcctttttacagccagatgacaaaaaatctctgcaacaaaccagtggcccagctactgccaaagatagttttaaaattgaagagccccatgaggctaaacctgacaaaatggcagaagcaccaccctcagaggcaatgaccttacccaaagatgctcacattccagttgtagaagaacatgttatggggaaagttttagaggaagaaaaggaggccataaatcaagagactgtgcagcaaagggatactttcacccccagtggacaggaacctatacttactgaaaaggaaactgagctgaagcttgaagaaaaaaccaccatttctgacaaagaagctgtgccaaaagagagtaaacccccaaaacctgcagatgaagaaataggcataattcagacctccacagagcacactttctcagaacagaaagaccaagagcctaccacagatatgttgaaacaggactcgttccctgtaagtttggagcaagcagttacagattcagccatgacctctaaaacactggagaaagccatgaccgaaccatctgcattaattgaaaagagctcaattcaggaactttttgaaatgagagttgatgacaaagataagattgaaggagttggagctgcaacatcagctgagcttgatatgccattttatgaagataaatcaggaatgtccaagtactttgaaacatctgccttgaaagaagaagcaacaaaaagcattgagccaggcagtgattactatgaactgagtgacactagagaaagtgtccatgagtctattgataccatgtctcccatgcataaaaatggtgacaaggagtttcaaacaggaaaagaatcccagcccagtcctccagcacaagaagcagggtacagcactctcgcacagagttatccatcagatttacctgaagaacccagttctcctcaagaaagaatgttcactattgatccaaaagtgtatggagagaaaagggacctccacagtaagaataaggatgatttgacccttagcaggagtttaggacttggtggtaggtctgcaatagaacaaagaagcatgtcaatcaatttgccgatgtcttgcctagattccatagcccttggatttaactttggtcg

SEQ ID NO: 12401 - DNA, 1400 bp, Homo sapiens
gttgaaagttgaaactaactataatagtttgaaacatgttttctcatttttccaaatagtatctgtttattaaattctctaatagaagatgtttgtctttcttacccaaagtaaagatcccctgatcagaaagaaaaaatacaatactttgggaagctatagctataaaacacttgagacacagatatctaaatcagtttttttccaagactccaacattgcactctgtaaagtaacacactgtgatctagtattatttatcagtagataatactgttctgactgtatatacagtctagaactcacaaatcaattagttcctctcacaaatcattcatcttagacttacaaataaggaatgaaatagtcaatggcctgattaaggcaaagagctaccaggctagatggacactttttaaaaattttatctgttctttttcttgctcagggctggtaggttggatctgaaccattaaaatcaaatggtccactaggcgtatgatctctttgagccaaatcagttcctgaatataaaggaggaaatgatgaggatgtactgaggcaacggggaagtatagaaacatccaagacaaaagccaagggatgcaaaggcagagacacaggtgctttttggtgacccagtggatatggcaaccagtgtaactgccatacaagaaaccctaggagcaaacccacaccactcattctcagctaagagattttacacaggcaaacgtgtcttaaaccatctataaatcagttattttatatgacagtcaaaaccttagaaaccttaggatcattatatctattttctgcctattaattgctgtgaggtttgatttgaccaatctgggcaatttattcatcagcttcccttgaagtgcaccagaaaatagaagaaaggtgtgtggagacttagggtattttattacatgttttcatagtcttaaatagtgattaaatttctctagaaagaagttaacagctcattagaaaagttttaacctgtgaaataagtatttttctcaacattctttaaagtttttatataagttaacactaggtaaacattctgcatactagaagtcagtttattacaaatacatgtcaaaaataaagattatacaaggcaccaaactactagatttggcattaaaacaaatgtttatttctaatcacaacaaaattataatgaataaatgttcttgctttgtatggaaatacaattctttattaaagttaacagaaaggaactgatcgtttgtaccagtaaaagagagaaacacacaggttaaatatcttcttgtggggttaaggggtagaacctatcttgccttcactctcaagataacgactcaaattaagctttttgagcaccactcttgtggggacacaca

SEQ ID NO: 12402 - DNA, 2139 bp, Homo sapiens
ttctttctagacatgcacatgatggtgtccaagccagaacagtgggtaaagccaatggctgtagcaggagccaatcagtacacctttcatctcgaggctactgagaacccaggggctttgattaaagacattcgggagaatgggatgaaggtaagaaatcgtgatgagagtgttttgtaacattcactctcagttgggaagatttgcgggaaacaggaaattttctctttttttgatacagtcttgctctgtcacccaggctgaagtgcagtggcacagtcagggcccattgcaggtaaagaataccttacttaagcagctgttcttcagctatgatgccaggatttaacttctttgtcacatagcatttatgtattccactaaagttttctgaaagctactgcttgttgaaaatacttacatttaatagtcttgttaacttttaaaaaataagaacagatatttctactgggcctgctatgccacaataatataatacagaagtaattgtaaatgtgatatagcatatttgtgtctgttacaggttggccttgccatcaaaccaggaacctcagttgagtatttggcaccatgggctaatcagatagatatggccttggttatgacagtggaaccggggtttggagggcagaaattcatggaagatatgatgccaaaggtaaaagaagtatttgattttggggtgaggcttttacagtgtgttcattcagtaagcatttattgaaaggcttgtatatttaggcataacctgttctgaaggtgaggagatggggatgcttacagatcattctaatacagtataataaatgctgtaatagatttctgatttggaaatcagagaagtattacatctttatcttgaaattttctctttctttgagacaaagtcttgctctgtcacctgggctggaatgcagtaattcaattagggttcattgcagccttgacctcctggactcaagagatcctcctgcctcggccccctgagtagctaggactacaggtgcataccaccatgcccggctaattcttacacattttagtagagaggaggtctcactacgtacccaggctggtcttgaactcctgggcttaagctgtcctcccaccttggtctgccaaagtgttgggattacaggtggcagccaaccacgcctggaagtcttgaaatttccttttgaaactattatctctaacttttagatctcttggaagttgtcattgactattgaggatttgtctgtcttgtttacatgacagtctctgcaaagacaatacagattgctgtttgccaaatagaacaaagcttgctattaaaaaccaagtgttccccagtaatatgttgtattggtatagttattgtgtgagacaattggagttttaattgctaatatttgctgttggatttttttgtttgattgtcccccacccccacccccaccaacatacccactttaggagttacttatttcctcatgtatatatctaggttcactggttgaggacccagttcccatctttggatatagaggtcgatggtggagtaggtcctgacactgtccataaatgtgcagaggtgagattgctcttcaactatgactagaccaatttcccgtcaaatatgtctccaggacattgtctcatgggccagcgattccctctgtggttcctaagttgactttctttcttggaaaagtattttttgttcacatgtacaactaggaaaataaacagccataagtggatatgctttttttttttttttttttttttctttttctgagacagtctctctttgtggcccagattggagtgcagtggcgtgatctctgctcactgcaatctctgcctgccgggttcaagcgattctcctgcctcagcctcctgagtagctgggattacaggtacctgccaccatgcttggctaatttttttatttttagtagagacagggtttcactatgttggccaggctggtctcaaactcctgacctcaagtgacctgcctgcctcggcctcccaaagtgttgggattacagatgtgagccatggcgtctggcccgtaagtggatattctaaaatcacataaattgttaaaattgtaaatcctggttttct

SEQ ID NO: 12403 - DNA, 1486 bp, Homo sapiens
cagtgattaaaactgattgtgcagaatattctaagaggtcagaaattggtgtgtataactacatttttagtgatgcaatttattgattagtgagtaagatactgtttttattgagagatttgatttttataaagtaaaaatacggctgcattagggttacaaacagaaaagtgtcttaatgtctaaggagggcatattagctacactacaaaaacaaattttgtctgtacttctgaaaagaattttgttgtttctcagctgttttccaaaagcaaaggaagtctttatggtttttttctatttcatgttattgtgatttgtttataagtttgggtggggtgcataccatattcttggttcttaaaatctatcacttttcaccttacacttgatgtgtgaaaactataaaaacaatgtgtgaaacccaggggttctaaaatacaagcatagattttatcagggtgttttgtcaaagcaggttattcagtgattcctccccaccattcttaagaacgttaaataatgctgttgtgttagctctgagtagaaaggaaaaagtaaaacctctgtttggaggtaatattgggttgaattctgactgcccctttctagctggacctttaacaaatcacccaatcttttttgtgtttctctaaagtcatttatacattaaatgtaattatagcaactgtggggttctgttgagaattaagagctaacactatatatgtaaagtttccagtactagtcccagaatttagaatatgctcaacacaaagtaaacagcattatataagtttatatttttgtgagttataaagtactttgatatattctcattaaatctgtaaatcacctctataagtaagtggtaataataaagcagatatttttgtccccatttaaaaaatgaagaaattaatgcttaatagggtggtaccctggaaaggatctgggaagtggtagaatttctggtctgtacttttacaaatggagcccttgggaggtgggttaggtaaaagaagctttttacttaacgttgtcttatttccagtctaattttacgctgtagcagaaccagatggctgagaaaattctggaactatggatcttgaccccaaggatatattattttattccaagaaagatcaggtaggcgaaaagatgacaggatacagagtcaatccataaactaaatatttataactgttctgaattatacagagtctaaaaatatgtgtcagctacttcattcctgtaaatactcttgctgtgttataaatatggcaagaaataaacatgaccaatatcaatagacttcttgaggctactataagttttgagaaataaggttcaaaaaataagaatgctaacacttaagcacagactagagcttgcttgggtttcttcctgcattacaaggtaaaaatttgttaatgtttgtttttattcagcttgggaaagctttgtgccatgaatacgtcgc

SEQ ID NO: 12404 - DNA, 1917 bp, Homo sapiens
aatgccagattaggaattcatgttatgtttaccatttagaagctgggattgcttttaaaggtttttctttttaaaattggcatgtttttgatttatcatgtctttctattcagattattgggtatcaaagattaatgaggacaccagaatcttggttaaatagacaagtggtatcattactgtttgagtcttttaatattctccatacctgccaccagtgaaaaaacttgccttttttttttttttttttttagtaaacagaatattatcaaacaatttattttggctttattgaaaaaagagtatttggtctaaatgtgccaccataggtgttaaattctcctatctgcaattgtctttatcctatattgtgttcatttcttttcttaataatttactttgttgtgtgtttctacactttcatccctgttttttatcttgtatatcatcaggaaattgtgatttaatcattaacattggtttttttgtgtgtgtggtaaaaatcaacactaggctcatggtacatatttttattctgtacatttgcttgtaactatcaatttgtaactctgtttatctactacatgtgtatatatacttagagcattttctctaacacattttaatgttagtattttttaaaaggtctgaccagtctagcaaattgtcagtccaacgtcattactttaaattaagaagcagtcttcttctggtaaaccttgttggtatttgtaaaataattttgaaggtcttaatttcttcctttgtaaaaggaaaaggttttttttaaagtttttaggttggcatggaggcagaagttggtgattacttgatttacaacagattttttccagatcatacaaaaggccatacagtaagtatagaagtaggtatggggagggcttactaatatcaaataggcaaggccttagtgagtgggcaggataccacctgagagtggccagatgtggggaggttactctgctctgggtgctctcattcatgaatcgacaaggatacattagattattttgaaacatttttttaagaagcagaattctttaataattccttcctagacattgaatatacttataaaattaaagacttggggaaggagacactgagagacttgccagtttggttcctcatgaacaaaagaggacagtttgataactaccagaatagaatatccctagttttaaaatagtgagaatctctgaagttcatcaacatcttaagatgcacttacttgaaagtttgagattctgtttatcatttgaaaacacattttgctttaattctttctttgacatgttgttttttcatatcaagaaatatatgaacaaaataataaccttttgaccctgaccttgctgggtgaattagctctgaaacactctctacaaccagtaatgcatttgtcccacatttcattctgatagaaaatgaacaccatagcaccaaacaaaaatccgaggcgttagataatgtctggattaaataatttaagactctctaggattttggttgtcattttttatttataacagactttaagtcactttctgttgcctcataggtcacattttagacaggtttgtgtctgttccttgcatctgaattcctgattgtaaagacacctatgaggtctcttagtttttgtcattcattttcttggtttatcacccctcccttctttttgttgtttttccctgactgttaagcagtttcatctttgcttttgttaaatatttgacagcagttagtttgtgttaagctcttgaaacttgtgattgtactttctgtgtagatatacatgtaattattttttatttttcaatcatagattcaagcttccttcttttttaccacaaatcattaaagttatttgtgtttccatatacctgtgtcttg

SEQ ID NO: 12405 - DNA, 1208 bp, Homo sapiens
aaaaaatatactgagtttgacagtacaggtgaggattttgaattttgggaggtggggtagaaaaaatgttaaatagatgatccttttggagaactacctttgataatttacatatgttttaaccattgggagatggctgtatactttgcatcttgtaatacatctaaattttttttcagtaataaactacttatagacaacaacgtagttaggaaatgtaaagtttaaaggtttgcatatattttaggacaagacagtatttcagaagagcaaatttgtgacttttgctagtgacaaataaattgttgtgcagtgtaatgtcataatcccttagctgtaatttgaaaataaaaatttgtgtttgccaatatggctttaagatatatggtttatgatctgatttttcatattgatggccaggttagagaactagatactaaatagaagtagtcttacacttaagtgtaaaaattgttgcctttgaagattcagatataagcttacaaaatatagatgagttataagaagcaggccaaagaaatactttggcttgtatctttctttctcttactgctttttttgtattttagtaactcatgttgttgttcctggtgatgcagttcaaagtaccttgaagtgtatgcttgggattctcaatggatgctggattctaaaatttgaatgtaagtgttggatttgagagaattaagaaatgaattagactagttttgtttttcatggttattaatgcctgtgattaaggaacttgatgttaattttcttacctctggttagtcactgcattttggaaaagcttctggctgggcgtggtggctcaagcctgtaatcccagcactttgggaggcccaggtgggcggatcacaaggccaggagatcgagatcatcctggctaacacggtgaagccctgtctctactaaaaatacaaaaaaattagccgggcgtggtggcgggcgcctgtagtcccagctacttgggaggctaaggcaggagaatggcgtgaacctgggaggtggagcttgcagtgagccaagatggtgccactgcactccagcctgggcaacagaatgagactctgtctcaaaaaaaagaaaaaaagaaaaagcttctcatatttatggtgtcatttagatgtccttagtaaatgtatatacatatgttctggttttaaagtcttttttcctacaat

SEQ ID NO: 12406 - DNA, 1394 bp, Homo sapiens
gttatagttcatgaacatggtatatctctccatttgtgtagaattctttaataagtattttgtaattcttagcaaacagaacttatacattctgttagatttgtattttatgggtttttttgggtactatatttggaatataagtttcatgttttgttctctgctatatcttcagtctctaggatatggcacaaagtcggattcagtaagtattgaatgagtgaatatctgctatcaaagagttcacactctaggagctgagaaagaagtacataattaaaagatgatacactttaggggaactgtaaacaaaattcttcgggagctccatgtgggagcaataaatttcatgtaacagatttctttttctttttttctgtcagatttgaaagaagataaacctaggaaaagtttgtttaatgatgcaggaaacaagaagaattcaattaaaatgtggtttagccctcgaagtaagaaagtcagatatgttgtgagtaaagcttcagtgcaaacccagcctgcaataaaaaaagatgcaagtgctcagcaagactcatatgaatttgtttccccaagtcctcctgcagatgtttctgagagggctaaaaaggcttctgcaagatctggaaaaaagcaaaaaaagaaaactttagctgaaatcaaccaaaaatggaatttagaggcagaaaaagaagatggtgaatttgactccaaagaggaatctaagcaaaagctggtatccttctgtagccaaccatctgttatctccagtcctcagataaatggtgaaatagacttactagcaagtggctccttgacagaatctgaatgttttggaagtttaactgaagtctctttaccattggctgagcaaatagagtctccagacactaagagcaggaatgaagtagtgactcctgagaaggtctgcaaaaattatcttacatctaagaaatctttgccattagaaaataatggaaaacgtggccatcacaatagactttccagtcccatttctaagagatgtagaaccagcattctgagcaccagtggagattttgttaagcaaacggtgccctcagaaaatataccattgcctgaatgttcttcaccaccttcatgcaaacgtaaagttggtggtacatcagggaggaaaaacagtaacatgtccgatgaattcattagtctttcaccaggtacaccaccttctacattaagtagttcaagttacaggcgagtgatgtctagtccctcagcaatgaagctgttgcccaatatggctgtgaaaagaaatcatagaggagagactttgctccatattgcttctattaaggtaggatgcttactctgaaataccatctcagaatgaggccaactataaagcaatttctttg

SEQ ID NO: 12407 - DNA, 1228 bp, Homo sapiens
catcatcatctcttgcctggattattgcaataacttggtaaatattgtccttgtttttacctttatccactctcttggtttaggttcctccaatagcagatcctgaacaaggatttcagtgtaacttatttaggaggtgatctcagggagcattgtagagagtagtgcagagataggagtaaggagaaaagcccattaaagatttagtgttaatgaggtggttactattgtagacagccaggctcgatcttgctagggaacctctgagagactgagtagaacatgtctctgaattgtgacaccaaggggcacaagaaacttgagacagggaacccaagtgatagaatatctcccatatctaaagagaactgaagcactgtgcctttttctttaatataggaggtgcatggtgtaataacttgtcctttacattgaaggaatgtcctagcttgcctcaaaacatggactataaaaatgtcactaatgttctgcagccaattaagccaactgagttcctttccttgtgggggcccagtgtgcaatggctgcacacagcagcttccttggtagtgtacacagcctgttggttgtatgggttgctctgagggaccttggagacaggcctttccaatggatgttcatgtttctgaccttgcgctaccccaatgtaggctccaaacaggcatgcgaggtgcctttggaatgccccagggcactgtggccagggttcacattggccaagttatcatgtccatccgcaccaagctgcagaacaaggagcatgtgattgaggccctgcgcagggccaagttcaagcttcctggccaccagaagatccacatctcaaagaagtggggcttcaccaagttcaatgctgatgaatttgaagacatggtggctgagaagtggctcatcccagatggctgtggggtcaagtacatccccaatcgtggccctctggacaagtggcgggccctgcactcatgagggcttccaatgtgctgcccccctcttaatactcaccaataaattctacttcctgtcaaaaaaatgtcactaatgtaccctaaattttcttttttatttttattttttatttatttatttatttttttgagatggtgtcttgctcttttgcccagactggagtgaagtagcatgatcttggcttactgcaacctccaccccccaggttcaccctgtgattctcctgcctcgccccctgagt

SEQ ID NO: 12408 - DNA, 1114 bp, Homo sapiens
cttcttccacccacagctgttgctttagcttgtaatataatttcttacatcgatagggtttataactttaattttgtactgtctctgtgattacctcaattgtttaatcttagttctgtatttacatgaattcctgactgatcactagtcttgtcatagtttctcccatccctaaatctcttattgtggatttatttctagactggctggttctggtcctccagtcgtgtgtgtgtgtgtgtgtgtgtgtgtgtgtgtgtgtgtgtgtgttcatgtacatgtgcattttttttaaagatgggctcaggctcagttgctttgttctttatcatcaagattttatgtttgtgtgtatctgtttggctcttaattatacttaaaacatttgtttagtcatgttatttttttgagaagtgtgcatacatctgaccttactgatcctgcttagtaatgtgcatgtatatttttacatttagttctaaatggagcccctggatttataaacttgtgcgatgctttgaacgcctggcagctggtgaaggaactcaaggaggctttaggtattccagccgctgcctctttcaaacatgtcagcccagcaggtaaagctctgtgctctggaaagctccagaattgttcgaaaggcatttcttcttaaatttttttgaatattaacaagttctaatgtgaatatagacatgctatgaaatctgaaagtcatctgttgataacagtatcaatgtaataatataaaatctgatacacacacacacacagaattgtgtaatattgtcaggaaaatgaggcaggaatttgtttgtggggtggaaccataaaagtttagaaaataaaagtgaaatgtcctaatgcaatagactaagtcttgtgccacatctttgaaaatgtaatggagtaaacataaagaagttcttctttggactctttatctgaaacttcttatagtcgttgtatgagatactttgcttctgtgtttaaatcatgaactccgcaattgagttgtctgtacaccacatcttgctgacagtcctccagcacatgatttgttctcaggtgtttattgggtgttaaagtgatgtgagtggggaagaaataa

SEQ ID NO: 12409 - DNA, 1258 bp, Homo sapiens
tttgataaagtggaaggcactgtttgaggaagtccctgagttactcactgaggcagagaagaaggaatgggttgagaaactgactgaagtttctatcagctctgatgccttcttccctttccgagataacgtagacagagctaaaagggtaagtatggaattgggtgcatttgcttagagttgagcattatgtagaaactgtttcagaaatcctgcttttgatttttaaaaggtgtggcaaagtgatacagatcagtaatattcagagaaccatttgacttctccattgggtggatggagaacccaaatcctgttgttattttgcctttttgactgagtgtatctttgttagcatatgctttttagagggggattttgagttttgcaggtttttacataaaatcgcgttttgaaaatcaatatacttcccccagagtggtgtggcgtacattgcggctccctccggttctgctgctgacaaagttgtgattgaggcctgcgacgaactgggaatcatcctcgctcatacgaaccttcggctcttccaccactgattttaccacacactgttttttggcttgcttatgtgtaggtgaacagtcacgcctgaaactttgaggataactttttaaaaaaataaaacagtatctcttaatcactggatccatagtttttggtagttgtgttttatgttaaagatgcaggctctttgaactgacacatgacacataacacataaatgaggaattccagagcacccctgcctaccggagctcagcccatcccacagcactgcccgtgtgaaacataaacattagcaggaaccaaacgagctgagcagccagaggacatggcacaagtcactgtgtacaggccacacttaaggactgggagttatacccatcttaaaggtggagtattgatgtaaattacctagaattcttctgcatgggagttgtatattaaaggtccatgttgcctcctaggggagtcttctcatgccgtttttgtttgtttgtttttcatttttttaatttgttattttgagagggagtctcaaaaaaatagctctgtcactcaggctagagtccgtggcaccgtcttggctcactgcaacctccgcctcccgggttcaagcgattctcctgcctcagtctcctgagtagctgggactacaggcatgtgccaccatgcctggctaatttttgtatttagtagagacagggtttcaccatgttggtcaggctggtctcgaact

SEQ ID NO: 12410 - DNA, 2205 bp, Homo sapiens
accagtggtccactgtgtgacttccctgctccctctaagcaagtcactcctctcctctgggtctctgtttccttacctataaaatgagaacgtttcttcatgtgatctcaagtcccttttaaaatcgctaggattctttgaaaaccttttctatcatctagtgcagagaacttgttgaggaagttgggattggaatgagcctcagcagatgggcaaggtttgaataggaagagaagagacatttcaggagaaagaaacaacatagagagacagatgtaggtataagatatggtaataagccaaaatgtattaagagttataaatgcatgaaatcatcatcaaagcttgcttagtgattaactgcttatattttgccagtgcatatgatgtgacatttttctttaactcaaacactaaattacgatgtcctcaggttatcataaaccccatttgacttcatgcctctactctctcagggctggcgctgtgacaactgccgcagacctgggggtgaacccagtcccgaaggcactactggccagtcctacaaccagtattctcagagataccatcagagaacaaacactgtaagtgcattagcagcacaagtgtgttccctcatactagacagtctctttctacaggtatctttcttcagaatgaaccaagtgttttaattaattaaaaaaaaaaacaactcataaatgacttaagtgaaacactgtattccataatatagtttaagttataatttatgtaactcttgaacatctcctattgcccagtatgctgctaggttcttgaaactaggaagaaatattatcctatctataagcagctgtcatgagtccccacctccccgcatttttttttctgtacactttacagtatttgccactaatttttttttccttcttcctttttaacagaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccacaacttgaagttcatctatttgatataagacaccttcgggggaaataattcctgtgaatattctttttcaattcagcaaacatttgaaaatctatgatgtgcaagtctaattgttgatttcagtacaagattttctaaatcagttgctacaaaaactgattggtttttgtcacttcatctcttcactaatggagatagctttacactttctgctttaatagatttaagtggaccccaatatttattaaaattgctagtttaccgttcagaagtataatagaaataatctttagttgctcttttctaaccattgtaattcttcccttcttccctccacctttccttcattgaataaacctctgttcaaagagattgcctgcaagggaaataaaaatgactaagatattaaaagtatttgaatagtataatatggaggagttttatcttagggaaaccccatggtatgataacccccatctaacatgtcttactttgggtcagctgacacttttgg

SEQ ID NO: 12411 - DNA, 1210 bp, Homo sapiens
tgggtcttaaaatgccctagaaaatggtaaatgataaaaaataatattttaaaattcaaccaaagaaatggcccattggccaggtgtggtggctcacacctgtaatcccagcacttttggaggctgaggcgggtggatcacctgagctcacgagtttgagaccagcctacccaacatggtaaaaccccatctctacaaaaaatacaaaaaaaaaaaaaaaaaaaaaaatagcactgtggggagtgcctgtaatcccagctactcaggaggctgaggcaggataactgcatgaacccaggagatggaggttacagtgagccgagattgcaccacttcactccagtctgggcgacagagaaagactttgtctcaaaaaaaaaaaaaaaaataaaaagtaaataaataaataaaataaatggcccattataggggtttttatctttaacttgctatttttccagatcatggttctgaagaccctgtgacacgtcccagttcacctactgtcttgtgagtcagaatatacaaataactttttggtcctgactttccccacccctacaggatggtgccatgacaatggtgtgaactacaagattggagagaagtgggaccgtcagggagaaaatggccagatgatgagctgcacatgtcttgggaacggaaaaggagaattcaagtgtgaccctcgtatgtcatcacagatcatttttagtgccttattaagcattctcactttcattatcaggctgtaactctcattcacagaaatgattggagactttaggtctccttgaggagtgaacagtgggtttcttaatcttttgatttgggaaagtggagacaagcttcaaaaatgagtcatgatttaatgttattacaggacactttagcacttgtccaacctgagtattttgaccattatctgcagtaaaatgctacaaagaagctttattggtctgtagattcaacttttaaaatatgatttccatcttcccgttggaccctttccagtgtattaggtctaatttttggaagtgccaccctaagatctgtatagcagtactgctcttagggatgattcacataaatatgtggtgtttgcgctgtgatgatacaaatttaggacagaaatagaacccacccctagatcaagtctgcagtattgttctcagcttatgcgtgcatctgtcttgtgtctatatgcaga

SEQ ID NO: 12412 - DNA, 1365 bp, Homo sapiens
gattagtctggattctacttcctacaacttgcttctcaaatttaaaaaagaaagagagaaagagaaagactgcacatttcagttccattaggtctaatttgagcagaggcagcttctacggggctcagcggtttaaagctgtgtgtatgataaattcatactaacacttttttctttctaaactataaagaaacctttgagaaaaatcctaaagatttctttctggaaaaagtgttttgtgatctcagaactgctcattttctggtggcttttatcaaattgatgaacagtcattgttgcctgaatcgattattatcattgctgctacttcctggagcttaatgcgctttgcttttttggctctaacctctctcggctagacgagcttccccaactggtaacccttccacaccccaatcttcatggaccagagatcttggatgttccttccacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggtgaggaaatccaaattggtcacatccccagggaagatgtagactatcacctgtacccacacggtccgggactcaatccaaatgcctctacaggacaagaagctctctctcagacaaccatctcatgggccccattccaggacacttctgagtacatcatttcatgtcatcctgttggcactgatgaagaacccttacaggtaattaattgttctcttcacttctcatggggcagcacagaaaggaataagttaggtaactgaagtgaccagccctcgaataaaaagtggcttcatggccgggtgtgatggctcacgcctgtaatcccagcactttgggaggccgaggcaggtggatcatttgaggttaggagttcaagaccagcctggccaacatggtgaaacctcgtctcttgaaaaaaaaaaaaaaaaaaaagtggctccacttttagaacctcttagaagatggcacatttaagccctgcttttttttttttttaaatcccaatatggctctactttggaggacataccagagagtcactagcttttatttcatagagaaaatgaaactatttctcttattctcacacatttgaggttcctttttgagtaagatagatgattctagaaaagaaagatattctacctgaatttccatttgtgtgcagaagtctaaaacactacctttacgatttgtccttgaagaaccccactat

SEQ ID NO: 12413 - DNA, 1066 bp, Homo sapiens
gggatggcattgtacctgttgagagaaaatacaaaatacttgccgtaatattagacacacacacacacacacacacacacacactctctctctctctcacacacacatacacacacacacacacaaaattgttagctggccatgttattgtaactcctaccacacatatttttacattataatacattaataattttaatatttattgaagtatttgtagatactataaagccagccctgggaaccactggtagtatctataaagcttttcagctcttcaaaataaaatgtctgagaggtagatattttcctattttctaattacagttgacctttctctctgaatgccaaaggagataatctacacattactagttatatatttcttgaaatggatgaatttgatatataccaaggaaacgttttaaaataccaaaactttacatggatgagccaagcaggcactaatctctagctatgctcctgtgcagatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtcagggaactcattgcactaaccacatttgttaacaaatacccacaatgtaaacgggcttattaactgttctacgactgacactgataaaatttattttcagtgttatcatcataacccagttttagaacgttattttcatgctatgatcagaaatagttttgtcctttgaatgcctgattttgtgtaatatttgtcatggaaattgcgtaagtgtcaatcaacaagtttgatcttccatcattgtgccctttcttatttaaaaaattgtaacataaggtttaaaactaaaagaaataaaaaacagtgatgtatagatcttagcattaaaaagcatagttaatataaaagtaaacaataccacttaataaaggccaaaattgtaaccgaagaatatt

SEQ ID NO: 12414 - DNA, 1222 bp, Homo sapiens
tgcaatggtgggatcttggctcactgcaacctctgcctcccaggctcgagcaattctcttgcctcagcctcccaagtagctgggactacaggtgcccgccaccacgcccggctaatttttgtatttttagtagagatgggattttaccatgttggccaggctggttttgaactcctgacctcaaatgatccacccgcctcggcctcccaaagtgctgggattacaggcgtgagccaccacgcccggccttgtatcacttttttttttttttttttttttaacttttctgtagttttgaaatttttccaaataaaatgttgagggaaaaaaactcttccccaaatttgaaataatcattttatcacaatttgaatgggctctgtaaccccttatcttgaattcgtcataatataaaattctgctaattacacgtagtatttacatgattgtatggaagaatcattaagacaattatctggaaaatgaacaaacagtaaatctgaatattgtttgaaaattacggatgtgaaaagtttcccttttttttctagtttctgatgttccgagggacctggaagttgttgctgcgacccccaccagcctactgatcagctgggatgctcctgctgtcacagtgagatattacaggatcacttacggagagacaggtacagcagtaaaatgctattttacactctgattaaatcagattctgttgtggataacctgaaagcccaacagtgaacaaagaattaaagaaactttggcaagtccattcaacggagcccttgttttttccaagaaaatacgtaagatatagatgatataatttgttctaaaacccaaataaaaagttgtttatatactacaactagagggggaacggcagagctgaggaaataaaaggattgtaaattcacaaacatattatcagtggtggaaataagtgatttttattttttcttctctttacttttctgtattttccaaattttatttaaaaggaatgtattctgttaaaagttttaaaaaggacacaatgcatgcaatcctgggttgagggcttaccttctcccacttctaatgctactctactactcagtgacattttaaagctgaaatgttaaaacagcgctaactgtaattttctctcaatgtttatacacttaccaaggtttgctacatgcataaatacccctttctgttcaagatagcgctcttt

SEQ ID NO: 12415 - DNA, 1194 bp, Homo sapiens
gcattgtaatttgtctgggataatgtctttagtttcagaaagttttgtgtttggcatcattaccactctgttgacatataaatttcctcttgagcttaggaggcttctctgagagtcaaacatttactttgagagtgggcagatcttgctttacttggaaggatacacttacaggatagaaacacagaatacttgaacactgaagaatttgaaaatgtcaattctcagaagatcttgaacacttatctccaaatgtgacacagaaacttactgtaataacccctaaaatctgcttgaattacttagcacaagaaaaaaatgaatgcttgagctggctattttgaattgagtcaatttaagattttaaaattcatatgtagcttagaatcagtacatcttactctttggtttatggcaaatcatggtattgatgagacaggaacgaaatgttggatgtacgttaatttcccctacaccttcctcacttcctaaactggtggtgtcttttcttttttttttctcttcctcccccgggtgggaaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacaggtaacttttcttgtctgcaaagaaactcagaagactttcctacccagttggtagattctgtaaagtagcttgctgttgtctgtcatcagctctcaaaaaaaaaaaaaaaaaaaaaaaaaatagatcattgtcatggtacatggagagggaagtgagaaaatgtggagaaacatcttccttagaatatggtaaagaagcccgggcgtggtggcagtaaagaagataatttttttcctctcaagaaatttctcacctgatttgggtatttatgcatttctaataacacaagttttgttgaaaatgtagaaaattggccggacggggtggctcacgtcagtaatctcagcactttgggaggccgaaatgggcagatcact

SEQ ID NO: 12416 - DNA, 1182 bp, Homo sapiens
catgctgagaaccaatttgcatgaacatgttcacttgtaagtagaattcactgaatggaactgtagctctagatatctcacatggggggaagtttaggaccctcttgtctttttgtctgtgtgcatgtatttctttgtaaagtactgctatgtttctctttgctgtgtggcaacttaagcctcttcggcctgggataaaataatctgcagtggtattaataatgtacataaagtcaacatatttgaaagtagattaaaattttttttaaatatatcaatgatggcaaaaaggttaaagggggcctaacagtactgtgtgtagtgttttatttttaacagtagtacactataacttaaaatagacttagattagactgtttgcatgattatgattctgtttcctttatgcatgaaatattgattttacctttccagctacttcgttagctttaattttaaaattacattaactgagtcttccttcttgttcgaaaccagctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaagtaagcagttgaatgtatctgttccataaatattaacctagagcatagcaaatgaattctaaattctcaagtaggaggagctaagagcaagagagctgcaaccaagctacaaactaaactctgaattcaatgcacagctccattaattttgaaagatgtaatgtttgttgctatcttaatatacttttgatatctacagctttaaaaaaatcatagtggaaaaacacctgcaggaaagttccatgacttcaaacaaattctgcttctaaataagcacgtaaaaataagtgaatatcaagagaaattatatgactaaatctaaatctttagagaaaaaaatgagaactgaaaatagtgtcaccatatgtgctttattctcatttttataaaaaaagtgtcagcagttgattgatttaggatttgaatacttagaaaagtgactgattgtttggtctagattagaatgttgttgtgaagagagtcagaagtttaatttgtact

SEQ ID NO: 12417 - DNA, 1198 bp, Homo sapiens
catgatgttgtcatgagttttgtatgggagaaaaaaaatcaatttatcacccatttattattttttaaccttcttcatgcaagcttattttctactaaaacagttttggaattattaaaagcattgctgatacttacttcagatattatgtctaggctctaagaatggttttgacatcctaaacagccatatgatttttaggaatctgaacagttcaaattgtaccctttaaggatgttttcaaaatgtaaaaaatatatatatatatatattccctaaaagaatattcctgtttattcttctagggaagcaaactgttcatgatgcttaggaagtcttttcagagaatttaaaacagattgcatattaccatcattgctttaacattccaccaattttactactagtaacctgatatacactgctttattttttcctctttttttccctctattttccttttgcctccccctccctttgctttgtaactcaatagaggtgccccaactcactgacctaagctttgttgatataaccgattcaagcatcggcctgaggtggaccccgctaaactcttccaccattattgggtaccgcatcacagtagttgcggcaggagaaggtatccctatttttgaagattttgtggactcctcagtaggatactacacagtcacagggctggagccgggcattgactatgatatcagcgttatcactctcattaatggcggcgagagtgcccctactacactgacacaacaaacgggtgaattttgaaaacttctgcgtttgagacatagatggtgttgcatgctgccaccagttactccggttaaatatggatgtttcatgggggaagtcagcaattggccaaagattcagatagggtggattggggggataaggaatcaaatgcatctgctaaactgattggagaaaaacacatgcaagtattcttcagtacactctcatttaaaccacaagtagatataaagctagagaaatacagatgtctgctctgttaaatataaaatagcaaatgttcattcaatttgaagacctagaatttttcgtcttaaataccaaacacgaataccaaattgcgtaagtaccaattaattataagaaatatatcaccaaaatgtaccatcatgatcttccttctaccctttgataaactctaccatgctccttc

SEQ ID NO: 12418 - DNA, 1229 bp, Homo sapiens
tcagcacttttgtttctcaccttttctcctttcttggttctcttcctataaatcccatagtttcagaccttttaaattaggagagctctctggggaatgtgcttaaggtggagagcgattctatactaggcaggtagaaaggaatattcctcagctgtcttcaaatgattcattaaggaaaagcagggtacagtgataggaccatgagatttggaaacaaagaaagctttggggaatcactcccctggttcaagatttcctttaaagtgaggatcttggcggaggttgaagtgagccaagatcacaccgctgcactccagcctgggtgatagagggagactgtctcaaaaaataaaaataaaaaaataaagtgaggatcttagtactgcctgaaaggattgttgcaagcattgaataacagtgacagtggagtcctcagtaaatgccaagtcctgcattccgccctgtgaatccatcattggagtctagttaaatatgctctggctcacagatcctctgtgcaataacttcccttttcttttttctccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccaggtaatagaaaaataagctgctatcctgagagtgacacttccaataagagtggggattagcatcttaatccccagatgcttaagggtgtcaactatatttgggatttaattccgatctcccagctgcactttccaaaaccaagaagtcaaagcagcgatttggacaaatgcttgctgttaacactgctttactgtctgtgcttcactgggatgctgtgtgttgcagcgagtatgtaatggagtggcagccatggctttaactctgtattgtctgctcacatggaagtatgactaaaacactgtcacgtgtctgtactcagtactgataggctcaaagtaatatggtaaatgcatcccatcagtacatttctgcccgattttacaatccatatcaatttccaacagctgcctataaaatagttttgtccctgtatgtgagcactgaaacagcatttggttgacacatctagtttttcatcttgcagttt

SEQ ID NO: 12419 - DNA, 1230 bp, Homo sapiens
gaacactattggataacagtgttacctaagtttttgaaatagaatcttaaaaggattttaaattatgggcatagttattctaattcttctcttgtaatgtatcatcctgcagttgaagctatgtacatatctcttcaaaaggtgtgtttttgcaatacagttgctacaggggctggtgcctttaaatggcaactaaaaggttaattgaatgtgaataactcgttaaagggagagctcagacattccttctagcacacacacagaaaaatagaaatgaactaccatgtgacccacagtccctgtatacgtctggtttgtaacaagagattctttatcaagcaaaacagtatgtaatgacatttctctggaaccttccattacaagccaccttaatgcagtttggaagatacctcccccacctgggggaatttccagctaaagtatataaaagagtccccaaatcatttcccaataaaagtacactgtgcagtttctgaagagtttacactatttaaagcataatcatagcctcacagcagtaacagtcctctggaaatatttgtccttggtgtttactttgcattccttcctctagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacacgtaagaagaattttttcccttttctattagtttttaaaactgttctacttttcgaaaaaagctagtgtcaatatcactttttacttatgagaatggcacaggggagatatcttatccttacttatattattaatgctattcctgaatttggagtagcaggttcaattcatgctttatattttatggcatcagaaatgttctttccatgtcaagaatatttatgaactggcaagatgaaaataatttcaatagtattgcaaaatcattaatcataaagaagtctttgtcagagaattactgctgtccatcatattttcataatgtaacctatatttttatgggagggagggagggagggaagaagcatggaagagagggaggtagggaaggaggaaagattacacaggtcaagagctttgtgtcagctttgacttttaaaatgttctttctgcatagcattgtctcc

SEQ ID NO: 12420 - DNA, 1167 bp, Homo sapiens
gagcaacagagttggcctaatttattttagcgttgtgaatactgttgacattttatttcccaaatctaagtatctcctccccttccccctattccagagaccagaccaccacatcatgctgggtgttagataaatatgtttaatcttcttcttatttatcctaacaagcagatatttaaaggaaattatcaactaagcaagaaattttcagaaagtaagacatgtatttgttcaaatactggcttctcacaggaaagtgtattttaccacattctttacttgagcatactgtaacctctgcaaaagttacacattttgggaagaaaaaaatttttttggcaaaaattgtattactgaccaaactttgaaaaaaatgttattctatgcttgtagaaaagttattttagtggaaggtgttgataattaagtggaagtagttgtatgctttgagaagcataccttttttctttcatcaatggaactttaaaaagtttctcactcacccacctgtttcctaaacagatcagtgcattgttgatgacatcacttacaatgtgaacgacacattccacaagcgtcatgaagaggggcacatgctgaactgtacatgcttcggtcagggtcggggcaggtggaagtgtgatcccgtcggtgagtagccctatttccctagatgagtttgcacagggggaatggttagcaagtttcagataagaaaagctatgtgaaatcacatgactgaagttggctccagactttgatcagttgcttgcaaagaactttgcaaagtcttctctctaatactggaccaaaatatctcgatattggtagtcgtctggtttttgctgaatttggtgacaaatttaggcttattttaattgaatggaatttattcttgggtttagaatcataaagataatccatgctattaaaagtattctttccttttttttttgtttgtttttgtttttgtttttgtttttttgagagagagtttcgctcttgttgcccaggctggagtgtatggcacaatctcggctcactgcaacctctgcttcctgggttcaagcaattctgctgcctcagcctcctgagtagctgggattacaggcatgcgccaccaggcccagctaattttgtatctttagtagagatggggtttctcca

SEQ ID NO: 12421 - DNA, 1199 bp, Homo sapiens
attccctttaattttccagttgtagaaacaagagcctgggcggtaggcactgtcaagtgtgactatgagacaaagaaattgcttatacttttatttctttcaacaaaagaagatgctgagtttagaagaaaaaacccacttttgcttgtaattctatatccaaacccatagtttttatttgatccagaataaactggaactgggaaaagttatgaagctgtagttaaatccaggcttctagaacagcaagaaccctttgtgtggatgtgtagatattatcttagtttaacatcccctaacccttcctgtaactattttctatgacacgtttggactacgttttctgcctccagggctcaaaaattctaccccttcacctgacagcacttagatgtctttgatgcacacaaagcttcttcccaagtgagaattcttaggatgaccaaactgaactgatccttttgcacacatacatgtttagacctggtgatcatttatcaagtgcatttcttatccatttccaaacagcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgaggtatgctggctgattaacaaaaatatttgagatggcaaaaggtacagaaagggacacttttttttatgaaaacttgcactatgccaaaagcaggggaagaaatatggaatgccacgtcattcattagtctactgtgcatggtaagataagcctgaaaggcttagcaggcagcctgctaagacaagcggcatagcaatgctaatgttctgaaacactcctagcatgtaagtacttaggctgagccaaaaagatggcttcaaaagtaagaatgaaacatttgatccattcagctttaggctatgccactggattcatgtctagaaaagataggataatttctgtaaagaaatgaagaccttgctattctaaaatcagatccttacagatccagatttcaggaaacaaatacataggggactaactttccttgttcagattagtttttctcctttgcacccagctatataatatgaggaagtattgactttttaaaagtgttttagttttccatttctttg

SEQ ID NO: 12422 - DNA, 1174 bp, Homo sapiens
gtttggactcaagagatcgcagcgctcacgtaacagctgaggattcttccatcttccccagtactgttgggaaatgacaccaagggagtagccttccagttcatttgatttaacacattgggattatgatgtgattaaagatacttgtattttggaatcagtagatgatcccacagggctgaggaatacaaaggatgaatgttttagtgccttagcttattttccagttaaaacaatgttttattcaaagctatcatttaatcttttgtggggggggtgctggggaaatgacagtgaaagtgggatttaaacctgttttgaaggtgtgaaggtaaatatgctaagaagcttagaactatattatcagacattttttattctgagatagactgtctgtgaatgagctgcagaaacctggctctctcagaccagtaattctgtgtacattggaaagctcagcggtaatcttttccttctttgttgtgtattgttcctggcagttttggttcagactcgaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctggtaagatgaagcccttgtgggttgtcttgtttgacaacaatttagggagtagagactaaagactagtgtccagtttactcccatttcattcattaacacaattttgagacaacagaaaacttcatgtgaagtgtgtttgtgtgtgtgtgtgtgtgtgtgtgtgtgtgtgatgttacatcatatacataaggattgggaagaataattagataattatttatataatttttaaacctcattgacatgatttaatgtcaaaaatataattacttatttgtaagtctggaaatatgaatttgcacaggtttgtctttgtaaagagcacacaactgagtagcttacaacatttaatatatgtatgacggctttagtcacagagctacaatattgacacatggttgtggtttgatgggcataagctctatcacttattaataagtgccaaagtgactaaaactcaatgttttctaacaggtagggaatctcactcttttttt

SEQ ID NO: 12423 - DNA, 1195 bp, Homo sapiens
atcccctgaggtcaggagtttgagacaggagtttgaggtcaggagtttgccaacatggcaaaaccccgtctctactaaaaaatacaaaaaaaatcagctgggcatggtggtgcgtgcctgtaattgcagctacttgggaggttgaggcaggagaatagcttgaacccaggaggcagaggttgcagtgagccgagaccgcgccactgcactccagcctgggcaacagagtgagaccccatctcaaaaacaacccaaaaaaccaaaaaacaaacaaacaaaaagaaatataatcccagtagccccagctgagctggaggatggagaccacttggtagacacttgtggattatttcctaggctaaatgcaaaagctactgctgaataagggacatttttttccagtcccaggccagtagcgacatagatttcagagtgatctctgtgagatcctgaagatcctgactgcagaaagtagtgaattgtcttctctcacccagttttgtgacattcccttttcatgccattaggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacaggtatgcattatctttttgaagaataggactgatgactttattatttagtttttgaaggacaatacattttcaatgtgaaacaataaaacaaacaagaagcctgtaatcttaccaccctgtgataacaattagggttggcatttgaaatagtttcttccaatctttttaatttatgtattttctttctggtcatggatatcatgggtaaaaattttattgtatttatctgtctaaagtgttgttacaagagagctactttctgaataatcatcaatgttttatattctaaatctcaaatttcagcagctttgtgatgtaaacatcttccaataacctaatatatgtattctgcactacaaacatggtagtcactatggcaataacaattgctacacaattctcccccagaatagtctcatatattaattttatggcatagatatagtcataaatattatcccaacatccttaagcag

SEQ ID NO: 12424 - DNA, 2323 bp, Homo sapiens
tctagttcagcatttgaatgtgccattgggcttaacaacttagaaaactaccaggatttccacactttatatgcatatgtctgtttgctttccaccaaaatgacatttctatcctagggtaaaatacaggctctccatgctcccaaaagctggagtgctgtgcctgatgtggccttttcactgaattagtctcagtcttagcctgctgtgtatgagtgaagaccaagcctcccagcctttcttttctgcttaggacccaatttcctgtgatctctctgggaaagcaggattcatgacctcttccttgccatccagatttctctgtggttttccattgtgttctaagcaagacacttaactgaattgactccaagtgaccagacctgttaacgtttcccctgtctctgatgggaaagctgttgtctgtgtctctactttagccaacctaagtacctaccatgggtggaatatgagaccaaaaaaaaaaatctgttctgccctctcctaacattttcgttgtatcttcaacagaccgctgccatgaagggggtcagtcctacaagattggtgacacctggaggagaccacatgagactggtggttacatgttagagtgtgtgtgtcttggtaatggaaaaggagaatggacctgcaagcccataggtgtgtgagtcttagggctgagcaagagctgggatgcttagttctaatgtggggttggaccagaatcacatctacataggtcatagacctgaattccagtgaaaaccaataaagaaatgggaattttgtttgaaataatgaattattatataatccatagtcttcttacaggagttagatcaaaaagtactgactacacatagaagtcttaactttgcttcaaaagcataaggtagaattgaaagatttagaatggagtcatttcttttacctaatagctgatctcagattcctccttcgtcaagatataatttatttaaaagaaaaaaaaatgacactttggacacatttctatatggaatgtcctggaccgaaacatgaaatagtgtgtgcttgtcacactctgctcatttcttttcaaattaaaagttgttgagcttctttggatctcaatcctcagttgaattttgtaagtacaagcctgaaagtttctggctataaattttactctgtttacttgtcttctaatttagaggtttttgtcttgttttgtattgttttgctttccaatatttaaaaatagctttctttgtcattgtatttaggccactcaaaattcataattggtcatttataattaagattggaattttgcatatgtagtctcccacagactagatacatacatagatccttgctactggaaatgctgctgggaagtttggggctcgctgaaaatatgtagtccatgtacttattaggagaatggaatttctgcctgccaactcagcttgagctttcttttgccttggctacttactgtgtgcttagatgctgggtgtgtcattctttctgaacagagtgccacttaaaaaaaatgtggctgaatttttgcttacacactacactttaaattacagggagcttgcacaattcaaaataacctttttttcctgtttttcttccaaatttccctacagctgagaagtgttttgatcatgctgctgggacttcctatgtggtcggagaaacgtgggagaagccctaccaaggctggatgatggtagattgtacttgcctgggagaaggcagcggacgcatcacttgcacttctagaagtatgttttacatctttatgttaaagattaagccaggtattgttttctggattcctagagagaagggtaatactatgttactcagaacacatccagtatatcagcatgctttggtaacttctggaagtcaagaaaactttcataaccaacttattccgcatcttcagagaagactacataaatagaaaaacatatcactttgataaggttcaatctcagctcactgccactgacatagagttgaacaaaaggtttaggtttccttctatgtttgaaatttaaatagggcacattcacaggctaaattgataaaattaaaaagaatttatcccataaattaaaatgatttatctactctggagttagggatagtgtctctgacctaacgcatttgattagtgctgtaaagaagctggcctctggtgtctttactgctccttctaagattgtcttggggtcttaattgttgcctttgggtttgaaggctccttttttgatattgtaaactaataacagctagagagtttgttgaagtaaaacag

SEQ ID NO: 12425 - DNA, 1163 bp, Homo sapiens
ttgatggactctcgctctgtcgcccaggctggagtacagtggtgcgatctcggctcactgcaacctccgccttccggtttcaagtgattcccctgcctcagcctctggagtagctggaactacaggcgcgtgccaccacacctggctaattttttgtatttttagtagagacggggtttcaccatgttagccacgatggtctcgatctcctgacctcgtcatccgcctgccccagcctcccaaagtgctgggattacaggcgtgagtcaccgcgcccggccaagcccttggcattttatctggaatagcatctgtaaactgaagtgtttgacctctgttttcttctctcctctttcatctgtttctgattcgttggctggcagctgcacctgtggggggacctctcatgcagacttgcacatatgcagggagtattgcactgaagatctttgctggaccttcttctcttcagaagataattttcaaaagggagcaatgctgtgaatgcagcttgcttctctctacagattgagaagtccagcttcaaaagttacttgccacttaagcaaggaacttgtcaagagatcatggttcatgttactgaaaagactttaaggatttgtaaggttaatccatagattgctgagaaaaatggaaatatttttatttttacagattttgcacttctgaattcaggttaaaaactaacttgtatttagtctgcttagaggactgtgacttgaaaatttttatataccaatgagctttttggtagcgtccacaatgtttaaaatatttcataggcgagatccgtgttctccatttattaatgcattgtagaccaatttaactgctgtgtttcaggaaaattcttcctagtttaataagcaagctaaaagttttattttttatatttagtgcttaatctttgcctcatgttatgtaaaattagcctgcagatattttctctcaattctgtagactctcgcaagataaacattcaaacagtgaaacaaacaataaaataaataaacctaaggatgtcgtattgttttactctcggtctcagaatttgtattttgcctttctgccttttttatgtcaaaatagatgagattgtgtgcatctataaattgttaccacagtatttttgataatgaata

SEQ ID NO: 12426 - DNA, 1222 bp, Homo sapiens
ttcttaatatgataactctctcttttagaggaaagaagtttgagaagaggcatattgaaatattcactgacctcagcagccgattcagcaaaagtcagctggatattataattcatagcttgaagaaatgtgacatctccctgcaattcttgtaagatcctaagaataatgcatgtagacaaatcctatgatttcctaatatagtgaatgggccctctgtatagagtacttggtttatgggaattttcgctttctgctccaaggctgaatctgtcagatgactgactactcagcaaacatttgctggttactctctgtgttctaggaactgttctgagtggtcgtgacaaaaagatgaaagtcagtgatccagaagaattgagcttagtggcagatcattgtttagtgttcttagactcaaagaattgaggattagaagaaccctttgaggatattcaatttgtctccttcctgcatagaaggctttacccaaacaattagcagattgatggatttttttttttcttaaacagctctagagaactgtgtcctatacagagtgcatgttttagggtagacaggaatgccaacttgggaatcattctaaatacataacatgtttatgtttaactcttttcagatccaaaagttgtggacacatatataaaatttaatttgcttctgttaattcagagatggagtataaaacttcaggggaaaaatatgtatttcacaatttattagggagagaattcctcctcaaaaagtaacttgaatattccctccgggatttactttctctgtgttatatccctaacaaaaatttcttttcactacactaacccttcttgctgcatttgaaacatattttttcttgtcctatttttggtgaaagttgagtgatggtatagaatgttgaattattaatcttctgggaatactcgtttttcaaattgagagctatgccaagaagcctctaggttagagtggtaagcctttggcttcataaaatgcctgcctgggggtattaagaacttgttttgcatgtgtgagtagtcttctcttaagactacagagcgacatctcctttctgtacgactgtggaaaaagagttcagaataacccatcaaaccaatacttgttaagatggtacttcagagaaattaagtgcttttaagtgacacttcttactgagttgaggtttttctcagtacttcagaag

SEQ ID NO: 12427 - DNA, 1189 bp, Homo sapiens
tgagcagatcactttaggccaggagttcgaaaccagcctggtcaacctgtctctactaaaaacacaaaaatagccaggcatggtgatgtgcgtctgtagtcccagctacttgggtgtctgaggcatgagtatcacttaatcccgggaggcggaggttgcagtgagccaggattgcaccactgcactccaacctgagcgatagagcaagactctgtctcaaaaaataaaaataaataaataaaaatattagacagtctgaggttttgtatagaaagtgtgaatgtaaatatttgtggattacttttgggagaaaatgaaatgtagagaaggttatccagtatattttgttatgaaataaactaaaattttcataataggcatgagcaaacaaaataatggagctagagtaattgttctggatttttgtctgtgccagagagtgtattaggttttcatcttctatcaattggaatcctaactttccttgttttccctttgtgttttggaatgtaagattctacaggagagagttaaaaagacttggacagttgtggatgcaaaaaccctaaaaaaagaagatatacaaaaagaaacagtttattgcttaaatgatgatgatgaaactgaagttttaaaagaggatattattcaaggtatgtcagtaagagttttcactgttgcctaaaagacattttcttcaacatgatgtgatgcaggctggggtttgtattattctttgtttaaagttatttctttgagttatagaaatataacagtttgaaaggataatgagaccctaggtcctttagctcatttgttgggtcttaggcaggttgcttctcaggagtacacttgggtgttccatctctgtgagttttaaatgtcttaagtgatagtactcaatacttggctttattttaaagtttgaaactcactagctaggagcatgtttaatatggttgaactaaggtttttttgtttgttttatttttgactttcatggtgattattcttctaagggccaacttcaggttttatgtcctaccagatatgcttccttaatttaggggctgaaaattatttgtatttattatattgcttcatattaaataggattttttaaaagttgtactcctatgttatacccatttggattgaatagtgtgtctagatggcatctttatccaga

SEQ ID NO: 12428 - DNA, 1181 bp, Homo sapiens
ccagtcaaagtccaaggtcccccgtttggaagtgattggactctgtggttggtgtaggcatggtcttttcagggactgaatctagctgtcatcaccattatatggtagccactagcggtttcatatttactatgttcaaggcattgtgctagcacttttatgttattttaattaccctgcattagcagttctgcaaaatcttgtgaagaaatgaagaaaatgttagagctttaacagcttttgccagaattttctgagaggattgctttacttgggaaaataactttgataagtgcttagggtagagaatgagtctccatccccagacttggttggctagtccagaggcttcggaggaaaggaagctcctcagcatcatagaagtagaaaaactggagctggtttaggagaggaggggcttagaagaagaggggagaggcagggagacaaagtgggtgaatttacgcacagtcacggccttctacaatacgtttcaaactcatgaccacaaattactcagtgtcagtacaactctggaaatgccaggtttaagtgctgtatttggggaaactggcagtttggtatctggcattatttcatgcagagcagagaaagcacctgagcacacaggaggccagagtctgaaaagaccaggagagagtcagttactgagaatctactcacatcttaggaaaatatgtcttacccctggccatgggattggggattcagagcagtcttgtgaaaatagcaagggcaagcggaccctagatagcatgtaagttaacaattagtattattatctccattttactgatggataaactgtaaaattggaggagatgcattttcccaaagatcacataggaattcaaacacatgtctctttcaaatactggattttttacgtagccatattgtttcttttgattcctaatgacttcctttcctacgctttttaaaacaacattttaaggtcgtgtatctgaaaccttgtacctactgataggacttttgatgaatagattgttcttttatattgaatttgactttgagacccagcatgttgctagtatttcgacaaaagatgtccctctgacctccgtctaagacttggtgaatcagagccctctagtgatgtcacaaaaccagactctccacagagctgtcggaaaatggat

SEQ ID NO: 12429 - DNA, 1357 bp, Homo sapiens
taaaataacaacaacagcagttttaaaaataactacaacctaggttctgacatcccaaaaaggaatatttcaactataattctcagcattttagaaattaatttcttgacaaatatcaataggtatcattcagactttgcaaatacagagttttgaaatcagaattttgcatctcatctctcccctaaaagaagtatggcaattgtgcttgctgaccatgaggcttgtgaactataatacatacttataggcacaaacacagaagcataccctctctcaggcatcactcaaatctaagaaaatttgttgtcttatgttttagcgagtaaccagctcataaatcacatcgaacagtttttggatactaatgaaacaccgtattttatgaagagcatagactgcatccgagccttccgggaagaagccattaaggtaatgctatcctagcatctcttttcttcctaaacagttggcgactatcacagggaaagaggcatacagcatcctggaaatgagtctgggccgtggaaattatcattctcaatatgaatagcagtgtatgccagtggagctaaaaatgacttaaattcatgttactatcactgtcatttctgagatgggataaagatgagtaggtagggtgttttatccctgaaagttggctttttattgtactgaagacctggcctttgctttctgttcctatttagggaaccaaggaaatttccattataacctctggtggcccactcactattgtaaaggatgggctattttagggaaatggatgggaaatatatattggtataattattgagaaagattttatgaagacaggagtagggatctaaatgtcagaaaaaaaagaacactgacaataagttcctcccatgccttttgtgtgggttttgtctgtttgattgttttattaggaattcttagaaaatatttctaaaacttttccaaattatgtataggcttttatatctctaggtaagaagtgagcaagtttaaattagaaagcatattttttaagtgggcacagttgtagtatatgttcttgtgtgggtgcttattaaatacttggcgaacgtatgaatgaattaatgcttaaataatttaggtgcttacaaagagtgacaagaaaatggaaaaatcattaaaattagattcaataacagattcagaagtagataacctgaatactcttagataaaagacaaattttagaaaagtagagtcaggacaagactgcagatgattcagttggatggagaaagatttggttcaatggaaagagatagtaaaagtgtattgcttttttaaagcactacccaggctaggtggagtgtcttat

SEQ ID NO: 12430 - DNA, 1239 bp, Homo sapiens
cagataggtaatttcataatagaaattcctgtgtttcatggtgtcggctatattgttcattcagattaatcctctcccttgaagggctgaaaaagagctagggaggctattccattagtagcaaaatgttgtaattcactgaaattgctgttaaccaaaaataagtaatacaacatgcagtttgtgtgggttgacaaatgaaacagcccttaaaagggctacttcttaaatgttctcaattaacttaatgtaaacaaaatagaccgataggcatttgaggatttctggaccccattacaccatgttgttgatgtctgggaagctgtgtagtaaatgtcttttgtatctatccttaatgtttggaaacttcccgcctttaagcttcatatgacaactgaccaacaaacactacgtactatgatgtcaatcttttttagagacattctcattactaaaatgagtggatacttgaatgtttaactcctaaaataatgagcggtgaataaatgagcaagtacatgcatgccttccaatgtagagtcattttcattaaaccctctctcaccagagaagcagtggtatgaaattggcctgattcctttctaagtgtgttgttcttgttcacagttggacatgatataggtcgtggatgtatggggaatctaagagagctgccatcgctgtgatgctgggagttctaacaaaacaagttggatgcggccattcaaggggagccaaaatctcaagaaattcccagcaggttacctggaggcggatcatctaattctctgtggaatgaatacacacatatatattacaagggataatttagaccccatacaagtttataaagagtcattgttattttctggttggtgtattattttttctgtggtcttactgatctttgtatattacatacatgctttgaagtttctggaaagtagatcttttcttgacctagtatatcagtgacagttgcagcccttgtgatgtgattagtgtctcatgtggaaccatggcatggttattgatgagtttcttaaccctttccagagtcctcctttgcctgatcctccaacagctgtcacaacttgtgttgagcaagcagtagcatttgcttcctcccaacaagcagctgggttaggaaaaccatgggtaaggacggactcacttctctttttagttgaggccttctagttaccacattactctgcctctgtatataggtggttttct

SEQ ID NO: 12431 - DNA, 1192 bp, Homo sapiens
ccctactccattcctctgccccaatctcagctcagctggcattagcatctgcccaacatttttcttttcttttctttctttcttttttttttttttttgaaagaaaggcaattttatttcaaaaaaaaaaaaaagtgtgctctgggaacagggttagtccatttgggccttcagtgtcctggtggtgattttgtccttcttggtgatgtggatgatgactcccatgcctgaccctgcaccccagtccacagcattcagcatggctggggagatggtttcaaacgggtgttctggatccatgttgggttcccagagggactcacacattccgtacatttgttcggcatagctgccattgaccacaaagtcatcagtcaccatggggaagccgatgaggtctagagagcaactgaagggcttaaaggtcttcaggtccaaaccagcaatgactggatcagtgtagtaggggccaaaatgtttctcatacaagaagttggccaccatgctcgtgaaggtataaggtttgatctgctgaccttccttcaactcatataggttcagctggaacttgaggcactgggcaactctctggacgtcagtggcaagcccggccagaccgatgtacaaccaaccacccatgggaaagatctcctggaagtccgtggtcaccatctgggcctggatcccgaagtgcctgtctgcagcgatggccacacggttcttccccttcatggccatgatggctcctccgttataggacataatagacatgattgtgtggtatacgaggacccctccattgccggagcaattccagtaaaccgggtctagccttcactcctgcccatcatttctgacatttagactctacatagagggtcctgagattccaggcctttactcatcctgcatcccctacctacttggatgaatattaatatttacaataacagagaaaagttctccagaatgtctgggaggtgaaagaagttaaataaatggaaagtgttgttattgtttgcaccatactctagttcttccaagggccggcttctaaacctttcctgaacatctcttttctgatgatgtctcctctacaactcgagatcgtgttcttgtcactcttccatggacatggccaccgctttctaactggcttctctgaccctccttggtttcctttagatccttt

SEQ ID NO: 12432 - DNA, 1229 bp, Homo sapiens
tgtcagtggtgggtgataccccaggatggaaggagttggtatgagccgactgaaatctacttgaaggtcaaaacggagccttatgtcttttgtgttccccagcggttagcccagtgccggccacaggggaagcgcgcaaacgaagtcctcgcgaactgaactgagagcagacaaaagcacgcgctcttctccaccgccacgccggtcctacccaaacccgcgagttatccgtattctccttcaggagtcatagtcaggccagaagagtgcggagggacggggcccgggaagagcagggaacccccagagcccgcagccaacgcggaggtgggcgagcgggcgtgcgcgcactcacttgccggcgcgagggagtgtcgggggggaagggagtggtctccaaaagggggaggggagaaggcagggggcggggagaagccggccctttaggacccggctgcggcggcgagggaggaggaagaagcggaggaggcggctcccgcgctcgcagggccgtgccacctgcccgcccgcccgctcgctcgctcgcccgccgcgccgcgctgccgaccgccagcatgctgccgagagtgggctgccccgcgctgccgctgccgccgccgccgctgctgccgctgctgctgctgctactgggcgcgagtggcggcggcggcggggcgcgcgcggaggtgctgttccgctgcccgccctgcacacccgagcgcctggccgcctgcgggcccccgccggttgcgccgcccgccgcggtggccgcagtggccggaggcgcccgcatgccatgcgcggagctcgtccgggagccgggctgcggctgctgctcggtgtgcgcccggctggagggcgaggcgtgcggcgtctacaccccgcgctgcggccaggggctgcgctgctatccccacccgggctccgagctgcccctgcaggcgctggtcatgggcgagggcacttgtgagaagcgccgggacgccgagtatggcgccagcccggagcaggttgcaggtaacgcggtctggaacaagtagttgggagaaacttggagggcagcggagaagcccgacgggcggctggaccttacggacggttttaggggcggcagagccgagaccttggaccaaatcaagggggactgttgctagcgggacgcggaagtcaggcccggggaggggaactggagttagagcaagtggaagagccctggcgactcatttggt

SEQ ID NO: 12433 - DNA, 1320 bp, Homo sapiens
ccccactggatgggacctctttgaggctggggactgagtcttttcatcttcgggtgtcctgaatggccttgctaatcagaggggtccctgggcgggcagcatcagcatcacgttggagctcgctagcgatgcagaatttccagctctccagggacctactgcatgggaatctgcattttatcaaggtttcctggcgcatatttgaagttgcgaagctccacccggcagcgcatgggtagctgcaaggggtggctgctcagtggacgccgggttgagggacagaaggaaagttgctggctgcgggctcctccatgctcttctcctctctccccagtgcaagatgtctctgaacgggcagcgtggggagtgctggtgtgtgaaccccaacaccgggaagctgatccagggagcccccaccatccggggggaccccgagtgtcatctcttctacaatgagcagcaggaggctcgcggggtgcacacccagcggatgcagtagaccgcagccagccggtgcctggcgcccctgccccccgcccctctccaaacaccggcagaaaacggagagtgcttgggtggtgggtgctggaggattttccagttctgacacacgtatttatatttggaaagagaccagcaccgagctcggcacctccccggcctctctcttcccagctgcagatgccacacctgctccttcttgctttccccgggggaggaagggggttgtggtcggggagctggggtacaggtttggggagggggaagagaaatttttatttttgaacccctgtgtcccttttgcataagattaaaggaaggaaaagtaaagtgtgtgtcttttgcctgagtctttggggtcttccagggagagatgcagagcctggcctaggttggcctacccgccatcatccagctttgcccctggctcctaggaaaatgggaaaggccgtttccgtttcccattcatgaaatggcaataagaaggaatgggaacctcctgaatccagatcaaaccctccagtgcagccccaggactcccaggtgaggcttctgcccccatgtggcccctgcctggcgctgtacaggggcaggatgagtcacgggctggggatggggagatgtggagcgtgggtccggcttcctccctcgcacattcagataacactgcagtgggagataaggaacaggaaacgttgggattggggttgtctggcccctgaaataaaggaggctccctcctgcccagggtgagacatttccactcagcccccaaagaaagggagtagggctgtggttaactggcttattcataaggat

SEQ ID NO: 12434 - DNA, 1226 bp, Homo sapiens
cccatctccccaccaccacctctgtggcctccatggtacccccacagggctggcctcccctagagggtgggcctcaaccacctgctcccgccacgcaccggttagtgagacagggctgccacggcaaccgccaagcccccctcaaggtgggacagtaccccggacccatccactcactcctgagagggctccggcccagaatgggaacctcagagaagagctctaaggagaagaaaccccatagcgtcagagaggatatgtctggcttccaagagaaaggaggctccgttttgcaaagtggaggagggacgagggacaggggtttcaccagccagcaacctgggccttgtactgtctgtgtttttaaaaccactaaagtgcaagaattacattgcactgtttctccactttttattttctcttaggcttttgtttctatttcaaacatactttcttggttttctaatggagtatatagtttagtcatttcacagactctggcctcctctcctgaaatccttttggatggggaaagggaaggtggggagggtccgaggggaaggggaccccagcttccctgtgcccgctcaccccactccaccagtccccggtcgccagccggagtctcctctctaccgccactgtcacaccgtagcccacatggatagcacagttgtcagacaagattccttcagattccgagttgcctaccggttgttttcgttgttgttgttgttgtttttctttttctttttttttttgaagacagcaataaccacagtacatattactgtagttctctatagttttacatacattcataccataactctgttctctcctcttttttgttttcaactttaaaaacaaaaataaacgatgataatctttactggtgaaaaggatggaaaaataaatcaacaaatgcaaccagtttgtgagaaaaaaaaaaaaaagccgaaaaaaaaaaaaaaaacacctgaatgcggaagagctcggctcccgtttagcattttgtacttaaggaaataaaaaaccaacaaaggatctcacattttcttaaaaagtgaagattgctgtatactatttattcaacttataatttatgttactccttgatctttgtcttttgtcatgacaaagcatttatttaataaagttatgcattcagttagcctgcgtcggcttcctccgagggctcagggaaggcaggcagagggagaggc

SEQ ID NO: 12435 - DNA, 3066 bp, Homo sapiens
ggtctggcttttgcaggcaccctctgacctcagcagagctcctgggcctgctgcctgcacaccacatcgcctacctacaatgccaaagcctcactgtcaccctttctgccttggtttccctagctgagccacgctgcccatgcagcagagggcagaaggcttgcacttgggccaaagggcctaaggtccactggacagttgggaaaacacctgaccaccatttaaggactctaagccagaatggaaaattcaccaggactccattcttaagcctatgcgagtcccctagagagaggcattgtactgatatataaatattatataatatatacatgagacatactgacagaatctgtaagctaataaaatgtaagaaaaggttaaaaaaagaataggtaaattgacaagaagtatttattgtttttccatattgctttattgccttccttggggataaaccaattcctatccttttttatatgtgtaagtaaagcctgaagtgtagggggcctttgttcttgaagcagccagggtctccttgccctggccttggccttccctagactgtgtggggctcagcattgggaggggttgcacatgtcccagcctttggcccccttacttttcagcaagccaggggcccagcagtcagctcccaggatgtgtggggagctgtccctgactctgcaggcctgagcgagtgtgtgagcatgcggggacatgggtgtgtatggcacacataggtgcgtgtgtgtcttttgtattttttctcctccaaggagctgtgtcagtgtggacgttctgtttcagggagttggaaaggagggtgtctgcagaaggtggagagcaggggcagaggccccactggccaccccctgcttcccagagtgaaaccttgtgcctggtgaccaaagtccctccaaagtgctcttccttctgggttattcaagccaaatatctgggtttccccctctcctcattccctagcaaaccccaattatcttccaagataggagatatttcccatccccttcctttgtaaatatctcatctcccactggagagcccaggagcctattcctggcatggatgttctgtccacacttgaggctgggcggtgtatcagacccttcaagcagcctggctggggcccaggactgagtctggggtcagctttcacggtcgcttttcccttcctcaccacccaccacagcccaccttgcatgcatggccagcccctccactccagcctgagccatgtgtgcccctgcgggaggacccattcatgccagaaagctggtaactccctcccagcatccctgcggaaggagtcagtttctgagagtgtgacttttcaaggcgaatgatggggaagggttccccagtccccacagtggccccacctctgggccctgcaccagagcccttctgtgtcacggcgggctgtgcacccatgcacacacctacgcacacacaacactccgcactgcagtatattcttgccaaagatttcctttaaaagcaagcacttttactaattattattttgtaaatgtttatcttcttctgtcttctccctccctgaatctattttactgttgtttattgttgaatctgtgtgtcagccaggagagcgctgtctggccttgaacatgggctgggatgggaaagggtctgggagaagatgggcaacaaagagccagggagtcatggacatcgcagcgacgcagaccccagcaggttcagtcccgtgctgccaccagctgtccagctgggtgtctggagggaagagggcagaggagggtcatgtcccttcagctgggggaggggcccagtgagctccacgtggctttttcccaaagggagcaagagggaaggattgggcgagaaaacaatggagaggggacctgcgaaggaaaacagggaggaagtgagcggtttgatcagcctgctatcacggtgttctggctctcttatttagccaggcgcttaagggacagatacatcacatcctaagtttgggaaaggcctttgacccatgtcatctgagcgtctcctccagtagctctgaaagctgtggacaccaatggccaggattccttctcccctggtttttgaggatccctgggtcttctgagactggccaggagagggatggtggggccagtggttgtgtgaaagcaggaggggcagccctcctggacaagtgtgatccccctataaacggctctcaggaggttagtgagtaggagattctgccttgttctgatgagcctgtgcaggggctccaggggagcatgctgtccagggggcacagaagggtggtgagtgtgatcaaatctagtctcactcccactttttagtctcactcctacttttgtccaccacccctgcctcctggatcttctcccactttttttttcagctttaggacctggggagatcctgtgagtcaaggcagacacccaatcctgcccccacactcggggtcctccaagaggttggggggcagagtcccagagcagccctttaccccaggtccaggccctggaatcctgagactcgcgtttccttggccagtggtaacacaggacgtgtgtgcgcatgtgcaagtgtggatgtatgtgtgtgcgtgtgttttgctcatttctttagggaacttgggagtcggggttggaggtgctgggcaatggaacttcaaattcaatgtcgcccagcagtgaggggagtcgggaggtgaggcctgtaggccaaccaattggtggagtctcagcgatagcccaggtgagaagtggttcacccagaggggcagggtgggggcctcgggcagatctgtccctcttggcacctctgtcctcaaatgtccaaaatgttggaggacctctgttcatatcccacgcctgggctcttgccagcagtggagttactgtagagggatgtcccaagcttgttttccaatcagtgttaagctgtttgaaactctcctgtgtctgtgttttgtttgtgcgtgtgtgtgagagcacatcagtgtgtgcaggctgtgtttccccatttctctcctccctt

SEQ ID NO: 12436 - DNA, 1253 bp, Homo sapiens
ccacggacaacgcctgccacctctttgctgagcttgaccccaaccagccggcctctgccatcgtcaacttcgtctccaaggtcatgctgaatgccggccaaaagagatgaaccctgccccttgcccagggccagtgccatggggaaggggcttgtggggaggggacccatgaatcctgaccactcttgaacccagaaggaggactttgggccaatttcggaggagagaagaaagtgcaacgtggggagagggaagtgaattgcagaggggagggggaaaagagagagagagagagagagagagagagagagaaagatggaggagaagaacttggattcccctgggtagatggaaactgcaaaaacccaaagcctccaaaactaaccaggtccacctaacaccccctccctcccctaagaagatggatgtcctcaaaagagaaggaacaaacctccttgggaatccacattttttgggggaatggaaaagctctgtctccctaactcaactgctttgcaaggggaaatcaagctgggagaatctttttctggccacctgtggggtaggttgtcaaaccaaacagagccaccgtgggacatcaagtggaagaacttgtttgcttgaaagtatctcagacccaaggcacctcaggtctctttgctgtgcctccactatattgtcgtgtgggtgtgtgtctgcacccacatcctcacacattgatctagatctgcctttatccactcgaattataaacagctcggcttgtccttgtcccatgtgtttgtagacacacatgcatactgtccaaagattagggttggtggtggcagtgcagcaggggagggacaaacaaccaagctatgggtgacagaggctctctcctggtgcctgcacctgcactctagtgaccctgggtgccgccagacccttctcttctacaaagaccccagcaggagtgggagggtctgcaatggcatcgccctgtcctgccttggccagaagcctggagctttggtttgaggaggtagagatatgtgtatccataggaagagatctgtcagaacaggcagctgttgagctcggggtgtcttccccaaggcatgtggctcagcagcaagaaaggcaagttgctcctgctggggccctggactctgccttagctcccacctctcagccttgttattgggtttcatgcccctggaccagccttatctcagacctgcttacctgcatgatgcctttttgggggctgg

SEQ ID NO: 12437 - DNA, 1213 bp, Homo sapiens
tttgcccccagcacttcctgctcagtgttgggctccactgcccggccctgaagctgagtgttggtgaggctctgccccaaagcctggggtagaggtctttctgtcagctccccttttccccacctcagggtggtgagaggaggttttaggatgcagggcatgggagctcttagcttctttctctggcagagtggatgatacccctgcctcccgctaatgtctgttgtctgttgtctcccctccggctctgtcccttgcagaggtggtgggacacacgcaggggccactagatgggagcctgtatgctaaggtgaagaagaaagactccctgcacggcagcaccggggctgttaatgccacacgtcctacactgtcggccacccccaaccacgtggaacacacgctttctgtgagcagcgactcgggcaactccacagcctccaccaagaccgacaagaccgacgagcctgtccccggggcctccagtgccactgctgccttgagtccccaggagaagcgggagctggaccgcctgctgagtggctttggcttagagcgagagaagcaaggcgccatgtaccacacccagcacctcaggtcccgcccagcagggggctcggctgtgccctcctctggacgccacgttgtcccagcccaggttcatgtcaatggtggggcgttagcatctgagcgggagacagacatcctggacgatgaattgccaaaccaggatggtcacagtgcgggcagcatgggcacactctcttctctggacggggtcaccaacaccagtgaggggggctacccagaggccctgtccccactgaccaacggtctggacaagtcctaccccatggagcctatggtcaatggaggaggctacccctacgagtctgccagccgggcggggcctgcccatgctggccacacggcccccatgcggccctcctactctgcacaggagggtttagctggctaccagagggaggggccccacccagcctggccacagccagtgaccacctcccactatgcccatgaccccagcggtatgttccgctctcaatccttttcggaagctgaaccccagctgcccccagctccggtccgagggggaagcagccgggaggctgtgcaaaggggactgaattcgtggcagcagcagcagcagcagcagcagcagcctcgcccacctccacgccagcaggaaaga

SEQ ID NO: 12438 - DNA, 1261 bp, Homo sapiens
acttatatgtggatgctgagagaatgggcctgtttgggatcaggaatagtgattgacctcacttgcagagatggtttcattcgtgtgaattataaaccagccctgaggcagtgttctacttgtttccagaaatgctttgagctctggtagcattgtgaggataaatgcataaaattcccagggaaccagtttgatggggacagtgctcacttgcctgctggagtttgttataaaccagcattgtgactttattgtcactctccactccttttttcttgttggatcttctaagatctaaacctttgcctcctccatctcctttcttgtttctccttcctttctgggaagcagaaagagcatgaatgtcagagtcagactggcaatgtaatcctgagcaagctccaacccctgagccttagtttctttatcaggaagatggcataacaatatccactttgaaaggcagttgtggaaccaagcaagggaacttccattaacgtgcaggcacatactcaataacatgcctgcctcattccattctaccctctccttcgcccttgctcccaaagccccatataccctctccccattcagtgaggactgccactgacatggtgtccacgtcctgggagcagtaagggtggggagaagcagaagcgcggtgagtggatatgtcccgaccctcatccaacacaaacatctgcctgggagttgacaattcccttcctgagtaatcctctggcactagggctcctgtcctgttcttagggaacatgctcctgggcctggccctgcccactgccttcctgggatgggaagtgtgaagaccctggaaggctgaggccctgccaggggtgcctgaagcttgtcctgctccgatggccctgtcttccctgtccactgggctgggaggcagggaggaggtcctggggaggtctaaggacatgttttcatcacatatgcagctgctgtgcccaccccaggcagcgggcccttcctccctctatccccagacgtttgaaccttgacaccatgcctatcttgggagaccccttccttctcctgtcctgactgctccctccagccatgtctttctcttccttgatggctgtccatagaaccagaagttttagagttcaaagcttatctcctcccactcattttaccacgttggaaactgagtcccaggaaaaggaaatcacttgcccaagtttaagcagtgaagtagtggcccagatggggttgaaacccaagactcttg

SEQ ID NO: 12439 - DNA, 1117 bp, Homo sapiens
tcagtcatgagggagaggctgagactgattttccccatcggagtcagctctgcttctcccgtgctgggggcttcctctaatcccctccatgctggctgcagagatgtcggcccagtgctaggcactagggccctagaactgagggtgtgctggaggagcccaccctagggcccctaggtggtgggcttgggtcccccagtctctgcaatcacatgctttctgtttacagagatgcctccctggtggtgaccacgtcaggagaccacaaagcgaaagtattttgtgtccaaaggcctgaccgttaatggctgcagcccctgcctgtgtgtctggtgttgaggggacgaagggacccctgcccctgtctgccagcagaggcagtagggcacagagggaagaggagggtggggccctggatgactttccagcctcttcaactgacttgctcccctctccttttcttctctttagagacccagcccagggccctcccacccttgtccagacctggtgggcccttcagagggaggggtggacctgtttctctttcactttcatttgctggtgtgagccatggggtgtgtatttgtatgtggggagtaggtgtttgaggttcccgttctttcccttcccaagtctctgggggtggaaaggaggaagagatactagttaaagattttaaaaatgtaaataaaatatacttcccagagacagagtctgtgtggattttgtgatggctggaccctaggaggagctagcgagggccccgtcagggcaaggctgtcccgcagaatcggctggatgttgagatgtgccagctccccatctccaggggtggtctgtgcgcacgacacttcttgcctgcctggagtcggactctgccttaatccacgcgtatgtctgtaggttctttctattgttggtgtgttgagccatttcctcctgcctcgccctgagatatggaatgagataatcataaacggccagaggagctttattcagtcagtgcggggtcaaacagaggcagggtctctgatccagagaagtggggcccggtagagacaggctggatggctgagctggacggatgctctggtaggagtcagcagaggccctt

SEQ ID NO: 12440 - DNA, 1096 bp, Homo sapiens
acacccccccactggagaccctaagcttccatggtgatgaagagattatcgaggtggtagaacttgatcccggtccgccggacccaggtgagaactgccgctcctcaggccatgggacaggagacgctcacccctggcctctgactcctgcttttccccgctcccctccacacccgactggtcattcctaccgatatccctcttcccctcctcccccactcccaccctcacacttagttctcaggcctggctggggtgggggttccctgacgcctcctctggcccttcccctcacacacccccttcccatcatccccttggccctcccttaccgcacggtctctggccagccgtggcctcccgtcctgtgtcccgcgcgcccccgcggaccccggtgtgtctgactccaccttcccttctcgccacatgacccgccccagcctcaggcctcctcatgcttctctccgtacctcttaccgcctcccgagccccatcttctaaccctctccccaaagcagatgacctggcccaggagatggaagatgtggactttgaggaagaagaggaggaagagggcaacgaagagggctgggttctagaaccccaggaaggggtggtcggcagcatggagggccccgacgatagcgaggtcacctttgcattgcactcaggtaggtctttgaggcgatccacctcaaatcagtttaggtgggcgtgtaagcattaaacatcagccatggacagaacgttatgggggacacagagatgggcaagatgctggccttgcgctggaggagcccacaggtgggaaagtgtggcagaatggatgattgcttggcttctggcatcagtcgagacaccctctactttgccagttaaccttgattaacctcttagttttcttttaaaaagttatctttggccgggcgtggtggctcactcctgaaatcccagcactttaggaggctgaggcaggtggatcacttgaggtcaggagttcgagaccagcctggccaacatggcaaaacccagtctctactaaaaatacaaaaatttggctgggcatggtggctcacgcctgtaatcccagcacttt

SEQ ID NO: 12441 - DNA, 1234 bp, Homo sapiens
tggggacggaggagctagggactaactgttgctcttggtgggcttggcagggactaggctgaagatgtgtcttctccccgccacctactgtatgacaccacattcttcctaacagctggggttgtgaggaatatgaaaagagcctattcgatagctagaagggaatatgaaaggtagaagtgacttcaaggtcacgaggttcccctcccacctctgtcacaggcttcttgactacgtagttggagctatttcttcccccagcaaagccagagagctttgtccccggcctcctggacacataggccattatcctgtattcctttggcttggcatcttttagctcaggaaggtagaagagatctgtgcccatgggtctccttgcttcaatcccttcttgtttcagtgacatatgtattgtttatctgggttagggatgggggacagataacagaacgagcaaagtaacctatacaggccagcatggaacagcatctcccctgggcttgctcctggcttgtgacgctataagacagagcaggccacatgtggccatctgctccccattcttgaaagctgctggggcctccttgcaggcttctggatctctggtcagagtgaactcttgcttcctgtattcaggcagctcagagcagaaagtaaggggcagagtcatacgtgtggccaggaagtagccagggtgaagagagactcggtgcgggcagggagaatgcctgggggtccctcacctggctagggagataccgaagcctactgtggtactgaagacttctgggttctttccttctgctaacccagggagggtcctaagaggaaggtgacttctctctgtttgtcttaagttgcactgggggatttctgacttgaggcccatctctccagccagccactgccttctttgtaatattaagtgccttgagctggaatggggaagggggacaagggtcagtctgtcgggtgggggcagaaatcaaatcagcccaaggatatagttaggattaattacttaatagagaaatcctaactatatcacacaaagggatacaactataaatgtaataaagtttatgtctagaagttaaaaccctgtatggctccaggagtatgtgtggctctgcccaaagtatccacttcttccttctgcattctggcttgggctgtcccaccttttccaaggtaatcaaatacactttactgcagcagtttccggggacgg

SEQ ID NO: 12442 - DNA, 1101 bp, Homo sapiens
gggacagaatgggagaatgtctgtagctgagtaaagccctgcagggaattagtttcccctgggtggagactggttctctgatacagtgactggcaggactaggttatgaaaagttaagaacagctaggtgagtgggtgggtgaggatcacaagtcccaggctgcatgaaatcccaaagggcagcctaggcgaagaagtgttccgtgggaaagagcagccctgcgtctaccaagcctggggcctgcagcccgaagattccacagcccctcccttcaggtgtcactgtgtgcaacggaggcctcggatgggcttggtcagggggtgaccagttgggcccagttcccagtgaggagggaatagatgcctggggtgggtctggaaagtgcacagtcagggctgacggccagccagagcattacaagctggttcccacctgtctgggtgtgccttatgccatattgtgttatcctggcaccttgtgacataccctccaacccccacccagggcggacctttgagggcaatgcagagaccatgctgagctcactggacactgtgctggggctaggggatgacacccttctgtggcctggtgagacacccccttactactccccatcctccagccccacgctcagcctgggacaagggccttcccaccccctcactcccctagaaagcaggccagcccagttcctggcccagaagcgacacagctccacctctaggggtagggacagagttctggcctcccttcttcctggagtgctggctccgtaccacctctgcttctcacactaccttcccctgccagtcagccttcagcctcttgggagccttgcaggccccagggcattccagagagatgtctaattgttcatagccttagcccagaacagaaaatagcctttgcttatctggggagaagtcagtaaatccactctgcatgtaaccattgccttgtggtgcataaaaacattcacagatatctgttaatcctcagaacatatattcattcattcattcattcatcaagtactttatgtgcacctaacacataccaggctctgttccaggcaccaggaacacagcaggtacatc

SEQ ID NO: 12443 - DNA, 1188 bp, Homo sapiens
aaaagggcccctccttgccaggggagagacagccacggtcctctttggccgatgctgtattctcattttggcccttgttcttaggcccgtctgcccgccttcctccatctaacctttcctgttttatccgcagcccttttcttctttgagttagtaaagatttattctgtaacctgacactcatctggccctttgcagtttgccagccatattcccatgtgatttcccactggatccaggcccccatccggctggcaggagggggctctgacgtgcaggttggaaatcagaagtctgtgagagcgcgggagtgcatggcagctctgggtcccagacctggcccgacccctctgcttcacctccagctctgctgctcctctactcttgggtcgagatccctttggagccacagcgaggaaccctgtggtcctcaggcaggtgtaccttgagtcagccaggagccctcttttcctgtgtcaaagcctgccctcgggctctgctcacctctggtgaccctccaagatgcccctgccctcagtttcccctcatgatctggcctctgcccccttctctagccacagcctctagtacactttagcaataccaccagactagttagagttccccactcaccaagcaagacatgcagtttcatgcctctgtgccttcgctcatgctgtttcttccgactggaatgccttcccctgctcctcctgccttgtctgcctggcaagttcatctctcacgatcccctcaaaggccccctcctccaggaaggcaacccctgtgcccctcccctccaggctacctctgcactttgtcaatgcttctcttgtggcacttatcacactgtattttacttgtttacatgtttgtctccccttctagactgtgaatccttaagggcatggactgtatcttatgcatctctgtatttctgcgcctagcacggtgcctagcacacagtaggcgctcaataaatgttgaatgaatgaatgatttaatcaagacttgatcacccaacagcttgtctttgttgctacatgagtgaaaacagcagagaactttctcacagttttcccatctcagttccaggcctgctaacttgcagttaggcacttcaagagttttgatcagaaatgatgcccaaaggctgggcgcagtggctcacacctataatcccagctc

SEQ ID NO: 12444 - DNA, 3299 bp, Homo sapiens
cattctttgaattataaatggcctcagcagttttgctcaactactgataaatgctttgcctcctaccatctacctatataccttattgtaatgaatgttccaaaatggtagagtggtagaaaacgccagagtagtttagagcagaggaaaatatttgttttaaaactagctttaaagttttgtttcatttctaccaggagcctctttggtttggtttgattttgcttggaaataattggttttcttataaatgagtgaagcggtgataaaattctttggctagttattaattcttttacgtgtctttgcatttgagaggcactgttaaaaattattgggaaagatttaaagtgcaggctgcaattaaaacatggagaaaagtagaaataatgccataagtctagattgcctcatgaagcagcctcatttgaattgctttcatagctttcatgtgtgtatggtttagaagtacacttacctcagaaacctgatttgatcttcatgtcttgggcaggagttgttgaaaataggttattggaatatataagttatctcactgctcatgtacttgcatgtttgggactcaaattttacttgatgtctgtccattcttgtggccctatcagccttctccttcctttactcctttaatctacttctttgactaccagtggagatttcagctggactatgttgatggggtttgttgttgtttttgagctggctgtatatattttaaaattataaatagataatatattattttttgcacattgtgatcagtttgcccagaattggggatggggcagttagcatgttggggccaggaagggacaagttagataaggactgagtgcttccgttgcaggcagtttgcacaatacctaattaaccttcctattgaaaataccaaatgtgtggttacattactttaaatgacattgaattggaacttgatggcaattagttctagatacaaccttttgatctttgttggaattttaagggaaaaatgaactaaacttcatatttgttgattttaatcacctaatagtactgaaggttggaaagttgcatgtggctggatgctgttaatttctttaatagccatgactataatttaagcctatgagaagatagactgtttcgtagggatatattcacatgtgtgtgcacactcatgagttttgtctcagcaggatagaataagcaaatccatgaactggtcttctattaatactttgattctaaaaattatttgtttacttgctatggtctgttcattctgggcctaaccttaaaggctcaataacaaatacaacaaatgtaaatatgtttacattttaagacatatgcagtggttcttacagatcagttaattaactccagaaagcaaatgttagactacacatttatttttctccttgatcaagtataaaattctgaaacagaggctttaaaatttaaaacctcagcaaaataatccatgaatttactgattcttctgtatcgtgtgtagttaccattatgtaactatacacacatacagctacggatataatgaaaattatctgcaaacacctaaattaaagagaaaaaaaagtagtttgtaaactcatttgtgatctactgaaaagaggttatattaaagcaaattaaaatattttccttctctgtcctctgaaatgactgcagtagatactcttagttatcccatttagggtggttggagggcctttttaatttaattgaccccccgaggtggtcttttgttttaaacagggggcaacagctggatctccaagtacatatggattttgtatatataggagatttttagaaaaatcaacaacctaacaccagattcaagtcacataaaagtgttccaataaaatggatggatgtctttttcctccccattttgctttatactgagtaatgcactcttgcaagtgtatacaaaaactaaatagacttctgccctccaacatctttttattgcattacttcaaaatcctaattttgtctctactgatatgtcttattaacatctgaaaaaatatatattttttattggaaaattctaatttgttaggccttgaaagttttgtgacaattattttgctgtgtttaaccacaatcattcaccttatggcatgctttgattactagacttcaggcagtctcattcattgtatcatacttacacacaattagtaagttgtctccatgtgtgctatatgtctgaggtgtatggagtttttatttaaaaagtgtgccagtctgaatataagcatttgattttgtaacattggacttttcttaaaagtacagaggttcaaagtataggtatgtccattggcataagaatagagtgggtgagggtctggaccaggttccaggttggtccagtcagatgccagaacaaagaagaacagtcaactaaactggtctacttcaaaaatagtgggcctgtgtgaagagtgagaccacatgtgggtgtgcacacctcttgtccccaggtttccctccctttgagcttttctttccctccctaacttctctggcctattgtcattgttgtttctttaaacttaaggagagaaaaacaaaaatgagattcctacactttgcctaattgagccactaccaggttttctggcagctgtggccacattatttgtgagatgattttttttctttatgttcagagtgacttttgattctgattctttatgttttgtatggagcggcacttttatctgtgttttagcagaactgttcctctgtatcctttacggtttttctttgtttttgtttcctttttaaattatgcatagagtttttttgtgtgtatgaaattaaagcctttattaaccttctttgatttgactgttatttctgaaaaggacacattcttgctgatacttgtaacaacctgttcaaagttgtggaaatcaccttctgttggctttctgacatggacttccttgcagcactgttacttcttaaaaggaacagaatggcaaaccagtgtctggccgtagtccccattgattcctgttattttcatctgaggagcctgtgaagctttgcagaggcttctgggtaagtttgtaaacctagcattggccttcactaggctcttgctttgcctcattattaagggttgggagagggagtgaagtagcatatgcatttcatacttgcctttaggtctcaagcctagccccagtggaagtgctgctctcactggtactgtttggaatttgtgaaacctcttaagagggtagtcttgt

SEQ ID NO: 12445 - DNA, 1296 bp, Homo sapiens
tgctattttatggaaactttggtctcacatccgtagctgattatcctctttttctcctatgagtggcacttcttttgtcttaggaatacatgttgtaaatatatatctgtgtatgtgtgtatacacacacacagacacacacacacacacacgggatgaatggagccttaaagagttaggatgagccaccagaatatgcctgctcaaaattaatagcacagcagtttggagaagaaatgaaggtgtcaaagagtccattcacctgagaaatgtgtgaagacatacttatcagttggcttttagcttttatgttccttgagtagtttcactcaagtctgtaaccttttgtgtttccttattagtaaaattcactggaaagccagctcttcatgttacactaatgacagtttgttctctttgcaagagaggggcattactgtcacctgacttgaggagctgttttgttgttgttgttgtctgcaaatttcatgaatttgtgatgtctttgctgtttacatgcagtcccaagaaatggattgttggtgctttggaatatgttacagtcccacatttgatatttcttatatactttgttttctctaaggagatttcttcacacagtatgttcatcatatatcatcatcattattatggtggtaaagatagaatcttttttcttttttgtcattctgccatggagcagcattaccctaatggattgcaaccaaaactttaaacaagtagaaagataatatttctccaattgggactccccagcaggaatacttagggataaggaagaatgctagcatctctgtctctcaaacatagggaggataagaagagtgttcttctggtaaagctaaaattctggaccactgaagctaaaagccctattgcaagtatgaaattaagtacttgagctgtaggacaaaccttgggcatttaaccatttactgtctggctttgcccttaaaatagggttgcaattaaaatgtgattggcttaggtaatcccaaaaactaacaaataacaaaggtgcataatttatttatctactttttaggtgctctgagttgaggcaaagtagagcggcaacattaagtgctatgctagtcacttagctgacgtaaccagcttggttaagcagcttatgaaaccatataaagaattcttttgaggatggaattctgtccacaaaataattttgtgagcccagatatcattaggatcacacagagttaaatatagaaaaatgaaaccatcattatattctttcgtgttttttcttttatt

SEQ ID NO: 12446 - DNA, 1214 bp, Homo sapiens
caactattgcgcatgcccgactgggttgcgtaggagggaaatggtgggggggcgtcgaaatcgggtgaggtggaaagtgcgcgtgcctactacagtcacggcaggggcggggctgcccgggctaggccgctctaggtactggcggggcggggcgagggcgtgtgaggggcggagttttcgactgacgcgcacgcgcctgtctggtcgcgtcgagtgtgcgtgcgtgcgtgcgtgtttgcgtgtggtcacagttcccgccatcagccgctctccctgactaggggtagctagcggcctccctcctttgggttcggtatccctacttccattaccctcggctcctcccactcctcgcgggctccgtgctttccgcgggtctgtccgggggctccggaccctcggcgcaggtaaggcgggccggggtagcttctcaattgagccgttttccctacctcctcctccttctgtgcgatccgcccactcggcgttcactcctctggagttcgccctgctgctactcagcccgcccacaacccctcgatgcacccccagcctcacaggtactacctttgggtgcactgccccggcttccacctctcctttgacttggtctccactgccactcgctccctccgaaactcaaacctggccccttttctctggggctgttgtcgttcgcctcttaccttctaacagggcctgctgtctcttcaggtgactttcgttacggcacatccaccaggccttggacatgatactcattcactctcttgaccatcttcaccttcctcttgaccagtcctcactgcaaaacatgaattgtatttttgttgtgcatttccttgcgcccatttctagccgccagatcaggttgttagatgtaactattttaagtcatgatccatgaaaggaaatgatgattgatgataaaatcctgtgtcctgaagagttgtcctaaagtggttttggggtattcctctcaaaatttcagctctgtataaattcctttattgaggtggcaattcctgacaagtgtctaactggaagagatacctgagagggaatgtcaagtaggcagttggatatagtgggtttggagatcttaggagagttctgggctgcgtacgtaaatgtgcgcggtgtgtgtatgtgtttgtcatctgccatattgatagtaattgaagccatggatgtggatgaaattgccgaaaaag

SEQ ID NO: 12447 - DNA, 2431 bp, Homo sapiens
gaacctgcaagagggccaggtcaccgatccccggggtatccccctgccccctcagtgatccttccctgttccctcccactactcccccaagttggggaaaggagggggaacctacgagaaaaacagctcaggttttatcaccgactgggaatagacaacctcaatgctgaaccgcactggagaaaaggggcaaggtacccctgctgaggtgtatgggctgccatctcaggctgtcttgaggacctgggctccctctgctactcccaggaaatgggctcctgacacagcagtctgccaccacagccccaggagggtgtcaacaccagcaaatgctgtatttgcagcatgtccaagatgacccttctcccctacctctacctagccactggcagggaggggagacagtggtgatagcagcagcactctaggcatggtgaacgcctgggaccaagccatgtggcgttttttattttgcctttctggaagactcaagatatgtctcttcattctctctcagtatttgtttactttggtttttttgtttttaatctcagagagaggtgtgtttagtgggcacaagctgtaatattcagcaaaactttgtcgactggcactgtttacaagtctgttagctgcataagctcaataaaaagttggtctgggcattacatcccctctggcaggccaatagctgcatcaagctgttgggagaaatgggagggcaggggaaagatgtaaagccaaagtacagcaggaacccaccacctgtttcccttccttctcccattctactcccagtccggaatgccacgaggaccttaaccttgtttctggctttagctgctagttttcccaaatctcagtgctttccctttttgaacttcccttctattaaacttaaaacagatgtcttaattaatcaggctgtcttggaagggtattgtattgggagacaaggggcggtggtggacctcaccttcaatccaagttttcaaagatattttctcaataactctaaaagggaggtgcttgggattaaggtgacagtccacttgatccttttctttgttttagtgtgaatttcagcagctccatctgtcttcatgattgtacttgagcagtattagctgtatgagttaattttattcagattgaagatggagggctgggttctgctcactcagtcttttttttttttttttttttttttttttgaccattctcttttagtctatgggaattacagggttgccgctaaaatattcacttgttcatatcgtgtcagagatttcctcttctctggagcttaggtggctcttcacaatccataggcttgaatctgcaacctagtgtaaactgccttgctttccccggttctttcccctgctagcacctgctttctcatccctatctccagtcaaagatgggattgcttaatccaactctggagagggaccaagtcttttctgcccacatctcacacaattgaggtgtctgaacaagcttggggagggtctataaggggtaggctcaaaaaaaaaaaaacccatttgcagaggcagttttgccaacacaagggctctttcaagccgactttcacaaagagagccggacttgttagttggcttctgtctctttagagccaagaaaatagtaattaagtggcctagatataggaagggcagaataagcacttactccccctgccttccaagatgaagaggagaagcaggccaaccctcaataattgcaagcctgaagagaagtgatcttagagaaagcagagaacagaatggactggatagacatcttgactctattcagcccgtagtctgtgatctggagagtccagttaaggtaacccagatttttgacaaccgccttcctgctgagccaaagttttctcattacccctccactggggaagcagctgaggcccagggccttgctccctgggaaattctcttctctccatctttcggtgcattggccatgttactgtgccaaagtgtcttaattcttgtcccatctattctcagctggccttggaacccacataggagttggtgggggagggatggaatgggtattattcattgtagttgatcctggtgtgtgtattatataaagagacccctccccttattttgtgttttccatccctctcccttaacaggattgaaataaaacatgcttctgtttttgtaaaaataatttttcctttacactggagattttattctatcagtatatgggtaactaggcactttggtcaggtgatccttgtcatgcctgcttctcccctctgtctacctacacaacacacacacacacacacacacagccctgctaagatggcagtagtggttcttttgtgaacatgttttttggggagactccatctgaggtacaaaagctgtttgggaggctg

SEQ ID NO: 12448 - DNA, 1214 bp, Homo sapiens
gggaaatgaggcacagaaacctgccctgtggagttgtagccacgtcagttccttggaagtctacagtgggtcatgctgattcatgattactttcttttaggaaggcagtacagaatagggcttagaacacaggccctgaagctaggctgtctctgctcctggcttactttgtaaccaaccttaggcaaattattaacttctgtgatttagtttttctcacttggaaaatagagataccagtttcatagggtagtgaaaaggagggttacatcaggtgacacatgtatgatactgagtgcagagcctggcccacagtaagtatttactgactgattcttagttgttgtgattaattattgtgattgcctccccctttccctccttgccaggtatcagtgcaaccagtgctcctatcgctgtcaccgggctgatcagctgagcagccacaagctgcggcatcagggcaagtctctgatgtgtgaggtgtgtgccttcgcctgcaagcggaagtatgagctgcagaagcacatggcttcccagcaccaccctggcacaccggccccactctacccttgccactactgcagttaccagagccgccacaagcaggctgtgctgagccatgagaactgcaagcatacccgcctccgtgagttccactgtgccctctgtgactaccgcaccttcagcaacaccacactcttgttccataaacgcaaggcccatggctatgtacctggagaccaggcctggcagctccgctatgcaagccaggagccagaaggggccatgcagggcccaacacccccaccagattcagagccctcaaaccagctgtcagcccgacctgaggggccaggtcacgaacctgggactgtggtggaccccagcttggaccaggccctgccagagatgagtgaggaggtcaacactggaagacaggagggcagtgaggctccccatgggggtgacctgggtggcagtcccagcccagcagaggtggaggagggcagctgcacactacacctagaggccctgggagtagagctggagtctgtgactgagccaccccttgaggaggtcactgaaacagcccctatggagttcaggcccctgggactggaagggccagatggactggaaggaccagagctatctagctttgaaggtattgggacttctgacttgagtgctgaagaaaatccccttctgga

SEQ ID NO: 12449 - DNA, 1245 bp, Homo sapiens
ttaattataggaaagttacttaacttttctgagtcttggattcatcatcagtaaactgaatgtaaggttttttttaggattaaatgagataatatggataaaatgcctagcatggtaccagacattcattaggtgcccaaactagtattcaagtttgtttccccttcatttactgtgcttttccagtttgtttactcaacagaatattgagcacttcctgtgtatcagtcactgtgttggggacatcagctggaggagaatgtgctccttgctcctagtgtgatgagttagttcattgttgaagctaatgttctgtgagcagtgatggtggcatgcgcagaggtgaggcatcctgttcaaactcaggagtcagggaagactgcctaggtcatgttgcagctgattttttaagttgggtgaagaagaagaaagggctccaggaacagcacttgtaagggaatgaagagctgagctagcatgatgcacgtgggaatcaatagtggggctgtttttcagggggaccagcctgagttttcatttccctaggcattctcctaccactttggtatgtctgttgtgttgcattggtggggaaaatgtggcttcccgaaagaggattaagtgacgggattatgaattattttgagtgtacttaatacacatgcatgcgtgcttgtagtctcgtaaagtgaatggcaggatttgacttttccctttgtctctatgcttctctaccacaaacacacgctgtaattgttccaagcacggtatttccatagtttggatttgtgtggtggtccattttctgtaacctcattttgaggtgactggcctcaaaatccagttttagcatttatgctgtttttagctcattatcattttgaatattggcagtgctgcattgtgattttttgtactccccttgagaaagagtccatgtaggtcagcctttgcaggtaaagagggcgatatcccatggcttctgcagtgtttgttggtggtattcattcgtggctgtagacaggaatcttagttcttccttggccattacactgttaatcagaatacaaggtactctccccatttttgcattttaaatataacttaagcgaaaaaaccatctctcctagggctgggttcagtggctcaggcttgtaatcccagtttattgggaggctgagagaggaggatcgcttgaggccaggagtcgagaccagcctgggcagcatagtgagataccgccac

SEQ ID NO: 12450 - DNA, 1208 bp, Homo sapiens
cacgtatgcagagccgctttggcaagaaggagttcagtttcttcccccagtcctttatcctgccccaggacgccaagctcctgcgcaaagcgtgggagagcagcagccgccaaaagtggattgtgaagccagtgagtgaatcacagtgggcaggagactatggtctgtgagtgggaacaacagagtattggacctggagcaaatctcatctcctttctgctcctagccagcatcagctcgaggcattggcatccaggttattcacaagtggagtcagctccccaagcgaaggcccctcctggtacagaggtgagcctgtagcacatatcccttaccccatcctcccacctccttggcctcgaggttcccttcttacaatgttctgccctttgttctcccagccaaagagcttccttagccaactgttctaaggtctttatcttggggactgttagctggcttttcctgtggcttggttacccactgagccccatcatctggctgtatgagaagctggcctttgtcctatgtaggtatctacacaaaccctacctcatcagcggcagcaagtttgacctgcggatctatgtttatgtcacttcctacgatcctctgcggatttacctcttttcagatggactggtccgctttgccagttgcaagtatgtgacagtggtgaggtatcctctgacaatattggggattttattttccttggagggagggaaactagaagacaccaaacagaaaaatagtttttgttagcaaggggaaaggcaggaaatgggaaatatggaggctctctacttcgttaaatctggggagggtcttcctgcatgcgggactgaggtgggataaaggagatgagtttagctgtggtttttcagaactttgccagtagacacacttctcaggctcttgtggctatgaaaagatctgtgtacttgttctacacctcttcaggatttggggaaatgtttggccccttctccatctgctctgttaccatcttacctctgccttttgtttccttacttccaggtattcgccttccatgaagagccttggcaataagttcatgcacctgaccaactacagtgtcaataaaaagaatgccgagtaccaggccaatgcagatgaaatggcttgccagggccacaaatggtactgagggcagagtgtcccagtccagtgaaggcctagaggaa

SEQ ID NO: 12451 - DNA, 1094 bp, Homo sapiens
cactaggctgccctcagtagttccatgagagtcccggagctgtaggaccccaggggtgtgctccctgttccccagcttcttgagtctctgcccctggcttacactctctcacaccctttttctccctgttccttggaccacaggacttctatgcatctgtgctggatgtcctgacaccagatgatgttcggattctggttgagatggaagatgagttttctcgccgtggtcagtttgaacgaatttttccttctcatatctcctctcgctatctccgcttttttgagcagccacgatatttcaacattctcaccacccaatgggaacagaaataccatggcaacaagcttaaaggtgatgtgccctccctgccctcagaaagccaagtttagtgagagattaaatcccagtataccaagaaatgggcctctctggaaagaattggccaattgattctaccttcttaaaccccaactcctgctaatcttgtcctaggagtagatctgctccggagttggtgctacaaagggttccacatgggagttgtctctgattctgctccagtggtgagtgctgccagtgtggaggacagctccttctcaggcccctccctcctctgccttatgagtgcagcaggagttgggttggtatgtataggcctctctcacttctccgctaggctctgcttctgtctcaccattctttcctttcaagggaatagttgcctccaggattccctgggtacctttctttcaaggatcaaaaagtgctttgtaggcctcaacttcttgtttgattcagaagagaactgagacttttacccacctgggcccatgcctgaggggtagggaaggggagaaccccatgatccatttagaggtagagctggagggtaccaagaccccaaacactcctgccttgcctccgccaagccttttggtctcattgcttcctttgctcttagtggtctctcccgacatcacttctgactatctcaaaggatgacgtgatactcaatgccttcagcaaatcagagactagcaagctggggtgagtgctgcctgggcaagggaggggctgctggctgtgagttt

SEQ ID NO: 12452 - DNA, 1683 bp, Homo sapiens
cccagttctgccacttactgtgtgaccttgggcatgtcatctaacttttaagtctccatttctttgtagtatgaatataatacctacagtgcagggttgcgaagatttaaaccaaatgtagtgaaagtacgtaggacatagagggcactttgcatggtcacaccttctccacttgctgtccaagccctgtgccctaggtgggaagagacaggcaagaaacgtaaaaccctctcctccaggaggtggagctgccatcgagatattttagaagtgaagatgccagaacagggtctagatagctcatggccctcaccttcaccccagtgcacacacaaacatcaccattcaccctcctattacattatcactcctctggggatttattctttggttaaacacttcacagtcagagcacagaatccctgagaaaggaagcacattaagcattagaagtatgtgaactgagtgggattattaaattatttcaagagaagctttgaaaagaaggggaaagcaagcacagtgggtgtcaggtggctggaaaggggagaagcagggtacagaaaataagagaacttgattggaactggacccaaagagcagatatatggacctaacagctgtacgaaggggcagttgtcattacaggtaccttctcttggtttcaagctgtttggctgagggtgagtatccccctgtcaccctagccaaagtacatacccagtggcttctggggcagtccagtgctgctgagggccagtgaaggagactgatcatctggacacaaagacctttctacttccttctcagctgaattagttacccaagataggtgaccaacaaaggcagacagggatctcctctcctgggctccccttgatttgtcctctaagattaaggcttacctgtgactgttgttcgaatcccccaactgctgtgagacttggaaacactgatggttttcagatggctaagagagctccatttcttgccacctgagattctgaccaagcctttcacaacccttcttggccttttagagttccccctgtagcagagtttgcccgctcattaatatccggggatctatgccagctcatttggcttgccccttcaccagcgttggatcagtgaaagttgcaagcagtcatatgttgctctcggcaaatgttttacaggtgaaaacacaagaagggtcaatagcaggtggtggttttctaaaacccatctgtgtcataattataatagactgagatacatggaatgccagggactgccacaggcaaagctaacagaattttgaaaagatatttaagtttcagttagtaaactggggacaccaaagcctactcagaatagttatgggactaaaatatggaggaaaagcacctaacaaggtgcctgataatatatgatgcagatttaaagtagtggattctaaaacagaccaaaactaccacccagaacatataaagtaaaagcactataacatgcaatagtgttacaatactattacaatagcgtgttaatattaccaaactatggtaaaatatactttgattttatccataattaaagctgaggatgtattgatagttaacttagaaagattaaagcccccatcattagcagtcagagaagagcagtttaaactgcaagataccacttaacactaaagtggct

SEQ ID NO: 12453 - DNA, 1118 bp, Homo sapiens
tgcctccctgcctcatctctattctcattccactatgccccaagccctggtggtctggccctttctttttcctcctatcctcagggacctgtgctgctctgccctcatgtcccacttggttgtttagttgaggcactttataatttttctcttgtcttgtgttcctttctgctttatttccctgctgtgtcctgtccttagcagctcaaccccatcctttgccagctcctcctatcccgtgggcactggccaagctttagggaggctcctggtctgggaagtaaagagtaaacctggggcagtgggtcaggccagtagttacactcttaggtcactgtagtctgtgtaaccttcactgcatccttgccccattcagcccggcctttcatgatgcaggagagcagggatcccgcagtacatggcgccagcactggagttggtgagcatgtgctctctcttgagattaggagcttccttactgctcctctgggtgatccaagtgtagtgggaccccctactagggtcaggaagtggacactaacatctgtgcaggtgttgacttgaaaaataaagtgttgattggctagaactgctgcctccctgactgtgagctgccttccacaccctgcactgcactgtgttctctcctcacccttaacctgcttcactccagtctgttctggctgtttattaccttgttgcaaaacagggccgaagcaaggattaccttgacaaccctagcttctccttagccatcttccttgacagtgtgatctgtttagtgagatttagcatgtgtgaataaagtatatgcaggaggaaattgctttgtcttcccaatcggtagaaattcgggaccataaaaattgtgttttaccatgtggcctacaaccttaacactgctttcttaagaagtcttcacccatctacatgctaacaactcactcagcctggatttatctttactggggaagccaaacaagcaatagaggacctttacctgtgttagaaatgagttggagccaaggaacactgaagaaatagtatcttaacagttactgagtccattgtatgtgcttggctctgctctgagtgatttatatgtattaagatttttc

SEQ ID NO: 12454 - DNA, 1191 bp, Homo sapiens
ccctttctccccacaggtatagacaaggctgagcagggttcctgtggcccaggatggaggccaccgctgccctgccatcccgtctgcctgccatgggacggctcctctgagtgttccctggccccacgtgtgtggtgtttgtgtgtctgtgcctggccaagggaggtgccaacactgggcttgccacagccccaggagaggaatttggggcctaggaaccgagggcacacgggactctagcctcatccccaggacccccttggctcagagtgtggtgctagaaactggcccccagcccagccccagtactgccacctttacacctacccctgcaagtccccagagggctgcccacgatagaagctgccaagcagggagaacctgtgccaactgtggagtggggaggttgggcctggaccctcaacccctgcaaccttccctagccccctcaatagatgagcaggtcaggctgtggcccttacctcacccgcagttctcgcccagtgctgcagccggctcacctctctccgcttcttgcacatcactggcctgtgtgtgctgcttgctcctgttctgttcgcttgctcccgttccgttcggcttttgctttgcgttagggtgaagaccctagcgtccagctcccctcaacgctatattttgacactaaaaaagaaggtttctaaattgtaggagcaggatggaaatactttgctgcccttgccatcttttaggatgggcccccaggagactgaggtcttcctgggccctcattgctgcttatcgtaccccccatcacctgcacatgggacagaccgggctggagggtgaccttggctgtgtgcgtcccagcaaaagagctctggcccgcatctcgctgtgccctgaagggggatgaagggcgatgcctcgcccgaggctttgggctgctgcactgcatgctgggactgctcctactctctgtcccacccctcacccagctgtggtccggctttgggagagtggtgaattgcgctgcccgaactcggagcggagcagggtagggaccgtgtacagcttgataacccttaataaaaagggagtttgaccagacttcttgttgtctcgcgcggctagaatcctgggaacaagagaaatgggatggggactctgccggggtctagaagaaagtatgtttaggccgtcgctcagata

SEQ ID NO: 12455 - DNA, 1178 bp, Homo sapiens
tcctccctccacaggcattcttcagcattgcggcagctcctgaactcgatgatgaccgtggacccgcatcagcgtcctcacattcctctcctcctcagtcagctggaggcgcttcagcccccagctcctggccaacatactacccaaatctgaaaaagcagcatgttgagaagatggccccttgtgccttggaaagaggttcccatccctcattggaatcaccacccattccatccaggacttctcttacacttgggggtagcggggtcaggacaatcatctcagtcctgcatcttttcttctgctttcttccctccaagagcaaaacctgggcaaggggacttactgagtgggggtgggtgggggttgggaaaagggaaactggtgggatatggaacatggctctgagcaggactgttgagctcacatagtgttctgactccaaatctgggagcaggagaatgtgtaaacaagaataaagtggaagcaggttggtgtagatcttagtctcagtgttcctggagtgagagaagaggtgcaaggggcccaaagtcaggttgccatttcaggcgaactgcctgggaaggaggaatggtgcagagtcggcaatggtgtgacttcattctacaggaggttggttagcagtggacagttctagcttgtcttagatcaaaacttaaagctgcttgggctcaagctggcatctgcctgtgtcaagaactagggccccctaaaaacactcaactagttctttccttccttcactcctggggtgagtagcttagtcaaagctgcctagccggtttgctaggcaagggcctctgggtggagacacctgaggaagctttgagacaggtagattacaggtctcccatcctcagcctaggggcgaggggagtggaggtggcagcggcagctgttttggcctgtgtctccctgatcgttcaagctcatacatggttaatgattaatgaggcagtgtggtgtggcagtatccagctgccacttcctgcctactctgctgagtaaacaggggccctgtcttagctgggcttcaaacctgttccctagggaagggctctgttccctgaatcaccagggaggaaaggcaagggcagggttggcatctcctgctcttttgtgatccaagcctcctcccccgaaccatgtctacccca

SEQ ID NO: 12456 - DNA, 2994 bp, Homo sapiens
cacccagggtgcgggggtggaggtggggagaggagccagatgggattgatccccagagccagatgggatttaaaggtgagggaggagggcatcctgatggcgtgtggtcagttgatgccagattggatggctgagacacctctgcagcttacaggaaagaaagagggaaagggttctatgaattctagctgttcatactcaaagcaaataattaatcaagtggggggggggcctctagctgtaaacccatacctctaggaaaccttttgtcatgtggagccacagtgctcacttgacagattccccactgagaagtgggctaagaggttggcctgcattgctgggtgcctccaggtggggagtcctgtacctgggagcccgggcaggctgctactctcttctcacctctgcccagccccaaccctccactcttgccaactgagtcatcctagctggtagatgatagggtggaagagagactcgcaaggtgaggacttgtggatgtggggctcatgctgtgtcccctctctctatccctcagcgtgaatgcatctcagtccacgtggggcaggcaggtgtccagatgggcaatgcctgctgggagctctattgcttggaacatgggattcagcctgatgggcagatgcccagtgacaagaccattggtggaggggacgactccttcaccaccttcttctgtgaaactggtgctggaaaacacgtaccccgggcagtttttgtggatctggagcctacggtcattggtgagaggaagtggggacaaaattgaagggggtggagcatgactcaaagcttctccctggagagagagggtatttagaccaggcattcctagccctgaaaattcctagccgtacttgaagctgcagaaggcaagctgatctgagactggcctgggcagctggtctgggtttctctcacactctggtatctcaggctggcaggaggatgagtccttccatgcatctggccacagctaccaccctgggggaggaaggtccctgctgagcatagctttgtggtttttgcccttccagatgagatccgaaatggcccataccgacagctcttccacccagagcagctcatcactgggaaagaggatgctgccaacaactatgcccgtggtcactataccattggcaaggagatcattgacccagtgctggatcggatccgcaagctggtgagagtgtgtcttgggagggagggaacttttgagactgtgctaatggtcaggaatattttttttcagatcctttcaggaggtcatctctaactatacatggtctcgagtgtggtgctgctatggcatcctcagtatttgccctgactgctgatgtatcttacgctttatggagccaggtgatagagtccctcaggcccctcccctacctaaactgttctttctcgttcttgcctttcagtctgaccagtgcacaggacttcagggcttcctggtgttccacagctttggtgggggcactggctctggcttcacctcactcctgatggagcggctctctgttgactatggcaagaaatccaagctggaattctccatctacccagccccccaggtgtctacagccgtggtcgagccctacaactctatcctgaccacccacaccaccctggagcactcagactgtgccttcatggtggacaacgaagcaatctatgacatctgccgccgcaacctagacatcgagcgcccaacctacaccaacctcaatcgcctcattagccaaattgtctcctccatcacagcttctctgcgctttgacggggccctcaatgtggacctgacagagttccagaccaacctggtgccctaccctcgcatccacttccccctggccacctatgcaccagtcatctctgcagaaaaggcataccacgagcagctgtcggtggcagagatcaccaatgcctgctttgagcctgccaaccagatggtaaagtgtgatccccggcacggcaagtacatggcctgctgcctgctgtaccgtggagatgtggtgcccaaggatgtcaacgctgccattgccgccatcaagaccaagcgcagcattcagtttgtggactggtgccccacaggcttcaaggttggtatcaactaccagcctcccactgtggtgcctgggggtgacctggccaaggtgcagcgtgccgtgtgcatgctgagcaacacgaccgccatcgccgaggcctgggcccgcctggaccacaagttcgacctgatgtatgccaagagggcgtttgtgcactggtatgtgggtgagggcatggaggagggtgagttctccgaggcccgtgaggatatggctgccctggagaaggattatgaggaggtgggcatcgactcctatgaggacgaggatgagggagaagaataaagcagctgcctggagcctattcactatgtttattgcaaaatcctttcgaaataaacagtttccttgcacggtttcttgttccctctgagtgcttgagcttctgctgccttccccttcatgctgctgctgctctgtttgctgttcatgacccttatcccttccatcgctgaaggtgagacctgcaaaggggttcttgccaggcccaggaagcataaccccagggactttaaattgaagtcctagggttactcagtatagggaggaaatgaggaccaaaatccaggcacaaactgttgaaggatgagtcttcagctcctttccaagtaggagtataatccagtggtttctgtctttgaaagttagactgctaccctgttcttcctgctgcctctacatttaccaactctggaagcaaggcttggcccaggctcctctgtgcattatgagggtttgggagtggggctgggctggcccagagttcctgggcatggagccacgtcataagcttgggggatgggagggaacacaggcgatctcctagagttgtttgtgccactgcacctctgagcagctt

SEQ ID NO: 12457 - DNA, 1121 bp, Homo sapiens
tgagtggcacctactgcctacccagtcccccagctgtgtgctgctccctgtaatctgtcccttgctgatggcctgtttctctgatccagtgggagatccagaataccagccatctggccgttgatggggaccaggcagctgcttggcccgtgggtattccagcaccatcccgcccggcctcccgctttgaggtgctgcgctgggactacttcacggagcagcacgctttctcctgcgccgatggctcaccccgctgcccactgcgtggggctgaccgggctgatgtggccgatgttctggggacagctctagaggagctgaaccgccgctaccacccggccttgcggctccagaagcagcagctggtgaatggctaccgacgctttgatccggcccggggtatggaatacacgctggacttgcagctggaggcactgaccccccagggaggccgccggcccctcactcgccgagtgcagctgctccggccgctgagccgcgtggagatcttgcctgtgccctatgtcactgaggcctcacgtctcactgtgctgctgcctctagctgcggctgagcgtgacctggcccctggcttcttggaggcctttgccactgcagcactggagcctggtgatgctgcggcagccctgaccctgctgctactgtatgagccgcgccaggcccagcgcgtggcccatgcagatgtcttcgcacctgtcaaggcccacgtggcagagctggagcggcgtttccccggtgcccgggtgccatggctcagtgtgcagacagccgcaccctcaccactgcgcctcatggatctactctccaagaagcacccgctggacacactgttcctgctggccgggccagacacggtgctcacgcctgacttcctgaaccgctgccgcatgcatgccatctccggctggcaggccttctttcccatgcatttccaagccttccacccagctgtggccccaccacaagggcctgggcccccagagctgggccgtgacactggccgctttgatcgccaggcagccagcgaggcctgcttctacaactccgactatgtggcagcccgtgggcgcctggcggcagcctcagaacaagaagaggag

SEQ ID NO: 12458 - DNA, 1194 bp, Homo sapiens
attgacgatgagtcggcctccttcactgtcaccgtcacaggtgtgggcccagcccagctccccggggtcacagagacagccctgagccctggaggagctggccacatagccccagctagcaccccggggaggagggaggtgtgggctgcaggtgcatgtgccagggttcttgctgagatgagcccagggcccctattcaaggaaacaagcccctccccggtgcccaaggccaggcctagctctgctccacagctcatttactgagcactttccctgaatcaggcactgggagtagcaggtgagtaatgcaaatacggtccctattctgaatgagctgccaggctaggtgaggaggcagctgttaaccaggggtcgcaaacgggtagtcctggggccctgcgcattccacacatgtgctttgtttggtctgcagagtcttaccaaagtcaggacagttcaaataacaatccggagttatgcgtcctcttgaaaaagccgaagacccggcggctctggtcccgcttccccccatggcgacgaacagctggcactgagtagcagctgcccccatagtttggggcccacattcctctgtcccacctccctgccattgctttttgcctctccccagactgcttcagccgctaacctaacctggcccctgtgggcatttgagtttgcgacccctgtgttaaaccaataaacatgcaaataaatgtacagtgacacctggtgataagtactgtgagggccaagggcagagggctcaagagcacagagcaggagggtcagggaggcctgggagaaagtcacccttccacacacgggagccagcagcacgcagacacggccgcttccctctaggactgcacagcctggcaggaaagccagacgcattccaggatcttagagcatgggttgttgagggccagtctagggaccctggggctgggagccaccaccctggccaggcaacaggaagtgctttcaaagctgatactggagctaagtggggtggggtgtgggggaatattcaaagcgggagaagcacaggacaactgtggaagtgacggaggttcagtgccggagacctcggggtgacggctcacagcgcccagcccagtgtgtgtctggggctgggggtccatagggctaggcagctctggggggcacagaaccccagtggctgcactg

SEQ ID NO: 12459 - DNA, 1145 bp, Homo sapiens
ccacgcgcagcacctgtacagtgcccttgcagcaactgtcagttcctggaacctggagaacctctcacttgagggcatagctgagtaacagcctcagtgtgccctgaccctctgggtggggttaggaggcacccaggatcctcagttacccagagcctttgctctcgggcccaggctttctatgaagtggagcagcgtggctgagtcggccctgcctcatcagtcacagaaggagagggtggagccttgtttctgagtagggtgggtgtggggcagtggggggcggtaggcctcagaggtattccagagtagagattcatggagcttgggaaagggagggtcttggccccaggggcacaggctgctttgtgacccacctcagagtgtggttcacacctcttctccccagcagcactgggacgctggccccagggatctgggcccctccatgaccttccacactggatgcctctttccctgcaggcccttccacctgcctcgtatccctgttgctgactccgtccaccctgttcctgttagatgaggatgctgcagggtccccggcagagccctctcctccagcagcatctggcgaagcctctgagaaggtgcctccctcggggccgggccctgctgtgcgtgtcagggagcagcagccactcagcagcctgagctccgtgctgctctaccgctcagcccctgaggacttgcggctgctcttctacgatgaggtgtgtatgtgtatctccagtgagagggagggaggggagatggtgagcacaggttggggccatgagggcagggtgggaaatgggtctaggaaccctgggcattggtggcaggatggcacttacagatgagagaactagggttggaggaactgggggactctaggcttggatgaatatcaagtcagggaggcagctgtaggcaggggagacacctggactgggagcccagccatttagctgggccacgaggctttcagtgaggtttccggcagctttgagttggcaggattgggccggttgtatgccagccgtttggcctttgtgaccaccacctgaggagatacggttactggtcctatttacaggtgaggaagctgaggcttggggatgttaaccagtttgcccagtccaaag

SEQ ID NO: 12460 - DNA, 2514 bp, Homo sapiens
gttttatttatatgtatttccatatttcattcctgtgtgtcactgctgcattggtgtggcagcaagtgaccaaatgctacaggtcttactatggacaccaggtcaggtgcaaccacacaaaacaaagccagttccatgagctgcctatgatatgcattgcggaagtaacattttacccagggtgtgccattgcagtgatataaatatatttttttcttagactaaatatgagctgactatctcttttgatgtgtgtacataggtgtgagtgtgtctgtatgcgtgcctgtctgtgtgcgggtgtgtgtatgtgcgtagcctcatgcttaggactacccatgaatgttgtggaatgctacacctggagagttctggttttccaccagtttcaagatgaagaactacatgatacagtggacctggagaccatccccttggaaagacaacccagagatgttcagcatcctgtatctacacgcatcctgtatctacacgtgtattttgtagctgtcacactaaccttaataagaattctacagctttggacagaggcattttcaccttaatggtgaagtaatttaaaatataaatccattcaggtgacaacccatcatcaaaattacaaattttctgattgaactcatctgaatcatcagttccttgatggagagagagaaggagatggaatgtgtctggtaaccccaaatggagtacaagtagcctttgttttcctgcataaatggacttgttgaatgcgaacgaatatatgcaattcatatacttttggagatgaacgtagatatgtgtgtcagctttgagatggtgtgtcctggattaatactttgtctcccaatatcacagaaaaatacatgccagtgactcttgaggttaaggtagttgggatgaaatggcctcaggcaatttcacattccctaattacctggaaagttctacagtaattaatatgcagctaactcctgttgccctcacaagagcatcagccttctagaatcggagctccggagtgtgaagattcagtattgatatgatatgtataccaaactccagccaacttactgccatttttcataatctgagtggctgccttgcttatcctaagctgtggttgcagaaaccgtggccatttatataagctataacatcaaatcagggaaaaatgaggaaaaaaaatagattctgaaccatttattgttgaataagtagagaaaatcatcaataaatatttattacattctgacagggtgtgtggcattgtgttctatgccagagtgacaaagttgattcacccctttttggggaccttaatatattttttaagggatgtgcctatgcattgatgcctgaaaaatatgtataaagaaatgaggttgactcttctgagcagttcatcttttccagaggtaagggtaggaggccaacttcagggtctgggtctgagcccgtgggcaagccctggccgagtgagctccaatgctaactcatgtgccgatctctagagcagtgggaaactaccccgctgcaccaaatcaagtagcttcaccttgtgtatgcaggccccaagttattttttagcaatcttacgagtgaaatgttctggtgggttgaaaaacgttcttattttaaagaaaggttgtgctcgctacactgctggtgtgtgcattctgagacctcttgtattcaatctgtgaaggatatgtgtattaatccgtacacccgtatagcctcaatatttgtctgaagacacttaaattctgacccataaaggaaagttctagaagcaatattttcacttatttaacattctccaaacaacatcaagcattgatacacactgaagagtgcgtttattttttgtatcactctaagtatgttggaatatgcaaggactgtggttcaaattagaatgtataaggcatattataatttagttcatactgaataagaaattaacagaacattgttcggttcacacgttccaaactttgagtgatttctggagttagacatagattttctattttgttttaatttgtcaaggtatttttcttcccttcatgaactttaggtacacataacttatgtcatttatttatggtcttttatacctagtttgtaaaattgtaaaatagcaaactaaatgcaaagagtttgcatttgaaaataataaagtagttgccgtatacaaccctgcaatctggttgtctctttcaataacttttgctatatatatggtgtgcctaaatgaattaattatttgttgtcatttaattaaaacaaaaaatcttaaattccaactgagcatacttagaggttaaaaaattattatcttctaaagattcttcacccttcagaacaatgcatttgaaaaatctgacttagaccatcgtaattaagactgtagactatggttggcattcaggcttcaccacttactaattatacagtctagggcaagtctcttaacttctctctgcccatttccttgcttgtagg

SEQ ID NO: 12461 - DNA, 1424 bp, Homo sapiens
ctatgtacagggacctggcaagaattggtatcacagccatcacgcaccagaataagattttgagcagtgtccaggcaatgcgaacccaaatgcagcagatgcacggcagaatggttcccgtctgagccagtactgaataaactcaaaactcttgaaattagtttacctcatccatgcactttaattgaagaactgcactttttttacttcgtcttcgccctctgaaattaaagaaatgaaaaaaaaaaacaatatctgcagcgttgcttggtgcacagattgctgaaactgtggggcttacagaaatgactgccggtcatttgaatgagacctggaacaaatcgtttctcagaagtacttttctgttcatcaccagtctgtaaaatacatgtacctatagaaatagaacactgcctctgagttttgatgctgtatttgctgccagacactgagcttctgagacatccctgattctctctccatttggaattacaaccattgtattttgtttgtggcataaattacagtcatctgtctttcactggaatgaagaccatgcctaggaacattttttaaggactcagctgtggcttttagggcttggttcataccatgggggaaaaaaaagtcctaggagaaagcgacgtggctcattagtgttgcctcttcagtgctcaagccgcctggtggattcctatgacacagggggcctggaaagaaagggaaagtggatttaaaatatatatatacgtaacccaagccccataacccctaactggacaaatgaggtctgtttctttgggcctgaggctgtgccatataaagtcttattttgggactttacaaacttgtcctaactatcttgtggatagtgggctgtgacaatctggaatagagaacgttcacacttcgctcctttaaagaagcgaccccagatctgcaaggtaagtccaacaaccaagaatgattttttctccagtgaaaactccttttgtgctttaaacttgatctcattcgaaatactgaaaacagaaaaatactctctcatgtctctcaggttgtgttgatgtttttcaggatttcagtccttttttgacagcgaaagaggagaccaaacacagtgtggtttccctgctattcttccggggagaagtgacatatgacccagatgaggtcaggctctgagggatggtcctagatgctcactggctgttggctgtgtgctttccatcacgaagggctcctcctgtcctttggtgccattcattcatggtacacatatttattatcttctgggcaccaggcagcaagcacaggaggctttctctctaaccttgttaggtcatgggtcccgtcctttggagagtttacctcaatggagaagtactggcgagacttttccattagcctcattttctgtcctg

SEQ ID NO: 12462 - DNA, 1221 bp, Homo sapiens
agaagccatctctcctgcaaacactggccattgtgtaccactgacatccatggcttcaggtgtcttgactttcataaagggctgttttcactcctccttgcccacaggctggagacctttcattgcatctgtttatttcctagctcacctcctccaccctctaatttgaaccagtaatgaaatgcagtcagcctacttcagctgttttctttttcctccaaagttccccccaaactgtttttaattcactgcttgtgatactggactcaagaaaacaattttctagctcaggaaccatgtgaagctttcctctctttcttttctccgtatctcctcttctcttctccatcccatttgggtgtcacaaggaccaaactgctgcagtaaaatgacttgtaggtgtttaatggcaagtcattgaggaagtgaataaaagaaaattgcagcattcacgtcagtggggagcaaggagaactgctgagctttgaaccaaagaaagttaaatttaccattttcttaaagggagccacctctgtttgacatcaaagcatctcctgtaatttctccttgtgaaatgcaccactgttagagagtcatgatagagccccctaatctgtgctgtttctgtttatcaaaaacacacacagagagaaaacccacatgtaccttctcagtgcattgtggtctgctctcaaaccaaatgtaaccacaggtacatagcaaatggggattctatttcgaaagcattctcagtttctcagggatttgtagaactgggaatacaacattctttgggagtgaaatttatcttggacctctattggaaagctcagatcattcaactggaaagctttggtgaattttttcctttcctcctcttttggtttttgcttcatcgttttttaaaaatggtattttgctacaatttcacttgtgtccatttggtatgtggaaaaacagagtctgttcctaataatgctgctcgcccacactatgactgcaaagggctctccaccctattacccccatgtttcaagtttatgtccattggtggctgttgcatatgtagtaactaatggcttctgctggcagtgactggctttgccctagtccatctttggaggcttaggatcctttctggatttatcattatgacttgggagtctcaccatcactccaccttggcagttaagaagtcaggagaactatttgcatatgccc

SEQ ID NO: 12463 - DNA, 1214 bp, Homo sapiens
ttttttttttttgaggtattagagagcaaagttctgacaggagcactactaattaactgataattgtcttcctttggcaagctctgctcttcctgcccttaatttgcaggtctctgctcagtggttgaaacaatacccatactagtttttcctttatgagtaaatttgaactgttgccacttgaaattgtagctgttgtaataggtgaatttgaggttgttggaccaccacaaggaactgccgagaactcacaagcagtaaatccaccattgcctctggatttcaggcaaaagattgaaacaattaaacaaacaaaaaaaaaacttcctcaataaaatattgtcttatctcccataagatcctttattagtgatgattggtgctcagtagtttgcttcattattgaaagaaaaataatcaggtgtcctatgagaataaaatgggattgacaaatcactgcatgatgaaactttgtagttgatacatctgctttggatctttgcagtgggaggaagtgagtatcatggatgaaaaaaatacaccaatccgaacctaccaagtgtgcaatgtgatggaacccagccagaataactggctacgaactgattggatcacccgagaaggggctcagagggtgtatattgagattaaattcaccttgagggactgcaatagtcttccgggcgtcatggggacttgcaaggagacgtttaacctgtactactatgaatcagacaacgacaaagagcgtttcatcagagagaaccagtttgtcaaaattgacaccattgctgctgatgagagcttcacccaagtggacattggtgacagaatcatgaagctgaacaccgagatccgggatgtagggccattaagcaaaaaggggttttacctggcttttcaggatgtgggggcctgcatcgccctggtatcagtccgtgtgttctataaaaagtgtccactcacagtccgcaatctggcccagtttcctgacaccatcacaggggctgatacgtcttccctggtggaagttcgaggctcctgtgtcaacaactcagaagagaaagatgtgccaaaaatgtactgtggggcagatggtgaatggctggtacccattggcaactgcctatgcaacgctgggcatgaggagcggagcggagaatgccaaggtaagagggtccatattgcagttttttcactggggcttagtgcga

SEQ ID NO: 12464 - DNA, 1925 bp, Homo sapiens
tgcctgggttgaggctcatgggaaactgtattctccaagtcagatcggagcatttgtgtcgatgaagatgaaagagactgcagaaaattacttggggcacacagcaaaaaatgctgtgatcgcagtcccagcttatttcaatgacttgcagaggcaggccactaaagatgctggccagatatctggactgaatgtgcttcgggtgattaatgaacccacagctgctgctcttgcctatggtctagacaaatcaaaagacaaagtcattgctgtatatgatttaggtggtggaacttttgatatttctatcctggaatttcagaaaggagtattcgaggtgaaatccacaaatggggacactttcttaggtggggaagactttgaccaggccttgctacagcacattgtgaaggagttcaagagagagacgggggttgatttgaccaaagacaacgtggcatttcagagggtgtgggaagctgctgaaaaggctaaatgtgaactctcctcatctgtgcagactgacatcaatttgccctatcttacaatggattcttctggacccaagcatttgaatacaaagttgacccatgctcaatttgaagggattgtcactgatctaatcaggaggactatcgctccatgccaaaaagctatgcaagatgcagaagtcagcaagagtgatataggagaagtgattcttgtgggtggcatgactaggatgcccaagttcaacagactgtgcaggactttttttggcagagcccccaagtaaagctgtcaatcctgatgaggctgtggccattggagctgccattcagggagatgtgttggccggcgatgtcacagatgtgctgctccttgatgtcattcccctgtctctgggtattgaaactctgcgaggtgtctttaccaaacttattaataggaataccactattccaaccaagaagagccaggtattctcaactgctgctgatgggcagacacaagtggaaattaaagtgtgtcagggtgagagagagatggctggagacaacaaactccttggacagtttactttgattggaattccaccagcccctcgtggagttcctcagatcaaagttacatttgacattgatgccaatgggatcatacatgtttcagctaaagataaaggcacaggacatgagcagcagattgtaatccagtcttctggtgggttaagcaaagatgatgttgaaaatatggttaaaaatgcagagaaatatgctaaggaagaccagcgaaggaaggaatgagttgaagcagttaatatggctgaaggcatcattcatgacacagaaaccaagatggaagaattcaaggaccaattacctgctgatagtgcaacaagctgaaagaagagatttccaaagtgagggagctcctagctaaaaagacagtgaaacaggagaaaacattagacaggcagcatcctctcttcagcaggcatcattgaagctcttcaaaatggcatacaaaaagatggcaactgaacgagaaggctctggaagttctggcactggggaacaaaaggaagatcaaaaggaggaaaaacagtaataatagcagaaattttgaagccagaaggaccacatatgaagcttaggagtaaagagacttcctgagcagaaacgggcaaacttcagtctttttactgtgtttttgcagtattctatatataatttccttaatttgtaaatttagttactattagctagtgatcatttaatggatggtgattctaacagtataaagttcacaatgttcgatgtccctagcttatcatttttcagctgcatgtaaaaggaagtaggatgaattgatcattataaagatttaactattttatgctgaagtggccatattttcaaggggtgaaaccatctcgcacacaatca

SEQ ID NO: 12465 - DNA, 1197 bp, Homo sapiens
tgatgagtgattgcactgtactttatgtagccatccctaatataggttgtttataattttactattggaaataatgttgtagtaaatgtctttctacataaagcctttttgaatttaggattatttcctttgggtagtattaatattatgaataagagagtatgaagctttaaggctctgatatattggtaaattgtttacaaagaattttaccaacttatacctcagtgaagccttattttccctggtcagcattgagggtttttcactctttcccccaaataaaacaccttagggaatttgatgagctgaaaaaagactattttatcttattttgcatttgtgaggttgaatccttctctgaatgtttaatatttggttttcttttttgttgactttttctaagtttgtactggggtaaatcagtttcttaagcaatggttaatacagcgttgtgaccagttcctttatttttctagatgtaggtgcaaaaaactacagacatctctgtgctgtttattacaacaagaatcctgggtttgagatcattcatgggctgctggacagaattatgcagttgctcgatgtgcctcctggtgaagacaaggggggatatgtgatcaaagcatcagaaggtaagacagatgagccgaatccagagttagtgacagtgtcaggaagaggctacaccttgtttttgatgaagttggtagttttgatttgggattttagaaagaaagggagagttttatttcaattaattgtcaatattatccagaaaatatcccctttccctccagcattttaagaaaacacttttcagaactctcgtaagtgctgcacagtatactttcgttccaactgagctgtaacccctagttactggcacctttaagccatcaaaatggctaaatcactggcacctttaagccatcagcacatggtgaacccagaagttttaactggaagctggtaagacctaaagtgatggtttgcactcaaaagctgcctgtctgatggctttaagacaaaagaaaaaagaaaacaaaaacaaaaacctcagaagttattctgaaagatttcacacatgttaatcaagtcataaagtttgcagagcaagggtgggaatcctcgtgtataaaatcccaagtacagtaaaatctttgttggagagtttaagctaggctaactaaatgg

SEQ ID NO: 12466 - DNA, 1324 bp, Homo sapiens
catgttagccaggatggtctcgatctcctgaccttgtgatccgcctgccttggcctcccaaagtgcggggattacaggcgtgagccaccgcgcctggcctcaacaatgcacatctttgaccatattaagtggatatatagccatacataagcttgcccttatattgtttgttttcatttaaatgtttttgggtgtaccctatagtggaaagagcatgggttttacagtcagttaattctggtcaaatcctggttttgaccagataattaatcgtattagcaatataattaattaatatatataattaatattatatttattattattatctaatatatataataatatataatataatattaattatattaataataatataattaatcgtattagctccagccaattagtttgactttggccaagttacttaatcattctgagctttgtttctccatctgttttataggaataataatacttactttgcatggttgtcttgagaattaaataagattatagataaattgacagatagttaatacctagcatgtgccagataatcgataccacagattaacagttaatgttagttttcgttttcctccatttatgtgcttacttttatattattttaatattagagtacagtgtcttaaaatattcatgttttacttggatatctagaagataaaaggcattctgtattttatgtcaactattgctagtagcttttacctatgggagtaaatccgtggaagaagttttgctcaatgtatgctaacatgaagcagctttctgttttcagtttattccctcagatattagtttgttttttctctttttaatttggaaagcaaaatgaggccagcattcgttctatgtttgtgttagagcagcggtctccagaatgtattgaagggccacaagtgttataaagttaaatgatgactgctgactttcagtcttcctctctatacttaggtacttctttttaaaaatgagttttgttacaggtttagatgatttttttttttacaaaataaaaatttaataaattaattttcagaaatcaatagcttttatagatacaatatgtctaatttcaagctctaagggaagaaaagacccatgttataatagcacaaaacataaatgataacatacttaggaataaacacaagaaatattatttgtagaaaatgttaaagtgctaatgagagatgaaataagacccaaacaaatgggaagatacaccacgttctttcatagaaatacgcagcatcataaagatatcacttctctcattaatgggtgcagcaca

SEQ ID NO: 12467 - DNA, 1097 bp, Homo sapiens
ggtgagaagaaactaggtgcgtgaggtgggtcgaccttggtgattggttctgggcactatcgtggtggtgggactgggattaagactgtcgtttggggtttgagagttgcagctttgcttttccccaagtgcgttttaatcatatactgttgataggttgggtaactcggggactgcttactaccagcagtcctgtggggtaggtgttatcaggctcgtttcacagatgaggagcccgaggcacaggttttcaaatggttttcgcaggaagtctgatactagaaagtgtgctctaagctgctgtataaaagatccctcgaaaatgaaaaggctggaggaatgtctttaaaattatatggaagctagaaaggcagtaggctttgtgaacgaaattatagctgaaaagaatgacaaatagctgacatttattgagcttttattacatgccacgcactgtttggagagctttatgtacagtgtcttcacactgttaacagtcctctggggtgggggttattcccattttacagcgggagaaactgcagattggacgacttagcttgcctcagatctcagctagtaagaagctgggattcagacaggcctgtgtaaatccagagctctgaaatctaagcactatattttgctgcctctccttggtggctggctgaatagtttccacagtggattttagtctgggtggccaggagagttgtagtttgatgataccttctttcatgtttatcaacctattttgtttccccaaattagttctgagagttaagggtgctgatgagttgctcctgaaagtgtattagaagggtattataggggacaggtggtgtgacatgggaatcttttgcacagacttgattttgttttctggcatttttctgggcagttcctcacacttggggatgagtaagccttctaattgtcgcatgcgttttctctctagacttttcctggtttctcttttgtataaaaatattggttttgtaggatgacattgggtgtggggcagagtggtccattggacctaagggtcaaggtgacaagtcacctcgtatctttggatctcagttactgaatttgta

SEQ ID NO: 12468 - DNA, 1151 bp, Homo sapiens
atggtctttttgtgagcaaagaatgtggtactgtatatttttataagataaagttaggacattttgaaaaaccatttcagacggttgttcgtttattttgtgagtaggttttagttcagaattagtaagataagcaaagcaatataaagaatatcttacaatttatatgagtatctagatatatttctgcttttaaaaattatttttgtggaaactttatttttaaactaattgtggttcgattttaaaagtttgatcttgataggatacatctttttgaaaaattcacaaaaggttttttccttcttgctgaatcacatccacagttgaagagtacttcttttaaaatgccttaatattgctagaaatgttaatctaatgctaagtgaatatgtaaggcagctgttattattaactatgttaaactcatttttatacatttaggaaatcatggatcggatctacaaaaatgtcatgaataaagtcagtgaaatgagtagttttcaacgtaatctgtttattctggcctataattacaaaatggaacagatttcaaaaggacgtaatactccactgtgcgacaggtaagtaaagactctctacctccttctttctcctcttgataatttaatcatttagttcacattaatagcccaattaattgagatagttataagaaagaaatatatttcataaagtcaagagaactctttaaaaaaaatccatcccaggccaggcgcggtggctcatgcctgtaatcccagcactttgggaggccgaggcaggtggatcatgaggtcaggagatcgagaccatcctggctaacacagtgaaaccccgtctctactaaaaacacaaaaagaaattagcggggcttggtggcgggcgcctgtaatcccagctactcaggaggctgaggcaggagaatggtgcgaacccaggaggcggagcttgcagtgagccaagattgcgccactgcacgatctgtctgcctgggcgacagagcgagaatccgtctcaaaaaaaaaaaaaaaatccatcctggctgaacacggtggctcactcctgtaatcccagtgctttgggaggccaaggcgggcagatcacctgaggtcaggaattcaagaccagcctggccaacgtgacaaaac

SEQ ID NO: 12469 - DNA, 1156 bp, Homo sapiens
ctggcctgtttttcttttaaaagcatgggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccagcctgggcgacagagcgagactccgtctcaaaaaaaaaaaaaaaaaaaaaaaagcatgtatttagcagtacaaaaattagggcctaattttaatatgtgcttttaatttcagcataaccattaatgcttaattttgcaaagttttaaataatttgatagcaaattacttagagaatggccagtatttatatatgtattaaatgttactaatattattactcattgttttcccctctccacctttctttgttttgcagatcgtaaaaaggaccttgtaaaactacaggcaggggaatatgtttctcttgggaaagtagaggcagctttgaagaatcttccactagtagataacatttgtgcatatgcaaacaggtaagaacgtggaattcatactacttttacttaaaatatttgatgtccatagacatttcctacctgtatggaccttctttgtaaaaatgttccgagaactcttcctatctgttacttgtgggaatggcctccttctcattgcagccattagctgactcttttccttgtaaggcttcccctgatctttctctctgtccctgttttctgctttacgtctcactgcagtgtcccatggagggaggtgaagaaaataaaaccttccttcctgctgccttggtacccctacctacctgtccctcagcaggggaagcttcacagaactactccagaggaatggggagtaaagaagtggcagtgaggagtgtgctgcttacttactcctgctctacacttgagcctgctcggcactccaggcaggtcttggggctcctatgtaagctgtgttaagctgcagcctaaacacacagcctccccacctcatgatgatgaagaggcagc

SEQ ID NO: 12470 - DNA, 1451 bp, Homo sapiens
agctttcagagttactgggattacaggcatgagccatcatgcctggctctaactcgttttcaatgacagaatatatattctattttgttcctatatcatattttatttaactcattttcctcttgatggggacttgttaaatagtttattgttttacttatgtttgtattttgaggaatagattctttagaagtgacattcatggttcacttgttggttgtgcattttgatggatacgcaaaaagtggggaagttacaccatttgctaagaacttaaataccttttcttcttttctttttttttaatcatcttagcaagtctggaaaagtttgaaattccagtaaaaattcgtttgagtcctgaaccgtggacccctgaaactggtctggtgacagatgccttcaagctgaaacgcaaagagcttaaaacacattaccaggcggacattgagcgaatgtatggaagaaaataattattctcttctggcatcagtttgctacagtgagctcagatcaaataggaaaatacttgaaatgcatgtctcaagctgcaaggcaaactccattcctcatattaaactattacttctcatgacgtcaccatttttaactgacaggattagtaaaacattaagacagcaaacttgtgtctgtctcttctttcattttccccgccaccaacttactttaccacctatgactgtacttgtcagtatgagaatttttctgaatcatattggggaagcagtgattttaaaacctcaagtttttaaacatgatttatatgttctgtataatgttcagtttgtaactttttaaaagtttggatgtatagagggataaataggaaatataagaattggttatttgggggcttttttacttactgtatttaaaaatacaagggtattgatatgaaattatgtaaatttcaaatgcttatgaatcaaatcattgttgaacaaaagatttgttgctgtgtaattattgtcttgtatgcatttgagagaaataaatatacccatacttatgttttaagaagttgagatcttgtgaatatatgcctgtcagtgtcttctttatatatttattttttattagaaaaaatgaagtttggttggtgatgcatgaaacaaaatagcaagagagggttatagtttaatagtaagggagataacacagcatgtgtagcaccagttgataattggtctctagtagcttactgtcaaaatgttcaatgaagtcttctgttcatctgttgaaactaggaaaatacccaaacttaaatggaagaattctgaaagagaggatagaatttaaagaacaagagtatataaagttattctttgaatatttcgttgactatatgtacattgagttatctatatttgtaaacaaattagtcatggaaaattattctatctcaaagtctccttttagtctagataatc

SEQ ID NO: 12471 - DNA, 1215 bp, Homo sapiens
ctaaaaatacaaaaattaggccgggtacagtggctcatgcctataattccagcactttgggaggcagaggtgggcggatcacaaggtcaagagatcaagaccatcctcgccaacaaggtgaaaccccacctctattaaaaatacaaaaattagccgggagtggtggtgcgtgcctgtagtcccagctacttgggaggctgaggcaggagaatcgcttgaacctgggaggcagaagttgcagtgagctgagattgtgccactgcactccagcctgggcgacagagcgagacttcgtctcaaacaaacaaaaaaattagccgggcatggtggcaggtgcctgtaatcccagctactcagggggctgaggcaggggaatggcttgaacccaggaggcagaggttgcagtgagccaaggtcataccagtgcactccaggcgggtgacagagcaagactgcgtctcaagaaaaaaaaaaaaaaaaagaaaaagtaaaagcttgtagtattctgtcttgctgcctgctatttgatgttttacctgtgcattttcaatgttagctttgaggtctggtatcattcatattagagtggtttgggacctccagtgatttcctagaagagtgtgtttcctgttggattctttaggagatcccatctggtagatttttagagaactcgatggaaaaatgttctctttagttcatctcagcagacatatttagggaaaacagcaaagcaagcaggagaacaaagggaaaaattcaccaattcctcaatataaccattgttcaaaggaaataactcagattagcatataaaataatcattaggcttttactatccaatatttcttcaggttaccatgtaattacaattatggcatcagcttgaagtttatcatgtatgattgaccactgtgtttactttagctaaccttcagttttgtggtttaactttttaatgtgttagaattttttctttctttttttctttctttctttcttttctttctttctttcttttccttcctttcttccttccttcttctctctctctccttccctcccttccttccttcccttcctccctccctcctttctttctttctttttctcttttcttttcttttctttcttttctttcctcgcttcttgtcacccaggccagagtgcaatggtgtgatctcaggtcactgcagcctccgtctcctgggttca

SEQ ID NO: 12472 - DNA, 3127 bp, Homo sapiens
atgtaaaggtgtgttttggggcatttgtggaacttacccatggggactaatatggaaaaggtctgtccatagtggttccctgaagactggaattacttcagcaaaacttccccatgaacagctaatgtgtagtgaaagaatgagctagcaaatgagttttagcggggacaaaaaatcaaacaaaaaagtgaatgcttagaaccttctcaaagcagtcacaagtacagacacttcacttagcctagggggccttccagggttcttgtggctgttgtcagagcaggagctgggggagggaagacttgttctctctttcttgaggggtggcattaggaacttacgaaaccagagacctttccctatgacttggcagtatgtgaatatcctctacacttagttattgataaacttcttaaagagatctgttattttcaggtagtgccataatctgcacttagcattggcttgcttcagttgtttctcttcccagccagtatgccacaggtgaactttcggggttgtcattaagtaagttgtgaaatttctgtaataacaaaggcagtccgcattcttccctttcccccaaattcctagggcaaaacttttttatggtgctgttaacatgggagtcacacaagccgcctgactttttctcattgccattagtaatgactgatggaaaacccagccaccactgtgatgcgaaatgatcagtctgttgcctgaaacagcccagtcctcttaactgaaacagcattctacttcttgttccaagatgagcctctgcaatattctggcaatttaatataccccctacaaaagcactccacagcttttacactattttgactttgagttataactagtattattcatgttttcataaaaagaagttagtgacccagagctataatcatccatcaagtcttccacaataattcccaactcataaattgctttcctaacaactagcaaaagctattgttcataatggcatttctaaagcttttgggcactgtgtaccaggatgaggaagagaagaaatgaggagcctgtcttttaatattccagtatttgtgtgtttgattttttttgacaacagtacatatatctatttctctagggatatggaagtaagtggagaagggcctacctttttaaaggacaaatataaaaatagcaacagtatctttgctaatcttactaatagatattgattaaaaaaaaaaaacctcagtactgcatcactgtgttgggatcataccaggacaatagggtcattccatatgataaaactaaaggactaaatttgttttataatgatgtcttagagggactgaaaggtttaaggaggcgatcaaactaaaatgtcttaatggctgtgtgacacacgtaaggaaaggaaagggggtcacgcacatcatgtactggaatgatctgcattaaacatagacttgtcttcagaaataagactgaagggttttgttgttccttagagttttcgtgttacatcacctaaagagatttcttttaaaaactttctagactctttgcaaaatgtatattactaacatagtttggaagaaaaattgagtagtggtaagttttgttcaagcacaatgttgaatgttaagcttcctgtattaattttagttcagttaatggttcagcccatacaaaggtgctatcctagggattttatgaattcctgaaaggaaaatagaatatgatcaattccttgccctgtggaagagtgcagaactgtggttttgttttcctttgacttctgtaaaatgtgaccgtttgacatctgtggtagattgaacggaatatcacagctgctgagtttactccatagctttcaaaccttttttattttaagaaattcttgaaaaaccctatgttccatgggaacataaagttattatagtgcctcctaaggggttaatataaatcaaggaggaagtttatatttaaggaagaattggagtgacgtatcttagaaaaggaaaggctgatgtttccatatagcttgctctccaccaggcctatcatttttctttttagagacaaacgtgacaggctagtcttgtctctctcatatgctaggtagcaaatggggtgatatttttatagaagtgggcaaaaattattttctcaattttactgagtaggcacagaagaaaagtacagataggctgatggttattgccttattttgactgcatttctcttaaatggatcatttaaattagttcttcaagtaacagtttactggttgttccattcctgaatatgcaggctaatttgtacagatagggattaaggaatacagactattagagaagatccttatatttacatctagtatatatgtggtaaggaaatgccgattcttcattataaacaagttttaaaattgttctttcttagttcaaatgatagcaatacccctatagcattaggtagaaacaaattattcattacatcgtaaatctctttactatgtcctagctctgtcctgctacctaaaggatataaagaaatactattgctctagaatgtattactttgttctcccatgaaagaattcagtttgttagtacctatatttttaaactggtgaaactgacccaaatatgtaataaataccatagtagctcagacccaaggagatatttttctaaaatcagttttcgttaaagtacttctacttccgttattggatatggtatctcctaaagtgtaaaaaaaatctgttactatatagtgataaaccatctgctcatcgtaagtgtaaggcttaacaaataagtaatacatgctatatttattcaagtgtctattgcttaattgttaattgtgagcagatttattgaatgcctattctattttctgcagtttacaatacaataactctttgagtaagttgaagtttaattgtgcaacaaatttgtattagagtacaatttaaagtgtttttctctatagccttttttgactggggaagcaaggggtaatgttaattagtacactttgttcttgtactagctatgtttctataagatatggtgccctgtgtatcccagagatgctagaaaactgttctttgctcctatttgtgggt

SEQ ID NO: 12473 - DNA, 1707 bp, Homo sapiens
taaatatgatgaccttgatagttttaatgaaatcttcaattcttgcagctgtgttttggaaagtgattaagcaatatttctcaaacctgatgattcttggatatttagctattgtcctccaaagagtcatcgtttcacgttttcaaacatgtgctttgtgctgaagattcttgtcagatatcctgtgcttccagagtatttttatcttcaattttatttaattttgtttcattttgttttcataagacaatgtttcagatatgtaatggggcaaaccactatagatttctgttggatagaaaaatgaaatgttactaataagtttaaattgacccttcgttgactatcagtactgttgatacatttattagaatgtatgtctcagaagatggtttctgtttaaatttatggtcaagttacaacaactgaattctaatatggattaaaaactccacataaatatttttccccatgcgtcttgggttataattttccttttagacttgcaaatatgcttttattgcaattttgtctccatctgtactgtagaattacaagccttgtgctctttatctctacattttccacttctacatgatgcaattaagatgccaatgaaaagtattgtgaacattattctcaggacacttttaccatacttgagtagtactaagtcaggtgtaacatggaaagctaagggtttcaccttctgattttgacataattggaaattttctataatggtaagatgtttataggaaagtaatggtagttcatgtttgagaatttttttattgctttcatttcccagttaaatgatatttaacacctgggaaaacaggacagctcagattgtcgagttagtaaacatgagcgatgtaaaaactttatttgaaatctcctaagtgagacattaaacattttagtgctagtttaagccattaaaagtaaagtttaagtttacgtcattgtctcaagtgtggctgtaaaaatcagatctagagtttagagacatacttgttaactttggagcacaggtttgatatttatgcttctaaatacattaaaacatttctgaattgcagttgaatggttggagattgctggcgatgtgatgctgcactgaaaaaactggtcacacaaaatgtttatatgtttgactgcataagtattattttaggtcataaaggttataacaaaatacatttaacattgctttctttttagcaagaggtcacagatgctattttttctcagtttttaatgctttaatttgaaagaaaaatgcatcctaaccattccatcctgttggtgcagagaaattttggtgatttattagaagacttttaaggagggtggatacatagtttttcaactgcaaaaatcatgtcatctcttcagtaactgttaaagtgtaattctctgccttcattatcaagtccaggacagtgtttattttgaatcgttaacattatttaaagactgaaaattcattgcaattagggaacgcacagcctcacaaaaagtggttgtgattgcaaggattctttatgtcagtgaacttaaaaagggaatgggggaagagatgcatgcctttctaaaggtatgctagagtcacctgtgtagcattgtaattatgtactatcaaacccccaagatgctgatgataggccttctctgtaagaatccttctcatagtgaagcact

SEQ ID NO: 12474 - DNA, 1176 bp, Homo sapiens
ttcagtgagcttaaatgaaaaattccgtcttttggctgtgtaagtttttgcctgcatatgcaaaggcttcataaaataatctctgtgactaaaatttcatttcatctgttctcaatcatcccttaacccagcgctatattaccttatgcctccaattcagtggtagccctctacggaatagaattccactccaacccctcattcatgatgcactaaatgagaatgtaagaatgatgctactgtgtgaagtaggagacactttctcaaaccgtatccctttttttgatgtatgtcaaccagatatctatgttttcaaacaatagtgtttttaagctgtaaatgaaccgtagtactgcttttgtagaactaaaattgtataattgttacatcatcttaattttgcagctaacagaacaagaagtagaaacaatattggataaagcaatggtcctttttaggtttatgcaagaaaaagatgtatttgaacgttattataaacaacacttggcaaggagacttctcacaaataaaagtgtttctgatgactctgaaaaaaacatgatatctaagttaaaggtaaggtgtgttttagatgaaatagagtgcacctaactgaggtttattatgattgtgtactgacaacgtgattggaaattaatttggtagattattaagtgtttatttctagaaataaaggtagattgttttggagaagaacacagactacactaacatttgttcaagttcagggacattcagagtttgctggaatttctgttggtgtgtcaggatacattcatggaggcctggaagggaggattagtaaaagggaaacaataaagaggctatgctgtgtagttctttttcacaaagtgtggtccatagaatacttgcacgtgaatcacctgagatgctagttaaaaacagttctgggccctgcctttcatgggggtatattggaatctctgaaagaatctgggaatttgcattttaaaatcctaaagtttgataaccacaggcacagagcaactgttggaaaaatttacaggaagattatcagggatagcaataacatgaaataatttatttctttctgtactttctcatagaaacatctaccatttatttgtgtatatttgtgtttttcctccacagactgaatgtggatgtcagttc

SEQ ID NO: 12475 - DNA, 1144 bp, Homo sapiens
agccaacaggaataatattgaaaatatttaataactgcttagaccaggataccgtgtgggccatgctcccctccataggccctgactatgtggacattaacctaccgccaactatttgctagtttgtaaagaggtccaagggggtgtaggttacaatttgtcacccacactgggacagttttgagaatgacaggtgtaaaccaggactttcctggcaaaagcaagaattagagtcacctcagccttttggaactcaacgcagtgaatattcaccaaccaaaaagaaaactttttaaaaatatgtcagctaagtctcacttgtgcatattgactctacatcacctctatgcactccaagttaatagacttgagttcactaactaatctggcactaattgtcactctggaaaattgttctcgcacctcaatttccctaccttgaaagtaagcttattgctgtttctaccttaattcattccatgtgaatttcatttaaatggatttataaataagcgtttctttctttgtcaatgtgtaaattgcaaaatatctcctgtggctttacattgtaatagcactggggagaaatgtgatgagacaaataaaaattcctgaatgaacaatagtgagaattgtgctgacagattccatatctttaaggtctgaggatgtttaatcctagagtataaagcctcaaccgtgtctttagtccctgtgtacaaaagctgttctctgtaggaagtcagccagctgttgcttagctctgttctagagaagaggaaatcgccactgatttcacaaaggtgaatattccacccttctgcatatacccatattttcccattcctgagaccctgtctcaaatcccatcattcttgggaattcctggctcatgacaccagctggtggctctccctcaagttacatattttgtgccttttgtatgcatcacaagatgggtattttatcccataacatcctgttcagtaagtacctgtgtttaacagtataccatttttgtatgacttcccaccaccaaattctcaagtataacaaattgggctaagcagcttgagccctagctctgggggccctcactgatgctggggaaggtggctaaagtttcatgtggcaagaatgaagg

SEQ ID NO: 12476 - DNA, 1776 bp, Homo sapiens
gaagggtttgggtgccatatcccaaggccccctacagtagattattttattggattgtctcagtaactcagaggtggacagagaaggcggttatgccaggttcaagatgaacaactgaggttgagtgacaagttcataggagaggcatagaaaggggaaggagtcccgtattctttctgctgtggtaagcctgccaaaatgcatactgagtcttttctgccagaataacagtaggtaaccgcttcctcacctcactatgtaatcaagttaggaaggaaatacacccttcctaactcagaaatctgaagaagggaaagggaaaggatgtttaagtgaatttaagctgtcatgaatgacatgtttttctatgtgtagttgtgtttattttgctccaaatgaaactttccatgtttgtaataatacttttgttgacaaattattatactacttactttataagaatctgattgccctattcattaaagcctctatattatattttttgtgtgtttgtttttcacttagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaacagctggaaatataaaagatttgcaaacttctttgtttctgtctctgcattgtatgccattttatagtccacaccctgaaaatgtatttcttccagaaagtctggaggaaggacctatatttgtagaagtaaaggtatattctgtcactcagctgtattcacgtctgagcagttctgcagtaacacctgcttaaaattctccctttgcatgttttgtaaataggctccagttttgttttttaaaaggaatttattttttgcctcatcagtccacccaactgattctgaatgggagagagtctgtagagaattgattcagaaaagtgtctgtgaaagaaaaacaattattttgtcctgtttctcaaacagtgttaagcagttttgttaatagacatttttgcatcgacacttcaacattaacactttcaaagtcatggtctggtgccagatttaagaaactcgaaccacctaatatttcataaccttcttcattaggtacttgtacagattaatttctaacattgcagcagtttcatatgtgtgcaatatgtgcattctttcattttagttttgcacttggttttctataaagtacgtttttactcagttcatgcgtgaacaatttaaaaaacgacagaataaggtacaaatgtagtgtatttaataaactgtcaaccaaagaagtatttgtctgttgaaggattttatttcatcatttgtgcaatcagctacattttgtatcatattaccttatgagtcttcccgtctcagagcaagtaatacaattaatgacctggtaggtagcaagaacctgctgtgcttcctttcagaccttcatcctggtggtggtggctgttggttgcattgtaggtggttttctaatttataatatctataaagtggttcaggtttaaataccttgagttgtgtatacttttttttttttgagatggagtctcgctctgttgctgatgctggagtcccgtggcatgatctcagctcactgcaacctccacctcccaggttcaagtgatccttctgcctcagcctccagagtagctgggattacaggcgctggccaccaca

SEQ ID NO: 12477 - DNA, 1202 bp, Homo sapiens
tgtttcttaaattttaatgagtttaaaattgcaggcttctaatagaatatgaatatcttcaatttatttggtgatcttgtcctttttttaaatttttatatatgaccatggtgagacatttgtaaacttaaaaaaagctctattaattaaaccatttttgtattattattttaagtatttcagttattattcagattcacatagttgattaccatttttaatcagtgaatttttccaggatgttttctacatctttgtctgctttcctataactcagtactgtaactcagtactctgaaatagtttcctttgttaatagagtcacttttatagtactgtgcttgaggtcatatacagagtattgtgtccaaatttatcattgcacaaagtgtttttggaaattcttggttactccttagtaaattacctgtaattgggttacatgctggtagggtttaaaatctgattgctaagtgaattctctataaagtgagttttgatacatagaaacttttcatataattcttaaactcatgtgtcatgtattttcatttatagttttcatattcattaacatatgttgttccttaccatttacagctcagaattctgcaaatgcagattttgcaaactttgatgcatttggacagtctagtggttcgagtaattttggaggtttccccacagcaagtcactctccttttcagccccaaactacaggtagagcttctccagcattgtgcttaaatgtttactttacaaaacaaaactctctaaatgtagttttgaaaaattagtctaaacttaaattctgtaattatctgactttaaaatggttctatcttcaaaagctctggggaaacctgaactctttatttttttctatgttcatttgtttttctgcattatttggtatattgtctgtttgacaacatccattctcctccttttcctgcgcatgaatcttccttatatctaccatgcacacaggacagaggcatgacactactataagtatttctctctctctgtctctttttttttttttttggcaatcctcctgcctcaggatggaatacaggcacatgccaccactcccagctaaattttttttttttttttggtagcagctgggtctcactatgttgcccaggctggtcttgaactcctggcctcaagttatcctcctgccttgacctccc

SEQ ID NO: 12478 - DNA, 1235 bp, Homo sapiens
actcagaaacttggaatcgttttttttaaaaatgcctctgagcaacccatataagtcacaaagtctgtgtgttagagcttatgcatttgtttttatgagagattttaataaatttaattatttgcttgtccagactatagcatattagctgtttagaagggatggcttgaaaggaaggagactgaaaaacactctgagagcatacactgtccaaggccattagtgtaaggaccgctacccagcctagaggacatcactatactacatcatctgatgattattctttattatgcctctaggtaattaagtaaaggtgaaattgcatacacagatatgtagtacatattttaaaagttttatcttaaattgattaaaactttttaaaaagctttggtattaaaagaggtaaacatcagtttcctcaaacattttattcatgttgaatgcctttttgcaatgatgactgagttgttatcatagtattttaaaacctgtatagtgttttagacttgttaaaacattgctgtctagtgtacatctagctaaaagtgtggtttatctaaaccgttttaataagcaagatgactgggaaatctctgccccttttctgagcagtatgcctcttcttttagaattaaatgaatgctgcacaggtccagatgtgtgttgatgtagacttgaaatgtctccacattttggaggacttcctcagcccttttcattgagggaaaatatatttgaatttctgttttagattgtatcgggtcccagttgattcatgtgtacaaagttatgctacctaattacagaccattacccaaatatcctaccaggctttccatctgaatagtaaattaaacagttgttatcaaaatgattttaaagactatttctttttctgggtaactattgaagtttgtaattaaatgggggctcttactgactttaaattagcgcttataaaataaaaatgtttagttcaagaagagacccaagctgggtatggtggtgtgagagcctgtgagtcctagctacctggaggtgaggtgggaacatcacttgagcccaggagttggaggctgcagtgcgctacgatcacaccactgcacaccagcctggggatagagtgagatcccatctctaaaaaatgaaaaaaagaagagaggtagctttaaagtggtttttctcatgatattcactgtttattattaaagaaaatcagctttcgttagact

SEQ ID NO: 12479 - DNA, 1224 bp, Homo sapiens
catgccatcagccacttacccagtacgatccacttgttcaagtgatgtgagcagcctcgtcatcatgataatgttccagcactttgttgatgatgattctagggtttcatatagaacagcaggataacatggatcaagaaaccagatggaatgtttttgtcatgaaagaatccaacttcttacatcaaaggttgggggaggaagagaagatacaaatggcagtgagaaaagaaagggggcgacgactagccaaggtacaaatggaaaatcatcctcccctaatttagaacctggtgtgtgtttctctgctactttttatgtaatagtaagctgacacagctcaaatcaagaatttagttgtctttcaaatatttcctgacaagttgattctccttatccaaaaagaatgaacaatgctagtagttactgctaaaatatacacaggtgcctagtcgtccccaccctgtcatttgcccttgtttatccaggaacccactgtttctgtaactctgctggtgtttacagtacaggaacaaagagtgtgagctgtaaaatctctctaatcttgattcaaattccagctccatacctctgaagacttgcacttttggcagcttatttagtttccctgaatttcagtttttctagttgtaaaatttggatcatgataacgatttcatggttgtcatcagagttaaattagatcgatgtatgtatgccctcaataaatgttaactattattcaattattaaccatttaactattcctacctgtcaacataggctttattttcaagttcagagtctaaatttcttttaggtctagactgacttttaagagtaagattggggcctatatgcttaaattagtttacattgtaattctagcattatctgcttaacctctctccatgaaaagaaatttgactaaaatcattttgtacattagttgtatgtatcaagggcataaaaatgaaaatttcaacccagatcaaataaaaataaccccttctcccctctttagacaaatctccttaataagcatatatccagggaatactttttagttaacatggatcattctgtattattattgaactcaagaatttaagagctagaaagaacccttgggagagtctgacctccagtgtttacaagggaagaaatggagacagacttattagaaatggagatttggtgacttattgatgagaagatagctgc

SEQ ID NO: 12480 - DNA, 1224 bp, Homo sapiens
cgtgacctctgtcatcctgtcagttcatctaagttgcagaaacaaacccaatgtgggaatgaggggaggcttagaactaagcctttcagtattttaaaaatattttaaaaattattattgaatagtcctgggagtttggtagtttaaggatttcatgtcaattttaaaagattatttttggaatcataatgaatttaactgtggcctttcttttaaaaaaatattattgtgttctagatgatgtattcatctgaagagtataagaagctcattatttctttgttttaatatcactcattagcacagaaatgaaaatgtcatataattcaatgttttgataaggaatctctgtttcactttaattaactttttgagaagcttatgcatgtcaactgtaatatgttacctacatttatataaaatatatttcctgtttctaaattccttcttctttacacacaaaatttagttgtgaaaactccaaatctctatcagcattcacaataaacagatgtaatcctgtacttacaataatattgtttttaagtgtatcttccagaattttctacttaaaatgaggggaaaaaaaagcaaggaaaaaacttaaggaattcccagaaattgcaacagggtctgcttctgtgctgatgagtggctccttgaggaacatcagccctcttattaatataacatctggcttgcatcttgcacaaataaaaacataagagtgagactgaagtaacagaagagggaagtgggaggatgggatgtgggttttccagcataataatttttaacagccaagaaatctaattagaagaaatgtcatttaatgaggctctggtcaaggtaattccacagaagaaggcaaagcctcatgggaccacaacaaaaacattgaatctgttagataatttacaaaataggtaaatggtatgcattgctgaaggacctcattcaatcaaaaccgtgattatcagtggcttctctggggaccatttatgactttaaccacagaaattccattccttggttaatatgttttgagaaggcctgtactgttctcatctgcacgatcagatttctgtcatttcctttgtgcattgtcagcctggaagacgagcgcatacctaattaacaacagaaacagaagccaattctcatgctgttacatagatgagtggaatggttcctcctctatacgaaacatcatttctaacaatt

SEQ ID NO: 12481 - DNA, 1531 bp, Homo sapiens
tccctctttactgggtttgagttaggtgcataacatggaaaggagtggtgccttcaaatgaatgtgaccactccgtattgtggagtgacttccctagggcatcctatacatcctaccacagaaggccaagggacagagcaccaacttcagtatccaagaaattagatccacaactcttgattttccacactgaggactgtcgcgagtaagttgtaagtttgccgtcttccttctggcttagcaggtgctgcagctgtactctcgactcctgtctgtgagcgtgagctcaggaaatgagagtggagtctattccaaaaaaaaaatgtgatgaagtttttcataaaagtgcattcatatgccaaatcctttttggaggattctggatgctattgttcatttctctactagtaaaatgatcaagccttcatttattttaggctttgttttttgatccattttgttttccctgctgtaatgagaataattgtttggaaatgtcatattctgtatttatgattctctgagaaatgcttttgtataagtcttaggtttgacattgcagtagttgacatacacggtaaaggataacctagtgacaaatcactgaagatgcttcctttgttacctcaaaaaaaaaaatccagacaaaatagcatttataaatatagaaaacaggattggctgttttccaagaacttcaagttaacaattcttatgcaaggaaaagttcttaatgctaaagacttgttctgcatgaaggagacattctttaataatggaagaggtggttttatttttactacaagccgactcatatttccaaacctataaccaattgctgatctcctgtgtaaagcatttttttccttttatctgaaacagtgatttatatgaactgttggaataatggaacctcaaactacagatgtgtatgtaaaattgcataaatgcactgacttccttctccctgactatatttttaataaacagcattatcctacatggtcagttttattaaattatacacaactagagggttcttctaagaagtgctatgtgcttgcgtgggtgacttttggaaagcttcctattttggtaagtaatgcagtgagtgaacttagctttttttggaggcagatagtggagaacgctgtagaaaacaaatacacttaaaaaggtggccctgctacctgcttgttggtggagcatttgtgtaaggtatccctatgcgccggcaaaatagtgccattggcgttgaaaatgtgcacagacaatagggcctactggttggaacactatgaagtcatcgtgcttgactttcaagactggctcttctgcccttagcaaatgtccagtctatttcactgaaacagaaaaagcaaagtagaattgatttacaaaagtgaaagatggatttttgttagaagagtgatgactgaatttaattttatttttaaaggtctgtgtacagttacacaactcacatacgtatatgcacatatacacgcacacatacattgtcttgatacaa

SEQ ID NO: 12482 - DNA, 3010 bp, Homo sapiens
actcttgtcacccaggctgaagtgcagtggcgtgatcttggctcactgcaacctctgcctcctgggctcaggcgagatcctcctgcttcagcctcctgtgtagctgggactacaggcacaacacagcaccatgtctggctaatttttgtatttttgtagagatagggtttctccatgtttcccaggctggtctgaaactctcaagcgactggctcacctcggcctcccagagtgctgggattacgggcgtgaaccactgtgggtattccattttaaaaatcagaagacataaagaactgttgcctccatgttatacagcgagtttttaaatgataaattaaagcaggttccttgcacttaatgtatattgaatgtgcaattgccaagcaagaaagaatatcttgtgtgtaatattgtacggcaaagcagtggaatgttttctgatagctgatgttttttaaaaacttaagttccttgtctttctttttctcttaatcaggattccggagtttgaatccacctttgacaattgtccgaaagacgtttgaatcaacagaaaacccagatgacttcttgccctctgtaatgacttgtgtgaactatcttaagttgccggactattcaagcattgagataatgcgtgaaaaactgttgatagcagcaagagaagggcagcagtcgttccatctttcctgatcatagcaagaaatgcagtgtctgcctgttacagcaaaagaaacaaatcatgatttcttttctaatgttatcacctgagtcaaggaaacatgttacgccttcttgttgtaggaaaaacggcttgcagattataaagagacatttggttgatattcattaatggccccatggacttaaagtgatcaggccctaaaacgttgttgtgatgaggtttctttagcaagttcttgtttaaattatcatttatttgatgagtgaagtttttaacatgctttgctgtgtgaaatttaaaaaagggatgtttttccaggctggaacaataaatgtggctgtgcagtttaattctgggctgtgtgtatccatctagctaagtctgcagttttctttcctccaaagacaactcttgtacataagtacagaaatttaagctcacatgtatttgacaaatatagtttagtagactagctctatgtgcttttcactttcctctgattttctctccctgattcattattatctgtgcagctcacagttttttttttgtatacaactcacagttctcaaattttcgttacccatgggcttctgttgtcccatgttctctccagttaagatctaatttaaaattcattggattgaaatttattgaatataattcagcttttgtaactaggtagacttttcttatagtttagttttaatatagtttagggtattactggctttttcccaggtgacacactaaggactgtttacatggcaattccagcagcaacagcctctggaatgagacaaggaaagctcatttgtttcttttatgaaggttaagaagtctacagcttgggctggccggtatttattattctgtggccagaggattttaaattaatgtaaattttttaaacaaaataagcagttttccttccctgttggagtaaaaaaatttttttccctttgttgttttacgtttttgttcatagtcttctttattccacgctcctcttccccttctcccagtgctgacttgggacaaaacagttcagcctttgtctcgacgcagataaaagcacctgtaagcaatgctgtccagtcattttatgtgctgatttctcaaatctgcaataatccatcaggttaatgtttttacctgaaaataaagaaagtttgcttcacctttttgtttatagttttgtgctgtatgcataactttcaattgtatagatgtatttcaatgcaaggaaatccacatatctccatgattcgggtcatggctgattttgctattcaaacaatttataatagcaacttgaagaaactaaaatgtgaagagaaaatgggaggagattccttcctaaggtccaaaactaggcctgtggcataaatttgaaggaattttccataattcatctccttgaaaataagagatgagctagtttttttttttaattgaactttgagaaatcaatttttttgactgttctgtaagttttaattaattgacacaaaagcccttttccctatcccaccacccaaaagaaactcagtggcttgtttgacatagattgctgtgtcaatttacacttaaatggccttatatggaaatgtcccctcctgagagttcacttgggcagtgaccccattaagtggaagggaactgtcagaggagttgggggcagagaattctctccctgtctctgcagagactgacaagtgaatggcttttccctgaaatccaagaagggaattgtgtttctgcagttttcaccactaacagcacagttgctgagcagcttcatcaagtgaagttaaagactgaaacaatttgttttcaactgttctgatatcttcctgcaaattaagcacaaggatttttgtgtgaacatagcattttgttcctgatttttaaagggttctgttaaaatttagacatgtataaacaaaataatgtttcatctgtacttgacattttatccatgttgcagccctggcaaatttggcctcattgattccagcatctaataagtatatatgatgattttgactcaaactctaaagtcttgagtgtttcaaagtcagtcgttacctgtttaaaagcctcagcctttagcttattcctccttcaatacacgggacctttggttaatttggggcaggaaaactcttaaagtaatctctcttggcagaggccttattgcaccagagggaaaaagtatatacttcatttgctgttactccagttatgccttaaattcatttgcttggtaatcctatcaacgagcactaacttcttagtatactttaaacacttagttgg

SEQ ID NO: 12483 - DNA, 1072 bp, Homo sapiens
tacaaagtgtaaagacctacccatttgctgtgtcctagttcagcttgcttctcccacttctttctccagctcaatgttctctcccttggcatctgttactgtatacctttgtgtttctgaaagccaggatttataaaatctccctgactagaagcagattatccatttaaagcacctaaagtaatgagaagaaaggaaaactgaaatcaagggtcatcaggtgtttttggtttgagaggaagggtttctcaggaaccaagtccctgcagatgggcagggtacttaatagcgtacagctaaaaaggaaatggaatctctaaattttattttattttattattatttttttttttttggaaagaggtcccaagcagaaggttttagtactgagactgatactcttttatggtacacgtagacctttattttcactcacgtaaacaaatgtttccttagtaattctttttacccttatttaaactcacagctggatcagctcctttgtggcagtaaagcagacacttgggatgcaaagacactgatggaatgctgtaggcctgatcatggttatactcatgacaggtaagtactggggtctgccagtttttctgttgattctgaagaatgtggagaggggtgtgtgtgtacacacacatgcgcacatgtgtaaacaacaaaagttggagtggttcattttaaaatgtgtctacctgttaatggatgcttacttctgttttggccttatttctctgaagatgggaaattaagacccaagggtttctttctcaagtatttctgtgaaaatactaggggttggggaagacagatttaatcttgttccccattattacatatagtaaagcagaaatatctgtacagtaccagatcaagtcttacttattacaactgtaatcattccatttgaattctagtctagtcataacagaaacgaatttaagtacattgtaatggaaaatgtatgtgtaatttaaaagtgctaatctaatttttatgtcatgtgatgcgatgcagtgtgattaaaactctattttaacctgatgaaataattttg

SEQ ID NO: 12484 - DNA, 1085 bp, Homo sapiens
ttaatcactatcactagatagtatgttttttatatttacgatttcccaactgtattattagtattggctgtatacttatacagtattggattcaaaattagcctagaatttatgaaaagtttgtctagttctagggtccacattcttaaaattaactaatatgcaacctattatgcacttactgtgaaatttgatttgcatatgcttaaactgagcagcagcatctcataatgaagaagcacttcagctctcttttcttatgcttacttcctttgtaatctcagtgactctttcatatgtagattatgaccaggaaaaaaataaagaggctaagagttgaacccatcagctttattaggatagcttatattttattaggatatcttttatttttttaaacaaccgtaagttaattttgcttgacaccatttctcccccatttgtgttttttagaccaaagagagtctacagtatgcattagaaaccttgactatgaatggctgctcagttgaagatctaggactggatttcactctgccagggtttcccaatatcgaactgaagaaaggagggaaggatataccagtcactatccacaatttagaggagtatctaagagtatgtaactgtgtctttggggggtaggccagttgtgaagacggaggactttgcctgattgtaccttgcttctggctgcacacgctatggcttgagaccttccacatccccaggaccactgcatgaaggctgctttacaaggcactagcttctctttgctcttgagtgcacatatcagatatttcctgtcttatataaccttgaattatttctcctcaggcttgaatgctatctaattacaccacgttttcttagtttaaaaaacaagtgaaaagagacattatttgtgttctcactaaattgcatttttgcatttccatcaaggcagctagcttgacagaatttactccaggcaccgtgcagtgcacacttttatgtttggtgacacctttcaaattactaacttatgggcgaggtgcagtggctcacgcctgtaatcctcccagcactttgtgaggcagaagcag

SEQ ID NO: 12485 - DNA, 1131 bp, Homo sapiens
atagttttacagcatacttaagattatgtgcaatctcttttctgaaacccctggagtttggtcggtttcaaaggtcctacagtgtgtagtacattaaaattcccagcagtttctgaatagcactgtatattatatgcattaaatatttttatagcataacatgaatattcttactaaaatcagataaataaagactgtaaatagccttatgtctgtttggatcagattttgccaccaagtgacttgtgttttcagagcctttggatgtagagattgtgaatacaggattgtgggctgtacaaaacagttgtctttattgaaataattgacgtggtaacatcgttcaaaccaaatctgccataaaagataaagatgaatagacaaattattctcttttataaagctgcttattaaatcttctctttgaggagacttttgttttgaaaaggctttgtttaacctgtttgtttatttataactttagcttcctggagaagagcccattggaagagtggaaccagtgggtaatgcacctttgttggcattagttcacaagatgaacaactgcctcagccagatggaacaatttccagtcaaagtacatgatttccctagtggaaatgggacaggaggcaggtaaggaccattgcctggctatacccttgccactggaatttggtacttaatttcactgaagtaagatggcaagaggtctggtaaagtcttgattggcccagaaaacattcagctgtaatgatgaaagaaattaagcactctaaagaatgaatcaaatgctttcttatctttaaaattataccatatgccttaaacaggatgctttataaatatataatccagtgattgtatttgtaacttgtaataggcttagttttccttaaattgatacacttcagcatacaaaacttccttaagaactttatgtttaacttcagtagggataaaaaattttttgtggctgtgagtaatgtttacattttgagcgatatgatttatatgtaatattagtggctataactttgtattttgatggggtcaaatgtttgaagttttactagtttaataaatatatatatttttaatgtagttttaaggactcttgaggtgctacag

SEQ ID NO: 12486 - DNA, 2256 bp, Homo sapiens
gtgtataaaaataattaagtgaatggatttctgaagccatcagcatttgtaatttaagcagccgggtcttatttgccatagcttattacatccttaataggcgcatgtttctggtctgtaaatctttacttcagctctccaggaaacacaagttaaggataatgcagatatgtatgtactttaggaagtaaagggaacacttaggaaagtgttatattgcagggttccaaaaaattattacactttgtttacaattcatgtaatgacctgcagtgtattttaagtttttaaacagttctccaggtggtacatcgtagcccattttcaaagtgaaagttaatttggttatggaatctggagtttttaaactgtaagcatagaccaggatgaattttaaatgtagcagctatttgccttgatcagaagttatatcctttctacatacactgggactttaatatctcctttttgtttcttgtagagaaaaaattaaaggttggattaaggagcaggcacataaatttgtagaacgttatttcagttctgagaatatggatggaagcaaccctgcattgaatgtccttcagagactttgtgctgcaaccgaacaactcaacctccaggtgctgtgtccagtgcattttgctggtctttttcagtctcttcccagcatctcctgctactcttttccttcatgactctctagcttcctatggatttagctatcctacatcgacttttaccttatatacacccttggtgctggcatttcttttacttatcccttgactatcaggattcatcagtctgtattaaatgtactagaaacctcatctttgactttctttccttcacatctcatcattcttgacaaatgaagaaacttcagaaatgtcctcacaagcacatctgttttctaagtcatcctcaactataggtatagatgataggccttccttagcccctctcttcacatggggtctcagagtggcaggagaggctagaggtttactaataagtgttttacgtttcatctggttctcagtttttgttcttatttttatttttatttatttatttattttgatgtttttgatgtaccttgagcagttttggtagtatgttttccaagaaattgttcattttgctgagaccttaaatgtattaatttaaagccacaccttgtattcttgattcatctttccattctggtgttatagccccttattcttcagttttctgttctcatcttttaaaatactcttttttaaagaaaactacattggttgaatatgaagattttcttcttatgttattatggattcctggttttcctcatgaaatatttagtgtgtgtgtgtgtgtgtttaaaatcataatttccaaggatttactaagactgtaccactcccctgccctcttttttaagggcgttgagaatatattcatttccttttgaggatatgtgagttgtgtattttttaagtgctgcttaaatcaatatagaaatacttttcctaactctttcaggtggatggtggagctgagtgccttgtagaaatccgtagcatagtctcagagtcagatgtttcatcatttgaaatccaacatagtggatttgtgaagcagctgttgctttatttgacatctaaaagtgaaaaggatgctgtgagcagagagatcagattaaagcgatttcttcatgtatttttttcttctccagtaagttatctaataatgcctgtgtatcttttaagaatcagtgctcactaatgcatatattttcatctcagtaataatttccagcaggtcttggtcaagacattgagggaaaacttctaggttttcacatagttggaatccttcaacttctgtatatcaaagtaaatagtaaaacaatgaaatggggatttaacaaagcccatgtcactatttctatgattgaagtatcttgagtcttttttgcttgcaggatgagccattaatagtagtctctcacctgtgaatgtattttacttgcaatatttgtttttaaatgtattgaagtttgtattagttccttttagtgaaacagacatctataataagatagaggagttatattttcttgttttgtacataaaatacagttgtaacagttccaatcaagggcgcttaatgaccatttatgtcaccgtttataatgtggattacaaagccacagagtggctccccttccttcactcttaagtgggccagagcaagagggtaatcctt

SEQ ID NO: 12487 - DNA, 1532 bp, Homo sapiens
cttaagctgctaagtgacttgcatcctatggtgggttacatgttagagatagtatacatggatgtaaattagagaaaatatgtagaagataagttattgggaaagaacttaaatgataaccttatggtaactatatatatgttcccagctgcaagttattcagtgtattgatgtggcagagcaggccttgactgccttggagatgttgtcacggagacatagtaaagccattctacaggcggtaagtgttgttactgaaggggactacatttcactttatgtagaatttttaaaatccacatttgtacaggctacttgattgcagtttttgtaagatacaaatgttgtttccagagtaatgtgctagactttttatgagttaaattattttttattgctgataaaggatttttctttaccttaacagttttctatattttagggtggtttggcagactgcttgctgtacctagaattcttcagcataaatgcccaaagaaatgcattagcaattgcagctaattgctgccagagtatcacgccagatgaatttcattttgtggcagattcactcccattgctaacccaaaggctaacacatcaggtaaaatatgcatctattttatgtgccataaagtgttttattactaatttttttaattttatattttattttattttatttttttgagatgggagtctcgctctgttacccaggctagagtgcagtggtgtgatctcagctcactgccacctccgcctcctgggttcaagcgattctcctgcctcagcttcccgagtagctgggattacaggcgtgtgccaccacacccagctcatttttgtatttttagtagagatggggttttgctatgttggccaggctggtcttgaactcctgacctcaggtgatccacccacctcagccccccatagtgctgggattacaggcgtgagctaccgcgcccagccacttttttaaatgacaatttcaattagtattttaaatctttaactgcatatataatcgaaaatgttctgatattttttatttttatccagttatgtgccatattaggttattttataaaattttggtagatttattcaaatgaatagtaattcatatgtttgatgactttaacaattttgacttttaagggatggctttgttatttcagcaaacattgagtgtttactctgtgatatgatcagaagttccttctgaaaagattactctttcttgagaggcattggaggaggcagatgggagcaggagaatatgggttaagaccagaagagagactagactatgtcccaaacagaaatgaaaaatgtagtttgtggctatctggggttggagaagagcaaaagtgattatctaggtggcagaatcaatggacctgatgataacagtgtgaaaagcagggtttatgggccggggatggtgaggacaaattgtgagtacagcttcaaggctatggagaaattgaatttttttttagctacagagaaatattttaaagcgttgt

SEQ ID NO: 12488 - DNA, 1199 bp, Homo sapiens
gtgttcaaatgattctcctgcttcatcctcctgagtagctagaattacaggtgcctgccactgcacctggctaatttttgtatttttagtagaggcgggctttcatcatgttggccaggctggtcttgagctcctgacctcaggtgatcctcccgtctcggcctcccaaagtgctgggattacaggtgtgagccactatgcctggcctgttttgttttgttttcactttttggaactaataaaaatcatactgttttcatatggttttataggttctgatgaccaatatctgattgggaaataatgtcatacagaaaacagagcaagggtgcttaacatattagctcttcaaaatatcaaaatatttaccttagatttttcttgaaatatttacacattcctgctggcactgatttaatatattagggtggtcttgaaagtttgtagcttctcttaaaagtccagaaagcaaagtaacattgactgaatcagttaagcgagatgaatcagttacttgaaatttttagatacatcagttgcatgaagtcatcttagttgttcactctgcccttcttttttctttagctttgttagaggcaaggggtcttccccctcacctatttggtcctcttggtcctcggatgtcacagcttttccatagaacaattggaagtggagctagtaagtaaaaatgttccttccctgaaatccctcaataattagccaactgctattgttacttgtaacctattgatgtaagtattaagaagtttttcatcaactttaacccatttttaaaaataaggctgtgtacaatcacaccttaaatacagctttcattgctgaattatccagattttgtagcgagattgattctgtttgaacaaaataagaataaagaatctcaaacaattacattgataattatggcacctgatggcatgttttgcatagatttgaatcttgagtttgtcataatgatgtatttgtcaaggtgagaggataaaatattaaacagtttgctagctgaattttttataactttaaatatttggacataaggatgttggttttcatgtgtactttttatatatatatattttttttgagatggagtcttgctctgtcgtccaggcgggagtgcagtggcgtgatctcagcttactgcaacctctgcctctcgggtccagtcctcccac

SEQ ID NO: 12489 - DNA, 1485 bp, Homo sapiens
cttttaatcagatattttagtatccaaagtcacatctgcttttgttttgttcttttatttcgttttacagatttgaaccttctgaaaacctatgtttaatactggacttagtaggaacatattcatactttattttttgaaagcattatatatgacagttgtaattatgacaggctgatattaactgttttcttatctaacctcttagaagctgcagttcatcatctgctgtgatagttccacaaccagaggatccagacagagccaatacttcagaaagacaaaaaacggggcaggtgcctaagaaagacaattctcgaggagtgaagcgcagtgctagtccagactacaacaggaccaattctcctagctctgcaaaaaaaccaaaagcacttcagcatactgaatctccctcagaaacaaataagccacatagtaagtcaaagaagagacatttagaccaggagcaacaactgaaatctgcacaatcaccatcaacaagcaaggctcataccaggaagagtggggccactggcggttcacggagtcagaaaagaaaaaggacagagagttcttgtgtaaagagtggctccgggtctgaatcaactggtgcagaagagagatctgcgaaacctaccaagctggcttcaaaatcagccacctcagccaaagctgggtgtagcaccatcactgattcttcttctgctgcctctacttcctcctcgtcttctgctgtagcctcggcctcctccactgtaccaccaggtgccagagtgaaacaaggaaaagatcagaacaaggccaggcgttcccgttcagcgtccagtcccagccccagaagaagtagcagggaaaaggaacagagtaaaactggtggctcttcaaaatttgattgggctgctcgtttcagccctaaagttagccttcctaaaacaaaactgtctcttccagggtcttctaagtcagagacatcaaaacctggaccttctggattacaggccaaattagcaagtaagtttacaaaaaggtatttttctttaattaaagaaagtttctcttggtttgtcaaaagcaattatgctttaaagttaagggttttttccccccagtcttagataatcttagatgtattactgtctgtgtaattaagtacataacagcatgtagtaagtgctactacatttagttttgttgagacaggtaaggaatactaccttcctattattacgaaaccatcacattttagtgtctgtgtctttattggtcctcgcggcatctcctacttcactgatttcctaatatcaggatgggacataaagttggattttcttctataccacatacaaaattatcatttagttaggagttctttttagttatgagttgccatgatcagagatcaaatatatatatgtttttttagatggagtctcactctgtcgcctaggctggagtgcagtggcgcagtctcggctcactgcaacc

SEQ ID NO: 12490 - DNA, 1195 bp, Homo sapiens
ttcatgtaggtttatttattgtttagtgcttgaaatgattttctgtgtaaaatcagtttgagaattggttcgtctgtctctgcatttgctgtgtttacctgaattttaagtacaaattggaaatcggtatcagtgtgggaatcatcaattgtcttttccgtaaacttttaaagccattacagtcacattatgtattaaaagtgtgtttagatctaaagtctaaatttgctttttgttaaaatgtagcatatttgaatatctgcactaaaattgctgaaaaatgtgttactgcttaagcaaccttaacaacgctgtgcaattatgactactggtgataataaactcttcggtattgcggggcgggggtggttctgagaggcaatttctttttgccagattatttagtagaataataattaaaatttataaatatttggaaaaagggtagggtcaacaatgaattgtgggaagctttaagaaatatataaaaatatttcattttcagtattgtatttgcatctcagtttcctgatagatttctgttttgattttctgctgacaggtcacatttagggcaggcaaaacataagggatatagccctcctgagagtagaaaatctaattctaaggcacccaaagtgcagtctaatactacttctgaactgtcaaggggacacctttctaaaaggtaaatcttcatgttgcttatacattttcaaggcagaattatttgcattcaaatcattgcataatgttaaaacttgaggttattccaaaacgttttgatacatattttcattattctctaagtaacttttaggattgacagtttatcacctttgcagtgattagtgcagtataccctagacagtgagtttgtcaatgataaaatgatatttttgtttggagagccgtaagattccccctttgcttaacaaaccattatggccattttttatttctttttattttttaatcttttttttagtttttattgtcagagccatagtttaggtttaagtcagtgattcttaagatttaattgttaagagactttggaaagcaatgttaactttgaagatttgatagtactacaatataaaaatctctaaccttcattttgaaagtgcgtatgttaatgcttatttcttctaagctttgacaaagcagttgtgcttgtgaatagggcatcaat

SEQ ID NO: 12491 - DNA, 1142 bp, Homo sapiens
gaggctccggggccgtggacggcccggaaatggaaactaggaagcagctccagtgacaacagttgtgggaagcgagggtcagagaagggagaggccagagagactttagaccgcagtaaggggtttcctgcccagggggacggcgagggacggttgagggagggcgagcccggagacggggtctgcgcggggcagttttttaagccgtgggaagttgaggctgagggaggatgatgacgaggggggcatgcagggaggcctaaagaagccgagaaacttgactgagaggaatagagtatccttttaaatagatcagaatggaaattggtggtaggtgggtttaactaggacttgggggagggaggtgggccaattgtcaccccaatcgtattagcattcagagcgagtcaggcgattaatttatttatatgtggattacataaaacctattatttacaacgtttgtccatcagttcagcccctctccttccttctccatagtgagtgggtttctagtacaggaacaagttagaggggagttcgaataacgaaggtagtaaaacctcaaatcctgtcttcctcggcgtctctcccttcctcagaataagaaatccttcatttcctagacggaaaaatgcggaaaaacataaaaacacatgtaaatcggggggaaatcacactttgaactcctggtgggggacaggagggaattggttaccttacgtggtgaggagataacggaaggggcagcttccaaacccttaagacaaatgttgtgtttttttgataatgctgttttactttgggggaggtttagcctaagcatcgagtctggtggtgggcatagtttaattgcttctttagttaattgggggagggaatgtgtttgtgtgtaaaggttgggccggtgcggggggaggcgggtacggttaatagcgcagtgaatccgttctaagtggacgtctaactgctctcctgctgtctcctttcctagtcgcggtcctcgatcttgcctgggctgccagatcacccgatctccgggctttactccgttttgtaggccctttagtgatgtgtttaactttatgttcctctcgagagtctcattaggtatttttggcatttcattttttaaagaccta

SEQ ID NO: 12492 - DNA, 1182 bp, Homo sapiens
tcatgttcttcactttcattgtatcaactccatgacactgaatatattcttttttgttttgtagggtggatctatgacatcacgcaaaaatatgatttttccttctacatatgtggtttgctttacatgataggaatactctttttacttattcagccgtgcattcgaattatagaacaatccagaagaaaatacatggatggtgcacatgtttagtatcatgtaatgttccgtgtaggtttcattgtaatactcatgcctacctcgcatggttgctgtgaggcacctatgacaggacgtgggaaagcattttgtacggtaactggcactgtcatttgtaaatgccattgtcacagcctcatttgtaagcagcactgcctctctgtttggggagatgtaatgctggaagatcttaaggactacatacattctagagatgacagtgttgttcaaagacagcctagtaagtaattggtagaaatgcccttataaaaaccattctcttgtcatctactgggactagggttttaaatacagcttttaaaaacaaaaacagggaataaaagcttttcaactcaaccacttctttgtaagacaaaactgaagtatctgtgtgcttccagaaagcttacagataaatgggtttcaagcacaagaatatgactagatttcagaaattaattattacagggagctattgatctactagcatcaaacaaaggcaagctctaattccacaggtaatacaatttagtgcaattaaagaaacacggcttgtatttttatgagggaattctgcagctagggattgtgactcctaaatcctcctctaaaagaaggcacttgccattaatcctaattcagtgctatccagttataaatggaatcttgagacaaaaccttaacaaagaaataacagtaatgatttccttagcagaagccgtatttgtacgcacaacattaaatcaagggctacaattcaagcacttttattcgtatcattggcctcttagatgatataagcatgaggtggggcctgtaatatttttttctgagtttcttctgcccaaaaatataatatagaactaattgctaactgacaaataaagttaatagttaaatcatctccaaggaatgttgctaatccaaagtataacactatcaatttgtgaggataataaa

SEQ ID NO: 12493 - DNA, 1887 bp, Homo sapiens
agttgacatgcgaataaattgatactgaaacttagcaacttcttaaaagtgtaaagaagcctcataagatcataaggaaaatgtatatatgcttttcacagctttctagaattttttgacatttgattttcttgagacttgtaaacctggatatgttgaagggtatttgttaattttacttttcaaagatactttaaaacagtagagctagcaatgacaccttgcatttcatttcaacactgcttcaaggtttcttttgtatataattcttagaatgctcatttcttttaaatggtttaatttgtacagcagaggaatgttattgtagtagtatgtaactattacctaatactgagtttttgcaaaaaacaatgaatgctcatatgtaattgaaatacttcagatcacatgaaaatgctgatttaacatttaagtatcacagcattaaaagaaaaagaaagtaaaccagtcctttgtattcagttacctaatggggtgccatcaataagctgcgatacagccctggagctcagtcagccacaccttcctgcatcctattggccttattcattttaaatgagttaatgaatctgccagatctgtgaatgatagagattatgctaaattaatgctgattctttgtgtgtgtgggaaatctctgtagagcaccttttctttcttagactaagtaacccagtacaatagttgtgaactgaataattaaaactttggcttctcttaggaaaagacgacttcctagtcataggtgtcctatggggaaatttattttttttaatgtcctgttccttaatgctgcaaattatcagtatttataaagtaactgattttgcaccacttttttgttactgtgaccacggcagaacaatgtcttctagactatatctatgtaaagttattagaatggtatctgttcattttagtgatatgaagatcacaactaacaactgacaaatcagagtttgccagttcaaattcagcatggctgcagctgattaagaaattgatatgattattctttgctagcctctcttactaatggaattatatactggccagtaaaatgggcctcccaattgctgtttcagcaggttttaaaccttcaggaacaccagttaggaaaatagctccagaaaatatagatatattttatttttattaaaatggcagtctacatcataattggcatttctcaagactgtctttaccagaatctgtgtgaaataaggcaatctagtctccttgaaaaaaaaatctcttggatgtttaggaaggaagacttggccgtgatgtggtgtcctggctttgtggtgtagtgctgtgtgtatggagttagtgtaaaaacatggattacaccaagtggaagaaacgtcttcttgccaagctcattcttagaacttacacatctagaacagcttccactttggcagtgaggtcgtagccttttaggtggaagaagtgagggtgcagcgtgtcagacacaacattcatgttactcttacattggaatctgaaggtagttcagacttcgtgggttttgtttttaagcaaaacaatgtgaaaacatttaagtttgaaatgttgcatttgaagttatgatcatttaatatattcatattaccaagactattatactggaagtggtttttgtgttataaaggtttaattttacataaggcagttacttaatgtgatttttaacccttaaaaaagtggagatgtatacatttgttaacaatgccatgaaagcattttctttctcctaaggaaaagtgaatttcttatcagaatatctggctggccctgtaatttaaattaaaataaaattttggagaaacagcattgtctgtctttatgatgtgttataga

SEQ ID NO: 12494 - DNA, 1925 bp, Homo sapiens
atcttcacgcctagcccagctgtcagagagctcagatagcagcagcaataacagctagcattagcagagcacttccgtgtgccgggcaatgctgtgtgctctttatgacctcttaagagtgtaagtcattctcatcctcattattatttttgctgcccattttaaagatgaggaaacaggtgcagagaggttaacaccctggaggtcacacagcagggaggtggcagacatgggcaggctgactccagctttcgagctctccccatttctcactgtgctctttgggtgaatctgggtgaatggtgtcacttcctggccctcctgtggctcaggctgaggctggtggtctttgtgactcagccaggatgcagggctcactggggtttttctttttcctcccagggatcaacaagcgtggggccaagaactgcaatgccatccgccacttcgagaacaccttcgtggtggagacgctcatctgcggggtggtgtgaggccctcctcccccagaaccccctgccgtgttcctcttttcttctttccggctgctctctggccctcctccttccccctgcttagcttgtactttggacgcgtttctatagaggtgacatgtctctccattcctctccaaccctgcccacctccctgtaccagagctgtgatctctcggtggggggcccatctctgctgacctgggtgtggcggagggagaggcgatgctgcaaagtgttttctgtgtcccactgtcttgaagctgggcctgccaaagcctgggcccacagctgcaccggcagcccaaggggaaggaccggttgggggagccgggcatgtgaggccctgggcaaggggatggggctgtgggggcggggcggcatgggcttcagaagtatctgcacaattagaaaagtcctcagaagctttttcttggagggtacactttcttcactgtccctattcctagacctggggcttgagctgaggatgggacgatgtgcccagggagggacccaccagagcacaagagaaggtggctacctgggggtgtcccagggactctgtcagtgccttcagcccaccagcaggagcttggagtttggggagtggggatgagtccgtcaagcacaactgttctctgagtggaaccaaagaagcaaggagctaggacccccagtcctgccccccaggagcacaagcagggtcccctcagtcaaggcagtgggatgggcggctgaggaacggggcaggcaaggtcactgctcagtcacgtccacgggggacgagccgtgggttctgctgagtaggtggagctcattgctttctccaagcttggaactgttttgaaagataacacagagggaaagggagagccacctggtacttgtccaccctgcctcctctgttctgaaattccatccccctcagcttaggggaatgcacctttttccctttccttctcacttttgcatgtttttactgatcattcgatatgctaaccgttctcagccctgagccttggagaggagggctgtaacgccttcagtcagtctctggggatgaaactcttaaatgctttgtatattttctcaattagatctcttttcagaagtgtctatagaacaataaaaatcttttacttctgaccttgacttgagtgtggctggaggggagatgggtgtaggaggggtgctccgggcagggtcgaggagctggacctcgggagcagcaggcagggagaagcctgcagaccttgacatctggcccctaaagagctgggcatcctggattcagccaaggagtgtaggatatccccttcgtagcaccctggatctgagccaggtagagttcacactttccgggtgaggaggggaacagggctgggagagcttaccgactcgcccaaggtcgtgctgctttaagtgcct

SEQ ID NO: 12495 - DNA, 1213 bp, Homo sapiens
gggagagcaccagacagatgtggcagtactcaatgcttgagtcactgagagctgtgttgtgtttcctggccagcaagtgagtgtaggcagtaagtcatgagggagtctagtagcaagataagaagcagaaagacttcagcagacacatttggaaaacatagctacttagtgtatggacagttgtatatcttttataataattaacagcatcactttattatagtatactatgttcatgtaatagtgattctgagtaccactaaatattatttttaatccattttttatgatgatgtggaaatatgtaattcttttaagattttcatctaaaatggtttaaaattcttgagtttgtattgcttaagaggtctaaataattggcttcctagattggctaaagaagcaagattaaaataattcaatttctaaataaatataatgctgcaataaccagataacgttatatctttaaactatctctttcagaatgatgtcccaggaatgttagcttatagccttaagctctgcatgtctttaatgcagaataaacagtttcggaataaagtactaagagttctagttaaaatctacatgaacttggagaaacctgatttcatcaatgtttgtcaggtaatgacattaaattatgtttcattacattgctccacgctgtactgtgctatgctataccacttcacattttattactttatattactataatggctttatacatgtatctcagctgatcttcacagcagccctgtgaaaataaggtatgtgctttatattcctttttattaataagaaactaaatctcacaacactaaaaagctattttgttgtaacacattctttctttgtattcttttttcattttgaaaatccaataatttaaggaaatttttagaaataacgaaggttttttaaaaagctagaagattaaaacagtgcctatgctatactatatcattctaaagagaattcaaagtgtataaattatatatggtttcattacccatacacaccaaaacatttgggtatcttttctttatctctttctatatataaatttgcttgcacataaaaaaaaattcagatggtacagaaaatatataaaatgaaaagtaaggcttctctttcccatcatttgggctttttcccaaaggtaagacatagatgtttttccctacttattcacacatgtggatct

SEQ ID NO: 12496 - DNA, 1134 bp, Homo sapiens
cagaaaagaagtaatttttctggggttaagaaaaaataacagtttattataattcattaacaagtacactttgttaagtcagataagtcattttgtggagaaggctaaagtaaataagatactgaagtatttatatgtgtgtttgtttttaataaaaagtggaaatttgtttctataaagactgtgtaagccattgaaaggataaattgaaatgttatttgcatagtctgagatggatttgggcaaatgttataaaacaaagggaaaaaattgaagcatttgtgattttttttttttctaaccagagtgtaactgggtctctttaaaggcttgtcctcttgtttgagttatacaattatatgagagagagccccactacctccttctctcttagcaagtgaacattctggggaaaaggcagtaatcatagaaaacattgtcttttttcttcttactttctctttttgatgtctttgttatgacttacctttacagggtcatgaaaaagaagcattacagttaatggcaacataccttcccaaggatacttctccaggatcagcctatcaggaaggtggaggtctctatgcactaggtcttattcatgccaatcatggtggtgatataattgactatctgcttaatcagcttaagaacgccagcaatgatgtaagtattaaaatggaaaactaaatttccaaaactcaagaatccaggataacatatttgccacattattttagtgactggagattttgtagaatttgcgaatacccaaaacaactgtcatcttggattttttttttttaggtaatttcatttccttcttgataagctaaaattgtgtttctcactcctttaaaccctgcgtgtatttgtaaaacatgttgttttcccacactttcatcttaaaatgttacaactacaagtgaccttagttatcatctagtctaggccctaacattttactggaaattaaggcctaaagaagttgcagtctctcagaagttagaatccttgcttgttttgatctttgataattgtttaaaatgtaaatcttttggaaaagcttactaagtagccctgttcttattttaaggaaccttaaaatgtaattttacactaacttctata

SEQ ID NO: 12497 - DNA, 1234 bp, Homo sapiens
agtttctacctatattttgtagcctcttaaaattccgatggatttctctagttgaagaggaagtgaattttgctccatttgtcaaagttatcttttaaaacaagttttgtgatatataggctttctaaaatggtatatcctgtgtgtccactttcataactgacttttgcaaacaggaatttattagggtgatctgcttactccatactgcttggcgataatatagaaaaaatgttatctaaatgtctcctttgaaatcactgtaggatttgatggtacattctgtcaaagtttaaaaggaaaacaaccctaaatatgaatgtgcgaaccctaaatgtatgaatgtgcttccacataaagtatcctttttaccaggtggtttaaaaaaatgctatcagaagctaatgatttttttgatagtttatgcaaaaagagtgctactttcagttggatgttttactgactttaaaaacataactctctgttaacattttactcgttacttgccaggggaagcagctggcctggccctaggtttggttatgttgggctctaaaaatgctcaggctattgaggacatggttggttatgcacaagaaactcaacatgagaagattctgcgtggtcttgcagttggcatagctttagtaatgtatgggaggatggaagaggctgatgctctcattgaatctctctgtcgtgacaaggtgagatcacatacgtccctcactgtccatttatctccagcatgtaaaaaacacttaacttcactggaaattaactctgttcccatcagaacatgtaggtacacttattcataaaacttctggcaatgtatatgaagcctaatagaatttaagaaataaaagcactgattagaaaaggtacatgggagtaatttgaggattttaaattttgctatagcttcagatcggtgatactcataagcagattcagcatagttctttaggaattcacgagttgatttcttttagaaataataatttttgggccaggcgtggtggctcacgcctgtaatcctagcattttgggaggccgaggcaggtggatcacttgaggtcaggagttcaaaactagcctggccaacatggtgaaaccctgtctctgctaaacgtagaaaaaaaattagccaggcttggtggcggacacctgtaatcccagctacttgggagcctgaggcatgagaattgcttgagcctgggagacagaggtt

SEQ ID NO: 12498 - DNA, 1168 bp, Homo sapiens
aaaaataattgctaaagcaaaaatgcagaagtcagaatttcttcattatcaaggcttctttatcagtttattattcaactaaagtgatactgggggatttaaatctttcatgtaacttaggaaatgtccaggaattactataaatgacttttgtcttctggaacaaaatgcaaagtaaccaagaaataggaaaatagatgtagagcagtgtgctacccccaacatggctgttcctgccatggaggaggtaccagagaataactggaatccagacctatggctgaggactcacttatactgagaaaggagtcccctttctgtacatatattctctgaatattgaagatcagatttcttctatcaataattagaactctatgaaagatttttaattctgcaatttatgttttaaatgctcattgtttcctataactttttcaaaaacaacttggttaaaactcttctgtcttaacttaaaatagattacctataacagtggcttcgctttctgtttcttatcagaacccctgaacagtgcccaagtgttgtctctttgttgtcagagagttacaaccctcatgtgcgctacggagctgcaatggccttggggatatgctgtgctggtacaggaaacaaggtaaagcccacagccaatggggtcagttctttcttggcgccagactgttttccctcgccgcagaatttatgtaacagctgtaaaaatacaagtgcaatgtgatctgtaagagtaaacttgccatacaaagcttcccagtactccctcattctgcgatgctggattgcccaaagctgcttaagaataaatcgtcacattacatggatagctgtaactgaaacagtgcttttgaatttctttttgaaatcattgatttctgggttttttgtttttgttttttttgtttgtttatttgttttgaaacggaatttcactctttcatccaggctggagtgcagtggcgcagtctcaccatgttggccaggctggtctcgaactcctgacctcaggtgatccacccgccttggcctcccacagtgctgggattacaggcatgagccaccgcaccaggctttttttctttctttttttttttttttttttttttcttttgagtcttgctctgttgcttgggctgaagtgcagtggcag

SEQ ID NO: 12499 - DNA, 1204 bp, Homo sapiens
ttagtttgggccttagagaaaggcagatttatactaaccttcctattttctaaacttacttttgaaaattatctttcagccttgatagtttcctaagctttacccaacttgcacagtacagcgtaggctatcatgatcactcagtctgtctgagaattgaggtgactcacgttagctcccatcaagcctttggcaatacctcatggaaaacccttgattacagctttcaaggcagttaattacaaaatgacttagaggtttatagctggaaactggaatcttgttagttttcaaaggggtaaaatattcagtccattaggagtttggaaactataatctgtcgtggcacaaactggtatattaggactgcagaggcagggttggggcctagttttagatttcaacagttaatagtaaagaggaaaaaaaagaatgtcttgaaattaagaatgaccctagctactactgttctttcttccctttcccaggatctcacttgcttatctgaagaagattgtccaggctcatattgggaatgcttatgaggaaattcatgccgagacctgctattcaatgcatgtatcgttgcctctgcactgacctgaagaaccctgtctccaagtctttggttgaagagaagatatatgactgttgagtgtgctctttcacagaacttggttttcaaataaatataagatctccagatggacaagacatttgtttttcagcctgggtttttaataaatgtatctaatcctccccacaccatgaaatgcctaaatcccaagagccagagtcttgatttgctaggatgagtatgcacgactttcatattgatgaaaaagtcaaactattcttaaattatagaccatgaaaataatggaagggaaaaaaatcaaaccttgctcatcacccccaagaattctctacagttttgttgtggttgtgggttgttgtttaatatggggtctaatcagccagggcaacatggtgagacccccatctctacaaaaaaattgaaaaattagctgggtaggccaggcagggtggctcacgcctataatcccagcactttggaaggccaaggtgggcagattgcttgagccaaggagtttgagaccagcctgggcaacatggcaaaaactcacctctacaaaaaaaaaaaaaaaattagacatgcacagtggcacgtgcctgtagtcct

SEQ ID NO: 12500 - DNA, 1136 bp, Homo sapiens
cggtgggtttacctggtgatgcgggtgggtctgagtggtgtgttaaggaacagtgtttgctgtcattgtccacatgggcatggatttcatatgtggctgtgctgtcataatgcttacgaggtacaggcatcctctctcctggtgagtgattttctactgtattcccagcagtttatattctaatttctatggagatttaataatttctgtaatcaaagctatattcctaaatacctcaagtttttgaaacctcatcaaaataaagtttatttggcaacttagtatgtaggcgtgtatgtctaagagaacatatatttcagctgcatattagaccctatattagaacataaatttatttacttatttattgtagagaaagggtcttgctatgttgcccaggctggtcttgaactcctgggctcaaacagtcgtctcaccttggcctcccaaagtgctgggattacaggcgtgagccactgtgtctggccagaacacacatttaaacttaggtagtggaaaagagtacgtctctttgtggaaagcccttttgagtgataggttgaatttagcatctgtagtcctttcccagatggggctggagatgggaagagaggagaaggctgaaatgtgaagctgctgcggtggctgagctttgagtgcagagtaaatgacagaagggcagcagaggcaagctggcatttgaccccgtgcattaatgactgccctatggaccaaggtgaacacatgagaatgtcagaacaccaacggtggggacagtggtggagggagcagcaggaccatacattgtggtagccgttgttggaaggctcttcctcaggttatcactcttgcagggaagatcacaggagattttcattttctgtttgtatttctgtttaagtctgggggtcaaaagagggctcatggtataggtcaactgagatgtgtttgtaagaacaggcttagtctatgtacgagactgtgaaggccatgattagtagagccagtgtgggagcaaagccccacattcacctcctctggttttctcattgagggccaagaggagatagaagccccgagaggggaactgacttgcctgggatccacatggagtagtgacacagagcgagcccagg

SEQ ID NO: 12501 - DNA, 2306 bp, Homo sapiens
cactccaatcctgtgttttagccccatttgggggaagaagaaatcgtggctcagagtggttgtaaaccactcattcagcttgtaagcgtcagggcctgattccacagtgctccttgaggagagggcagggtgggagaaagaaagggcagggtgggagaggaagcgggaccctaccctgacagcttagggactccgggactgagcctgtgcccaggtccacttgcccgtctgggaccacccagcctcccaaggggggcgccaggagagccctgggctcatcttttctctctcctctgtactgtccgctctcccccacaggaagaaaaccgtctaccggagtctgtgcctggccctggccctgctcgtggccgtgacggtgttccaacgcagtctcacccctggtcagtttctgcaggagcctccgccacccaccctggagccacagaaggcccagaagccaaatggacagctggtgaaccccaacaacttctggaagaacccgaaagatgtggctgcgcccacgcccatggcctctcaggggccccaggcctgggacgtgaccaccactaactgctcagccaatatcaacttgacccaccagccctggttccaggtcctggagccgcagttccggcagtttctcttctaccgccactgccgctacttccccatgctgctgaaccacccggagaagtgcaggggcgatgtctacctgctggtggttgtcaagtcggtcatcacgcagcacgaccgccgcgaggccatccgccagacctggggccgcgagcggcagtccgcgggtgggggccgaggcgccgtgcgcaccctcttcctgctgggcacggcctccaagcaggaggagcgcacgcactaccagcagctgctggcctacgaagaccgcctctacggcgacatcctgcagtggggctttctcgacaccttcttcaacctgaccctcaaggagatccacttcctcaagtggctggacatctactgcccccacgtccccttcattttcaaaggcgacgatgacgtcttcgtcaaccccaccaacctgctagaatttctggctgaccggcagccacaggaaaacctgttcgtgggcgatgtcctgcagcacgctcggcccattcgcaggaaagacaacaaatactacatcccgggggccctgtacggcaaggccagctatccgccgtatgcaggcggcggtggcttcctcatggccggcagcctggcccggcgcctgcaccatgcctgcgacaccctggagctctacccgatcgacgacgtctttctgggcatgtgcctggaggtgctgggcgtgcagcccacggcccacgagggcttcaagactttcggcatctcccggaaccgcaacagccgcatgaacaaggagccgtgctttttccgcgccatgctcgtggtgcacaagctgctgccccctgagctgctcgccatgtgggggctggtgcacagcaatctcacctgctcccgcaagctccaggtgctctgaccccagccgggctactaggacaggccagggcacttgctcctgagcccccatggtattggggctggagccacagtgcccaggcctagcctttggtccccaaggggaggtggagggttgaggcctacgtgccactgggtgtggtggggtgcaggtagccagaaagggacctccctgtgtggataattctaggaaactgaggcccaggaacggttggagctgcccagtctggaggccctctctgaggagcgaggcgccaggccctggcagccctcctgacctgggtccgttgctggccccctcagatgtggtgggaggtcctggtgacctctggaggaacgctgtgctcaggtacctgggctaggcctggcctgatgggtctgtggccgcccctcgtcttcacagggaagagtcttctgtgaaatgcctcagtctccccagaggccgggcggccctggcaggagaaactcaaccctgtgcgggctcacaggcaccccccagtccacaccctggtctcctgggagagagggcccagccggctctccgcagccccaggcctgcctggagacgggccgcctctgccacagggcctccactcctggctgtgtcctgtaaggtctggaagggcgaccgctctgactacctcagcgcccctcagaatctccctggggctgcagccctaccccaccccgacacagggcagaagagcagcgctcctggccccccgaagtcccagagctgctgacccccaccccaggcaagtctctcccgcagcccccacacccccaggcctggc

SEQ ID NO: 12502 - DNA, 1112 bp, Homo sapiens
gatggctccccagcatgtacagttaacttgggacatgtgtagtaggtgctttttataatgggcaatttcatttggtgttctaggtttggttttgtagacttcaacagtgaggaggatgccaaagctgccaaggaggccatggaagacggtgaaattgatggaaataaagttaccttggactgggccaaacctaagggtgaaggtggcttcgggggtcgtggtggaggcagaggcggctttggaggacgaggtggtggtagaggaggccgaggaggatttggtggcagaggccggggaggctttggaggtaaggcacgcagagataatgacaccacatagcatgtgctcttcagaccctgtgccctgtcacggttcctaatcactggggaggaggagctttgtacccattcttttaacagtgtcttgccttcctcctgtagggcgaggaggcttccgaggaggcagaggaggaggaggtgaccacaagccacaaggaaagaagacgaagtttgaatagcttctgtccctctgctttcccttttccatttgaaagaaaggactctggggtttttactgttacctgatcaatgacagagccttctgaggacattccaagacagtatacagtcctgtggtctccttggaaatccgtctagttaacatttcaagggcaataccgtgttggttttgactggatattcatataaactttttaaagagttgagtgatagagctaacccttatctgtaagttttgaatttatattgtttcatcccatgtacaaaaccattttttcctacaaatagtttgggttttgttgttgtttcttttttttgttttgtttttgttttttttttttttgcgttcgtggggttgtaaaagaaaagaaagcagaatgttttatcatggtttttgcttcagcggctttaggacaaattaaaagtcaactctggtgccagacgtgttacttcctaaagagtgtttcccctggaatgtcactggagagcatggcaaagccagctctgccacttgcttcacccatcccaatggaaatggcttagtgcgtgtttccagtatcccagccctaactaacttggttgaaatgctggtga

SEQ ID NO: 12503 - DNA, 1128 bp, Homo sapiens
aagggtatgttctgtctattgaaatgtaagggttttattaacattaatgcactttcctgctttataaaagaaatattggtttgatttccttaggcgtgtaatcttggacagtttaacctgtaagtttgtgcctcagtaacccatctgtaccatggggataatgtactcatagggtgattttaaaagacaagctaatacttacaaagaagcaagaaatgtgcctatcttacaataaatactttgtaagtagtagcagttctttcagtgaggtgaggttactatgaaaaaattccaagtatttgtaaaactagtgggaagtaagagggaagctcgagttttgattgaaaagtggcataaaactaagggcatttattgtactcagatctgaagcaagttctgtgttgctgaggtaaaagcatttgtgttaatatggttttaaaaaccatgagttcttctccctccattgcaggattgcttatattgaatttaagacagaagctgatgcagagaaaacctttgaagaaaagcagggaacagagatcgatgggcgatctatttccctgtactatactggagagaaaggtcaaaatcaagactatagaggtggaaagaatagcacttggagtggtaagaaattaggcttgttacaaggtttcagaattggtggagggaactcctttgtgtctttgtatttcataagtttataaatactttttaatcaaagttactcaaatgtaggtgaagatcaaggacatgataccccaagtcatactcttatttggaatagtaatttccaatcttgaatgagagctctaaaatcattttgcattggaatacagtaggcaaatcaagcttcctttgtaggcatgttttatactttaaatgacttgaccatgtgcgttttgaactcagatgattctaggaaaacagaccagtcatcagcctatgtaagaacaaccagcaggacattgcaacacgtactaggtacttaatatgttgagtaacagaaatggatttagcttacgtcatgagtatttgtatattaactcaagcactgaaattcttaggaataagatattactgttgtgaccgaagctgggaaccactgtttcagagtcttaggaatgt

SEQ ID NO: 12504 - DNA, 1166 bp, Homo sapiens
ctctcgaagtgctgggattacaggcgtgagccaccctgccagtaagttttaataatttggtgttaggtgggagaatcgcttgaacctgggaggcagaggttgcagtgagccaagttcgcgccactgtactccagcctgggcaacagattgagacaccgtctcaatttaaaataatgtttattttcttggaagtacctgaaactattagacctgtctagtcatcatagtgaatacttttatccagacaggattctcctgtattagtgcttataggtgttcttttgtcagctgctactgtgaattcttataagcaatttagctccatgatgaagacctcaaacgtgaatgtgcatgtcatatcttcatgctgagaccttgttctgtagctgcagtttgcagagccttgactttgttttgctaatactaggggtgctttttaaaatgtgatctttgtttgcaccatcacatttgtctagaatacatattgtggattttgatttgtgttttcacctgttgtaattttgccctcctctccaccttgaaggaaatttggttatgtggattttgaatctgctgaagacctggagaaagcgttggaactcactggtttgaaagtctttggcaatgaaattaaactagagaaaccaaaaggaaaagacagtaagaaaggtatgtaaggctttatgagattatgcaatgaactcaggagctagactgctagggaaaatgctttgtaacccatttcccttggtttcctcttatttttttaaatcatttttttcctttggtttcctcttaatgtgggaattaaatgagctacagtgtttacaagagtacttggcactgcttgtcagtgttatagtgtaaattcctgagttaggcaagcaagagcacttttatacagaacaagaattattagatgcacctaaattaacgtaaagggatctttcttcactgaaactagattaggtccctaattactccctatatacagttgtaatgttttgaattggtacattcactttttttgttatgcgcgtctactctaggttgaactccagtgtacctaacagagagtttgacatcagctgtgacaacatggagggaccacttgtgtgttgacactgctatatctccatatttagcaccgagccttgtacattata

SEQ ID NO: 12505 - DNA, 1990 bp, Homo sapiens
gtatttttaagtgttcaaaagagttccttatgtctgggtattcaccttatgataggggctctgacttaagacaacataacagaagcctggagtttaacatgctaatgtgtctagtgcatgtggtcttgaaccagaggcattgccagagtctaacatctcattgggaccatggttatctttttgggtgtggggctggacttactggtttggttttcatttattctcaaggtcgtcatacctcagaagaaaggcaagaaggctgctgcaacctcagcaaagaaggtggtcgtttccccaacaaaaaaggttgcagttgccacaccagccaagaaagcagctgtcactccaggcaaaaaggcagcagcaacacctgccaagaagacagttacaccagccaaagcagttaccacacctggcaagaagggagccacaccaggcaaagcattggtagcaactcctggtaagaagggtgctgccatcccagccaagggggcaaagaatggcaagaatgccaagaaggaagacagtgatgaagaggaggatgatgacagtgaggaggatgaggaggatgacgaggacgaggatgaggatgaagatgaaattgaaccagcagcgatgaaagcagcagctgctgcccctgcctcagaggatgaggacgatgaggatgacgaagatgatgaggatgacgatgacgatgaggaagatggtaaggagttgtcttggtagttactgggcttctgattacaaggtatcttgagattctgggatcaacatattccttccacgacaacctggagatgagattagaatccttgtgggaattctctgggttgttgtggtgtgctagacttaattacccatgaatgatttttgtgcctcttgagaaaatttcaatagcacattctattagtgttttttataatgtaggattttgtttctaagtgattttttttttttttaaatttttttgagatggagcttttgctgtttcccaggctggagtgcaatggcgcgctatctcggctcactgcagcctccatctcctgggttcaagcagttctgcctcagcctcccgagtagctgggattacaggtgcccaccaccacaccctactaatttttgtatttttagtagagacgacatttcaccatgttggccaggctggtctcgaacttttgacctcaggtgatccacccaccttggtctcccaaagtgctaggattacaggcgtgagccactgcgcccggccccaagtgatctattcttgccatgactgttaactaaacatggtgacaggattgcattttctttacattagatttgaaaaccgatgttggttttgggagattgctgcaatttttaggtgacttctctttcagactctgaagaagaagctatggagactacaccagccaaaggaaagaaagctgcaaaagttgttcctgtgaaagccaagaacgtggctgaggatgaagatgaagaagaggatgatgaggacgaggatgacgacgacgacgaagatgatgaagatgatgatgatgaagatgatgaggaggaggaagaagaggaggaggaaggtacttaaattagattctgacatacgacatgagttatgtttaaaggaggcacttaagtgtttgtggctactgatgtgtgatacattgtttgacatcttgtccagagcctgtcaaagaagcacctggaaaacgaaagaaggaaatggccaaacagaaagcagctcctgaagccaagaaacagaaagtggaaggtaacttgcagaattaggggatatgggggagataaacagcacaaatgatgaataacaaagggacttaatactgaaacctgatgttacattgtagtgtgctgatgtgctgtgtatagaaattttgctttggaaactaactttttaccacactacaagtagactgagttgagctttttttgtgcaggcacagaaccgactacggctttcaatctctttgttgga

SEQ ID NO: 12506 - DNA, 1990 bp, Homo sapiens; identical to SEQ ID NO: 12505

SEQ ID NO: 12507 - DNA, 2177 bp, Homo sapiens
caggaggctgacaatgaggtagacgaagaagaggaagaaggtggggaggaagaggaggaggaagaagaaggtgatggtgagtagccttgtctatcttccccttttcaggtactttttcctggccttgtctggcagaaggggaaggaaggaattggggctcctgggagtgggacaatggtacttggggccagtggaccacatggccctgggcacccacctgtagagtcagggaaggtctccctgacatggagttgtgcccatgcccactcacactcactcgcacacctgaaagtttctttcgtgcagctctgaaagccactgatctattgggctggccttttggggtgcagctgcttgggcctctctcctctggagagtcccacctgtgtagtgggcgtgggtgccctgattgggcccagttgcaggcagtagaggcagggcagggaccttgcagtccactacatgttcctcgggatttccccaggagccacagtaggagggaagtgtggtttacctggcctttgattctctccaggtgaggaagaggatggagatgaagatgaggaagctgagtcagctacgggcaagcgggcagctgaagatgatgaggtgggttctggcttgagaagaaggggggtttggcatctgggtctccccacctgcctttagctgaggtgctcaagctgcggagggactgtttctgactttgtaggtggccactgtgtggtcctgaatcttaagaacaggaaggaaacagggctgggctcaacttcccagaggccttgggctgtggagctgggggtccctggttcttgctctgccagcaggagctgaggcagtgggctggatagggctcctggggttggaggggcctttgacagtctttctctgcttaggatgacgatgtcgataccaagaagcagaagaccgacgaggatgactagacagcaaaaaaggaaaagttaaactaaaaaaaaaaaggccgccgtgacctattcaccctccacttcccgtctcagaatctaaacgtggtcaccttcgagtagagaggcccgcccgcccaccgtgggcagtgccacccgcagatgacacgcgctctccaccacccaacccaaaccatgagaatttgcaacaggggaggaaaaaagaaccaaaacttccaaggccctgctttttttcttaaaagtactttaaaaaggaaatttgtttgtattttttatttacattttatatttttgtacatattgttagggtcagccatttttaatgatctcggatgaccaaaccagccttcggagcgttctctgtcctacttctgactttacttgtggtgtgaccatgttcattataatctcaaaggagaaaaaaaaccttgtaaaaaaagcaaaaatgacaacagaaaaacaatcttattccgagcattccagtaacttttttgtgtatgtacttagctgtactataagtagttggtttgtatgagatggttaaaaaggccaaagataaaaggtttctttttttttccttttttgtctatgaagttgctgtttattttttttggcctgtttgatgtatgtgtgaaacaatgttgtccaacaataaacaggaattttattttgctgagttgttctaacaaagctgtctcaagcctggtttttctgtttcagtttcttcagaccttccagggcacaaggataggagggggaggatcctggggacagtgggttgacattttgggaggcagttggatgtgtcctgtgatgggcagcagagtctggtgggtgggcagggactgagctgcagttggctgggggggctgctcactggggcagtcagtgattgccccaagaagccttaactggggaggaggacttcatcactgggtgccacatggggaccctggtgccctgggggtgggggtttgcagtcctagacactggaaacgggccacacgggactgccattatgtggagcgcagggtgctggtggtataggccaagagggaacttgccaagcctcccaggatgagcgtccaagtggtggctgcctctgcaggcctcacaggtttagctccatgacgtggctccccctgctggtggcacgtggtaccccccggcctcttagaatgccggggttttggtttggcactggtgcagcctggcagtcatccaacctttggt

SEQ ID NO: 12508 - DNA, 2177 bp, Homo sapiens; identical to SEQ ID NO: 12507

SEQ ID NO: 12509 - DNA, 2177 bp, Homo sapiens; identical to SEQ ID NO: 12507

SEQ ID NO: 12510 - DNA, 2177 bp, Homo sapiens; identical to SEQ ID NO: 12507

SEQ ID NO: 12511 - DNA, 1122 bp, Homo sapiens
tttctgggaattaattgtggctcttggagtgacaacagaagaaacccccagatgacactgaaaaaccagaatcatctttgacttagctttttttttttttttttttttttttgagacggagtctcgctctgtcacccaggctggagtgcagtggcgtgatctcagctccctgcaacctccgcctcccggattccagccatcccgagtagcctcagcctcccgagtagctgggattacaggcatgcactaccatgcccaactgatttttgtatttttagtagagacagggtttcagttggccagactggtctcaaactccccctgacctcagatgatccacccttctcagccttccaaagtactgggataataggcatgagccaccatgccccgccagctttcatttttttaagagttataatttgaaggagttgagtttcttcccaatactatagcattttttaaaaactgggtgaaattcaggaatctgaatgtagattttgacaggattcaaggcaatatccctgtgcctccaaataacctgaaagaaacagtggcccttttgggaacatgcccttgggaaaaggccttgtattatttcttcctcagtcaggaggtgctgggaagcaaataaaagtgcaaagggagcctctaagaatctctttggatatgtctcttctagcttgtttctgaccagttccaggcacataactgtacatgtcagtaggataatgggctgactagaaaaaagaaaggtttgcgttattgtttgactttgctagggagaagactgtgttatgtttcaaatactgatctttttctcattactaaattacttgcctccactgtttcccaggccagtttgaattttgattgtatactttccaagcatagtaactttgccagcacaagagtattatttcacggggatatcaccactgattacaatgctgcatattatgtttcaaggatactgaaacctgggttctcagagatccatttatattttctcatcttatcccccataaatgggaaaatcactgggaaattattgggtggagaaatgcatttaaatgaccgtgaattagaattggtccttaagaaggaactaaaggcagaatg

SEQ ID NO: 12512 - DNA, 1775 bp, Homo sapiens
atagtgagagcaagttttggtgagcacatacaggctgagcactccaattctatatctccccaccaggttaccaacatcaagaagacactcaaagccaccgcatcctcctcggctcaggagatggagcagcagctggctgaacgggagtgtccccctcacgctgagcagaggcagcccaccaagaagatgtccaaagtgaaaggtctggtctccagccgccactagggccggctggggcagctggcactcaccaggcctgggtcaggtggggaggggacaccaagggcccatttcctcccctctctacctgcagtgagttccagacctgcccgtcccctcaccagcgcctccccaccctgttggtactgttccagaaaaactgttactccccctcacccactccctccttccccagttgttcccttcagactcaggggctccaccaatgccatcccaaaacagggtcagacactgcccagcttccctccaggaggttcttgtctctgtgtaagggcttgtctccctcccagtttttcttttgctccacgtcattttgtcaggctggttataagccggaggcagctttaaccagcccccagggatgattgtgaaggaggcccctccccttgtgaggagggggcactcctctccagcccctggtaccacagtcctcacgatggtgcagtgatttctagccaggcgtcaagatgcgctgctttccctctcctgcctcatcccttgttggcagctccagttcaggccgtggagggacgtgatgctgggctgtgtttactaaacccacgggttttcagcctcttaagcccagctccgatctccaattagttgagagcgctgggttgactaacctctggtatctgagcacagacagagggtgctgtgggtctgctgggtggcagaaatggttccttccggcttggcgttctctcctggccactcttcctgctgcctctgactactcagccttgttttcggtgtgtaggccccagctgcccactggaactgccggctaatgcttgctctcccaagatctttaactcctcctggctgcacctgggtagggatggtggcatcgatgcccctctgtctgctgaaggacctgttgctgcttctgtcttttcacccctccttggctgatgacccagagccctctgatgatggcattctcctggcaagagaaaaagacttaactagacttctgaacttgaacagtttcaggttatattttaatttttttttttttgtacaggttctgattctaatacatttcaacatgcttttgtcccccctcgtgtcaatatttgttatagactaatcgccggggatttttcacctggttggagggtgggggtggggtggggtgtgtgtgtgtgtgtgtgtgtgtgtgtgtgtgtgtgtgtgtgtttgtaggtcctggactgattaaagttcattgaggaaaaagcacattttacaacaaaaaaataaaagtgtagatttaatgtatgtgactggggtttggggttgcatacctggtggatcttgaggggctgggattagggtggttcaggaaaatgtgatgctgtttccccatgtttagccatggtcaaaaaatggatttctcctttttctaaaatgtccagcaactgcctactgttgatcaaatgttgaagtattcttgtttcccttttaagccaatccatgtgcccacataacattatgcccaagtggagagttcactttaatttccaaagtatgtttcatgcagccccctgtca

SEQ ID NO: 12513 - DNA, 1198 bp, Homo sapiens
tcccagagtgggcaggcccaggttctccacaacacattgacttgagggagtgtgacttcgtttgattttatttttttcatttcagctattggaatgaatagagcatgctgcctaaaacttctttttctcttctctctctcttcagctaaagcttgctttcactctggaccacgagaccggattgcctcaaggatgtcatatctatgagtaccgcgagagcaacaagtaagccactcagtgggaaagagtgtcacttcacatgtgtgcagcagtggtgcctgtgggctttctgacactgagcttccattgctaagtggttgtcaggaagggaatacaccttttactactatactagaaaatagctggcacagaaatagtcctcttgtaagatctctttgcccctaagtatagaacttggagcacttgcagaggagcagttgtggtgtgttagaagtagatgctgaagcagaccttctttcaaggctgcagatgtcccccagaccctccccactcttggtctccagtcatgtgcctgcttgtttggttcactgtgtgactttggctttgttgtagttctcagtcactatctgcctatacttaggtttatgggttttgttgtgattatctaccttgtaaattttatattaatggttgggagatttccgggtacttacagagatttaaattggtgcccttgttggaaaggtggcaccttgcatactttcatagcacctcctttccacatcatagactgctccttttttttttttttttttttgagacagggtcttgctctgtcacctgggctagagtgcagtgatagaatcgtggctcactgcagcccaaaactcccgggctcaagtgatcctcccacctgtttcccgagtacctggtactacaggtgcacaccaccatgcccagctaattttctaaatttttagtacagacagggtctccctatgttgccctggttggtcttgaactcctgagctcaagcgattctcccacctcagcctcccaaagtgctgggattacaggtatgagccaccacacccagccacagactgcctccttgactgtgtattttcgtttgtgagacagtgaaagtggtggtgaatgaggcacaggaactgtgccccgatgatgacaatgatggtaatgacagcggctaccattgagcacctcctatgtgttaggc

SEQ ID NO: 12514 - DNA, 1220 bp, Homo sapiens
tcctgtgttagcattgctttactctgggcacatttttcttattctctattctgggatagaagtagtttctgacttctagccacgttcagtccaggctggagagatctacacctgtttctaggattctcgttttcaaggtttctgaatatcccctactcccacttacccccaaaataagctttttacctggataggagagggaaagaggtatttttcatcaattctccccttctctgctcttctccctttctaataccataaggcagttcttcgtgacttttacagaaacatatgtacacgtccttacagagtttaggagagcctgtgggctttttgccttagtctgctagaaagactggcctgctgctctctgctttatccagaggtctgcctctgggacttcagccctgtagctgtagagaccagaagaccaaccctctttgagacccagatgctactttcccttgcgtccccctctctttcctctcccaatgagccaaccttttgcacttccactagaatgccaggcaggctgggcccccaaaggctcctttttcaaaacctctggaagccgcggttgaatgtgccatgaccctctccctctctggatggcaccatcattgaagctggcgtcatcggagtctcttgttctgttggcgtgctacctggaagatccttctgtcctggacaagaggaattggaagagcattttatgttttaagaacaggctgacacgcagcagctacaacaacagctgagatcacttaataaatggtgctaaactagcttgtctcatgctcttgctctttatggtgcatcaaagatgtggcctttcggactgactgtcaccatattaagggatggcacagacttttccatggagggccatccggggaatgcagcctcatttccataagcccattgtgtagtgtcatgtggtattttgttccaggactgctgaggcctgacataataaggtgacatctagcttagaaaataagaccccattttctggtacttaaatttgagttcccatctagtcacaccgatgaccagaacagagtgatttctgatatagaattcagcttgaaagtctgttcaggttggaaagggggatccttggcctttgcttcgctgacttccattcgcctttacttcaaagaaatctcttgcttggaggtaaatccctgcttctgtctgtgtggctgtgtgtatatagc

SEQ ID NO: 12515 - DNA, 1407 bp, Homo sapiens
acttgttaaactgagttcttgctcaggtcatagctccttttaatgaggccaacttgtagtcgagttttcatagatgtgggttccccatattctctgctttgaggagaaatctcataatacagtcagaatcgtggggctaccaggataaaactgggctcggagccatatgaaacagcaatgtcttttgtgaagaaactcctctttggattagtcccactgattccttttgtgcatctagcctggaatggaaaaggaaaacaggccaaattcccatagtgggctacagcactgggaaagactggcccggcttctctgcaggagtggagggtgggtgattctctttattcctttatctcagagaagagacaggtcaaattgtggaggctttcccacatctagatatcattgtatttcaacactgaacttttataggcaaggaccaacccattcccttctcctggcatggctaaatcatagtccagtagcaccaggttaccccagcttaattgctggcctggctttgcatctgtgatatgtaccaccgaactggtaggcaaagcgaagagagcccagattagcaggaggctgagcccctccctaagtatagagagcagtgagcgcaaggctatgaaccttgcagcctttgggtagaggtagggggaagtgtagaattgcacaggatttgctttctggtacgtgagatgggccaagagtggtcttaaaagagctctttgttcctctgtcttttgaatctgttcagaattccttgttgcctatattaacctctaattaattttttctgtttttagaaactccagtcatgacacttcttacatttaacttgttctttctttacctttaaaagaaggaagttttaatattacccagtatgcctggaatgccagatggaaaatagctagactattcacacctagttttaggtggtagatttgcctcttggccgagctgtgggcctatgagaataagagtgattataccaaagattatggcccactattttatttccactgattccatgtgaagaaatttctttttttgttttgttttgttttgtttttctgagatggagtctcactctgtcacccaggctggagtgcagtggcgcgatctctgctcactgcaacctctgcctcctgggttcaagcgattctcttgcctcagcctcccgagtagctgggattacaggtgcccgccaccatgcttggctaattttttgtatttttagtagagacggggtttcaccatgtttgccaggctggtctcgaactcctgaactcaggtgttccgcctgcctcagcctcccgaagtgattacaggcgtgagccatggtgcccggctgtgaggaaatttcttaacccaggttcttcatgttgaggtttaacatat

SEQ ID NO: 12516 - DNA, 1451 bp, Homo sapiens
caccttaagctatcagtttatcttggaaccctttccacagtagtagagagcttccttgttttatttctacgaatgtgccctagcattaatatttaaccggtcctctcttgatcggcatttgaattgtttctaatcttttgctgttgcaaaaaattgactggaagttttgcaagggacttgggaggtgggttgccgttttggcattagattggcaagtgaagaaggccccgggatatgtcatggagaccccgagggctgatgagtcagcatccccctgtatatgtgtgcttctgtatagatgatccttgtattgaacactctattttctcccatttttttctttcagggacaattcaagctttcgaaatacaaaaatcacattgtgagagtacacaagctggcaataatccttttctgtatgtgtgtgtttgtccgaaatggatgggaggcctccagccagtccttccattgctcactgaagggacgtccctgagccgtgcgctctccttttgcactcattcctggaggacggattccgctagacaccctccagcatcgctgactttataaagcggaaaaacggaaaacgtgactttgtaatagacaaacattgttttttaatggggttccatgggggggcgttcagcctttctgtttgctgtgtgctgtccagatgcctcttgggcgtcctgttgttctcttcccgtgttgtacgaagggtaccgtggccacgtgtacatgccagagctgttgatgagagttaccagtattatgaatgtctgtgcatccaggaaaagtgttctgttggagagtcccaaaatagctgtaaatgctctcttctagctctgccattaaattattgggacattttgtttctttctctcccctcctccaagcccaccactttctgaagctgtgttactgatgtgatgactgtccaggattttgtatcatcccctgccttatgccctccggtctcctctcctgtgggactctctccttcttaggcacagctgcacttagaattgtaatccagtggctctcactggtttcactgaggcagcttagagggaatgccttagtaaactgaactggagcagaatctagtttgattaggagctagattataatctaggttccaagtacagaatttggagctaaggactgtgactgaaatcattttcccatatgagcagaccctgtgtgtcaggcctgtttcccatatgagcagagcctgtgtgcaagtctgtttctggcatgtccctcattgaggaagggaagcaaaagctggttattgccaggcctattaacacttaatatgcaaattctatcatcctgaaactggggcatctgaggaaaaggtgaccttgctggatggctttatttgcatggctctgcctgtctgcagtggttgagtcctcatcacctggtatgtgtatgagcaaatgtgt

SEQ ID NO: 12517 - DNA, 1190 bp, Homo sapiens
gctgggattatagatatgcgttcccacgcttggctaatttttttgtatttttggtagagatgggatttcaccatgttggccaggctggtctccaacttctgccctcaagtgatctgcctgccttggcctccaaaagtgctgggattacaggcgtgagccacaatgccccacctccagtatactttgtttttcagtgatcgagaatttcagattttaatgatggttgctaaggacacatacagttgcttataaaactctccttatcatcttctgctttgcatttaatgtagagacttttattcctctactttgtgctctggtatagcagagttagtgctaaatccaaaagtggcaatcacttgagaagctggggagtattgactggggtttttaatattgactctctcaaaatgtataaggactatagaagtcaattatggctgaataagcattaatctgtatttataataatcaacaataaatagaagagtattctttcttggatttatcttcttgtatttcttcttattgcagaaatagcattaatctcataatcatgtgtttggtcctacagataccttcagaccttctggataaagaatttctgcctatcctccaggaggaaccccttccaccattggctctggtaccctttacagaagaagaacaggtttgtgattagctctgagccccagcaaactcttattcttttcctgctaaggcatgaaaataggaagttactatttatgctctaaggattatcctgcatcctcataggtctgctttcttctatttcttggtatgttgatgcttattagttgactagattttgctgtagtatctgtagcttttgagtattatttggaaacgtttgtagatccttaaggacattgggaaccatcctttaaaacttactcaagtagagaggaagagtgattcttggggaggggagaaaatcatctttgcaaataaacagattttcagaagtaattgccaacctgaattcttaccggtgcattttaccactaagggaaaaatgtagatcttcagttcaaaatgcattcaaaactcttctgtcaccaatgtgtgtgtgtgtgtgtctgtgtgtgtgtgagagagagagtgatgtgagaaagtaaaacttgtgggctggaaagtagcgaatttagtgttgttcctgtttatagtgt

SEQ ID NO: 12518 - DNA, 1930 bp, Homo sapiens
tgtctgccgactatggagtctccacctttggacacaacacttactcaccatttactctttatcactctgcaacaaatcacagaaccgatcatctcaggctttttcttctggccctttgtgtccaagattctttaatccatttttgttggtgaacatctcagactatagataagtggactggaccctgtgtcttgggggtggcagttgggattactccccaacaaggctgattttaggcagcatgtgttcactgtgctgtgatttcatctactgtctcccagaaagtgtgttgggatcggccattagcagcttgctttctcttgtcactttttttcttctattttgttttttcttcttctttttccccccatcagggcaaatggtctaactggtgcaatcatgaagagagttaatggttaacagacattggccaataacaaaacaccccatggactgtgactcgagtatccaacaggcagtcagagctctcccggtctgaaagttgcattgccactgctaactttgggattgcatcagagaggccctgagtggggttgagatgaggttggtttggtttgatgttacacactcctcacctgttctttctgagtgtcctttctctgaaaggatttatgtttttcttcgttagatagtgacttctgagcaagctgatctcccctggcatgctccaacctgattggacaaaggaagctctatggcctgggagagagactattcttaatttttctttcttacaaaaactgatttttcccataaatatttttacttcagaggactaggaccattttgttttgggcccttctgctgaaaatttgtctcgtttaagaggcagctagaatctttaccatatgtatgaatttgtataatttcatttttggatagggataaacttttgcttctgataaaagcctggaatttcatctggtcctcagagcattgcgtgtgtgtcttgctgtagcccggaaaaggttttgtgtaaagattctgggatggcaagttgtttgccttttctgaaaagagaacatacagaacctgtccatctttaagaccttcatccatggaatctactatacaggaggatgcagtgggctggaggggatgggcgaaaatgggagcaggaagcctggcctggcttctggtcatggcctcctaaaaccttaaacttcaagtagaaatgtactcaagccctatttataaacaaatacttttcctgcctccaccaaacccctacagaacatcacctggaattgccactcacactgggttggagtcattgggcagctgtgcctgtgcgagaggtgctgtggtctgggcagcccctggaaaagcacctttgctgcctgtcattgttgcctgaagaaggctggagttgctctgagagcagtttgggtttggagtattatatttggcttctatttttattattttggatcaccattctccctatcccttcttgcctccctcccttctaaacatgtgtaataactatacagagactgctacaaaattgtatatagtttttggatcaaatagcatgaggggagaggaaaccattaaaagttggggctcctactctcctttgctttgtaaattcaaaagttgggggtgggtaagagggatagttaaaatgtttacaaaactttaggctccctcggaacttttgccagtgtggaggaaaataaaaaagaacttaaataaaatctgattgtattctatctgagtgcacctcttgtactcacctttatggaggctgagttctgcactaaactgttcctcttggtaccatggaaaagctccaagcacccaagacatggaggcagccatggcttctttctctgccagaccacgtagcactggctggttctgtatttgagaatgtagaggtcaaggcagatgtcggtaagtttga

SEQ ID NO: 12519 - DNA, 1221 bp, Homo sapiens
gcaggtaaagtacttagagcagtgagtgctggctcttctcagctacacgttaaaggaagcctggcctagcccacagcatgcagggacctgggccacttagttcaacatggcctggtgagaatgagccctgacagcccttctgttcttgtcccacagtgaagccctcagtgagctgccactgagtcgggagcccagaggaacggcgtgaagccactggaccctctcccgggacctcctgctggctcctcctgcccagcttcctatgcaaggctttgtgttttcaggaaagggcctagcttctgtgtggcccacagagttcactgcctgtgagacttagcaccaagtgctgaggctggaagaaaaacgcacaccagacgggcaacaaacagtctgggtccccagctcgctcttggtacttgggaccccagtgcctcgttgagggcgccattctgaagaaaggaactgcagcgccgatttgagggtggagatatagataataataatattaataataataatggccacatggatcgaacactcatgatgtgccaagtgctgtgctaagtgctttacgaacattcgtcatatcaggatgacctcgagagctgaggctctagccacctaaaaccacgtgcccaaacccaccagtttaaaacggtgtgtgttcggaggggtgaaagcattaagaagcccagtgccctcctggagtgagacaagggctcggccttaaggagctgaagagtctgggtagcttgtttagggtacaagaagcctgttctgtccagcttcagtgacacaagctgctttagctaaagtcccgcgggttccggcatggctaggctgagagcagggatctacctggcttctcagttctttggttggaaggagcaggaaatcagctcctattctccagtggagagatctggcctcagcttgggctagagatgccaaggcctgtgccaggttccctgtgccctcctcgaggtgggcagccatcaccagccacagttaagccaagccccccaacatgtattccatcgtgctggtagaagagtctttgctgttgctcccgaaagccgtgctctccagcctggctgccagggagggtgggcctcttggttccaggctcttgaaatagtgcagccttttcttcctatctctgtggctttcagctctgcttccttggttattaggagaatagatgggtgatgtctttcctta

SEQ ID NO: 12520 - DNA, 1273 bp, Homo sapiens
tttgcatcccagctggggtagttgagcagaaattgaaccagcctggggaaacattcagtacctggctcagaactgtcaaagcatgaggagggtaggaaacagagcacaaagaacagaacctggagagttggactgactccagtactggcctaataactggcagcgggtaagtgaaaggagccagctttcaaagcagggaagattttgccgtaaaaatgggatggaatttatatggtgggagctttgggttccaggtataaggagggacttagctagttacacagtggactggctgagtgatgaactgccttgactgttgtaaagagagttccgctttggaggaggagttgggatggggcgcatcaacgccccttcccagtcccactccactcctgtgattccatgatgcaccgggcacctgcagaggtcgatgatgattggtaaaaggtctgattgcactgaatgtcacggtccctttgttgccctcaactcccagcagcccattttttccctcccgtcacatttaagtcatgtgtatgggatcatggagcagctgataatttgggattctgtcagtgtgtgtttctgagagtgatcggctcacagctgacgagtatccaacaaaaccagttacacaggagactgacgagtggcagtcatgggtgtgatggtgcatgatctcaagttttcaatctgagacctcctaaggagaaagaaaccataaaaaagaaaaggaaatttcatgggggtaaaaggtttggtcacctgtcatacttttcagcagtgggtcacaagagggaggcaaagtggaaaatgaagttaccaaagtgatgcctgttgcccagcctgttaatagtcactccctccgtgatacttcaagcattttatttttttttagtcccaagcaaatgtaaatatcacatattctcttccccaagtgaccttttagacaagtgattatctacttaacaatctcatattgatagtctatgttttctagtctttcttttccttctctattatagaaatttccaaacatacgcagtatctcttcccccccacacttatgctggagcaatttgaagccaattctaggcattatatttcatccaaaaatattttactgcccataatcttcttaagagagtatagtgaatttttcgattattcccttttcccattctagaatgggatgctgagtctcactctgttatccaggcgggagtacagtagcacaatctcagctcagtgcagtctcaaccttgggctgaag

SEQ ID NO: 12521 - DNA, 1263 bp, Homo sapiens
attgaagctgagaggggagtatatgtggtccgaagttttcgcttctgtgctaaagtggagttaaccccactgaaaatagaggaaggattggtttcaaaaatgttaacacaaaaaaaatctaaccctgaaccatgaggtctcatctttgggaactaaggtttggagtgcagtggcatgatctgggctccttgcagcctcgaccttctgggctcaagcagtcctctcacctcagcctcccctgtaacagctgagactataagtacccaccacacccagctaattcgaatttttttgtagagatgagggtctcactaatttccccaggctggtctcaaactcctgggctcaagcaatcctcccaccttggcttcccaaagtgctaggattaccagtgtgagccactttgccaacccttgcattttctaattagaaagaaaacatcagtgaataccttctgaacctctggtgttttacacatagaaaaatgttgatcatgcactgcatagaggtcaatgatgaatggtaaaaggtctgagtcctcagatcccctcccggcatcccagttatccccagctgcctctcctccatcgcacttcagaagtgctgcgatgggcagaagggcagctgacactccgtgatgtccctcattctgtgttcctccgtgagctcagggaagacactggttggcatccaacagcttagtcacaaagggatttgattgttgggagtgctggtatctgtggctatgatctgccttgttcaagctgagacctctgattgaaaatcccccaggggttttaattgtttacataaggagtcctgatgtttccttttgtaaattatgcctgtggtgaccttgtctagtctgactttaaatatggaactgactttcagcagcatggcgcaacatcgaggctttaaaaattctttaatttgatataattcagacatagaaaaattacaaaaacagtacagcaggtatctgtggtagagctgatttcaaattcaagattgaggatggggagcacgtgaagcttggtgctagtgatgttgaatttttgtttttaatgttatttttagtgggagttttatccttttggtcttgatacctcacctttggccaacactcaaagataggcttcctatgagatacatggcccctggataagactcagtgaatgaaattgttgcttcttgtcctgtttgggatgtgtgtgtgtgtgtgtgtgtgtgtgtgtgtgacaggatcttgctatcactcag

SEQ ID NO: 12522 - DNA, 1170 bp, Homo sapiens
caagcttctggtgtttggtttaccaagatctcatcccaaatgttctgaaacttggtgcttttctgatctctcctttgaagctcatccatcaatgcggtggcgtggtcgccctctggctcgcacgttgtcagtgtggacaaaggatgcaaagctgtgctgtgggcacagtactgacggggctctcagggctgggaggaccccagtgccctcctcagaagaagcacatgggctcctgcagccctgtcctggcaggtgatgtgctgggtatagcatggacctcccagagaagctcaagctatgtggcactgtagctttgccgtgaatgggatttctgaagatttgactgaggtctctcttggcctggaagaataacactgaaaaaacctgacgctgcggtcacttagcagaggctcaggttcttgccttgggaaacactactagctctgaccttccatacctcacttgggggagcacagggccccgctgggcctcctcaccaacggcagtgccaaaatcagcccccacatcaaggtggtgttctctgtgctttctctcgtccttccaaagtcggttctggcctaacgcatgtcccaacaccttgggttcatttgcccggtgaactcactttaagcattggattaacggaaactcccgaactacagacccctccctggtgggttgcatgaatgtgtctcattactgctgaaatgtcctcacatctctttcactgttcttcagagctttctggctctctttcccccacaaaattcgacatatttaaaaatctccgtgtggctttaaaaaatggttttttgtttttttgtttttttgaggtgggagaggatgtgtgaaaatcttttccagggaaatgggttcgctgcagaggtaaggatgtgttcctgtatcgatctgcagacacccagaaggtgggtgcacactgcatgcttgggggtgccaagggattcgagacctccaacatacttgtctgaaggtggtgattctggccatggcccctctgccaagcctgtgtgcgatgcccttggtgctttagtgcaagaagcctaggctcagaagcacagcagcgccatctttccgtttcaggggttgtgatgaaggccaaggaaaaacatttatctttactattttacctacgtataaagttttagttca

SEQ ID NO: 12523 - DNA, 1872 bp, Homo sapiens
cagggcctgtgctcctccctcctccatcctctctcctcccgctcctccctccccccactgtgggctggggacgcctgcccttctgtctccggacgctctaggcgagttcagcttggggtgtgagtgagacagcttgccagctgcatccctgcagacagaggatgtgtgtccacatgagtgtttctgtgtgggaaatgcttcctggctctgggaaactttttctgcccattctgtggttcccagggagcgtggccctggtgggccaggggtggtttgacctcttcagcccgtccggtggcctggaggccggaggctctcctgagtgtctgcccctgcagtggcttcttgtcgcctgctgctgggcgtgatgtcgctggaggtgctggcagggactctgatttggtggtccgcgctgcccctgccctgcctctgtcctggctctgaactagtagatgatggtgccagagggcagggagctcgcctggggagagggctgtgccccgtagggacagtgcccaggtgaaggatgcccctggtcctccagggcactgactttgcccttttttcccgttgatagtcatggctcagaggtgcttgtaaatgtcttgggaagaggtttctgtaacccctgccctggtgtgaggaggaaatggctctggcctggctgcctggccgtggcttctctttggctcccaaagagaaggacagtgttgggagtatctgccgtggcttctctttggctcccaaagagaaggacagtgttgggagtatctgccggcgctgtccaggtcctttagtcagcgtcactccatctgatgtgcagaagctgggctgcacctgcgggggtgggcatagaccgggctgggtctgcagcagcccctggtcctgagcaggcggcagtgaacagcactggcccacctcccactcacagcccctctgtcccctctgcagtgcacccaggtgggcccctctgcgtgcctttgggtgctcccctctcgtggtcgttctggcccgaggcccttagagtatggaggctgagccaggccttgggtttccccagcacagcctcctgtcgctgcatgcgacgtgttgggatttttggatgaaagactctcccacgctctgttggtggacttagctgcctcactggaagtgatgtgggtggaaggtggttgtatgttaccttttccacctctcattgttttccccagaacattgtagatgggggttggcagagggagaaataagccagccacggcagtcgcttggtttcccaggtggaatgggctaacacaggagatgatgggaacctgtcccgcagtccctgcatgaccattggccctgctggcctggcgatgtgggcatcctggggttcttagggtcccagaacaagccccaggcaagctggaacttgggtggggaggggacatgaggaggataaacagctgactgtggcttcaaggacatcagggccaccccaagtcctcagtgtcctactcctggcaaggagttgggtttggatcaaaagtgtttaaaattaatatgttgtcagtgattagaacaacactgtttacataaaaaccatttttctaattctaacaagttagaatgtgaggaaggaatgaacatgagtgtttaggaacctgccctttggtgctgggctggcgtcccgcactggggtgtcctcgctgtctgggggctgctctgctgccccggcccaggtccccttgtggtgttgccagacgggcctcatggtctgctgtgcagagagaggcaggaaggatccctgaagagtcttggagaaaaggttctgtgccctcaggtggggcttaccccctcgtatttataatcttaatttatatagtgaccacc

SEQ ID NO: 12524 - DNA, 1099 bp, Homo sapiens
cgggtgactttcagccacagttagtgaagccttcaagaatctcagctacatcttcatggcagacacttcatggaggctgctttgaggcaaagtttatgcgttctgtttaacagatgacctctcaagagtctccttctcagttgaaaggggagaatttcaccaaaaacaactgtccggcccagagagagatctgaggtttctcctggtctcccacacatcagagctcctctgctctgctcgtcctgcttgtctaaacctaactgctttttctcagatagtgccccagctcttccttttaccatcatcctgcccctgggattttgtctcgtgccttttcccaccttgttccatgatctggcaccgtgccagtcgcctgcagacccctttccatgagtgacatctgccccagtgctccgtgcagaggctcctgccttgctttttcacctgctcagtctaaagggctttcttctggcccagccacacaggagggacctcggccttgtagagaatggtgtgaggttgcattattgtgggaccatcctgaggactcagcccttggtggccccgcagggccctcccagctaccctggaatttgatagcaagtcaaatcatgaacaccccaggtttcattttaaaccacaatataaacatgtttaactggtttcctatgtttttctgcttttcccgcttaaatgatagatttcttgaggaaagagaccaattcttcatgagctgcaactacatatggagttttcatgcctaacgtctgagtgctctctgtgtgccaggccatgctgaaccgtttttacgtcttatcttctttcatccccaccagaaccccttgattagatcgattctgtccaataggcaggctgtctctccttttaatagatatggaaaagtagcttaagtcttagaactcctaaattcactcgtgcagcagcgctagctgggccagggtgtgggatgtggacttccccaccagcttgtgctccctgggggagtgtggggagcagggtcggggggttgccattatatttttgttgtttctttaacataacttacttatttaacgtaatgccactttctataagtatt

SEQ ID NO: 12525 - DNA, 1256 bp, Homo sapiens
tcttgctcttctctctggagaaaatattacaagattaatatcaatgaagaagcagaatatgcaatcagaaatacatagggaaaaagctgggttaatagaagtattttcctggattttgtgatgtgtatcgcatttgtcagcatctttaaatgtgtcattcgttgagacttattttttccttctagatgaatattcgctatcctgcctccttttgggttggtaatttggggttgtctttcttaggcccctgccctggaaactgcgccgggatcccaggcggaggggtgaggaaggcggacctcgcccagcggcgacacccagagcaagtcacgcagaaatctccaggccgcacttatctccggtgcacagcgcgggagatgacacgcatcccaccggatctcgcacagcaccgctgatgaataagcacacagctgtttgtacaactaccaccggccgtggcggccggagaccctccctcccttccgccggacattggggcgtggctggaaactcgggagtggattggccggaaggtgggacgcaaatttgtttgaaaggcccaatcagtgcccggcttctccgctctagccaatagaaaaccgagaggaaggcagggagggcggagtctcctatttgagtttgtggcgcgcgaggccctgcagtccgggttggcgcttgggtactggctgggtccgatgctgggtacgctgcgcgccatggagggcgaggacgtggaagacgaccagctgctgcagaagctcagggccagtcgccgccgcttccagaggcgcatgcagcggctgatagagaaggtgcggcccccgccggtccgccgggaggggaggcctgcgtgtcggagtgaggctgggaggggacgtaggacgggaagggaaggggctctgaggactcggagcgggggttggggaagcgggactggggcttggatgcggagagaaggtggaggcggagctgggggctccggagagggaaaaaggaggcagcgccgaaggcttcggtgcggggacggggaggaaagactggggcctccggaacggggagtggggaagcaggcctggggctcgggtgcagagaggagggtttggtggggctgggggtgctcctgagtgggacgagagaggcggagttgggggctccgctgcagagaccgcgtttggggcgccccaggccagactaacggcctctcacgggctggcgccgcctcctcccgggtctggggcccctcgtggccctggaac

SEQ ID NO: 12526 - DNA, 1172 bp, Homo sapiens
taggtggatttgtcagtgccacttcctacaaagtgaaggctggatttttgggggactcatttccagcagccaccagcaggtggagggagtgagatgcgtaaacaaactgtccctcatgcttggtgtttgggcagatgcattgctaaagcgtgctcactaataaatcccctgctgatatggcacaaatatttatagccgatgattgatgtgaaattaacaaaaactagcagttgacagcgatatgaggtggcaaaggctatttgggaaagtttccgttgtctttgaaaattaagaaaaattatacgtttacttgccttgctaagaactgtttaagaataaatcaacataaactagggcagcttcttaaactatgatggagaagcacaaggtcaaagtgtttcgtctcagaatgaagcagtaatgtattactttgcgtactgtgtacaggggccggcagatgtttctgatgttatgaagctatgctcctggaagtggttgtgaaaatcgcagccctgtgaattgtgtgccctaagagccagctgtgctcctaacagtgatgccgtctttccatggaaatcacccataagcacagccttcagtctaacttcatgtcaagtctaagtggcacagctatccatgaacactgtaaacattcccagctccatctaaggtgattaaacggagtcagaacccggccatggatgtgtattcactgttatttaacagatgctcaaactagacaggtgggactgtccagatgcctgtggggcactacagagttttgaggaaatagagtctcagactggagccccaaggaccttgaggacaggagtctacctggggaggggcatcccagagacttactccagctgcttaactccggtgtgcctggagtcaccttgggaccttgttacctgcagatttggattcagcaaggcaaggtggacctgagagtctgtgtttctggtgagccacaggtagcaccccggctgctggtccctggtctggggaaaggcaggcagagttggagagacccttcccgggttcctggttgcaggtgctgtgtcatcgtatggctgtatttgaggggattgtgtaagaagatgttgttaaatttatttttagaataatagacttttagatagaagagaaacctcggaggtcaatcagct

SEQ ID NO: 12527 - DNA, 1206 bp, Homo sapiens
gctcgctggatgcggcggggccccagcgcgcgggcgacatgtacttgttggacggcagtggcgagcccgcgtcgccacccgcggacgcgatgccgcgcgggacgccccccagaaagactgtctaccgcatctccgtgaccatggtcaggaaggagcagctggccgcgccgggctccggcggcccggacccacgcccggttcggcggccccggcccgcgcgctccccggacgcgcccgggaggcttgaggaggaggccgaggaggcggagggcgccgaggaaccggagggtccccggccgcgcgcttgggatttccgcaccttccgcacccgcagcaccgggcagctggaactggggcggctccggccgtgcgcacgcggcctggaacccgcggacctggccggcagcgccccggccgaggaggagggacgcggctcgcccgcgtccggcagccccgacgtggagggggcccgggccgcgcccctgcggcggagcctgagcttcaggcactggagcgggcctgaggcgccgcaaggccggacactgggcggcggaaggcgccacagcagctccgggagcctggcctgggcgccgtgcgacgaggccgcggccgggaccaccctggagcccgcgaccgccacgcagcccgcctcggagaagcgcaacaccctggacgtgggcgaggtgctcagcaagaacgacgcgctctcggacctggagcgttgggaacgcagtaagagcaagaaccgcacgctggacaacagcgacctgcagcggctggagcgcgcgcgggcggcggccggggccggcgcggcctcggagcaccggctgctgcgcttcttcagcggcatcttcgcgcgcagggacgggggcccgggcggcgggccctcgccacggagcggagcctcgcggccacgcggctacttcagcctgcggcgggccccggccgaagcgcactcgtccagcgccgagagcatcgacggctccccgcgcagaggtgggcagcgtggccgggggtcccgggacgggaaggggcgtggtggggacttgccggttccgcagcggctatgggacccgccctcccgggtcgggagcctgcacgtggcctcgagggatgcgaactcgggtactgcggttttccccagcagggcgcagcggtcctgggttttctggctgcccctgcgcctggctgtgcgtgctggtgccc

SEQ ID NO: 12528 - DNA, 2289 bp, Homo sapiens
ggtggcacaagggatggggacgcgagggggaggggaggcgaggaacaaggagaaggggcaactttccttaactggcagttgagcacatagtacatttcccctctaccaaacggaacacttggattccatctcttctctgaggagctcgacggcataaatcagaagcaagcacagagtttgtcaggtttgaagcccctatgatggtgtgtgtcaaatcagttgtagctaatctgtccagggagaatactggcttcattacacttgtacagccgagttcttcccgcattactgctgtttaatagaacgtgattagtcatcgccgagaagaaagcatattagccgaggaggtagtcacgcggcacgcgccggtgattgccacgatgtgattgcaatactcttagaagcaccatattatcccagacatgttctttcaagcccttggagccctctctaaattcactgtcatcatttagtatctgtttaatttttcagtccaaagagaggaaatcagtcgctgagtattatttgactccggtctccttggtgcaaaaacaaaatgggaaaaataaataagaataactcagaaactcaaaaggaaaccacaaattcagctaataatagcatttcgagtatatttcgtaaactaaggaaatacacaaaaggctgttttttccgactgtaagagatatttgatgtccttttgccgaggtggatgtgttagtctcaggccctcctggaccacgttgcccaagtcacacaggcttctgtgttatgtatttagataagatgtgtgaaaatatatttgaataaaagaagttcataaatatgcattgatttttgtacagacaaatggcacctctcttaatttataaattgaactggatgtgaactaataatgtgcaactagttgagataagagggttacagatcattgtacatggaaaatattcccagcagtaaacacttccattaatgtgatctacggcttttgaaaaggagcatctcagaataagatggtggtacaatttgcttattaaaattgagaaagaaaaaaaaagacacactggagtatattagaaaggaaaaagaaggaatgtggtctctcatgattgaaagcatgatttagatcggatacggcttttgctaaccaaggaccaagggactctggcaagatggggtggttttccgaatgccagaccgaggtgccttacgaaggcagctgccaatggttctgtggcacagactggctcctgagaacccagacgaccttgacctggcagcccggccctccacgctagtacctcgcctgattttccatcgttgcggtatccagccgcttcagacgtccgccgccttcagtggtggtagtcaaatgtagtcaaccaaaccacagcatcccttaggttaaaagcaaacggggcagctttgcctagagctcattgacagtgtgatggggggagaagggttgtcacaatggaagatgaggacactagactcatgtagcacagaaacatgaagccacacgcaccggcagcctccggggtgttcctcgctctctcgtatgttaaaccttatattttataagagtttttcctcttatttcactttttaaaaaaaattaaagtaggtggggaaaaaaataaagctttacacagaatttatatgtgggtaagtgtttcatggaaatttctaatcttaacgaagctaagtggagctcactcgtatccaaaagtataacaggtgcagaagccacaagtctgagaaccttgacgacagttccatcgtcctgccatttgatttttcagtctgcgtttcatcactgtgtagctattgtaaatgtgaatagaaaaaaacaggtcattgcctatttttgaagaacgcgttggtgttcgagtccactagacacactcgctccacacagccttcaccgtagactctgtagtggacacagatatagcataaatgaaattgttaaattatttcattgtagttaattcccactataggaatgctttatcatagtgaagtttcttttgagaagaaacggaactccttgaggcttctctttgggatgtatatgagcgtgtacatattattctatgtgtttataatataatattttcccaaatgacttcttgtttcactttgccttccacaacctgaatgccagattggttttttcccttcctggcccccagcacaagctgccatgactccccctcagaaaacacagcccctcctctaccattctcagtgatgtccatctgctccactccgcagccactttct

SEQ ID NO: 12529 - DNA, 1108 bp, Homo sapiens
ctaattctccagactgcagcccctctcagccccgagcacctgagcgctggggaggcccttattgagctcagcctggagaggggagggtcgcacgggtcccgggggcaggtctcctgcactggctcttcccttctgccagcttggaatttggttctcatcttgccacaggggtgcgtttcctaaagggcagccggagcagctcaaaggtgacaactgagatgcatttctaggcaggggcagggaaggccaacccaccttgcagccagttttctgtttctgtaaatagcagtgtatagagatggaagggcagcgtgggtgtatccacagatgggtttaggttttttttttggatgttttctattacctcattcagcaactttatgtttcacaatgactcaatgatgctttatttatattgtttgtactgtaattaaaaccattgacagacatttcactttgcttgttatttcatatgatcttgttttgattaaatatgccagtttgtattttcctgccttgggatttttttgtgtccgctgtacagtattctaagggaaaaagaaaaagaaagatgtgtaaagtaacagagagaggtggctatggtgtagagacctctttctaataaagaaatgaaaatatgtctacaccgcttccgtggagttgttgttttttgttttttgttttttttttttttggtggcgttggtcatttgtcacaactaattgtgtttctaagcccaggaaaggtaaatcagagagaaaaggggctctgtctgctgcgggcagggattgccccaggcccaggctgccccaggcccgagggactcagcacacgagttcacagacggaatgaagaaagagaccaggagtgtctcttctgacttcttcctttacaaggacagaaactccaagagaatgttctttgcccagccagggttgactgggcccagaacttccagatgcttctgtatctttgcactgtgccacactgccccaggtgtgtcgtaagaactattcccagcaggtggctagcagtagaaccatcccaggactctattattaagaccgttattatcattaatattactgtaatttttgcctacaaacta

SEQ ID NO: 12530 - DNA, 1150 bp, Homo sapiens
tcagcatcagcagctagaacaggcccggccctgagggtccagaagggccagggcctggcacccacctggagaagcccccgcacccgagggaacccatggtggactccactgtgtttgaagcaacaaagtcacagcccagctgtggccatcccaagcaaattgagaatatattcactaaatgggcttaaaagactgcttttgaaggggcttacagccacaccagaagacacgctaaatatttattatactatcctactttgtacataaatatctctatagactggatctcagctgcagtattttgaaagttataggacttaattacccagtaatttctccactcattccagaagaaaacaaaacctctgctgtaatctgcgcggttagcagccacctttccatacttttccaaaggtaaacgtgaaacccaagaacaagcactggggtttaaactgattttggtttgcgttctggctttttgagttgactgaaaagcagacattgttaggcagcctggaaattcgctttgctttgctttgcttttgcctggctttggtttcccctggggttgcctatcctatctgagccatgtgaagcacgtctccgttgtgttaatttatttcaatgtagcttattttcttataagttatgacatttaaacaatttcagtcttgtgaataataaaaaggagagagggggggaaaaagaccaatccctgggcctcataagtgtgtccagaatttgaccgtcccgggcactgccagggtgtggccgggcaactggtctgggaccagtactggagaaacgtcccctgaaacaggtctccttaggcatcctggacttgagccacccagcactttgccaggtttaaaataggagggcaagagggccgataggattacgaatttaagaaaacctaattctcaccttagaaatctatctcccccttttgcacagcctaatcgatacctagtaggccggcaaacttcggcagaggaggaggtgggtgcccggaggaggcaagcgagtgcgggtattggtggctttgcacaaactcctgatgctccaaatcgactacagccagggaggaaacgtctttcctttacaaatatctccggcccgaaaagaagcggtgctcgcctgccggcag

SEQ ID NO: 12531 - DNA, 1188 bp, Homo sapiens
atttcaaacagcgaattataaaggctgcccaaacctgtaatctttgctttggtttgtcctctagcttttaaaagattaacacattaataacaatttcatatgaagataagatatatacttcatagtgaatgaaataaagcatattaaagtgaatttgaggcattcagtgtacactctcaataatgatgtataaatataactaaagttaatgacagctgaggcagttggtgtatagtgaagagtgtgggctctgaagtcataagtgggttccaatccttttcccttacgtaggaatagtgtgaccttggttaagttgcttaaccttttagccacagcctgcctatctacaaagtgggatcaaataggacctatctcataggacagttgtggggattaaacagatagtgtgggtaaagcacttaagcccagggtctggcacacagaagcagacagaagattaccagctgtcctcagtaagacggataagtgtctaatccctaagctgccccagcatggcaacatatttcttcttggtcaaagtgacagcaagaggaggacttgtatattttctagttacaatgcagctccaagagctgcagattcccacacttcacaacccactggtgtttatgttggacagtgggtggcaaccggtcgatgctgttgtggggaattaacaagagggaaggacgtttggtggtggaaatatagggtgttattttatttgggggatggaaaggtagtgagaaactgagaattattagtcactagctaattaaaatgtggaaaagaatacaggattttggtaggtggcaatgaacccacaaataagtcccggccttgtctctctgtaggtaggatgggctttttctgtggaagatgtttgataataatagcacaagaaatcctggtttcaaaatatcaaaatatgcttgaaaccttaaaaaaaattctattttatctatgtgatggttccacaaagggctctggaagtataaatcagtctgatactgattcttctaagataaggagagtacttgggtataggagttaatactagaacatcatcattatgtatatatttttcttttctttcttgttttttctattagctgtactttatgccaaatagaacaccatcattagaaagcagagtgttccacatgcctgacatctatagataaatgt

SEQ ID NO: 12532 - DNA, 1188 bp, Homo sapiens; identical to SEQ ID NO: 12531

SEQ ID NO: 12533 - DNA, 1264 bp, Homo sapiens
gaaaaaagaaaaaaaaaaccttagcctttgaatagttggacaaatatttattttatctccatctccaggccctttttttattttttattttttggttgggcctaaaacccgtttatatttctccctggtgttgtaggttcattttgttggcctgtgatgggctcttcaaggtctttaccccagaagaagccgtgaacttcatcttgtcctgtctcgaggtgagaaatctcacacgggggtggtggttgtcccaattgtgtcttagttttcagagaagtagaagttctgagaccccatttcctcccattgtgggacagcccttgtgccctttttcagtgtgaactctgcctactgactcactggtcagtttgtcctgccagccctgatggagaccagagcagctcttcttcctggcagtcatgtctcaggaaagtgacagggtgcggggtcactccattcactcattccctttctcatctggtaggatgaaaagatccagacccgggaagggaagtccgcagccgacgcccgctacgaagcagcctgcaacaggctggccaacaaggcggtgcagcggggctcggccgacaacgtcactgtgatggtggtgcggatagggcactgaggggtggcgcgcggccaggagcacgcatggtattgacttaaaaggttcattttgtgtgtgtgcacattgtgtgttttgtgtactcctgtgggactcccatggttgtaaataaaggtttctctttttttttcctagtcttttgagttattatactgtgagcacctcttgacccttcagagattgtgtttgcttttgaatatgctgtctttccttgttaaaaccattataggcatcttggactggctcgtagtggcctgcaggctgctggttgtgtgatgttttgtagttcacgggcattttgctgtgctttcactgtcatgatgaccctggttggggaagtggcatgttgcaatgaagagacccaggggatgactggttagtcaaggctaggcccagaccagggctttgggaaccctctagctcttttcagttttccctatggaaatagtgttgcaaaatgttacatagcatgagctcaggcttagccaggaaatagactcatagacaaggttactcatgcatcagacctgccagaaacagtacagaattagccattctcattccattggtgagagctgcagtctggtggaaggagtctgtggaggactcggttcagtggcttccatctggactccctgg

SEQ ID NO: 12534 - DNA, 1722 bp, Homo sapiens
agatgtcatcttcaacttagcttgtcacttcccagaagacagctcttcacagtgttcattttattatttgtctggcattaggtatcagaaaataagcttaaatgagtctaaccattaaatgtaaatagatctctgcctgcattggaatcttttatccttttcttcctcagttgaagtaaaagcagctgatcttactgtttgttcaaattcttcaccagccttgagcatggaaatacatattttcagggcatcttaagggcttttgagataaactctcctgacttgcatttgtccttattcaattatcacaagactaatttgcacatgatccttttgcctgatttgaatctcacttctctgggatggcagcacatcccttgccctgatgctttgacttacaccctagacagagttgttttgtgctcactgactcctcttttgtgtccctgtgcaacctcttagagctcaccctgtccaacagtgctccgatttgagttatagacttgcagctgggggagatgccttaaggggtattgcttatttgtttgcgccattaggatattgctgagtcagacagtcatagttccctctcatttgctctgggactagggtttccagagggttgggcacagttttgtattggctcttttgttctcttttccttagcctcttcggtgatctttggtctgaagggctatgtggctgagcggaagggtgagagggaggagatgcaggatgcccacgtcatcctgaacgacatcaccgaggagtgtaggcccccatcgtccctcatgtgagtctcatgtggtaggaagcccggctggcattaacatctcctgggttctgactggcattttggactggctagtttgtatttactagaaaatctaacacatcacttgattgtacatcagtgattctcagctggggttgattttgctccccgcccaggggacatttgtcagtgtttgggtacatttttgtcacaactgcgggagggagttgttactggcatctggtgggtagagactagggatgctggtaaacatcttagaagcacagggcagccccacaacaaagaattgttcagcctggaatgtcagtagtgtcgcggttgagcagccctgctgagcgggagatgacgcttcatagcatggctctgcagcgtgtgttactccttaccagcaactgagcggcttctggcagagaatatttttaatccatgacctagaagataagagttggaagccactaattaaagtatgaatggtgatcaagcagagctagtacagataatcagggcccaggaagaacaaaagtcaaaatgatgtcaaggaaaagacagacaatgaaaaattagctgcaactatacaaactaaaatgaagccttctggataagctcttgggcctggaaaaaaaccagaaggtaggacattaagttggctgtaaacatacattatagtacatattacataggttacataattcagaattacataataaatacattacgtacctttactgacaccagttggtcattaacatacagtgtgctggagccgtttgggctgatggcgtttgtccagtagatgaggtctgctcatggagatgaggtgatggctgctgcagagcagctgatcatatgtagaggggacgagatacacacccattgagacagggtcttgctgtcttgctcaggctggagtacagtggcacaatcat

SEQ ID NO: 12535 - DNA, 1129 bp, Homo sapiens
ccatgcctggctaatttttgtatttttagtagagacagggttttcccatattggccaggctggtctcgaactcctgaccttgtgatctgtccgcctcagcctcccaaagtgctgagattacaggcgtgagccactgcacccagccgataacacattctttttttttttttccttttttgagactgtctctctctctgttgcccaggctggagtgcagtggcgcgatctcagctcagtgcaagctctgcctcccaggttcatgccattctgctgcctcagcctcccaagtagctgggactacaggctcccgccaccacgcccacctaatttttttgtatttttagtagagatggggtttcaccatgttagccaggatggtttccatctcctgacttcgtgatccgcctgcctcggcctcccaaagtgctgggatgacaggtgtgagcgaccttgcccggcccgataacacattcttaagcgggcaggaaccatttacaaaagttgattatgtactaagccataaaataagcctcaatgatctgtttcttgtacagactacattctcagactacagtgtaatttgcttagaagtcaataacaaacctgtaaggtgtctttattttgaaattttattatttttctttttttctttttctttttctttttttttttttaagacagtctcactctgttggcaggctggagtgcagtgttgcgatctcagctcactgcaacctctacttcccgggttcaagttcctgtctaagcctcccgagtagctgggactataggcacctgccaccacacccagctaattttttgtattttcagtagagacggggtttcaccatgttggccaggatggtctcaatctcttgacctcatgatccgcctgcctctgcctcccaaagtgctgggattacaggcatgagccgctgcgcctggcctttttctttttcttttttttttttttgagatggagccttgctctgttgcctaggctggagcgcagtggcgagatctcagctcactgcagcctccgcctcctgggttccagtgagtctcgtgcctcagcctcccgagtagctgggattacaggcgctaccatgcccggctaattttttgtatt

SEQ ID NO: 12536 - DNA, 2198 bp, Homo sapiens
gggacaaggcttcctgctgtgcctttctggcagggttttgtggggtcacatgggaagcaatgtgttacgcaagcagtctccatgtgtgtgtaaactgctgtcctggtgacttgtccctcttcttagtggaaatgcatttgagatggtgacagggctggatgaacgtgtgaccctgggagatccgggctggactgtggaccccgatgggccagagtccttgtggcccacagcatagcactggggacagagcgctctatgcaggtgaggcgtatgagaacagcatggtaaataattgatgaagtcacatttgttcaacttaaaggattgttctttattctgaagttattttcttccttatttggatgataaaatttccttttatgtaatgaaggtaaaagtagagggcaatatttttgctttttgaaatgctcttggttgcaaaacaaaatgttggttgctgtttgtcagccccagaatttcttcttaagttcgcctgtctctgaaatcccaaagtcacggaaccgcagtctagctgtggtgcatgtttacgtattggtgagaaattcctcttgggttcttgaacagcctgtacgctggcaggcagcactgcagcatttctgctgctcatggccaagaacgagtctggagatcgctgcgtgcggttttaggaagtgccaacacccgtggtgatgggcctctggccacccctggatccatgggacacactcacaggaagctgatgtggccttctcggtgaggactgcaccttaacctgggcactgggagcctgtggcccccctgtatgttggtgatgacactagtgtgggtcttctggctctggggctacagcttctgcctcctcacctggccgtcggtactcggcaagcaggcctggcctcccggggcctggatccctaccggctgggattggcctcctggaagtacctgtttgggccatgtgacctcctttctcacttatgcctcactcccctcctcccgctccaaacccgaacctctcagtgtggaatgaacgctccaaacccgaacctctcagtgtggaatgaacgctccaaacccgaacctctcagtgtggaatgaaacagtttagatgtgtacatgatgcacgtgggtgggattcacatcccaggagaattccacggagaggaatgtgcagattttgaagtgtacagtgatgtgtggaataaatactagaaattctcagcagacagtgggatggagaagtgagtgggggcaggagggggatttctgttgccttgacatgtcgttgctcagtgcctggattgcaggcgagtctctcttttttatgttgctttgatttcaagatctcttagatatactaggtagtgtatgaatgtgcataaatccagtttgagaatggtgtttatgaagaagctgtttcgtgtgtacagttgctgctgtaatttagccagcagtgccctgccctgccctgcagtgtctgctcagctcccactgcttctctttgctgttgggcatgtgaggcatgacttggaggggggcctggtgcctggggacctgctgaagagaatgctcaccaccagctctctgtttccctttctgctttggtaatcaacacgtgtttgcctgcagtggccgggaccgtgactgtttctgcccttgtgcctagttaagagccttcaaaagcataatgaacacttttgatatgatattgtaactttagtaaatgctttacttccctctaattgcccccaaatgccttaattttgtggactgtttatttcaacaggtggaagtgttggtcgtgcgaaatcttggtattcgcatttcaagaagggagttcttttttctttcttctttctatggaacgtttcaagtgattggatagaaagaagggctctgaagcaggagttttcacctgctctgagggaacttggggctccagggacgtaccccaaatgttgcccaggttgaaactccctgacagcctgttctacgtagtggctcgtggtttccagtttgaagagagttgtgcccctaaaagtgtttgaaacctgtggctttcaagcaaggtaccgttgtccccacagtgttccgtggggtagggggtgatggagactgtgggcaagcctgttgtttttggccccctgttgttacatgggacctgttttgacggtgggagggtgagatgtgaagatgtg

SEQ ID NO: 12537 - DNA, 1288 bp, Homo sapiens
caaatggatggcttgtgaatttgctctcaaggtgcttatggaaagggatcctgattgattgaaattcatgttttctcaagctccagattggctagatttcagatcgccaacacattcgccactgggcaactaccctacaagtttgtactttcattttaattattttctaacagaaccgctcccgtctccaagccttcatgcacatatgtacctaatgagtttttatagcaaagaatataaatttgctgttgatttttgtatgaattttttcacaaaaagatcctgaataagcattgttttatgaattttacatttttcctcaccatttagcaattttctgaatggtaataatgtctaaatctttttcctttctgaattcttgcttgtacatttttttttacctttcaaaggtttttaattatttttgtttttatttttgtacgatgagttttctgcagcgtacagaattgttgctgtcagattctattttcagaaagtgagaggagggaccgtaggtcttttcggagtgacaccaacgattgtgtctttcctggtctgtcctaggagctgtataaagaagcccaggggctctttttaactttcaacactagtagtattacgaggggtggtgtgtttttcccctccgtggcaagggcagggagggttgcttaggatgcccggccaccctgggaggcttgccagatgccgggggcagtcagcattaatgaaactcatgtttaaacttctctgaccacatcgtcaggatagaattctaacttgagttttccaaagaccttttgagcatgtcagcaatgcatggggcacacgtggggctctttacccacttgggtttttccactgcagccacgtggccagccctggattttggagcctgtggctgcaaggaacccagggacccttgttgcctggtgaacctgcagggagggtatgattgcctgaccaggacagccagtctttactctttttctcttcaacagtaactgacagtcacgttttactggtaacttattttccagcacatgaagccaccagtttcattccaaagtgtatattgggttcagacttgggggcagaagttcagacacaccgtgctcaggagggacccagagccgagtttcggagtttggtaaagtttacagggtagcttctgaaattaactcaaacttttgaccaaatgagtgcagattcttggattcacttggtcactgggctgctgatggtcagctctgagacagtggtttgagagcaggcagaacggtcttgggac

SEQ ID NO: 12538 - DNA, 1104 bp, Homo sapiens
agggaggggctgtcgctgcatacattcccgaggatctcagggtctaagaggcctcaggacccatgtttaatcccgggacttgccccttgtttgccatgggagggggctgctagacaagccctaggagctcactgaggagccaggctcggggtcctggagcaggatttgctgttagatacagcccctcaggggcacgggctgcaggcagacgcccaccaggggtacctcgtgctccccagtggcttggtgcctctcctgggcccctgacaggctgatgccacaacaatttgaggtgtccccaccagggtctgtgacccagctcagccctcacaggagtcaaggcacctctaagggccagacactgaccctgcagcagggccacagggtgtcacaagggggagcagtggcccctcgttgtcccacaaatgcccaagtgccactgaagaccccggagtgcgcccagggcctgtcgagcaccttggccgcgtgcccttggcctctctgaccgtctccctcccccccacaggctcgctcgcctccgtgttcgtccggctcccttgcggtggtgttggggtaagtgttcctttaatgtgtaaataatgtcctgtttcttctcgagtcccagtggtcacagaaatcgcagccttgcttccctcaaagtgaataattgctgccaggtgttttccatacgcaggggctgcccatgtgcggcttcaaaggccgtgtgagccgagagcgttttgatcgccgactcgggcacctttctctggggaaggttgtctggcgcaggtggctggggctctggggtgcagtggctctcgctttaagaaacaggatcctgtatgcagccagcatctcatccccttcgaagtctgtggcagtaatctgctcacatcaggccacgagtatggtgcgggtaggatgcgtgcttctgtattctgtacctagtttccacccgaagctacaggtggggctcccagtgcagtgaccgtgatactcatgggccacgtggagtctgtagggctactcgctgggctgtgctggcttctgtgagctgatgatatggacctggcctgggcatatgaatcactggtctgtgccagc

SEQ ID NO: 12539 - DNA, 1242 bp, Homo sapiens
atctgaattagcccagggatctcaatctgaagaatttccaaacctcagagagacgcagccggatgccagctagccatccaggacagatgccagaccctggcagctgtggccccgggcggtccaaggaaggctgcttcatcctggggctcagagactccgggagcgcggctggggtttcccttgaacgtgagggagctcagcagctcacctctattttaagaccagaccctggcagctggaaagcaaagtaataatttgatgccaagtcattcgtgcgacagtgaagggtaatgcattgaaggctggaattatcttttaaagtgttttttcaaagctataattaagtgtaagccctctaaaatatttcttaaatattttaaaatatcacgttgggtgatgttgcttcttcttttgcagtaaccaaataacatgcttgtttttgtatcaaattaagtttccttttgggcaatggtttcagttggagtttctgtctgtggagctgaagcagcagcttctgcagaacgtgtgagtgtcctctcgcctgtccccacagtgcatccgcggacgcaaggccaccctggaggagctacagacggtgcactcggaagcccacaccctcctgtatggcacgaaccccctcaaccggcagaaactggacagtaagaaacttctaggtatttcaggaccttcctttcctcccatattgggtttgaagtcccctgaggttgtgtttccagctctcaaccccttgtgtctggggcacctgtgggtgtcgcctgccaggttataaggtaaagggcctgaaagggaacctttcaccctctgttcacaagccactggttgttgatgaacgtgccaggtagcaggtgtgtttgtgtaaaaactgggctgagaaccgttggtttagaagcatcttgaatcagagtttaggtttgagaggctgattaggaacacagccagcatgctgcccgccctgccctgcagggagcctgaagttgttttgagctccgctttaaggcccatcagagcaagaccaggaggaggcctagggagtgtccactgcttaggggtgaaaggctgctggtgtcttggctctggctgaaagcacctgcacaggtggtggaggggaattttagcctcatggagagaactttctaatgggcatcctctgcccggggagctggtgagaggctttccacagggatcttcagcagaggcaggtgaactcccagccagctccat

SEQ ID NO: 12540 - DNA, 1195 bp, Homo sapiens
tgggcagtgagcattgtggacgtggttgtcttccgctgagtgggtggtgggctgtttctcttagcagttgtggctgtgaggtcagcattggcctctccccttcacactcaagctctcctctgcagactctgttgacacctgcagcttcttttctgtttctcggtgcctgacacagaagaggtgcttagtaaaccccaaatgttagtcagcctccttccctgggccaggtcaccttgaccctgggctggggtcctactgggcattattttcttaggcactcaggcaccccagtgcctgttgggagataaaggtgcctgctggcctgtggcagggtgataaggtgccctgagtccctgattgtctgccccagagggtggggtttgcagcatcccttctcctgtcagatgagctcagaggacccagctctctgtgcttcatgtgttacctccgccttgcagatcatccccaagccaagcgagccagcccggcagccggagagccacccggaggagacggaggaggagctccgtgagcaccaggctctgctggacgagccctacctggaccggctgccggggcagaaggaggcgcacgcacaggccggcgtgcaggtgaagcaggagcccattgagagcgatgaggaagaggcagagcccccacgggaggtggagccgggccagcgccagcccagtgagcaggagctgctcttcagacaggtgaccgcaggcggggagggcaccagaaggctggcacgcacagccaccctcggtccccaggtggcatcttctgtggtgatcacgggggctgcagggcatccttgcgcggtcactgtccagtgtctcacctgtcttgtcctggccagtgagggaggttgatgtggcttccattttgtcccagccgttcctagggatacgagatgtttgccccctgtgggtggttacgtaactgctttccagccatgcgcaggccccagagaatggatttccttcctgtctgtaggctgtaaatgaacacagaatccatgtgttagtgagatacagcatgctttttaaagaagtgaaggaactagaggtattaattgatcaaaaaggcaggcagggcctgatcagaagtcaagaccttttgtgacccagaggtgctaatgagcagccctgcagatccagacagacgggtgcgattgtggcacccagagcca

SEQ ID NO: 12541 - DNA, 2020 bp, Homo sapiens
ctgctcgtatttgtagaaatgattccgtcgaactgttctatcagtccttggtcagaacaaggataaagaaggaagttggtggggcgtggtggctcaagcctgtaatcccagcactttgggaggctgaggtgggtggatcacttgaggtcaggagtttgagaccagcctgggccaacatggcaaaaccccgtttctactaaaaatacaaaaattagctgtgcctggtggcatgcacctgtgttcccagctactcgggaggctgaggcaggagaattgctcgaacccagggttgcaggggtggtggaggttgcagtgagcccagatcgtgccaccacactccagcctgggcgatagagcaagattctgtctccaaaaaaaaagaggaagtcatcatttccctagttggatgttgttttccagatcggaacttccatgttgtaactccagtctcttttctccttctgaccttgcaggttcatctgcagaagccagcggacgcctctgttcaacttgtgggttacctggctcatgagaccttgccggcgaggctcggcgcttgaacgtctgtgacccagccctcaccgtcccggtacttgtatgtgttggtgggagtttggagctcgttggagctatcgtttccgtggaaattttgagccatttcgaatcacttaaaggagtggacattgctagcaatgagctcccaaagccatccaggtaaggccgggtcatttcttctctgggcacacagcggggctttctttgcccaaagtagaagttcttgtgactgcagcttgctttctggatttgagacttttgtttttcttgatagtggtcactgttggtttttgacagcacaaagtgcaaaatggatggtttattcttcctcttggtgaaagaagaatgataaaacctgggaggatgtggagtcaagtctgcgaccccggtttgcaggctgacttgagaggcacacaggtttcctcgatgctttttgacaagggtgatgttgaaaggtcaggttgtgatgtggagagctggtttcttgcccagtgtctttgttgtttcatgaggggttgtgtgaggggtgggagtgctcctccaactgggcgtctgggctgtctgggaagaagctcatgttcccactgaggtcgtggccacagttgctcctggtgtttgagggcctctgtgaggggctgcactaagcattttacaagcatttagtacagccccagatcatctcaggcctggagggaagaagtaatttgcctgaggtcacagagctggtaggtgggggacccacatgattgggaagcaagcttgtcctgctctgagcttcagaagcatgtcatgggcccatccatttacgacttcacactttctgtccttggaaagtcaccgagagcgtgcaccataatgaaacctcgaggcctgccgccgacctgcctgagtgtggggctcctgcagagccagtcctgtgctgcccagcttcctgccacttccagcgcaccgtggccttcaagggcacttagccatcgacttctgtcttgcgtccacatgagagagaagacggtggccactggacagacgcttggacaggcacctgaggctctgttagccttggctctgggtcctgctccttagagcagaggcagagaggctcagggtctgtctgggtcactctctttgagattgccggaacgcttacacacatctttccctgggtggaatcgtctttgtctgaaaattccagagggcaagattccaggtttttttagatatgaaagttttattgagttaaattgtttatgtattgactgatgtaaagaaatggtttatgatcattccaagacaaaattaagcgctatggctcaaagtgtctaaatagacattgaatggagctggctctctccctcctacactgggctgctgttgggtgagagtgtatcttttttctgtgtctaaacatagtgtgatgtgtgtgagcattttcatagagtataattctataggcagggccctgtgt

SEQ ID NO: 12542 - DNA, 2020 bp, Homo sapiens; identical to SEQ ID NO: 12541

SEQ ID NO: 12543 - DNA, 1170 bp, Homo sapiens
tgagtatcattcacgctcccttactggaggcttcacctttctgcagcctagcccggctttctcatgctcacagcggcagccggctggtttccctctgctctcaaggacccagcacgtgcctcccagcttcatctctccccggccccggcagcgagggcagcatcttgggtgcccgtgcactcgtgggtgcagacacggcactggcgtgtcctgagtgctgagttgtggctgtgcggtggtgtccgtgggactcagaacagccctgcatgcattttcttaggattgtcttttaaatgaaagctagaaagcactctagccaacactctccccttggactacatgtacgagccctggttggctgaaactgaaagtctgttacgggaaaagtcttttatttcattggatcattgacgattatctctgtattttggactactatataattcattctgaagtgatttcttcagcccttacccttgtaggtgtaactacgtggttttgcttatttccctagattttgaagatctttttgatgatgatgacatccagtgagatgccctctggctgcaggcggggccaagcccttggtacagagccgcagtgtgagcctgcgcaggacagtttcaggtggttttaaagaacacgtggaaatcccttgaatttaggacctggttaaccagaaagataagactgttcttaacgacctagatgattctgttcatctctgaacgggatcaggttttgtcctcactccaattaaaagaaagcaatgtcacatgtggagtgatctctttcttgcacttatgagtgaatgttgcagtccctaaacgtctctgtgtgtttgtgtgtgcatgcatgtgcgtgcatctgtcagcacgctgagagaaccacatttgtctggtagcagataccttgtgttaaggtgctgtatgtgctggagcaggaggcagcgcggcccgtgcacagctgggcctgctgacagcacttggaggaccttgccacggggccgcccctctgctgtgtgggcaggttcccactgtgtgtgtctgtcagcacagtcgtccttatgctgtcctctggcctccacgtcagggcagctgcccctaggcttaagaactaggacgacaggatgcgactgcaggagacgccttctacgtggaaatgcacatt

SEQ ID NO: 12544 - DNA, 1160 bp, Homo sapiens
ctggggctggacgctgagccaggctgtggagtgaaagtgcagaggagacagaagagaacaacatgcgtgggggccgggcagggtggggccccagagcctcgcaggccagggggatgccttggtcccttgcggggcacgtgtcagacccagctaagctgggacatagggagggcgtcagcctcagacccacatgccctgggtgggaactgcccccacctccaggctcctgggcaagtcatgccttggtttcctcagcggcatgcgggtgaggatattcttgcctccctgtgaccctcgagatcattaaaatgagggccgtctgggctggcaggccctgcgagtcaggcagcgaccaccacgagctggggcagagcagaggcctcccctgacttccctccagagccccctaccctggggcttcgttaggggctggccggggccaggcacccccagggcctcggggcctggcttagggtcccttgctccccaggtccccctgggcccggagtgctcgagagctgtcatgaagctggtctactgtgctcactgcctgggagtccccggcgccaggccctgccctgactattgccgaaatgtgctcaagggctgccttgccaaccaggccgacctggacgccgagtggaggaacctcctgggtgagcccccacccgcgagagcggcctggaactgtcttggggagtgcacgactgggggtcctggggggcgggtggtccctagcttagagcttggacccagggacctgatcagggatgccctgacccgggccagatctgggtggtgctgcagggttgaggggccagggtgccttttgaatgtcctgagtgatgtgtgacttggggcagctgccagggagggagccctgtggggtcatagtttcttgtccttccccacttagcaagcacctcggtgtgcatacatgccaacacgtgtgactcatcgaggaccggcacttgtttaagctaacacatacatgcaccgtcacatgacaggctgacacatgcgaactggcgtgctcacttgctgacacacagtgggccagtgcccaccagtacagcgtgtgctcctgggcgcatgtgatgacatgagctgggctgacccgcatcaatgccaacacgtgtgtggtaatatgtacatgctta

SEQ ID NO: 12545 - DNA, 1232 bp, Homo sapiens
ccacaagcccctcccctgggctctcccaggcagggagaatggggagagggacctccttgtgtctggcagagacctgtggacctggcctccccactcccagctctcttgcactgcaggccctggggccagcccgcacacaccatgcctcctgtctcaacactgacagctgtgcctagccccggatgccagcacctgccaggtgccgccccggggcaagggccccagcagccctatggtgaccgccacactgtgccttaatgtctgccgggggcccaggctgtgctgtccctgcagcacgcctccttgcagggatctgagccaccctccccgcacagccctgcaccccgcccctggggttggcagcctcagttggcccctggcagaggaacaaggacacagacattccctcagtgtggggggcaggggacacagggagaggatggttgtccctggggagggccctctggccccaggcaaccttagcccctcagaacagggagtcccaggacccagggagagtgtggggacaggacagcctgtctcttgtagcttcctggggtgggaggcacaggggcaaagcaataccccagggaaagtgggaggtggtgctggtgctctctccaggcccaccatgctgggagaggcggccagagcctggggcctccagcctgggactgctgtgatggggtatcacggtgatggtcccattaaacttccactctgcaaacctgatctcctgcgctctttctcgcgactcttgtcctctgcatcttcctggctgtgtagggtgggctggcctgccgggacttggggcctggagctggtcaggagctgggtgtggccccctcctctgatacataagcccgagagcaggctccccgaatcctgcccagccccttggctggaccccctgggcctgagtagcctctggatgtcacaggaaagccatgtgtcaccttcactctgggccttcacctgtggcttaagccaaatcccggcctcagtggtgatcctttcccaagatgggtacaaggtgacaggcatgttttgttttggagaactgagatttccattttcccaggcgataggtgtcgctgcccttcacagtccccaaggatgtggcgccaccatctcagtgccacgcacacctggccaacatgccgtggcccagaagcagcacgtctcttctcccaacccgctggccaggcccagtcacagccccactccacaca

SEQ ID NO: 12546 - DNA, 1212 bp, Homo sapiens
cgcgcgcgacgtcacacaccattttcagatgccgttgcaattaaatcttgccacactgtcctcctgggtgattgttgacagttattgtagccacagagagaacataagacacgttgcgttcattcgctagaaatccctgtttccttctctcagaaggcagtcacagtccctacctgagtcgtgtgaaacacagggcctgagagtgctttacaggcattcacgtgctgtccgagtggcattcgggggctggcctagctggccctagtcctggtgtgcagggttcaggcagtcttgacctgcaacaaccgaggttttttagtcttttaacccagccattttcaattttttaaaaattaggtaagttaaaaaagctgggtaaaagctgactcagccctgtgtgcttgtgttccttagagctctccttcaaagagcgccgggcagggctgactgttttcacgtgtgcccgtcagttctcgccacatcccttgcctgtgggtgaaagctcaggtgtggggagggtgtcctgtgtcccacacggtgctgtgctgctgccagaatacgagtcccattgagcctctccaaagacggcctccaaggatctgaactcttggccactggtatagtggcctcctgttctcaccccattgttattttggcttttttaatataaaatgtacattgacagacacccgaagtctggatttaatgctaccagggcatcgtcacctcccagggtctcagatttctcctcctgcagaatgagggccacatcatgtggtcaccaaggtcccttctgcctccgggactctagactctagaaccgtctacttgaggaaccaggactctagaaccgtactgtccaatgtgggcgaggctgcagtgagccatgattgtacccactccagcctgggtgacagagggagaccctgtctcaagttttaaaaggctccaaattaatacccagccatctgttctttaacagacatttttacaaacatacaaaaaatgtggaagtgatgaggaaaggtatgctaaatccagcacaatcctaatcaaaatgccatttgattttttttttttttaaggagtcattctctgtcacccaggctggagtgcaatggcgcaatctcagctcactgcagccaccacctcccaggttcaagcgattctcctgcctcaccctccctagtagctgggattacaggcacccgc

SEQ ID NO: 12547 - DNA, 2521 bp, Homo sapiens
catggacgaattcaaggtgagccggctggaagcacagtgggtgagaatcctctctcaccgggggcacctggctggccagaagaaagagcagggcatggccttcccctcaagatgatgaggccacaaccccagggctggcagtggaactgtcctcatggacaccacgggtcagtgcaggcgacggcctgtgtgaggctgcactgccacggtggccattaggagggcatctccttgacagctgcctggcgagctcgtcctctgtgggtgggaatttcatgcaagagcgcacagtacgtgctgcggccctctgtctgctgggaacaaggtgctcctgagatacacctaacttggtgtggtgatgaggctgactgacttcagaacaactctgaaaccagattttaaaacgtttgctaactcagaaaatgcttcactagaaattgacacataattttaacccttttcctcgcttggagtcccctcatctgacgttgtacaccccttccaggtggacattcgcttcccacagagcggagccccagaccccaactgcgtcactgtgacggggctcccagagaatgtggaggaagccatcgaccacatcctcaatctggaggaggaatacgtgagtctctgtgggccttggagccctgaggcgccctggcacgtccaccggcctgaggcccagccaggagcttcaggggacaaggtggcacttgtgtttccagaggcaggcgaggtgcaggggtgagcaggcgggcgggatgctgggggtgctgggcagactgaccctgtcttcctgtcttctgcctgcagctagctgacgtggtggacagtgaggcgctgcaggtatacatgaaacccccagcacacgaagaggccaaggcaccttccagaggctttgtggtgcgggacgcaccctggaccgccagcagcagtgagaaggtcagatgcgggcttctgccctcctgggtcccagggagggtgggcgggcaggcgggcttggtgtcctgagggtggcaactgcgtcggaagctgcttgcgagttggggagcatcccctcctgaagccgtgtcctctctctgcacaggctcctgacatgagcagctctgaggaatttcccagctttggggctcaggtggctcccaagaccctcccttggggccccaaacgataatgatcaaaaagaacagaaccctctccagcctgctgacccaaacccaaccacacaatggtttgtctcaatctgacccagcggctggaccctccgtaaattgttgacgctcttcccccttcccgaggtcccgcagggagcctagcgcctggctgtgtgtgcggccgctcctccaggcctggccgtgcccgctcaggacctgctccactgtttaacactaaaccaaggtcatgagcattcgtgctaagataacagactccagctcctggtccacccggcatgtcagtcagcactctggccttcatcacgagagctccgcagccgtggctaggattccacttcctgtgtcatgacctcaggaaataaacgtccttgactttataaaagccaaacgtttgccctcttcctttcccacctccctcctgccagtttcccttggtccagacagtcctgtttgtggagtgcaatcagcctcctccagctgccagagcgcctcagcacaggtgtcagggtgcaaggaagacctggcaatggacagcaggaggcaggttcctggagctggggggtgacctgagaggcagagggtgacgggttctcaggcagtcctgattttacctgccgtggggtctgaaagcaccaagggtccctgcccctacctccactgccagaccctcagcctgaggtctggtgagtggagcctggaggcaaggtggtaggcaccatctgggtcccctgtggccgtcacagtgtctgctgtgattgagatgcgcacaggttgggggaggtagggccttacgcttgtcctcagtgggggcagtttgccttagatgacagctgggctcttcttcacaccacctgcagcccctccctgcccctgccctagctgctgtgtgttcagttgccttctttctacctcagccggcgtggagtggtctctgtgcagttagtgccaccccacacacccgtctcttgattgagatgtttctggtggttatgggtttcccgtggagctgggggtgggcgccgtgtacctaagctggaggctggcgctctccctcagcacaggtgggtcagtggccagcaggcccatctggagtgggagtgggcacttccaccccgcccacaggccatccggctgtgcaggccagcccctaggagcaggtcccgggtgactggcagttttcacggtctagggccgagacgatggcatggggcctagagcatgaggtagagcagaatgcagaccacgccgctggatgccgagagaccctgctctccgagggaggcatctgtgtcatgctgtgagggctgaggacggggccctagtctctggttttctggtcttaacat

SEQ ID NO: 12548 - DNA, 1202 bp, Homo sapiens
aaatcttttcctattcttttctattgagttaaaggtcctggtggcattgtcgggtggggcacattgctgttgtcatagggctgtttgccttgtgtttcgtggagccccattgctgagcttacaacgtcactctgctctcagctcccacggcctaaccatgaccatcctccctgcaggcattggttcctgtcaccattgaagtagaggtgccctttgaccttcaccgttacgttattgggcagaaaggaagtgggatccgcaagatgatggatgagtttgaggtagacccctttcccgggaggccatgtcacaggagtggcctgtcgcatcctctcccgagtgccagtgtcctttctcaacttcctgttgactctgcctcctcctgctcggactgggcactgacttcccttcacggcgggtggccttccctctcaccacttctgggtcccagggccaatggactctttcctgttctctggggtcctgaacgtcaagtcagccccctcttcacgtaggtgaacatacatgtcccggcacctgagctgcagtctgacatcatcgccatcacgggcctcgctgcaaatttggaccgggccaaggctggactgctggagcgtgtgaaggagctacaggccgagcaggaggaccgggtgagcaggaggtggccggggcactgcccagagccatggtgctcagctttgggcacatgtcagaatctagggaagttcttcaggatcccagcatcccagcgacatctggctggaggtgagatgcaggcagtgccaggacgcagtcagcatccaggggtcttgctgtggaactagccaagagcatggcacctttctctttttcataaaaaagtgacaaagttggacttccgtgtaaatttgcagtttctctcaaaaccaaatcagagtggtacctcagacctacaagaaaggtcaaggttgcgagaggcccccaagcatgtgctatgcagtgaggacgagcatcggggacccccactaacctctagcacagggtggtcaaagggcgaatgacttcctggtaagcagggatgaaacccccccaacctctggcaaggctgacgtttgaaggattgtatgagcggagcgctgcagacgcccagcctctggcagggctgacatttggaggattgtgtgagcagagtgctgcagacaggagcaggggttctggaactt

SEQ ID NO: 12549 - DNA, 1099 bp, Homo sapiens
tgactgtaatttgcaacgtaagttagttgttggacaaatgatctatctcacttaccctcatgacaaacctctgaaggtttgtttgcaaataccagtgctctgtcgtgttcatgctacccttaggggtagaagggatactgtattttactctctagcacaggtggtgaatcgggctgtgttttttgtctttaaggtggaaaatagctattcaatttctgttccgatcttcaaacagtttcacaagaatatcattgggaaaggaggcgcaaacattaaaaaggtgataacttgtccgctgcatcttgcttcttcttgccttgtcctctgtagccctgcaccattttggttttagactaggagggactcttccttacttctagccctgtgctcaactgtgtctcaactctgggagagctctagtcagcttctcatggtgatctctctccctgtagattcgtgaagaaagcaacaccaaaatcgaccttccagcagagaatagcaattcagagaccattatcatcacaggcaagcgagccaactgcgaagctgcccggagcaggattctgtctattcagaaagacctggtaatgggagatgttttctaatggagatcctccagtaaaatctctaacagcctctaagattgagcctggggttgagtcacgcagggtcattgggccagcgcaggctgatgtggaagattgcacctttcaatccaggctactgatgagttggtcagcagttttctgcctttgtctctcacgatacttacttacctggaccctgcagcagtaacatttgacgtgggcacttgtcttattagacattttcttcttgttacctgaaaatcttatctgaaggtatttacggtattttctttcctttaaaaaaaattgacatgcagtaaattgtacatatttacagtgtacaatgtaatagttttgacgtgtgtatacatccatggaatcattcccaccatcaccccaaaaatgtcccatgccattttgtattacagtctccctccatcccacttggcagctcctgaaaaccacactccccccacccccacttctatccccaggcaacccccagtctgctt

SEQ ID NO: 12550 - DNA, 1229 bp, Homo sapiens
ttgttttcttttattctcttcttgctataggcctcagcaactgttgccattcccaaagaacaccatcgctttgttattggcaaaaatggagagaaactgcaagacttggagctaaaaactgcaaccaaaatccagatcccacgcccagatgaccccagcaatcagatcaagatcactggcaccaaagagggcatcgagaaagctcgccatgaagtcttactcatctctgccgagcaggtgaggcctgtgtgagtgcctcgtgcccctgcctacctgcttgtgcagacctcactccctcatgggttgccgtgtccagtgtggacttcaaggcataatgtggtgggggtggagggcttgactccaactctaaaaagccctgtctgtccccagtttgttttcaaaggcctgttctcatcagatcatcccttcctttccaggacaaacgtgctgtggagaggctagaagtagaaaaggcattccaccccttcatcgctgggccgtataatagactggttggcgagatcatgcaggagacaggcacgcgcatcaacatccccccacccagcgtgaaccggacagagattgtcttcactggagagaaggaacagttggctcaggctgtggctcgcatcaagaagatttatgaggagaaggtacacgatttagaggaggcaaatccccatgggcaggaatagaaatgaggatttgggtctggagattcagttaaggcctggttctgccccttatctttttgtccttgatgaagatgcttattgtctctacacttgagtgacccgggtgagatcggtgcccgcccccccttgctgttgagcatctgcctggcagttgtccttgccgtcctgggcctctgactgtgctgacaggctgccagctgggctgccccgggtcagatgcacatcccggacttgttcacgtcttagattaagctgttagctcagcttagtgaactttgaggtctgaaacgtgttccttaattgagggaaaggattgggtgttttgcagtgttcaaggacgaagttatcagccggcgggtgactagactgaggggaaaaatccagtccttgaacagtgaagtttctggggattggctagtcctgatcacttgttgttcacttcttgggatcagcatctatagtctgggccgctttggcttgctttctgcagcagtggccatgcccacctgcccgcttcccacacctttccctttg

SEQ ID NO: 12551 - DNA, 2137 bp, Homo sapiens
ttctgtatactttctagttttgcagcatttccagtttccaggagcctcatgaatggctttttggtttagttaactttgtggtcatgtaagccctgccttttgctcagtttatgacctttgttaaggagaaaagtagaactgttaataattaacgcagcagacattgcctcactcccacttaagtgtgttttgttttcttttttctagaaaacactttcctggataaaaaagaaaacattccagatgcatgatccagctgtgtgttttcaatccttgggagggtgccatccacattttaacagtacctgtgcctgagaatttaatttttaaaagactttgatgtgtttttgtatgaagtacttttaacgtatgtatttcattgctgtgtcacactctgtgttttgtgaggtgaatgtcttccttttctttctccctaaccactaatgttagaattgatttccaagaatcggcatgtatacttaatactgaatttctttgatttaactgacttaacaactgactaaccattgatgagcactcctgatttttatctagaacattcagatttaccataatgttccttagtggtagaggtgtgtgcctagtgatgtagaaagatacactgacttggtgcaaggccatctgcttaccacatcacaccacttggagatctttgcttccttgcttttatgtttgtacacaacacctaaaaccagttttgctgctataattctatactgttgattcgtctgcgattttatctgttaaccaaataaaacataatagaatttcctaatgagatatatctttatacttaaacagcttttttagaggtgagttttaaagaagtctcttaattctgatgctaggttgtttttaaaaccactatgcaaagaactcaccacaagccaccttttgtagtgttctccactaatactggttatcctgtgctacagagaaaatcaaagcagtcataagctccagttttcgtattgcaaataagactcttacctacaaaatgagattcagtgaactaatttggtttttactcaaccaaattaaaaatttttttaaggaaaattagcagttggtctattcagaatcaaacctttttatattttatactgcactttagtgtattttctgtcactgtaggtatagaagatctgcctcccctgtggaaattggggtctgttggtgggcgtgcccctgaagcctggcttgggttgaaaagtgttcccgccctaaggccttggtgccctgaacctctgatgcctaccgggttctcctgatttgagtttcctttaaatactccctttttgagtaattttctgatgggaggaaagtagcagtcatcatctttttgtgtgcaggctgtctcatttatttttagccattgtcgtttcattcattttgtgtaatataaaccgtgtgtcatgtcaaagtgaaagacatttcaaatctgtagcataggctagtgggcaggtccgcacagtcgaagccacacctggtctgttttctgtgcactgtagccttagtgtcacctttcttcttgtgtctccttatggtacactccagcggttgccttttttatcatttctactgaagttgggaaattcaaccccagaaattgacagatgaaaggagacaatggttgtgtagggagatggagaaaatgcttaatctgaggatgagacagggttttttcatttttgtgggggctagaaaaaacataaaatgaggcagttaaataataatagttaatgaaggtgtgctacagaaaataatctggtgttcttgctaactttgcccttcactgttgcttaattgtgaacagccaaaagctatatgttatggcttattgtgtgaaggtaactaagaagtggtgttccatgacttcagagtacatccatgcggagtccattatttgagtttgacatttaataactttgctggaaaatctgtaaaaaagaaaaacaagtttgctagtgactaagccccgcatatgtgagtgaaagtacttcaggcacgctgcctcctggtaacagctatgcagggagggaggacccacactgctacacttctgatcccctttggttttactacccaaatctaaatagatacttttgataataga

SEQ ID NO: 12552 - DNA, 1119 bp, Homo sapiens
ctatcttttcttaattaagcagatggaaccagaagactttgtatacaacttttagaaaaacccttcctgggctgggtgcagtggtgcacacctgtaatcccagtaccttgggaggctgagatgggcagatcacttgggctcaggagttcaagaccagcctggccaacatggcaaaaccctttttctacaaaaaatacaaaaatcagctgggcttggtgttgtgagcctgtagtccctactgagcagtaggaggggagcggctgaggtgggaggattgtttgagcctgggaggttgaagttgcagtgagccaagatcacgccattgcactccagcctgggcacagagcaagatcctgtctcaaaaaaaaaccttactgatttttaattttggaattccctatcgtgtgatctgcttcctaaatgtactttctcttgtccaatacttcattcttgaattaattaacctttgtgttttgtttctagggaccttaccaggacacattagaatttttgttgggtagtagagatgaatgtaagaacttctggaagatttgtgtggagtatcacaccttttttagacttttggaccaacctaagccaaaagcaaaagccgtcttcttcagccggggctcctccttcagatacaggtaggggccatgccgtggcttgcatgggcccctcactggtttgtaaagctgagaaaataggtaattcctagtcaagaaagaagtgttataaaatatttcagagaattacacacaaagtggaggtattgtgaaagaataactagaggaagcatatgaaataaaataacggaaaaaatacgcttaataaaaactttgcttacaaattcagttacgcttactacaaagtataactttaaaatatgtatgtgggccgagcccggtggctcacacctgtaatcccagcactttggaaggccaaggcgggtggatcatttgaggtcaggaattcgatatcagcctggccaacatggtgaaaccccatctctactaaaaatacaaaaattagctgggcgtgttagcgggcacctgtaatcccagctactcgggaggctgaggcatgagaatcgcttaaacccatgaggcagagatcacg

SEQ ID NO: 12553 - DNA, 1096 bp, Homo sapiens
tctgtctttccacttgtaacagttaatgaggcactgacgttgctcttttccaccttaacaagacagtttacagtggttaaatagcaaaactccaggagcaattcagcctgaggccatagtgccctgcagcagcattgggctctgcttttgtttctgctttgtgctttgtggctcttcttcaagccagtgttgggtagtgcacagcctgagaggtgtggcctgataaaccctgaaattgaaagaagtatgcagatttgactcagcactcctggaagtgtctggatacagctcactgagagtgtggaggtgaaagtgcctgcaaaatattaacagttctctctcaatctattgatctcctcagttacatccagaaccttaaagccgcacagttgtcatcctccgcccgcagtctcaggcagggcgcatcaggggctgcactggtagctcccaggaggacttacccatgggtcaccgtcatagccaggtgtgtctactcagaggggacgcaatcctgcagcagtccccgtcaatgagaggccaccagcagacagtgcctgttggacccatgaagtccaccactaattatatactctgctttaggtagaatatttttattagctgtcaaactgtttttgtatttaagtttccaaaagtccaggtactttatgtaggccaatgtataaatatttcaagtctaacagtagcacagttatatgttaatacaactgactacacgaaaaatatgtaatagcatatgctatgtaatttttcaaatcactaggtattgatatgtgccttttttatattaccaagagattctctaaatatggaattagattaggattctctgctccacttaacacacatttttaaattagtactgatgattgagggatggacaatagcacaccaaaaaaaaaagagtttagtatgaaaaatttaaacctgttggttaagtcattcccattaatgtcattttgctgagggtgacttggtccttttgaattgctttggtgtacgggtatgttctgatttttcatgcaagctcctctgccattccaccgctctgaggagtaattgtagcacttcacatgtg

SEQ ID NO: 12554 - DNA, 1308 bp, Homo sapiens
taaaaacacaaaaattagctaggcttggtgacatgtgcctgtagtcccagctactcgggaggctgaagcaggagaatcgcttgaacccgggaggtggaggttgcagtgagccgagatcacgccattgcactccatcctgggtgagagagcgagactctgtttaaaaaaaaaaaaaaaaaaaaaaagattctgaaaaaggtttggatgccatctgtatctttagtgtgaaagtgaaaacttgtttctcatatttatggtagagctgacctgtaattttttttccaatagattggaggtggacacaaaggaagaggcagccagacagctacttcagcgtcctcaacgcattcatcgacaggaaggacagttactactccattcaccagataggtgggaggctgcagaatgtgccaggccccacccgggctgtctggagagggtggagtggtcggtttcccctcagagcttttctggtgtcgtgggatgtggagcaggaggctgtaaacctgtaaacactgacctctgaccatctgtgcgctgctgtcacatcacccccgtgtcatcccacatcacccccgtcccacccaggcccagaccctgggccttgcccttcctgctgtccatgcggcttgcagtgcctggtgctcggcacagtctggggaaattggcctcgccccatcagtgaatctgaatgctcagattgaagtggagtgagtaaagaagagttggcctttcttgcaagcaaggccggcttttgagcactgtgttttcacttatagaaggaagtggtcccttcatttcccctccttttctaagttcatagtgaaggacagtccctgagaccttgtttgccccctcatgcctcccccgatcttgttggggcatccttccgtctggaggctgggtcgggtgctgtccaggccttcctgtgacgtgtctcctggcaccacgtgccaccagaggtcagggctgggggcgggtgtgtgttgctaatgtgtatctgttccctgcagcgcaaatgggagttggcgaaggcaagtccataggccagtggtacgggcccaacactgtcgcccaggtcctgaagtatgtactgcgcttccactgctgagcatggggcagcagggatgttccctgggggttaaattctccttgagtcttcatggctacaggaaataaggggtctctaattatttacttcatggccctcagaaggtttctcagcgatgactgtgttgaggtcttgtgaataggaatttatgttttctaacaaaatgaacaccgtagtccacatcctggctggcacat

SEQ ID NO: 12555 - DNA, 1266 bp, Homo sapiens
tcactcctgcaagtgggcactcagcggggttggggtcacgaggctgaggtcggcttaaagcaggagtgggcagttggcacatcatgtttctcctgcatcagggctgtggcaggaatgccgggtgactaccgtagacacttgtcaaggttgaggttcagagaaaggtgtggggtatcccggaggtcaccacagtgtgccaggaggttcaggttggccttccagagcccggcctgtgtgaaatccccacgagcacagaggacagaacgaaacatggtgttgttttgaaacagggtgttactgtgtcacccaggctggagtagagtggtgccacattttttgtagagacggggtgtccctgtgtagcccaggctggtcttgaactcctgggtacaagcagtcctccctcgtgggcctcccaaagtgctgggattacaggcgtgggctcccgtgaccagcctggaacgtgctgatgagcctctttttctcctgaaaccccggtgggaacagatggtggatgcttccaaaagcatcgaagctgtccatgaggacatccgcgtgctctctgaggacgccatccgcactgccacagagaagccgctgggggagctatggaagtgacccaaggctgcccactggagacgcctctccctgcagtcccccgagaggtgggagactcgcggaaggccccgtccccagcagagtccagaccccacaacttcaggagctctttcccggcagcagagatctgcaggctgcctcttctgccccggagctggggtgcactggggacccccgtggtggggaccttggcagtgtggacatgagcagagcgatggagcagtctcctgccctctcccctgtcctgatggcactctgttgtattttcttactgaagttcagtgataactctgagcagtttcattgtgatcactgtaaatggtaatcagttggaattctcctaaatgtcttccagacactagtaaaaaacgacctgaaaattgtttgtggaacgcttcacttttcttagactgaggacggagctggctttgaatgggaacctccatcccaggagagaagagccttcattgggcccagtagggccttcctggaccctggttcctgcctagttgagggagtcccactgtgggtctgaacagttgcagccatgccctgggctcgctgggtccagccaggctatatccgagtgtcatcacagcttacgtcctgaactcacctaagttaactctgctattttcattgcaaccc

SEQ ID NO: 12556 - DNA, 1241 bp, Homo sapiens
agggagggagagagggtgctggcacagccctggcaagaagggccagtggatgagactaggctggcacataacaggctctaggagtgcctgtcttcttcctgctcttccacgggagaggagaccctggcgtgtgtgtggcagaaaagacactgccaaggacctcgtgcctgtgtccggacccagctgctctgtgctgcaggcgttctaggccgggggtctccaggggttctgtacatagactgtttgctcctggccagcaggcctgtagctgtgctgggagggcctccatggggcctgggctgtgggtggcggggactggcagccgttctatctacctacttttctgtccacttgtctgtttacaaaggaaaaacaaaggtgacactggagaaaccgacacgtttgaggttctaaaaattaaacgagccacaatataaacagtctcacatcttggtacctcaccaaatgtcccctcattttttcctgtttttacgactttcgaaacaaaaacctagactacactaagctttaactgttgggttctttcttggcagaatttttccctagattggtgtaaacagccagacgtgggccttcccaaacccgacctggtcctgttcctccagttacagctggcggatgctgccaagcggggagcgtttggccatgagcgctatgagaacggggctttccaggagcgggcgctccggtgtttccaccagctcatgaaagacacgactttgaactggaaggtgagaatcccagaattgcacactaggaagcgtggagaagtggctcaggatgacaccgtggtggctggcacagttgtgtcagcaaagctgctgccgtttccgtctggtcctcccagatgtggagccccgggagtagtcgttcaggggttctcggtgccagcaaattcttttttttttgagacagaatcttgctctgggtgccaacccaggctggagtgcaatggcacgatctcagctcactgcaacctccgcttcttgggttcaagtgattctcctgcctcagcctcccgagtagctgggattacaggcacgtgccatcatgcctggctaattttttttgtagagatggggtttctccacgttggtcaggctggtctccaactcctgacctcaggtgatctgcccacctcggcctcccaaagtgctgggattataggcatgagccatcgcgcccggccagtgccagcaaattctaacccgatgagtttt

SEQ ID NO: 12557 - DNA, 1610 bp, Homo sapiens
aatctgtcccttcattcgtgtcgcaatatttcccttccttttaaaactaccttgttcggttgatacttagtaactccgtggccagttgaagcgctggatgtttcctagaacaagaaccaccaaagcctgttcgcacagaagggcgaccttgcagggactcgccgccgcgacctcagtgtggcttttacaggactccccccgagcatcagcagggaccccggcggacgtgggcgggcgcgcgtgagctcgggctgcccggccgggcgtgcgggcggggacatggtaacctggtccacggagggcggccgccaccctcgcgtagctttcctgtggttttccaggactgtccggtacagcccgggctccgcgtgccccgcccgctggagcacctgccaccgaggcgcgcgtggggccactgccgtggcggcggctgccctcctcacactcggctccgcgccgcctccggccaccgtgcgctcccgcgtggggcgcctcggatgggcccgggagggctgggggctcttccctggaggaagcggcctccgcttcgctggcgccgcctttttagcttggacttcagtcctccctcggggactcacctccggagtaaacggctcttcattagcttggagtggccgcaggtcccgtgaccagcacccgcgagaccctgtgcgacagctgggctgatgctccgtttctctgggaattggtgattttttactgtgaagatgaaattaccctaatagcatgaagatcgtgggtctgtgtgtccgtgaagtgagtcccgtctgccaggagctgacgaaccacgaatgcttctgcctgtgctgtgcattcccaggcccgcagctcccggtcgaggggactccgatgtgaatttgttgtgaatttgttgtgccacaatagcagttctggaatgaagctaggaaactcgagtgtgctttttgtttaatgagcgttcaccaagctgagccggagccatcctttcggtggtagttggggaaggctatgcagatttgctctgttgtgacgcgttggtgacggtgcccagcctgcggttccccacagcatcgcaggcgctcggaaatcctctcccgtgcctttagaggaaggagaggattgctgaggaatgcagggacgcctgtttctgtcctcacaccacagaaagaaacctgagggaaaactgagacgtgaggttcctgatttaagaagcctgggtttcttcatggtggggggccatttggaatgacagcctcacttccttctgatggctacatctgtatcttttcctcctgtgtttaatgtttcactagggagaggaaataaagcagaaggaacgtgtgaagctctgtgtctcagacggggccctcccgtcgagaagctggtagtcagtgagtgagaacaagagaacaagaacaccctgaacagtcctggttgggatggtgtccacattcatgttctgcggttcttgaacacacggatgcctctgggccacctgtccttttccgagggtgtgggtgggagtggatcctccgggcgcaggtgccaggcaggtgcaggcgggcggtcggccactgctgctgctcgtccctgccagtgtctgggcctga

SEQ ID NO: 12558 - DNA, 1221 bp, Homo sapiens
aggtgctgctgctggggacatggatgccaagcggaggcctgcgtggcctcctgagcagcagctgaccgcccgtctcatgctggacgggacccctgggcgggtggacatgagaccactgttggccagggacgccgtgcggaggcctacgtggctgcctgagcagcagctgaccgcccgtctcactgttggccagggctttgtggcgtgggtgttttccagtctgcctggagcagcgagaagcagctgtgcagactggtggcggtgggagggtttgctgggactgatggggacaccggccagcttgtctggtgtccagcagccctgccggacttggcctcctgtcctgtcgttgggagccctggctggggctgctttgagcaatgacgctggcccagagcagcttcccacatgaccccagagccgagggtctgccctgtcctaggttaggtcttcatggtttagagtaaaaccgtgagggatgttaattatgggcattgaagacttaaggttttcttaaatttttagtgagcagtgattggccttcaatacttgtgctgagaggaattttaagccaggggaagtgtaagaaaatgttcccattcaggagagattgtgttggagtttctttcttcctctgtatgtattttgtggtgtccacctttaaccacgtttcatccaaaacgatgatgcagctttaacatgaatgttacatttttattttcaaggaattattatctatgttccctttgtaaaggaaagataatgttgtaaatctttttattagataatgtaaagatgtatatcagtatttttggatcatgttatagattatggatatattgtttaataaataaagtattttttggaacaaacaattgaaagtgcatctgtattagcccgttttcacgctgctgataaagacatacccgagattgggtaatttgtaaagaaaaagaggttttttttaaaaaaaattttcttttctctttttttgagacggagtcttgctctgtcacccaggctggagtgcaatggcactgcatgatttcggctcactgtaacatctgcctcccgggttcaggtgattctcctgcctcagcctcctgagtagctgggactacaggcacgtgccaccacgccctgctaatttttgtatttttagtagagatggggttttgccatgttggccaagctggtcttgaactcctgacctcaggtgat

SEQ ID NO: 12559 - DNA, 1149 bp, Homo sapiens
ggcactaaacacccgcctgcctgccagggtgaacacacagccagcttatccctcttaagtgccaaaacttttttttaaaccattttttatcgtttttgaaggagatctttttaaaacctacaagagacatctctctatgccttcttaaaccgagtttactccatttcagcctgttctgaattggtgactctgtcaccaataacgactgcggagaactgtagcgtgcagatgtgttgcccctcccttttaaaattttattttcgtttttctattgggtatttgttttgtttcttgtactttttctctctctccttgcccccctcccgccctccccgccccataccttttcttcccctggattttcaccctttgggctgccttgctcatctttatgccccagcactaggtacggggcccaacacgtggtaggcactccatcagtgtttgctgaattgaaaacattgttgactgtggcttctatcagagtgtctaccttttgcagctcttcccctccctcatttaatttgctgcttttaatctacgtggtctgagaatttgtgaaaccagtgttgttagaagtgtatataatctgaatcaataagctctgaatggtggccaagggcctctcttatggcacaaagatgcatggacttcatgacagctcttttggtggctcagaagccattttttatagaatcatggaatctagaatattcctgctggaaagaacctgagagttggtttggaccaattccctggttttccagcagatgaaacaggcccaaagaggttaaatgactgggtgaaaatcacatagctgtctggtgccagagccagcctatagtagagtcccctgaccccaagcccggtgctcattccactacctctcacacttcacaacaatttcctcaacacttgagggcccagaaagtctgatctctccagaatgatcagcccagaggaatgctgagaaatcacctggaggagggagcagaaagagaaggtttttaaggaggggcttctgaatacttgggagatacggaacggaccaaggaccacactccagggtgcattcgttgctccctggggcaccacttctggattacagtgtgccaggtcctttggaggccctaccccttccccattcat

SEQ ID NO: 12560 - DNA, 2951 bp, Homo sapiens
cccggtggtagcggtggcggcagccggctcaagcccgggccgcagctgcctggccgcgggggccgccgagcagcgggagggcctttggggggcggggcggcggcgcccgaggacgacgatgaagacgacgacgaggagctgctggaagtgcgcctggtcgagaccccggggcgggagctgtggaggatggtcccggcgggacgggccgctcggggacaagcggagcgcgcccaagggccgtcgggcgagggggcggccgccgccgccgccgcctccccgacaccgtcggaggacgaggagccggaggaagaggaggaggaggcggcagcggctgaggaaggtgaagaggagacggtggcgtcgggggaggagtcgctgggctttctgtccaggctgccccctggcccggccggcctggactgcagcgccctggatcgcgacccggacctgcagcctccctcgggcacgtcgcacttcgagttcccggactactgcacccccgaggttaccgagatgatcgcgggggactggcgcccgtctagcatcgcagacctggttttcacctactgagcccaccgtcagcggggcgcgcacgcccccaaaccagctgtttacatacaggaatcaggtattggggcccctcggaggccgaggctggcaccccatctcccgcgcagcctgccccctcctggacgtgcccatcccccctcagatccagacatgcccctcccccgcagacacaccccaaggcagcccaacccccaccccttccccgacacccaagcccctccccacgtcgccccctcctgcacagccaccagcagccagccccctccgatacacctcccgtcctctcctacagacctgcacccctccccccttttgcacacgcccctcctcgtggccggaggacccgccccctcctttgctccggaatctctcctccctcgcccggcccgccttctctgggttaggggggcgatgcggccgggtggcaacgcacgcgcctcctgcgcccctcccttccctggggggaggggcgcaccccttttatccccggagcgctagggcccgcccctccgctggggcccacccccttcgtgcgcatgcttaatgcttctggggaggagggggctggtcccagcggagccgcactcttcgcccgctccgggcaaaagcgggggcgagtgtagagcgatcctgggaaatcctttgatccgggagccctaggtttcctctccagccaacggggcgtcgctgccttaatgggaggagcactcggaagggttggtttgggcctgaaactctcccaagtggcatagccccttttccggtatggggtctcctacacccacgcgcaccacctctccggtcgcgtggctgcctctacagcctacctatacgtccctttttccccccaactgggaattgagaggtaaggtctttctctggaaatccagcagtagaggaagggaccacccaagaaaactaaaaaccaaggcaccttaccagtctgtctggggacaggatccctgctgcaccttccccaccccctcctgggaagtgccccctcacctcagggcacccgcaacctgggctcctccctgagcgcaccggcccttcctgtcacccaggtccaccctcagtactcaagctgcagtatacagcgggaaaaactgaggcactttggtgctaggggtttgggactgaggcgtggagagcagatgtgatggcaggaagactctcgcttttaaacatctggtttgggagagaccatcgacttggccagtgagactgagaatggattccgagtagtgatgggccgtttgcacctcggtttttccacgtgagaaatggggagaacgctgctgttaggaggaagttgtgtccagttcagggtgccctcgggagccctgtccctgttgctgtggcccctctcacgccgccatctctctgccccgccccgcccctccggcctccccacaccccccttgccctcactacctgtatctcaccggcgtgtgttcaccctcccgggtggctcacacactctcattcacacacacaaatctcaggaacaaacggtcccagagtcctccggacccctgcccagggtctctgcaggtctctgccccacgcgttcccgtcgctgacaaagccaccagctgcctcctttaagcttggtgctccggctctgggcctttcttgcgctctattttttttttttttttttttaagaaaaacaacaacaacaaaaaaagacaatgaaaaaaaaaacgtcatgtgagtgaagagatgtcactgtctgtggtcttggagaactagtctcgtagctgaggggtggggtccctctgtctggggcactggcacccacagcaggactccgccagtctgatgccaggactgaataaagtgtatttgccccgaccttgccctgtggttctgcatgtctgtgctcttcctcaaccctccctaaacagtttgccagattcaagtccgtgtgatttgggcccgagctgggtgtcccagggcaagccaccttgcctgtctaggcctctatgtcaggactccctggccttcatgaagaatagcaaactcatccctgtagggaccaggcaggtaacatagacgagtgactctgggtggacagtggtgtcatgacccacttcaaggggcctacctcctgccagttgtgaccctgtgggaatgcagtccacagtggccaggtggccagatttttcaagaaaagctggatggatgtttctgagtcatcttaatttcaaaatgagactcatattttaaaatttctgtgggccaaatgaaacaagtatgcaggcaggtctggtccgagggggctggcttggccatgcctttctgtgcctttaatgaggactaagaagcaagattgggccacactgtctggactcaaagcccagctccaccactgagca

SEQ ID NO: 12561 - DNA, 1205 bp, Homo sapiens
gactggggctggacgaagccagggaagaggagggagacagagaagtggttctgtatggctaggaccaccctactacacgctcagctgccaacagtggattgagtttgggggtagctccaagccttctcctgcctctgaactgagccaaaccttcagtgccttccagaagggagaaaggcagaagcctgtgtggagtgtgctgtgtacacatctgctttgttccacacacatgcagttcctgcttgggtgcttatcaggtgccaagccctgttctcggtgctgggagtacagcagtgagcaaaggagacaatattccctgctcacagagatgacaaactggcatccttgagctgacaacacttttccatgaccataggtcactgtctacactgggtacactttgtaccagtgtcggcctccactgatgctggtgctcaggcacctctgtccaaggacaatccctttcacaaacaaaccagctgcctttgtatcttgtaccttttcagagaaagggaggtatccctgtgccaaaggctccaggcctctcccctgcaactcaggacccaagcccagctcactctgggaactgtgttcccagcatctctgtcctcttgattaagagattctccttccaggcctaagcctgggatttgggccagagataagaatccaaactatgaggctagttcttgtctaactcaagactgttctggaatgagggtccaggcctgtcaaccatggggcttctgacctgagcaccaaggttgagggacaggattaggcagggtctgtcctgtggccacctggaaagtcccaggtgggactcttctggggacacttggggtccacaatcccaggtccatactctaggttttggataccatgagtatgtatgtttacctgtgcctaataaaggagaattatgaaataattttatttttctctgcaatttcttccatcctttccaacgatctcttaccagtttttcctgccttcaaaactggcccccatggtgaaaggccgtagagttgtgtcttaacctgggctgagtggtttgtgagaacagattacctggagcccagtgggtcttcctgcactccttctgtttcttctggcagcagcagtgtctctattagggtactttctgagtcaaaatggcttcaacaagatggaaatatgtttcacacaaaacaagaagtcagcag

SEQ ID NO: 12562 - DNA, 1385 bp, Homo sapiens
ggcagaggaaactgccctctcgcatgctgacatgtctagaatatgcagagtggtcagatcctctccctggcctgttcccggatctaggcgtgggtagactgagtgctgtgggagcccagaaaaggcctcagtgactctccatcaggtagctgaggctgaccaggccattcttgcaggaggacctgcagaggcaaaggcccggggtgggagagcgctcggctgtgggggcagtctctgcactgcgctgacattctcttctcttcctcccatcctctagggcccaggagacaccagcgggggctgccgctgcagggtaaatgggattccttgccacccaagctgtcagaactgccactgagctaaagatggtggggccacatgctgacccagccccacatccacattctgttagaatgtagctcagggagcttcgtggacggccttgcttgctgtagcgttgtaggggccctgcctgcactgcggttgtccacggtcacatctgccccagtgcctttgtccttcccttggggcttgccggccagacttctctcccctgcggctcccacctctgcctgaccccagccttaaacatagcccctggccagaggccttgctgggtggagcctctgtgtgactccatactcctcccaccacaacactcatctgtcaaacaccaagcactctcagcctccccgccttcagctgtcagctttctggggctaacttctctgcctttgtggttggaggcctgaggcctcttggaactcttgctaacctgttcagagccaggaaggagactgcacagttttgaaagcacagcccgtcaggtccggctctgcgtctccctctctgcagcctgtgtaagctattataattaaaatggttttccgggaagggatgagtgtgatgtccttgagaggaaatgaatgtcctggcctgggactctacacacaggcaggatcctgaggtctctgggaactgcatcagaaagttgacttgtcagtccatctgtggtagaatgaggctgtgactgagcactgggacctttctaccagatgtggaccccatgcccagcctcaggggcaaggatgctcttgggtcaccgtcagccaggacaggtggagtgtgcagtgtgtcaagtctgcagagaaggatgggcttaggggcgggaggggaagtcttgccactcctgctcccttttgacctctcagcaggcatctagggttggcaggtagatagttcaagaaggaacgaagctgctgcagttgaggggtggggttgtccatcctattttctcgtctcaagcaagatggcacagtatcgattcagcagtatttactagaacccactctgtgctggtcggaggttactaagacagggtcctg

SEQ ID NO: 12563 - DNA, 1943 bp, Homo sapiens
atacacccctcgttcgacccatggtaccgggcagagcagagaggccttaaaaaaaaagcaccacaagccaaagcgtctctggggattaaggatcctttgccataaaactcattttgtgtctcagcagtgcagggattggggatggaaaaagtcgccagtttttgtgtgtttgtgtgtgtgtgtaaagtggactttccactgtaatccaaccacctaagtttatcaggtgcttcactgaggaagcctagttttttaagcacaatagcaaaaccatcagctctgtattttctcctgttatttcattacagtagctgcttgtgggaactaggaaaaattcttccaacatattttaaggcctaaaatcttagttccccattctcctaccttatagattcacaggcctttctcgcctaggcatcatagataaacgtaattgtttggggagttgaatttaatgaacttatctaactttgtaacccatcttggctttagtaactttatcaaggtggtggctttagtgaatataatggtaaactttagaggacgctaaagcctccttttatagcgcttctcaacggtagggagagctgaagggaaaacattctgactgtgtggcagggtgattttcttccttatgaccacttacagtggatatttattgtacttgacccttttatgccctagaatgctgtgagggttaccatgttgaatttgtgcagaagctaaaagcaccagatgtgccagagatgcaatttgtgattatgtttgcactggattgtgatttgaacaggacacttataactaatgagttctttcttttgaggtggggagagggttgtaaatcaagacttcataccctatccttgtagctcggaaattgaggtgtagcttaggctgatgcggagagctgcagacagctggacctccttacacccatcagaccttggaataaaccgaaggtgaatgcagaggactctgaggtgccacccaagagccttttaaaataaatagaagtttttaaaaatgctacttaagagtcactgcagaagcatggagagagagaaaaaaaaaaaagacccaattgggtggggggtgggggggaggcaagggtttacagagtaacaacttacgtgttgttgtaaattacctcatctgtataccttgtattgggacactatttctcagcactacctgtgtctgcattgcttagatggcaggaaatggaatggccaacatgaaaggttatgttggcaattactctgaaagattttttaaagtatttttaaactttgtttgaagtggtccctcccctcttcctctgcttttttttaagtttgaagccagaaggccctccccaccttgctttattggttgtaattgtattgtaattggtatgactaaaccataactgtgctgggaagaagttgtgccatgaaggtctttaattttttttaataaaaacatttaaataaatgaaatgtccctgcagcctgagcaatatgcttctccaaccgacaccgtgtgtgatagatggctccgttttcacgttttgaattctgtttcttgtacttgaaatgcctgtccagcttacataagatagattaaattgttagagtgggactgtcagaggaatatatcttgtaaagtagatcctcagggtatggctaattactatagtcctaaagtagcagagaaaattagagattggttgacagatttgggaattttaatttcttcttagtttttaactttcatctttgcttcaccttttgacaagtatggttataattagaattgaccatttaagcatctcttgaaaaacctgattttgtcccaccagcaaattctctcccaagactggaattgggtttgcatagtagagagcctgtcttcccagggccttttcctagttaaagaaacacttaactaaaaaggctgtgtgg

SEQ ID NO: 12564 - DNA, 1083 bp, Homo sapiens
atgcctgagcagaggtgggggagtccaccctctccttgatgcagcttgcgcctggcggggaggggtgaaacacttcagaagcaccgtgtctgaaccgttgcttgtggatttatagtagttcagtcataaaaaaaaaattataataggctgattttcttttttctttttttttttaactcgaacttttcataactcaggggattccctgaaaaattacctgcaggtggaatatttcatggacaaatttttttttctcccctcccaaatttagttcctcatcacaaaagaacaaagataaaccagcctcaatcccggctgctgcatttaggtggagacttcttcccattcccaccattgttcctccaccgtcccacactttagggggttggtatctcgtgctcttctccagagattacaaaaatgtagcttctcaggggaggcaggaagaaaggaaggaaggaaagaaggaagggaggacccaatctataggagcagtggactgcttgctggtcgcttacatcactttactccataagcgcttcagtggggttatcctagtggctcttgtggaagtgtgtcttagttacatcaagatgttgaaaatctacccaaaatgcagacagatactaaaaacttctgttcagtaagaatcatgtcttactgatctaaccctaaatccaactcatttatacttttatttttagttcagtttaaaatgttgataccttccctcccaggctccttaccttggtcttttccctgttcatctcccaacatgctgtgctccatagctggtaggagagggaaggcaaaatctttcttagttttctttgtcttggccattttgaattcatttagttactgggcataacttactgctttttacaaaagaaacaaacattgtctgtacaggtttcatgctagagctaatgggagatgtggccacactgacttccattttaagctttctaccttcttttcctccgaccgtccccttccctcacatgccatccagtgagaagacctgctcctcagtcttgtaaatgtatcttgagaggtaggagcagagccactatctccatt

SEQ ID NO: 12565 - DNA, 5159 bp, Homo sapiens
tgtgctacacaaagatgttttggccatccttgttgttggccctaattagaggaagaaatggaaagggcccatgtttcatcctaattgataaaaagtttgatatactttagtattactaacgatttaaattgctactttgtaaggttttaagacattaacatgtttaacatgttttaaaacattaacatcaagactgatgattgaaatgctaattctgcagaagtgtctggtctttggaatagaaatctttttttctttcaattcaacatttgtaagtacctgcagaatacctggcacagtgctaggagaaggattcagagacgaatgtgacacattttcttccttcaaggtgtgctcataagtaagccatttatcatttatgtattacactacgtgttgaaatactctgaaaaaattttttttttttttttttgctgatgtacttttcccctttcagccagtaaaaaagaagaaaattaagcgtgaaataaagattttggagaatttgagaggaggtcccaacatcatcacactggcagacattgtaaaagaccctgtggtgagtatagtaggtgttagcaaggcccgccagagctgagatggtgtttgacctggagcacaactggcctctttttgttccctcccccaaccctcatcattaagtcctgctttgaaagtgcttaatcagatataccatttaactagcttgggtctttctttcaaagagacctccacccacagactatttcttattcttctaggctaagagactgatagcactggaaactgaaatgtgttaatccattttgcaaactcaggtccgatgccgatgggcgatgggcgcattgtcgggctgcctagagcctggtgagacttcagctccatgtcttctgtttgaaatccatcccaaaaatgacctaagtgcggtgatgatcagagcggggagggcttgtagcaatagagggtttcttactactgaggcgaggactgccaaatttcaccacgcagcatccgcaaacattgtccccattaaagctgtcagggctattgctaatgtgtgtttttgtttttgttcttttcccctagtcacgaacccccgccttggtttttgaacacgtaaacaacacagacttcaaggtataatatataaccaactgtttcgggctagtgggtttttagaccacatagcctttggggatgatgctgttagaagagcttgcttcgcatttgtttttaaaaagcttttcatccttacagtgcaaattttaagatagaagaactcctatataagcagtgcccactttctgcatcttgatattttgcccatttgtttaatgttctttttaatgaccaacacattgacttctcactacttagttgacagtttctgctgatgtccaacctaatgaaggcagtaacacacgttcacttaggatctggccatatggcaattcgctttaaacaatagtgttcaggaagaaatatattgtatgtataaaagtagggactgcttatttcttaggattcctcataaactgtgggctatagatcttaaaaggcagggatcgaggaaggataatgtcaaattctgccataacacaaacctctataagagatatctcagaattccagtctatccagtggcctacttatttcacacagttccaattttacagaagaatatagctactcttttggagtaaaagtaaaaatcttcgatttgcctttccaccagtccagtatccagaatgttatatattaataaattagtgaattctgttgcagagatagggagaaaggaagaggaactgctttagagtcagaatgataatttcaagaaaaactttgtcagaagacgttgctaaccattaaagagacgtacctgtggctgggcatggtggctttcgcctgtagtcctagctactggggaagctgaggtaggaggatcgcttgagcccaggagtttgaggttgcagtgagttatgattgcagcacggcactccagcctgggcagcagagtgaggaccctgtctcaaaaaaaaaaaaaaaaaaaaaagatatgtccatgtaaaaaacattctgcaactctttggaaactggaaaggatacataacagttgttcagagtttactttccaattggaacaagaatagttttgttaaattgactcaacaggtttggtatcatgccatctgcatacccactggtgatctgcagggccaactatgtaaggcaaagatgagttagttccctactaaggaggcagtatatttgccaaaatgcctcttttgagaaggtctgaagatacatgaaaagcaaactaaattataggtgggtgtcagtgcatattaacgtatctagatcagtatgtttctgacagtggattatagcttccgcaatatatgtttaagtaattcttcatttttaagagttgaagacccaaagtatctctttaaagttaatgtaatgttggagaaatagagggcagtgaatggacagatcttggaacaacggtaaatgagccaagtcttggtttgaattactgtgagtgagggtgaaaaatgcctttctgtcagcattatttcatggctcaaacatttgtctttaacagcaattgtaccagacgttaacagactatgatattcgattttacatgtatgagattctgaaggtaagtgaaccttgaatactaaatattttttaaattggtcttctttttgttaaatagtcaattgatggtagaaaagccagcagattaactttgtaaagtatgttgaaagaagggacctctatataagtttttaataagttaatagtatcatacctgtaatcccagcactttggaaggctgaggcaggaggattgcttgaggccaggagatcaaaagaccagcctgggtgacatagtgagatccccatctctacaaaaaaaaattgtttaattacctgggcatggtggtgtgcacctgtaagtcccagctacttgggaggccaaggcaggaggattgcttgaggccaggagatcaagaccagcctgagcaacatagtgagaccctgtctctacaaaaaatttaaaaattagctgggtatggtggcttatgcttgtaattccagctacttgggaggctgtgacaggaggatctcaggaatttgaggcagcagtgagctatgattgttgcacaggctggagtgcagtagcacagagtaagaccctgtctctaaatacataaataaataaaaattaataataatagtatcagaacccttgtgctaagggttatggaatggggtctagtgggagtataatttagaacaatttgaaaaagggtatttgtaagatagctgggactgaccccttaacaaatatttgtaatttctgtggcccctatgtaagttaatattaaattttcaaaactcgtgaaaacacctgacgtgctagcttctggtatactttatctcacttaagagtcagcaaataaaacagtaaactttaactcagttctcaaagggtaattgtcctaaggattgtgtaaatttctgcttatagatgctaattgaaaatttacttacatttctaaagtggggtcaccaaatatcttgttcccagtagccacaagatcagcttcctagaagagagaattgctaaaagttggctaagctttcttactaaacaagagttgacataaagcctgctgttggagccttagaaatcccctgaggagattgtgccagcagagatacttgatctttccattggctcatgcagtttgtggcaagcaaggctttagaaagttacagatatgattgcccagccctgggaactgtaggaacccaagttgcccttcaggaaggacaagaatttggccaacaacgtcggctgactgaaaggctgggattaacaaaccccaaagattatactactcagttccctttagtttgaggttggaaacatttcagattggatttgatgacctaaatcaggcattggcaaacttctttaaagggccaaatagtaaatattttaggctttgtgggccatgtagtgtttgtcacactattcaagtctgctgttgttgcacaagagcaaccataaacaatatgcaaacaaataggcatggctatgttgcaataaaacattatttacaaaagcagacatcaggccaaatttggcctgtggtctgccaacctctgttacagactcttaatggctaaagaattactgttcttagaataagaggtttgtagtaaagatctgttttctttctttgaggggtctgtggaaataatctaggatctggacaagacagaaaaatttgaagtggtgcaatttgggtatactttgggtcttttaggacagaaaacatgttgaaacaactgtgtcagaaaaagatctctaagctcagagagctgagtttgcttgactgtgagatcatgaacaagtctctgaagcattgctgtggaagtgactgtgtcctcagcttgaatcccaggggtattgtgaggctaaaaggaaaatttacatggagggaaaagtaaaggactcttacgtattattcaggctaactcctttctgacccgttcatcccacaggccctggattattgtcacagcatgggaattatgcacagagatgtcaagccccataatgtcatgattgatcatgagcacagaaaggtaaagtgataggctgacaagtgttatttatctacatgatgtagctaattgcccatcttcaacactttatcccttgtgttgtcacaggccctagtacctattcggcagttgagaaatatttggtgaatgaatgtacgaatttacaagtcaacatgtttgaaccattatttatattcctaagaatattcccaagaaggaaacatgagtaaagtgggcaaaatgttcatcttctaagcccggaaacgtggcttctcgccttatttattgagtaactggtttcctgagaaactactttctctccatttgccttctttttcttacgtgtacagtgtgggtaataatagccctgcaggcgactaggtattcgtgagaattaaatgtgcacagttaagtggacgagatatacagaaaatgctgtttctgtttattggatgtcataagggccctgttgtctgcaaatgcttttacatgagagctgtaatggcc

SEQ ID NO: 12566 - DNA, 1242 bp, Homo sapiens
catggtgcttcccgaagacccttggtgctgagttcctaagggacaaacaaactggggtcttgtcaggacttttttttttttttttttgcgatggagtctcgctctgtcgcccaggctggagtacagtggcacgatctcaactcactgcagcctccgcctcccgggttcaagcagttctcctgccccagcctcccaagtagctgggattacaggtgccagccaccacacctggctaattttttgtatttttagtagagacggggttttgccatgttggccaggctggtctcgaactcctggcctcaggtgatccgcctgcctcggcctcccaaaagtgctgggattacaggcataagccaccatacccggccgtcaagacctcttctaagtacacttagcagcttacacagctgcattcacattcgactgcaccttgagatggcaagtaaaatcattttgtccccatttcatagatgaagaaactgaggttcagggaggtgaacagtcccagcattcttctgggaccctaggtctccagctgacctccagacttggggtgggagggggcggctctccctgtccctgagcacttacagagtaaaagagaggaaggccagttttctaattcaaccttaatattgcaccccctcccctatctgcccttctcagccactcctgccagagtttgtctgagaagcccaagccccaggctctgctgggactgtggcctcagccctcaaaatagccctgcctgtgagtgaacatgctgtccctgggctgcaagagcctcgagggaggctgggctcgcatctggatggatctgccccaacctggacctgggggtggagggggcaggggacagagctcccagatggtcagctgtttctctaagtgggctgagaaagctgcctgttcctccatcatctagccaggctcagggtgatgagcatttacagtgggatttcagacactatcatgtcctggaaacaggacagattgttggacaacatagatttctagcccagctcttttacaactggctgggtgcctctgggccagtcattcagtggctggaggcctcaaaagagggggtgctttaacatctgtgacctctctggcttacggtgaggatgaaacccatgtgtccagtctgaaaatatcaatgagaagagctggtagagacagcccctgtaaggactgatggtttcagggactgccgccattagcccatcttccaatggc

SEQ ID NO: 12567 - DNA, 2742 bp, Homo sapiens
gctcagcacaagtggacaaagtctgctttacaaactctcaagccttgtaccatgtccattgactctgtgcctcttctccccaggaggacccagacagcgtgccccccatcgatgtcctctggatcaaaggggcccagggaggtgactacttctactcctttgggggctgccaccgctacgcggcctaccagcaactgcagcgagagaccatccccgccaagcttgtccagtccactctctcagacctaagggtgtacctgggagcatccacaccagacttgcagtagcagcctccttggcacctgctgccaccttcaagagcccagaagacacacctggcctccagcaggctgggccatgcagaagggatagcaggggtgcattctctttgcacctggcgagagggtctgactctgggcacccctctcaccagctacaaggccttggactcactgtacagtgtgggagccccagttcccacctctgtgacaataggatcatggccttacccttgaagcattaccgagaaggagaacagagatgggcttgaagagccacgtgctgccggctccaaattcccaaggacaaggatccctctgcatttttgtctatgtaacctcttatatggactacattcagctgcaaggaaaggaaaaccttgattgcagtggtttaaacaaacagaagattgtttttccacatagcatggattctggagatgggtggctaatggtattggttcaacaactccacgaaggtaggggtcacgtcttggatccttttgccttaatctcagtgctcgttacttcatggtcccaagatggctgctgtatccccaagaatcatgtctgcgttcaaggaaggaggggtggaggaagaggaagggccaaactagctggacccgtcaccttctatcagaaagtaaaacctcgtcagaagtctgtttcctgctctctccctctgcatatcttcacttagatgcccttggcccgagccagctaccattgcacctctagctgcaaacaaagctaagacagcagggaacagaattgtcatggctgaatagaccaatcgtgttccatctactgagactggcacactgcctcctgcaataaaactgggatcccattaccaagagagaaatgcagaattgtgtaccagttagcttttgctgtgtaacaaaccatccccaaacttggcagctagaaacaaaccctgtattttcccacaatcctatgggttggcaatttgggctgggctcaacagggcagttctgctgctcacacctgggatccctcatggagctaaggtcagctgttacctcagctgggcctggatggtctaggatagccttactcacttgcctggcaggtgacaggctgttggctggaattgcttggttctcctccatgtggcctctccagcaggctagctcaggcttattcacatgatggcttcaggattccaaagagagtgagagtagaagctgaaagacttcttgagttcttggcctggaactgggactaggacagtgtcacttctgctaagttcttttggtcagagcaaatcacaaggctttacccagattcaagggatgagaaacagactacatgtcttgatgaggggaaccacaaagagcttgtggccatttttcacctatcacaaataattttggatgggtatttatttggataaaggtatttccctcttccccctttctctctgtctcatggggcctcactctgccaagttggaaggcactaagacattgtcctggccctcagggtctaggggaagaggtgttggggcaggaagtgagtctctccatgggctggacccactgtagtaggagtgcctccttgtctgcactgctggtatggggttaggccaggtaggacattccagaggggcttctgaaaaccaagagtccctggggaaagggaacagagtaaggcaggccttgttctcactgccctctaagggaacttggtcactcggcacttttaagcctcagtttctccagttcaataataaggacaagagcttttcccatgcattctctttccccgggaaagttgactgaggtgaccagtaatagaattgaaaagggagagtgtcttcagtgcaatgtggcatcctggattgggtcttggaacaaaaacaggacattagtgggaaaattggaaatctgaaaaaagtctgaattttagttaatataccaatttcagtctcttggttttgacagatgtaccatggtgatgtaagatgttgaccttggggtaggctgggtgaagggtatacaggaactctttgtactatctctgcaacttctctgtaaatctagtatcattccaaaataaaagtttatttaatttaaaaaaaaaaagggggggtgtgcaattcctttagaccaatggttcagggtctcaagcttgtttgctaaataccagattgctgggccccacccccactttcttttttttttgagacagggtcatgccctgtcacccaggctggagtgcagtggcacgatcatgactcactgcagccttgacctcccggggcttaagtgatcctcccacgtcaacctcctgagtagctgggactacaggtgcgcccttctcatttttttgtagagacagggttttgctgtgttctctgggctggtcctaaactcctgggcacaagcgattctcccgcctcagcttcccaaagtgctgggattacagacatggccactgc

SEQ ID NO: 12568 - DNA, 1150 bp, Homo sapiens
cacacctggcatattttttgtattttcagtagagacgaggtctcaccatgttgcccaggctggtctcgaactcctgagttcaggcaatctgcccaccttggcctctcaaagcgctaagatcataagagttagccactgcgcccggcccctgggacttctttttagaggtttcgtttgcttgccaccaccatgcttcccatccctgttaacttactgtgaataggtaatacagtcacgtgtttcaaaaaatcagaaaatataaggtgtacagagaaaggttttcatccctttcctctccctcatctgcccagtttctcttaacacacacacacacacacacacacacacacacacgagcacttttatcagtcgctgtttacccttccagagattatacaaatggcaaatacagccttctcagacctctttttttacagaaaaagtagtaaactgttgtgcaccttgcacttttcattcaacaacgaaaacaggctccttgtttttttgccatgactgtgcagtattctcttttgtggagatgccacatttatttaaccaaccctctgtagaaagacatttgaagatgctggagacaaaattaaagatctaatccagaaaacctttccacaaaagtagaagagaaaacagttttattattaaataagcgttaaaccagactgcagtgggcatcacaggcaatccacaaaagagattacaaagagaaatacatttcgtcctcctatataaccaagcaggtataacctattgcatacatgtcctcaaataataactagggccggggtggtggctcatgcttgtaatcccaactctttgggaggccaaggtgggcagatcacttaaagtcagaagttcgagaccagcttggccaacatggcaaaaccccatctctactaaaaatacaaaaattagccaggtgtggtagtgcacgcctgtaatcccagctcgggaagctgaggcaggagaattgtttgaacctgagaggcagaggttgcagcgagctgagatcgtaccactgtactccagactggacaacagagcgagactctgtctcaaaaaaaaaaaaatagttctcgagtcagatgactgcacaacacaatttgcaacttatttcatcccgaattcacctggt

SEQ ID NO: 12569 - DNA, 1677 bp, Homo sapiens
gactgctcagctgttggggaagggatttggcgtggcagatggcatcgtggctgtcgccactgcacacaaagaacactgagttgctggaaactcacagattttctgtccccaacagatctgccatggagggatctggtgcctccagacatgtgcacatgaatccatatggagcttttcctgatgttccactccactttgtatagacatctgccctgactgaatgtgttctgtcactcagctttgcttccgacacctctgtttcctcttcccctttctcctcgtatgtgtgtttacctaaactatatgccataaacctcaagttattcattttattttgttttcattttggggtgaagattcagtttcagtcttttggatataggtttccaattaagtacatggtcaagtattaacagcacaagtggtaggttaacattagaataggaattggtgttggggggggggtttgcaagaatattttattttaattttttggatgaaatttttatctattatatattaaacattcttgctgctgcgctgcaaagccatagcagatttgaggcgctgttgaggactgaattactctccaagttgagagatgtctttgggttaaattaaaagccctacctaaaactgaggtggggatggggagagcctttgcctccaccattcccacccaccctccccttaaaccctctgcctttgaaagtagatcatgttcactgcaatgctggacactacaggtatctgtccctgggccagcagggacctctgaagccttctttgtggccttttttttttttcatcctgtggtttttctaatggactttcaggaattttgtaatctcataactttccaagctccaccacttcctaaatcttaagaactttaattgacagtttcaattgaaggtgctgtttgtagacttaacacccagtgaaagcccagccatcatgacaaatccttgaatgttctcttaagaaaatgatgctggtcatcgcagcttcagcatctcctgttttttgatgcttggctccctctgctgatctcagtttcctggcttttcctccctcagccccttctcacccctttgctgtcctgtgtagtgatttggtgagaaatcgttgctgcacccttcccccagcaccatttatgagtctcaagttttattattgcaataaaagtgctttatgccggcttttctcagctctgtgtcatggtggttattttcaggtgcctcccctgccatttggtgcagggggatggggttgggcagggtgaaggagggtggcagtggggatgcagtttcaagattgtgtcttggcagaagaatgcagcagtgaacatccttcctcactggctattaacgggttgggggtcagaggagggggaatgtggggtaggtttgcatcaaaggagctgcctgaaagggcaagctgggatagtcagggaacatcccctcccctgttaccaaatgtttattaaatatgtgttctgggtagagcactatgctcggggttcttgggttacagaaaagtgggagatacaacacatttttgagaagtgagtcacagtccacttggagatgtgctacaagcaactgcaagcaaattaatgagatacgaagagaagactctgattttaaattggtattcctcagtaacatttaatgt

SEQ ID NO: 12570 - DNA, 1071 bp, Homo sapiens
tcccatccagagcccacgttcagccaccatggagtgcagtatacactccatccctaactgccaggcccatatacatacacttgacctccccctacctccttctcacagtgtctgcttaattaattagtatattgcagaagagattgtaaaaacacccacttaaaacctgtatcatctacggtagtttgcacagggcccccagcacctctgggaagtaagcgaggcaggtgatctaactcttacctatattgttgatgcagccaccacagttgagagacagtccctctgaccttggaccagggatcacactggtctggttccaggctggggaaggatgttcccagccctagttttctgttttgggcagtccagatggaaaggcccatccacccagataggttttcacaggtttagaagaaaaaggatactcagccactggttccggggcttctgaattcagttctcaactggggcattttggatctccccaaaaactggttggtaagagaacctcctggcattaaatgggccaggacaaggatgcatgtcagttcattggatatgccttgatagatacccaaaactcatcaaaatgaaaaataggcaaagtaattgtcatgatgccctttctaaaagtgcagttttaactagtctttgctgtgggatgtgggttgtttgatcttgttaacaatcatgcccagcaaccctgtaggtagagtcttgcacagatccggctgcttcctcagtagaaggccagggaagaagcaggcatgtggtcaagagctaggcatggctttaatggcgttccaaagtgtcttccagaggggcagcggcccttttcatacccatccataggacaaagcatgcccttccctgccaggagcttaaagatgacttagagctcattcaggggaagcagctggtacagaaataagggttccctgctgctccctgtctcctaactcccagcatttcagagagaactgccaactcctgattcccaggcccaaataaaaggccttccttctttaaatgggcgttgggctcctgtgttgagggtgtgtggctggg

SEQ ID NO: 12571 - DNA, 1211 bp, Homo sapiens
ttgtgagcggaggcctagcctgttcaaggtctgaatttttacccctagaatgtaagaagcatgggagcagggactttgttttgctccctgccatatccacagccctagaaaaacgtcgggccattgatagctctcagtaaatgcttgacaagtaagtgaatgaacgaatgcacaattaatgaaatgagggctgcgtcaatgaataactgggaatctgactcctgcagggagccttcagcccacaggtgtatgtaagacccgccccgcctctcatccttcgggctcccacccccgccgttaggctgcggttcgcgccgcggtcgccagagggcgcggagcggcggggcttcccgcacggagggctttgcgtgaggcaccgcgtggggcggggctgcgggcgggctcccagctgctgggccctcatcggctgggcctcgtcgaccggcaagcggaacgcggcagcggggctgggcctgtgcggcggccgccggagcgctttggaaggcgcacggggcgaagatggcggcggagcgacaggaggcgctgagggagttcgtggcggtgacgggcgccgaggaggaccgggcccgcttctttctcgagtcggccggctgggacttgcaggtagcgccgcgcggcgggctgtgtcgggtgggccggggactgctgggagcgggcgcctggtgccttaagcccgcggcggccgaagcgcacagtcatccccgctctaccgcggcccgacccaggcctcatggtcccgggaccgcttgtcacgcgtcgcctgctcggcttgggagtgggggaacgcgggccagccccagccagttctgccgtgccagtttcaccctgcctcgcccgcttgcggcgtcagcgagacttcgggcgctgcggcagccggcgaggagagggagcgcctgggggcgtggctgccgcgccgagtatctgctggaggccgggctggtccgagtgagcagctcttgggtgaagccccactcgggactaggtggccgctcatttccacttccgaagtccagcccgggagttgaccgccgcccagccttcctaattgctgggagaatacctctggggtggtggcgcaaggttggagcttcttcaccttgcgtagttaacttatctgtaaaatgggagtctcgtggaaattgctgtgtagttcattggcacgtactgagtattcactaaatacttgctaa

SEQ ID NO: 12572 - DNA, 1966 bp, Homo sapiens
gaaatgtgaaacgtgcaatcttgaaactgaggtgttagaaaacttgatctgtggtgttttgttttgttttttttcttaaaacaacagcaacgtgatcttggctgtctgtcatgtgttgaagtccatggttgggtcttgtgaagtctgaggtttaacagtttgttgtcctggagggattttcttacagcgaagacttgagttcctccaagtcccagaaccccaagaatgggcaagaaggatcaggtcagccactccctggagacacagccttctggctgggactgacttggccatgttctcagctgagccacgcggctggtagtgcagccttctgtgaccccgctgtggtaagtccagcctgcccagggctgctgagggctgcctcttgacagtgcagtcttatcgagacccaatgcctcagtctgctcatccgtaaagtggggatagtgaagatgacacccctccccaccacctctcataagcactttaggaacacacagagggtagggatagtggccctggccgtctatcctacccctttagtgaccgcccccatcccggctttctgagctgatccttgaagaagaaatcttccatttctgctctcaaaccctactgggatcaaactggaataaattgaagacagccagggggatggtgcagctgtgaagctcgggctgattccccctctgtcccagaaggttggccagagggtgtgacccagttaccctttaacccccacccttccagtcgggtgtgagggcctgaccgggcccagggcaagcagatgtcgcaagccctatttattcagtcttcactataactcttagagttgagacgctaatgttcatgactcctggccttgggatgcccaagggatttctggctcaggctgtaaaagtagctgagccatcctgcccattcctggaggtcctacaggtgaaactgcaggagctcagcatagacccagctctctgggggatggtcacctggtgatttcaatgatggcatccaggaattagctgagccaacagaccatgtggacagctttggccagagctcccgtgtggcatctgggagccacagtgacccagccacctggctcaggctagttccaaattccaaaagattggcttgtaaaccttcgtctccctctcttttacccagagacagcacatacgtgtgcacacgcatgcacacacacattcagtattttaaaagaatgttttcttggtgccattttcattttattttattttttaattcttggagggggaaataagggaataaggccaaggaagatgtatagctttagctttagcctggcaacctggagaatccacataccttgtgtattgaaccccaggaaaaggaagaggtcgaaccaaccctgcggaaggagcatggtttcaggagtttattttaagactgctgggaaggaaacaggccccattttgtatatagttgcaacttaaactttttggcttgcaaaatatttttgtaataaagatttctgggtaataatgagtccttccggtgttcagtattcttgtctttgtgagtgcgtcccggggccgcctcggggcctgcctgccctcctgccaaagcctggaagaggattgaatggaccccagggtttggaaacaacctacagcatttgagcccctcacgtaggttttagagacgtacaatttttgtttgccctggctcagaaggagccggtgtaaggttgagataaaattccatatagacaactgagtttggatctcggctctgctgctttgtagctgtgggagttcaaacagcacctctttgagacttgggccccgcgtcggcacaatggggcaggaatagtccctgccagggtgactgtgtggattcaaggaggttggaagcactgagcccacgcttggcactgggtaggccatcactgaggcttgtgtctttccttcctgccctgaccctg

SEQ ID NO: 12573 - DNA, 1612 bp, Homo sapiens
ttctacaagtcaggaaaaaagagagggaaggtcatttgctcagcatggagtaacaatgatattagaagcaacagacccgtgacagccttcttgcatgctttcccttgtcccatctgcccagcagctttgggaggtgtgggtggtatggcactccctgtttggagacagtataatgaaacaaaaaggcttcgcagtcaaccagacggcagtaaacccgagtttccacctgggcctcattccaaacccaggtacctgacaccagtccctggtgcctgtgtcataccttagaaaggcactcagtgccagttgtgcaggtccccttggagcagttgtttgtcaccaatgtcactcttgaatacactgcatcctttagttaaaaagaagtgtgactgtgtccatctcactcaagctccttcctgtcttctttgatttaggagaaaggatcctgggttatgctgaggagccctgctatctctggtttgtcatggagttctgtgaaggtggagacctgaatcagtatgtcctgtcccggaggccagacccagccaccaacaaaagtttcatgctacagctgacgagcgccattgccttcctgcacaaaaaccatattgtgcacagggacctgaagccagacaacatcctcatcacagagcggtctggcacccccatcctcaaagtggccgactttggactaagcaaggtctgtgctgggctggcaccccgaggcaaagagggcaatcaagacaacaaaaatgtgaatgtgaataagtactggctgtcctcagcctgcggttcggacttctacatggctcctgaagtctgggagggacactacacagccaaggcggacatctttgccctgggcattatcatctgggcaatgatagaaagaatcacttttattgactctgagaccaagaaggagctcctggggacctacattaaacaggggactgagatcgtccctgttggtgaggcgctgctagaaaacccaaagatggagttgcacatcccccaaaaacgcaggacttccatgtctgaggggatcaagcagctcttgaaagatatgttagctgctaacccacaggaccggcctgatgcctttgaacttgaaaccagaatggaccaggtcacatgtgctgcttaaaattcagggctaagcattttgggtgattttaaactaggtgagtgctctctgttgttgttttttgttttttgttttgagacagggtctcactctgttggtcaggctggggtgcagcgggtgcagtggcaggatctcagctcactgcaacctccacctcccgagttcaagtgattctcgtgcctcagccacctgggtagctgggattacaggcacctgccatcatgcccggctaatttttgtatttttagtagagacggagtttcaccatgttggctaggctggtctcaaacttctgacctcaagcgatctgctggtctcagcctcccaaagtgctgggattacagttgtgagccaccatgcccagcctctcttttttttctgtatgcccacttcttggaccgggttcttcattctggaccctggcatgggccctgtgaacttgcaggggaatacaaagttgaagaa

SEQ ID NO: 12574 - DNA, 1058 bp, Homo sapiens
ctgggtcttcagcaggcatctgtcactgccgtgaggtcagcgcttctcacctaactgcctcctggattgtcatcttcccagatgtgtcccatagtgtccaggtgtcacagagacggcctgaggccctaagatctggttgtgactttgccatgataacagggtgtcctgaactggctgccgttgtcgtgttctcacagtgaagggcgtgccctgtgtgccggggtccatggtgtcatatgcagtgacacacactgtcaagcgccatttccctcacccctggagacttactgttaggtgcctgccctcagtatagacgtatccaatgggaaaacagcggacctgcccagagcagggaggtgtcgtggaactgggtagaccccctgcagcgttaggggcccatttgtgggctcgccaccttcaggcttccccagccatgacacttcagccccgccacccatgcctgtctgctgcagccatccttgcactctccagcgacactctcgcacctccctaggggaagcttccctccccctgggctgctgctctgagcccatctgttctccccctgcaagaaggggcaatgctcttgtgttgtccctctgtctggacgcgcctggccactccgaaggcttttcaccccattatggccaaatagtatagggccactggggagggggaagggaatcattttgtgttcatttttgttttctgtttcacctaaaccagcataggattgataggggagacggttggcgggcatttccgtttctatgtgaccaaggcagcaggggcttttacctgctaagcggcaatcctttggccctgagaatttgggagagaacagtgcatcaggccaggctcagcaatatgtttgctcacattctttcagccttctgtcacccccctcaacaccaaactttcttccttgtgagcagaaggttggctgctgttagcaggatcccacagtgataaccaggcccttcccttcctaagccaaaacccattgtgactgcctgtctctcctgtctctgacttctcaggcagcctcctgagtgcac

SEQ ID NO: 12575 - DNA, 2447 bp, Homo sapiens
gcataaatgcaggccagcgttttagccccaagtgcctgcccttgcttcttacccctcccctgctttctcaaacacttgcccacctcaggcactcagcgggctccgccgtggtgagagaactggccgtggctcagccccgggtagcacctgtagtttcagtgccactctccactgtccccttgtggaccagcttccactcactgtcacgtcccccctcctgcgtcttcactgggtctcaggctgccagcagctctctggtgcatcgtctcaacaccaccaagtttgtaggacctgcccaagttctagtagtattcaaaacttcaaacggcagtcatttgttctcctcggctctgtggcaaggatagccctttggagggggactcttgacctcggctgttagggatctgaacttggttttcccgtcagaagaatcagcaggacagatcgtagtgccttattccattgtcctcccctggccaggcctcctggctcagctggaagtgcatggcttctttctccctatctgtgtcctctgtcacttgctctttcactctctctctcattcccagagagccacgggggagggatcaccctcacccccaacaccctcttcctgagggctgtagccaggtccgcatctccccaccaccaccagggcactcactcgcagctatagcccaggacagaaaaactgtgctttggacaggtgcacactctctgcctcttacctctagccaggaggatgcctcagtctgttcattcgagactggccccgtctgaaccttctctgggcactggggactaaggttgcaggccttagcctcgtctcgtcccagaggcattggatcaggagaatgggaatttttttcctcccacctggacatagtttgcccctgtggctgcctttctgagggagtatactaaatgtttacttaagaaacaccctgtttacagccagaggagaaacacccaacactgagtggagatttgactctggacagggcctggcctccttagtggcactgccggggggccccagagcgaatgagggcagagatgcccggggcaggggcaaacgccctccgctccctctgctcccaaccctgtggtgctaggaccactccccgccttccctacggcctcctcgccctgcacattccccacctccacattcccctcctccaagatctcagctccttaacatatcagttgtctcctagcctagaaaaccagtgtttggagcaataagatgattatttttgcttgaatctttttctaagagaaggaaaagagctggcattgtgggaattttctttttatgctgttagctgtttaccttcttagaagacatcctaataggatggatgtctgggttttagccttggggtatcttttggaaacttagaaaagcaggagtcaggctgccaccccctaaggagggaccctaacgttctgcccttgcctggttccatatggctccttccagccctgcccaccaagtgcagctcccactttccatcctgcccatacgcccctcttcccccgacatctgggggcgctggtggcacttactctaggttggtctcagactatccctccccttggctggttttccctcctaggcctgtctggcagcccccagacagacgtagctcctgggagtctcggccctggcaaccttggaagagccaagctgacattgtttagctcttcaggccactgggttttggaggcagaagtccagagatactggctctgccaagctgtcgtactgggctgtggcacagccttcgagacaacacgggtgtatctctgatcctgccctacctaggcttcaaggggcttctgtctggagaaatgccctcaaagggtaaccagtaggtgtggcattgaattggccagtgttagcatctacagccatcaccgagatgagtccactgccgttgcctgcccgagggccccctaaggttatagacggtatcagcagggaggccgtcccgctggttttctaggagagcccacaggaggaagggagcctcttcaggggcactggaatcttttgtgccaggggcttcttttcatcagagccggggagtacattgcagtgacttcttaaacatttgtgtgggacagacgagcgtgagggaggttttaagccaggcacaaagttagtttccaatactagttaataaatctatttttcttcatttcctttttttgcacagaagctggtaatctaggacctacgtgtgaacaactttatatgaatattttttgtacttggtttacttgggttggtatgatacattatatttaagttccttgaacactgtggatcccctaatgtgtatgaatgactgaggctttgtaaattaagggacgtttgtgtgaataaagttatttgatggggtcaaagaagccatatgtgatttgaaaaagagtgtttt

SEQ ID NO: 12576 - DNA, 1215 bp, Homo sapiens
ggcagcggcctcaggacacaatgaaataatgcattctgaggatccctaacagaagttatgagattgtcttatgctctttggtttgacagtgcctagtaattaagagggggctctgggctttgctgtactattatggatttctctttaacttcagttggagaaattctgagatcagtccccacatggatgagaaaataggcccccagggagtttggactccaagcccagtgttctttccctataagataacccatgggcaaacttggtgacccctgtttctctagtctggattattcctctatgggtttttatagacataggaacccagtcagcctcagagtagtccctagttagcacatatgccatgtatacccctctcctcactcgattactgcagggcgtgggaggctggggcagggttggggattcaagttgcagatcaggcactgactaaacttcttactcttacttcaggccttctttgacccttggccacagagtatggaagtagctccgcagaggcgtgggctcgattcctcagggccacgttaccacagacctgtttgtttcttatgctgttgttcgtggagtctcatgggattgtctggtttcccttacagggccccctcccccgggaatgcgcccaccaaggccctagactcatcttggccctcctcagctccctgcctgtttcccgtaaggctgtacatagtccttttatctccttgtggcctatgaaactggtttataataaactcttaagagaacattataattgcacctatggatctttatttttagaaaaatctttgatatattgggtgcttaatagagtcaagaagggttgccttggaaaaaattaaccctgatcttaccttcttccctataaaatgttttactacccatttgcatctgtacatcctcatacactaagatacttacaaaattgaacattttcacttatcagattcaaagatcagttttgttgaaatcagtacccataatatcctcttgggaaggcacttgtctagatagcttctccatgaagcaaatgctaaaaatgaaaattctgctgggagaggaacaattttggcataactttctgccagggtcacacacgtaacatataacctaacgtaacttttgaattgtggtatcttcatgagttcttccacccaaagcctgtgttcactgagcagcactctagtacttagt

SEQ ID NO: 12577 - DNA, 3035 bp, Homo sapiens
atttctgtgtatgtgaaatttctcttaaccttttccttctatggcttctcctatttctgatgtaagatgaggggcagaattataggcctgtgaggttgaattgatattagaaggacactgcacgtaagtgaggtgggtgggagtcatttgattggaattgtttaggcagcctcctgatgttggcaagaccttaagctgaagggagggaatagggtcctaagaaagaagacttggctgagggaagggccttcacggttgctgtggaatagcatttgggcccgggctgggctttgttgaccttgtcctatctcttggtcagtgtgtcctcttggcatggtaggaaacaggtagatagccacctaagaggttatgtgttcagcctgtagagactatccaggagggctatcttgggaaagtttgtgtactgtttgttaggagatgcagtataagcaaatcttggaggccactaggcaggtgaactttacccacctctaacactttttttgttccttctaaacctctctttaggccaaagaactccaaacaagcagaaagggaagagaagcgagtcctcggtctggtgctgctgcgaggggagaatctggtctcaatgacagtagagggacctcctcccaaagatgtaagtcagagcaggaagccttgtggaggaggggaggccctactgtgagccaggctctgtgttagattctgtttcattgcagttctcacaggcatcctctggattttgccccctttttcagataataaatgaaatcttaaagaggttaccctgcaagaggccgggcgcggtggctcacatctgtaatcccagctctcagggaggcaagaggcgggaggatagcttgagcccaggagttcgagacctgcctgggcaatatagcgagaccccattctccagaaaaaggaagaaaaaaaaaaagacaaaaaaaaaaaaaagaggttaccctgcaagaaagaagtggaaaaggggaactagaatttgggtatctcagactttaaagctctacctgtttctcagttgatgtacatagtgagtcagtggaggaagcacctgaagccatctgggtcagttcttaatgtgacgacaaagcctaggtagaccttaaaaagttgtaactccgaaacaataggaaatgtgtgtattttgttttgtacagttacagttcatagttactgagaatctaccttgcgccaaccacttcagtattttatttgatcctttaggtctctttagagataaattctcatcttataaatagaataaaccagggcttagtaacttgcccaaggtgccacagccactaagtggtgaaactgacatttgatctcagacagtcttgattctgtaaacaccaagctacacatagaaatagagcaggctttagagacctagtcaaatttgttttccctttccctttttcatttgaagggttttttttttttttttttttagatttttagatggagtctcgctctgtcgccaggctggagtgcagtggcacgatcttggcttattgcaacctctgcctcccgggttcaagtgattctcctgcctcagcctcccgagtagcggggattacagatgtgagccaccacgccctgccaagacgttattttaatcaaaagagaataatccttttaactttttaaaaatccacatatattatctggatttttttgtacttaacacatagtgggcatatattatgttgttctgtgttttcacttaatgttaacatttttctagttgctcaacacttttaaagtcaagttaatgactgagattttctcaaatgagtacagagtagtttatcctaatcattttcttttttggagatttttacgtttttgccttttccagttaaaaatgtctgcaagggatgttagcatatcttggttcaaagtccatgtacatattcaaatctcttagtacctacttccagtagaattggctggtctaacataacccatcataaacctttgtgatcacaaccagttgtaccataaccatgtcatttgcagataaggcaactcagcccgggattgtgggattatttgtccattgtcacctagcggattagaatcagctgggaatggatctcatgtccctttaatgccttgcctgctgaaccctgagtggaaccctggccctttgctcttggtttaactttcacaggagtgcatataggtggttgagttgtggcatgtttctctagacttactcttaagttctaccctgcttcagggataactcatagtcttggatggaggaagaatggtgttggcacacatggagaggtagtatttataagctatttcgatagtatttataagctatttcgaggggctctcttggcaatgatattccaaagtatacttctgatcttcagatcactgggcatcagagcatatttgtttatttttcagactggtattgctcgagttccacttgctggagctgccgggggcccagggatcggcagggctgctggcagaggaatcccagctggggttcccatgccccaggctcctgcaggacttgctgggccagtccgtggggttggcgggccatcccaacaggtgaggagttggggaaagggtaccacctcctggtggctaaaataaaggataaaggggagggtccatagttttaaaagggtccagagtgaccaacctgtgattgtcagactatcagtgtttcactgtggtttatacatggccctagaagcaagtgaaaaggataagttgccattgtaaattatgttgatgctattaaagagatgtacgaattagccaactgtatttaaggaaaatatttccatgacagcatttgaaatcatgagtcatatttgaaaatgcagttgccttctctcacttggattggacatgcttacattcaggtctagaagatgggagttgggcattcaagcttgatctttcccgacatgtggttttggatgggaagtctggtgctgagagttgtagcattaagggatttggtgtctgttatttcc

SEQ ID NO: 12578 - DNA, 1203 bp, Homo sapiens
tataatatgagaaagaccgatttcaagggaagagagaatagcagattactgggtagaggtcagggctaaaacagggtggcatgggagaattcctaggaaaaggctgtgggtgggagactgagctaagaatctgttgagaaagttggacacatggacaagaacgccatgggaagttttggggagggccagaggtgcttgggtccaaaagagcagagtctcatccctgtccatttctccttgcagacggtgggcaagagcagcaagatgctgcagcatattgattacaggatgaggtgcatcctgcaggacggccggatcttcattggcaccttcaaggcttttgacaagcacatgaatttgatcctctgtgactgtgatgagttcagaaagatcaagtgaggagtggactgtggggggcggagactggaggatgggaatggattgagtgggtgggccaagcaatagaggtggtgatgtagctagttggttcttctctgtttattctccagttttagagggcagacttaaatggggacattgaacgctaagaaatctttttgagtccagcaaaccttgctctctagtctagcaaagtacaagttgtgaagggctgctaggctttttgtttctctcactttgcgtgcccctgggtactggggtaaagggctctcatgttctccccacaggtgtgtgaggggggagagcttgagtttctggcctcattgcctatttgtaaagctgtagcctaaagggctctcccaatgcagcctggtctgaaactgctttaagaagcctctgaccctcttcagggtaagtgctcagctccccatgtgggtttggggccagtgatttttgttggcatttatacaaacaattggagatattgtctactttgctacaattccgtaagttattggctaactcccttgccttgagtctcacagatcttaagcttttggcccattaaaagatatgatttagcttcccatcatgttttacattcaaggctacttgaggcacaaaaagatgatgtgacttccgtggccagcagctcttttgtcatatgcagtgtccatattattctgtcactcactttgaattccctttgattctccttggggctgatttcttctgtgacccaaggtcaagaagtatagtttaaaaatgtggtagggatgccttggtgccaggtacgtattagag

SEQ ID NO: 12579 - DNA, 2453 bp, Homo sapiens
agatccttggggctgaaaaggccctgttcaggtaccagtgagggcacctgcccacaatcaggtgccacttctggtgcccactgcttgttgggggatcacggtgatggctgaccagggctccctgacctatacaggcctctgctatgggggtgatggccagtcctggtgtctgagtgattcccagggcccagcaaagggaccaagtttccaggtcagcgacattggatgccttccctctgcctctgggagctatgggttggcatgcattggggtagagatccaatctggcctgaggctcactcaggacttcggggtgagaggaggggaggagctgagctgccttggctaatggggttgaaatttctgatcttaaactctccactgaatattctctcagagccctgaagacaaggggtaacactccaaaatatggactcattttccactccaccttcattggccgagcagctgccaagaacaaaggccgcatctcccgatacctggcaaacaaatgcagtattgcctcacgaatcgattgcttctctggtatgggtgggggggcgttggcaggtgtgagaaggggctgggtggctgggtggggaggcttgcaaccatagcttccacaatgatggcaatatttttcgtcaacagcagttcacctagtgagtgttgagactctgggtctgagtgaagctgagggtagagggaacacagggttggggtagtttctctctttgggctgacaggctttgtcacccacacacatccagaggtgcccacgagtgtattcggggagaagcttcgagaacaagttgaagagcgactgtccttctatgagactggagagataccacgaaagaatctggatgtcatgaaggaagcaatggttcaggtcagttgggctttgctgggtgtggagtggcatagctagctgttggaggtgatgaactgtctgagcctgaccttgtagaatggaggcaaaaaaactgatttaatgagcctgatccaataaagccagaaaggagtcctcagagcaccagaagtcttcaggcccttttagcacttttctttgaccaggcagaggaagcggctgctgagattactaggaagctggagaaacaggagaagaaacgcttaaagaaggaaaagaaacggctggctgcacttgccctcgcgtcttcagaaaacagcagtagtactccagaggagtgtgaggtcagtaggcagcacggccctggcagagatcctaggttgtaggattttcaacagcagaacaaaggatatgctgcatcaagctgtggtcttgagtccaggcttttggactgaaacaaggacctgaaacatctaaaactacctcttgattctataggaaggagataggtgctgaacttgctcaagagcccagagagctggttgtagctcacacccgttccctgggcatgtgtgttctgtcctcggctgcctcccaggagtcctcaacctggggtagtgtaaattcctgctctgcttattatcagacgtgtgtccggaggtggtcgtgtttcacagtggggatgggggcagggaggtccccaatgtgctaagctacaatcattctccctgagattttcatttagcacccagtttcttaaacagtgtttcagggccctgtctggaacttggcatgatggttctgttgcgaccagcatggtgggtgttttttaggtttttttttttaatgggctgaggtaatttctcatgacatgttttccttctaatttgggacagcctttggggtggatttctaaagttatacccacacaattaaactatcccagaaacactgggcaatgttaacgacacgcgttcccctgccttggctacttaattgctgaagatgtaatgagcactgttctcacagcctgttcccctgtccttccctttaggagatgagtgaaaaacccaaaaagaagaaaaagcaaaagccccaggaggttcctcaggagaatggaatggaagacccatctatctctttctccaaacccaagaaaaagaaatctttttccaaggaggagttgatgagtagcgatcttgaagagaccgctggcagcaccagtattcccaagaggaagaagtctacacccaaggaggaaacagttaatgaccctgaggaggcaggccacagaagtggctccaagaaaaagaggaaattctccaaagaggagccggtcagcagtgggcctgaagaggcggttggcaagagcagctccaagaagaagaaaaagttccataaagcatcccaggaagattagaatgcaaatggacattctctgggaggtggggcataccatagcccaaggtgacatttcccaccctgtgccgtgttccccaataaaaacaaattcacaagagttggttcatgttctttattgaacaccttacatgggtatggacagggcctatgggtggggcaa

SEQ ID NO: 12580 - DNA, 2453 bp, Homo sapiens; identical to SEQ ID NO: 12579

SEQ ID NO: 12581 - DNA, 2453 bp, Homo sapiens; identical to SEQ ID NO: 12579

SEQ ID NO: 12582 - DNA, 2453 bp, Homo sapiens; identical to SEQ ID NO: 12579

SEQ ID NO: 12583 - DNA, 1175 bp, Homo sapiens
ggacaaggaatagacgccagcttaggcttcccaggggggtgtggcttgttgtcaagagggtggcacacggcaggcaccattgggagccagctgctttgggacatgcccacatcctccccagataatgccaccacagggtgggtgctgcttcacggtacagcttcctcctggcgtgccccttctggcccggggcctctggtccacatcacttcttgccttctcgtggttctgacttccgcatctcatggacctctttttacagcaggctacaatgtggagtcctggccagctctaggattggcttcccccgagtcatgtggccaaactggtctaatgaactgtgtccaatccagagagcaaggctgcctagggctgcccattggcaggggctgtgggccggggtctgtgtttgatgcacagtgcaagtctctagctgagcccactagggtggggagacagtaagcttggaggcctgagctccttccctgggtcctgggccaggcttctggggtttgagcagccacaacagagaacttgctgcccccaggtatttcctgccaattcagacccagaaactccagtgctgaacctcctgccggagccccaggtggcccgcttcattcgcctgctgccccagacctggctccagggaggcgcgccttgcctccgggcagagatcctggcctgcccagtctcaggtgggcagtcaggccagggttggttgggcagggcttggatgcagggtgcatccttcactgtggacacaccctttaccataaactcaacctccaccagaccccaatgacctattccttgaggcccctgcgtcgggatcctctgaccctctagactttcagcatcacaattacaaggccatgaggaaggtcagatataacccctatgacctgggaaggagggcccacccatctcaggtccccttcccaccttcccaccggggcacaacctgctgtgactgcgcttgtatgcccctgctgcctcctgatgtctcagccttctctcctgtggacccctaagctccatcccactttcccttattatggcgcccccccagtcctaccccttcctcccggctctgctgccgctcccctcctgtaccatgatgggatgccccctctgtgtgggccatcgctgactttttaagtctttccatggca

SEQ ID NO: 12584 - DNA, 1180 bp, Homo sapiens
ggagccccgcagatgtagtttctcatgctttctcatgggaagccctccctggatccctgtccctttcctgctttccctgctggctgatatccacccctttccaaactgctctctcgcaagtctttctgtctggaccttcattctctagagccacagaggaggccagagtggctgcccccaatccacaggctctgaggtggctgccacattcttccttgggctccctggctagtatcctaccttctcttgctgcccaaagactcagatccaggtatctgatacctatattataggactgtgaggttcaggctgggaagaaaggggtatcatcccacctgcccagccaggaaggagaaaagggggcctgatgaagaagggtggtcattgtatatttgaaggacactgagttgtggggaggggctctcaggcccaaggatggaggcagaaagccaggccaagcagggtcaagggcatgccacaggctctcaggagcgggcccagccccatgagcagcagcagcagtgcgtcctggaggctaagttgtcctgagactgtacccatttgcaggagtagagcctcctgctgtccaggaccttcaccggccccctgactctggcccctggtgagaagtttgcgctgtggcagagtgtgacctgcgggcctgtggagagagagggtggtgactgggcttagggaagttgtccactggcccgcccgcctacaatgcccacctgccaggctgctgcccacttacctatggagcaggtcaaaggtgaggaagctgaccagaagcagcagcagggctgggccagtggtggaaaagactgcctggattgtcagtcctagtgcccccagccataggacactgtccaggagctgggcccagctagggccccaggtggatacaggtggacgcactggactacctgacccctccccagcacccaggccccttggaggaactgggatcggatcctcacgtgcttcgggtctgggtaagcagagccgggtcatggagagaggtggaggtgacgggaagacctagtgctgaaaaggattataagggtgagagtaggggaaggggtagggcccgggcagacagaagggtgagctcagagtggggaattaggctcctgcagagtctccccctcccccatacccacccagcaaaccctcctca

SEQ ID NO: 12585 - DNA, 1046 bp, Homo sapiens
acgccccctggcctggccccaggagtaagcagcttcctacagatggctgtctccttcacctaccgacacctggcactcttcacagacacaggctacatctggatggggacagcatcactcaaggtatgatcctggggcaacacaggggtactgtgccttgtccagggtacaagatcttttggtgatgcgggagggcttttcgactagaatggtgactgctgggacagggccatgacattgcccacaccatttcaggagaagctatgtgagttcaactgcaacatccgggcacctccaaagcagatggtctggtaaggatgggggtgttattgctgggggtgtgggtgagacatagcttgcttcctgggacaatcagttccttgattcgtcatgtctactggccaagcctagtggagtttggatcttaccttctctgccattgcacacttgaaggaaaccattgtcctctgtgggccacagctgccttgagctgagagctcagggataagagggaagtggagaggtcagtgtacagtcagtgatgcaagtgtatacaggctgtcccgagacaaaggattatgagcagccatgtgggagacatggccatgggacagtgtctagccagtgtgtatatgctgctcacaggtgcagccgtcctcgtagcaaggagagggccgtggtggtggcctgggaaaggcggctgatggtggtgggcgatgcacccgagagcatccagtatccttggagggctgcctgtgtgtggagagaggggaggggagggttcacctgccccgtcccatctgtaggtgctcttaggagccttaaccaagctcaggtttgtgctggatgaggactcctacctggtgcctgagctcgatggggtccgcatcttctcccgcagcacccacgagttcctgcatgaggttccaggtgaggccttcacaagggcaccacataacccaaggtggggactcctcggcaccccagctgccctgggccagtgccacagagcaggaatagggtgttgaggcagggctgagggtttc

SEQ ID NO: 12586 - DNA, 1206 bp, Homo sapiens
gggaccactgagggacggatttcacctaccaggacgtgagattttcatagctggcactcggggctatggctgaagtgtctgagaaaagaggaacgtggaaaagcaacctgatatcactccactgggaggccagaggggctctcaaataggacctgggttccaggcatgcttccccagggagagcaggagctgctttctcagtggggtgagaggccagcaggctgggtgggctggctggcatgtgcccaaggctcctgttcagctgggcttttctctcccgataggaagaggtgaaaaacttcatcacccgagagaacctggaggcacgggtggaagcagcattggactcccggaagaactacaactgggccatcaccagagaggggctggtggtcaggccacaacgcagggactcctaggggcccagtaaggacagtgcccgccagggaccatgtatgtatcatggcggaagagttggccctgacctggaataaagcagttggtgttgcttatgaggaaggttcagccttatccagcacagccttcacgttttgccctctgctgtcaccacttggtcagaaacttccaaacgcagtgccctgttctgccggtgtgtacagcctcagcgcaccaggagaccctagagtggtttccatctcacagagaatcagacagggccacagccccctcaggcagccaggtcatctgagtatcattaagagtagtgatgggaagattacagtctgagggccaaacgtgcctgcttcctgtttttgtaaataaagttttgttggaacacagccacacccactcattgacttctttttactacagtggcaaaggtgagtagttgcaacagagaccatatgaatcccaaagactaaaatctttaactttttacaggaaaagtgtagtgatctctcatctggagctttaggactctagcctgtgtcacccaggacctgagccacaagctaaccattggccaggcgcctgcctctgctctatactgtgctttgctggccagagtctggtgtatccaagacccagaaggcaaagaggagaccccatttttttctgggttccacaaagaggttgtattttgccttacaggtaatgaagccatgaagaattaaatattctaggctaggattagcaggtgtgtgacttaaaagcagggaggccattaggagtgggtctctccac

SEQ ID NO: 12587 - DNA, 1184 bp, Homo sapiens
catccgggaggacatcgcacgcaggttccccttgtaccccttggacttcactgatggtacgtggcctctgctttccaggccttgggcccacacgtgtgcctgtcctgcatccccagcaaaccctctctcccatcccccattcctaggcattattgggaaaaacaaggctgtgggcaaatacatcaccaccaccctgttcctctacttcgcctgcctcctgcccaccatcgctttcgggtctctcaatgacgagaacacagacggggccatcggtgaggggctggcggtgggcggtgggtgggggtatgctgggctgggccctgggctgcggcgcccacctgacctccgcacccccacagacgtgcagaagaccatagccgggcagagcatcgggggcctgctctacgcgctcttctctgggcagccattggtgattctgctgaccaccgcgcccctggcgctctacatccagggtgcagtgggggctgaggcgggagatggtgcctgagacccctggttcctgccgggccctgacccgccctgccccctgcctgcagtgattcgtgtcatctgtgatgactatgacctggacttcaactccttctacgcatggacgggcctgtggaatagtttcttccttgcgctttatgcctttttcaacctcagcctggtcatgagtctcttcaagaggtgactggcccttccgtgagctgctgggaccctcaaggcttgggatctggttcagccccctgtaaccccagggtggtgggggtgcccccaccatattgctgccccaaggggctggggtgggctcaggcaaggcctggggccctggccttcttcctggcagggggaggcaggggactgtgcaggggctcagggaggcctcccccacctgccccctgaccacacccactctgatgaggctcatggcctcctggcaggtcgacggaggagatcatcgccctcttcatttccatcacgtttgtgctggatgccgtcaagggcacggttaaaagtgagtgcggctgggggccacctgctgaacagggcgctcagccgagatgggaggttctgcactgcccctggctgggggcacataggactggctcaagctgagtgtgtgcccgtgatcaagggtgcggtgctctgggagccttgggctggcagagggcagagccctc

SEQ ID NO: 12588 - DNA, 1141 bp, Homo sapiens
atttcaatgtttttgccctctgttgcagttgcaggatgtgagtttgaatctatggaatgtctacagcaagatggatcctatgtctctggagagtttgctttcagatgtaaggagccaaacagtaacttttaaatattagtattacgtccagctcagttacctgctagtgatctttaatttgaagaaatgcaaaggatattttagtttgcttcggtcaaaaaatagagcagtttcttccttgattattgtcttgaattccttgggggtataaaggaacctggcaaagtgacactgctccctcttccactctgaggtgacttcactggaggcaaaaccagggcctcctgcctggcctttaggtttaggtttttatctaaaggcattctttctgttggactggactttagaaaaacaatgcagaaggctttctctggcatgaaaagatagaaagatgagattatggcttaaaggaatcaaggattagagcccggggggcaaactttttctgtgaaagtctagttagtgatattttagcctttgtgtgccttatggtctcagtggcaactacttaacaatgccatagtagcatgaaaacagctctagacagtgtttaaacaaatgggtatgtctgtgctcccaggaaactatttacaaaaatacacggcctgtctatatcaggatcggggggaaatttgcaacgagcggcaacaaacagaactaaagctttaggactctgtactctggttaggcaggtcagtggtgtctctcagtggccatagatagatatgcatggtcacagacttagaattagccatttcaccaaagagcttcagtacaattagtgaggaacaatatttaacaaccaagatctgggcattaggtatgtttcttgcttctgtggggacattggttttaggccctttgagtgggcatgctgagaaaataaagtaaaagaataataaggaaaagatacagtttcaaaaattgtctttccttgaaagaacggaaggtttgaatctacgtattcaaaagggcagactgggcacagtggctcacgcctgttatcccagcaggtgtgaggaggctgaggcaggtggatcacctgaggtcaggagtacaagaccagcctggccaacatggt

SEQ ID NO: 12589 - DNA, 1088 bp, Homo sapiens
ctcctctgaacttgtggttcattctcaggctggggtggactcagatgccaggaaagggacagcctcccattgtcaggcagaagctgcccaaagcctggagaaggacttgtttgccctctttcccccaggaggggctcgacccacccaccctccctctcagaccaaggtggtggctgtgaggagggcagcaaatgctgacaaggatgaaaagcacatggaaaaaaatggatgaggagggaaaactctgccaaatggaaaatgaccaaatttaagagggtgggacagtcccctgctcctctcccagagggcactgcttggaaattgtgttttccccatttatggtgctctgtattctggcattatgcagcagcctcccagaagctctcttctgcttcaaaacctgggatctctggcattaccctattgggatggaccgctggacagcaatgctcgagtttgtgaatttggagagatactcaaaagagctaaaactgcagcattttacctttaaatgcagtgcctagagagagagtattgtctcttccccaacactaaccccactcccatgaagaattgcctggaaagatgttttcaaggaatttgaaccataaaacactatctgatgcacagaacacctctactttgagactcacctctcataaagcttctttttcacattactgttaaagaccagacgttctagaaaagacccctcctctcatgagctcccccatccctgctacagaacacagcacccatggcgcctgcagtggactggccccttaattcccacaggcccccccagcaaggccaaagggaggcccctgggtattgtcctcctacaaggaagatcctctttgtttgttcaaaggaccagttttcctaggccaaagaagtctcttccccatgttagtcctatgccttgaaatatcatgcaccatgacccacagccatctggttatgtcttatttttttcctaaaagataatgtttatttttaaaaaggaaggaaggagcaagtgaagtttcattctgctccagcggtggggaagccgctgaatccacctgcttctcctttgcaaccgacag

SEQ ID NO: 12590 - DNA, 2640 bp, Homo sapiens
gcccgtcgcctgccgcccgccgcccggcgacgcgcccgccggcgtccccggaggtgcccccggcccggccgggtcgtcgccccgccgccgcgcccgcgagccgctttgtctcgggcggggcgcgcgggagaggccgccaggtgccccccgccacgggcccgggccccccgccccggggcggcggcggcggcgccgggccccggggcggggggcgcgccgggatgggccccaagaggcgacagctgacgttccgggagaagtcacggatcatccaggaggtggaggagaatccggacctgcgcaagggcgagatcgcgcggcgcttcaacatcccgccgtccacgctgagcacgatcctgaagaacaagcgcgccatcctggcgtcggagcgcaagtacggggtggcctccacctgccgcaagaccaacaagctgtctccctacgacaagctcgagggcttgctcatcgcctggttccagcagatccgcgccgccggcctgccggtcaagggcatcatcctcaaggagaaggcgctgcgcatagccgaggagctgggcatggacgacttcaccgcctccaacggctggctggaccgcttccgccggcgccacggcgtggtgtcctgcagcggcgtggcccgcgcccgcgcgcgaaacgctgccccccgcaccccggcggcgcctgccagtccggccgcggtgccctcggagggcagtggcgggagcactactggttggcgcgctcgggaggagcagccgccgtcggtggccgagggctacgcctcgcaggacgtgttcagcgccaccgagaccagtctatggtacgacttcctgcccgaccaggccgcggggctgtgcggaggcgacggacggccgcgtcaagccacccagcgcctgagcgtcctgctatgcgccaatgccgacggcagcgagaagctgcccccgctggtggccggcaagtcggccaagccccgcgcaggccaagccggcctgccctgcgactacaccgccaactccaagggtggtgtcaccacccaggccctggccaagtacttgaaggccttggacacccgaatggctgcagagtctcgccgggtcctgctgttggccggccgcttggctgcccagtccttggacacctcgggcctgcggcatgtgcagctggccttcttccctcccggcaccgtgcatccgctggagaggggagtggtccagcaggtgaagggccactaccgccaggccatgctgctcaaggccatggccgcgctagagggccaggatccctcaggcctgcagctgggtctcacggaggccctgcactttgtggctgccgcctggcaggcagtggagccttcggacatagccgcctgctttcgtgaggctggctttgggggtggccctaatgccaccatcaccacttccctcaagagtgagggagaggaagaggaggaggaggaggaagaagaggaggaggaagagggtgaaggagaggaagaggaggaggaaggggaggaggaggaggaggaagggggggaaggagaggaattgggggaggaagaggaggtggaggaggagggtgatgttgatagtgatgaagaagaggaggaagatgaggagagctcctcggagggcttggaggctgaggactgggcccagggagtagtggaggccggtggcagcttcggggcttatggtgcccaggaggaagcccagtgccctactctgcatttcctggaaggtggggaggactctgattcagacagtgaggaagaggacgatgaggaagaggatgatgaagatgaagacgacgatgatgatgaggaggatggtgatgaggtgcctgtacccagctttggggaggccatggcttactttgccatggtcaagaggtacctgacctccttccccattgatgaccgcgtgcagagccacatcctccacttggaacacgatctggttcatgtgaccaggaagaaccacgccaggcaggcgggagttcgaggtcttggacatcaaagctgagtcactggacctagctgtgcccccaacctagattggcagcaccaccccagggcagaggactctctgggcacccgctgtgcatggagccagagtgcagagccccagatcctttagtaatgcttcccctggtcctgcaacaggcccggtcacctcggccgggcccggggctgaggtcagcctcactgcctgcttattgcctctttctcagaatcctctttcctccccatttggccctgggctcaggggaccaggtggggcgggtggggagctgtccggtgctaccacaccgtgccctcagtggactaaccacagcagcagccagggatgggccctggaggttcccggccggagagtgcctctcccctctgccatccacgtcaggtctttggtggggggaccccaaagccattctgggaagggctccagaagaaggtccagcctaggccccctgcaaggctggcagcccccacccccaccccccaggccgccttgagaagcacagtttaactcactgcgggctcctgagcctgcttctgcctgctttccacctccccagtccctttctctggccctgtccatgtgactttggcccttggttttctttccagattggaggttt

SEQ ID NO: 12591 - DNA, 1221 bp, Homo sapiens
cccgactaattttcgtatttttagtagagacggggtttctccatgttggccaggctgttcttgaactcctgacctcaagtgctccacctgcgttggcttcccaaagtgctgggatacaggagtgagccactgcgcctggctgatcccagcacttttcaaatgatgccgctcaaagccgtgacttggcctactttgaacagcaaacttgttgctgctgttgtcaacctgaaggcctctcaaatgccagcttcaagcagggtgtgaattggccagtgtcagatctcaggagtcctgtgttgagagtgtggctttcagctgcggggagctgcacttggtggggaaagccaggcaggtcaccctcacagccagataatgtggaggtcagaacccaaggaagggagtgagacctccactcccagtgggggacctggccacccatccttggggacctgagaaagcgtacttcaccttggggtgaaggctgggtggggccagagggaccagtgccctcctcagtgcttaggggcagagccacctgcagcaatggtatctgcatattagcccctctccaccttctttctcccgctgaatcatttccctcaaagcccaagagctgtcactgcttctttctccctgggaagaatgcgtggactctgcctggtgatagactgaagccagaacagtgccacaccctcgccttaattccttgctaggtgttctcagatttatgagacttcttagtcaaatatgagggaggttggatgtggtggcttgtgcctgtaatcccagcattttgggaagccgaggtgggaggatcccttgaagccaggagtttgagacaagcctgggcaacaaagcaagaccctatctctaaaaaaaaaaaaaaaaaaaaaaaaaaaaaaaaaaaaaaaaaatctaggagatgctctttaccctgcctggcctcaaactattaatagcttcctttgagcaacattatttattatgaactttcaaacacaaaaaagtagagagagtagaataacaaatccccatgagcccatcacccaacttcagtaattatcaattcatggccatcttgttcacccctgcctgcttccctgcttcccctcattctgcagaggttcttttcttttgagacagagtgttgctctgttgcccaggctggagtgcagtggtgcaacttcggctcactgcaacctccgcctcccaggttcaagt

SEQ ID NO: 12592 - DNA, 1216 bp, Homo sapiens
attttgaaagataaattgaccattggaggttatatgttacataggtttgggaatttcctgtttctagtttgctgctaaaccagaactctgaagtctcaatgtttttttttaagccgataggaaagagagattttcattctgaatctttgtttttcacagttgaggcttacgagtagtcatcttgttatttttaaaacacttcatagtgcggtttgcgcttgtctgacagaatggttgggttggctcaatactttgatatttttctttttcgtctttgccgtagtattttttttttaagttatgcatctaaatcaagacagaatcacatttctttgccccaaaacccttttgcctagaattatgttctttggaaaccctagcgtttgaaataagttgctactgtggtaagggtaaatttaattttcagaaaaaagctgttctgacttatttttcttccccatttagtttttccatggtttggactggatatcggtggaactctggtcaagctggtatattttgaacccaaagacatcactgctgaagaagaagaggaagaagtggaaagtcttaaaagcattcggaagtacctgacctccaatgtggcttatgggtctacaggcattcgggacgtgcacctcgagctgaaggacctgactctgtgtggacgcaaaggcaatctgcactttatacgctttcccactcatgacatgcctgcttttattcaaatgggcagagataaaaacttctcgagtctccacactgtcttttgtgccactggaggtggagcgtacaaatttgagcaggattttctcacagtatgcattttttagcttatatacaatttatggtaatttgattgttaaaaataatgccagtagcaagtggtgaaataatttccatctctaatggaacttgaattttcttgagtcaaatgaagattaaaggtacgctagtgataggagttggccatctagaggtggttgtctagttcagatgtatggacgacaatcagaaccactaaaagggtagcattttattgctcctttagtatgaaaaattagggcatctgctatacgttgaggaagaaactacctaaaaggaacatcattagatcatgaacaatgagattgaaatataattaaaatcatttcatgtcataaaattgttttcagtcttgtctaccacataatttctcttgtctccctcagttgtt

SEQ ID NO: 12593 - DNA, 1068 bp, Homo sapiens
ctgtatccagctgtttgcagagctcagggaggccagggggcttcagactccactgtactctgcattccaggattctctgttctctggctgtggtggcctgacacactcttcaccactgaccccacccccgcttgcacactatgccacaggaagggcaggggcttccatcacaatcactcagtactagttaccagctctgatagaattactcaccttgagtttccaagtcttgctgaaggtgcttgcgtaagtggcacatggatgttccctctgttcaaaggcatatgcacaacactatttttcaaaatttgcttttatttacacgtttgagtcaattacatgcatgttttatttttgaggagtgattagcaaaatgcattaaaattttaaaatagcaattaaatatacaaaaatatagcttacaaaaaactgcgaatgtttaaaaatattctgctgcagaatttttagtgtacaaagacgtctatgaaacctgaggttcagcatttcataaacctttttttgagggagttacacaatacctagtgaggaaacccgagggccaaactacaagacgaaaaagtgccccgttcctggcaatgatgtcagaagaccaagaggcgatagttaccagcaacactctaggaagaccagctgtcaccagaagggagttcctaacacttgccacacctgctcccccgaccgggggcctgggagggaagggcagatggagaggaacggtgtgcagtgggcgtgagatgcagatccaccaggcttgggactggcaaagggagctgagaagagagttcccccaaagcacaaacaagtctgctgacactggtggggcccttacagtcacagaagtaaggactggatggtaagccaaaggtgctgatgcttggtcaaaaagtggagtacatctttgcatcttgtaacaatttgggctctacagctgaattggcaaagtaaggtttactacacaagcccctctttttcttctgatatccccactcaaatggaagcacactccccagcacatggggatcccttattaatctttactaaagaacc

SEQ ID NO: 12594 - DNA, 1824 bp, Homo sapiens
tctcagcacatgtgaatgtggactggttttaaaatgcattcattctgctaggattgggctggaagctggaacagtgagagtactttttctgctcctagtcatctccctttctcagcgtgacatcctcctgcagcaagcctagtatcactagcagtagttcctgcgactcttagcaacacaacccgaatatttgctccctgcatctgggtcctccaccaggatgggcctgcgcatctgcattgctgtacagacaaacaggccttttaatttacatcctcctttaattctcattaaaatcgcagggtttttgtttgaaagacagtcctttttttatttattttgaaaaaggaatgagttagggacccctttataactctcttggctcagactcgaaccccatggtaaagtcaccctttccgcatctatcttcaggagttgctgggacttgttactgtgtagctgcgtggggattctggtctgctcttggaccactggctggtatcctttgtgtgtttcttaagcagctcaaagatagaatgttgctggtctgctatgggttagtggagcataactcagccccaactggactccacgggtggctgaaccattagtagttgctaggggtacaactgaattcaactgccttcagaaacagggaacaaaaccagcctgacttgattcctggttgggtcagtatcagacactaggaagttgacatctgctgcttttctttgccacgtgtgatttggttaggcctgtccctggcagataaggtccttgaagcctatgcttgcctagccagggaaggcaggacagaaatggccaaataggggcaggtggcccctgggaaggtctgagctgagggatacaggggacctcccaccattgccggataccctgttcttgacaagaagatccttttccccagtgccaagccccttggatccatcagagaaatagcctcgggccttgtcctttttcacaaccccacttcaaaatcatgtcatctccctggcctgatcccgctctaagctactttgaacaactaggaattatttttctcagaggctttttgggcattatgaaatacatcctgatacatccagggcagtatacccagagctccaggcagagagtgatggaatcacctcttgtcactcactagccttaggcccttctgcaggttagcctctcagtctcttccttagcttccttagctaccacccagggattgtagtaacgtccctggcacctcttgtgggggttagctggtgcccagagcctggtaggcagcaggcctggtgtcatgggggctgctgataccacataacatcatctgggttacatgggctcctctgccatcatgattgataggaacagaacctcagccaaaaagcttcctgagctgtaggggctttccctgaggcccaggttcacctggcccctttcttccttggtcatctctgcctttgcccacagtgaactctgacttggttgttcagtgctgaatatttctttcttaatgttttgaataggtaatccattcatgtggttcacaaatcataaagtagttaaaagcctttcttgagttcctgatgcctagcaagctccgctcctcactccatgaatacctactattggtttgttccttgggtatccttccagagatcatttatgcatgtacacacatgtgtatgtgtgtctatataatttttctccttttctactcatgtgataccagacaagtgtattcaaggaacgctcctactaatgtgggaagagccatcccagaaatcagaatacaaaatgtgaacccagaattgg

SEQ ID NO: 12595 - DNA, 1454 bp, Homo sapiens
ttcctacttgaggacaattctttagataaagtggcagctctggtctatttatgaccgagatttatagcagctgaaggtatgggcagaacaccaataacatctactgtagattaccagattaccaaatatctgaggaaagctgctaacatggaagatagaaaataaataacaataaaaacaagtcaaaacaagcaagcaaactaataattaaaataaacagaaaaaggcaagttggaggaaaccaagatttatttttaagaataagaggtgataggcagttcggcggtccagtgggtctgtctcttgcttcaacagtgtttggacggaacagatccggggacggtcttccagcctccgaccgccctccaatttcctctccacttgcaacctccgggaccatcttctcggctatctcctgcttctgggacctgccagcaccgtttttgtcgttagctccttcttggcgaccaaccatgagctcccagattcgtcaaaattattccaccgacgtggaggcagccgtcaacagcctggtcaatttgtacctgcaggcctcctacacctacctctctctgggcttctatttcgaccgcgatgatgcggctctggaaggcgtgagccacttcttccgcgaattgaccgaggagaagcgcgagggctacgagcgtctcctgaagatgcaaaaccagcgtggcggccgcgctctcttccaggacatcaagaagccagctgaagatgagtggggtaaaaccccagatgccatgaaagctgccatggccctggagaaaaagctgaaccaggcccttttggatcttcatgccctggattctgcccacatggacccccatctctgtgacttcctggagactcacttcctagatgaggaagtgaagctcatcaagaagatgggtgaccacctgacgaacctccacaggctgggaggcccagaggctgggctgggcgagtatctcttcgaaaggctcactctcaagcacgtctaagagccttatgagcccagcgacttctgaagggccccttgcaaagtaatagggcttctgcctaagcctctccctccagccaataggcagctttcttaactaccctaacaagccttggaccaaatggaaataaggctttctgatgcaaaaaaaaaaaaaaaaaaaaaaaaaaaaagaataagaggtgatattacacccatgaaacaagaataagatgctattttgagacaagaaacaaaaaataagctttaaaataaacacacacacatacacacacatacacacaacagcagaaatgaaaaattcaatggatggcttgagaaaaatgtctagaatatctcacagaaaatagatctgaaagacaaaacaatgaaaaacaggaaagaaaagatgaggaatgtagggggaatagtccaaaaggtttaacatctgaataacaagcatttcagaaaagga

SEQ ID NO: 12596 - DNA, 1841 bp, Homo sapiens
cctggaatgggggttctccagtaatttctatcattctcccctgttgaaagcttatgtattgagaacatctgggtaagagtcacaggcagcttggaaaagagggcagtgattagggatttctagttttattatttttttttagcatttgttgagattggtttaaaatccaggacatggttaatcttggtgaatgctccctaggcacttgaaaagcacatgtattctgctgttatagggttgtttgttctgttagatcctgttggttgaaggtgttgttcaattcttctatatcctcattattttcttttttatttttttagagacagggtctatctctgttgtccaggctggagtgcagtggtgcagtcatagctcactacagcctcaaactcctgggttcaagtaatcctcctgcctcagcctcctgagtagttaggactacaggcttgtgccactatgcctggctaatttttaaaattgttattttttctttttctgtgcctaacgtagccatggctcgtggtcccaagaagcatctaaagcaggtagcagctccaaagcattggatgctggataaattgactggtgtgtttgctcctcatccatccaccagtccccacaagttgagagagtgtctccccctcatcattttcataaggaacagacttaagtatgccctgacaggagaggaagtaaagaagatttgcatgcagcggttcattaagatcgatggcaaggtccgcactgatataacctaccctgctggattcatggatgtcatcagcattgacaagatgggagagaatttctgtctgatctgtgacaccaagggtcactttgctgtacatcgtattacacctgaggaggccaagtacaagttgtgaaaagtgagaaaaaatatttgtgcgcacaaaaggaatccctcatctggtgactcatgatgctcgtaccatctgctaccctgatcccctcatcaaggtgaatgacaccattcagattgatttggagactggcaagattactgacttcatcaggttcgacactggtaacctgtgtatggtgactggaggtgccaacctgggaagaattggtgtgatcaccaacagagagaggcaccctggatctcttgacgtggttcacatgaaagatgccaatggcaacagctttgccacttgactttccaacatttttgttgtttgcaagggcaacataccatggatttctcttccccaaggaaaaggtatctgcctcaccattgctgaagagagagacaagagattggcaaccaatcaaagcagtgggtaaaatggtccctggatggcatgttagatctttgtatgtaattaaaaataatgtggcatgattgatagccaaaaataaaataattattattattttgtaaagacagggtctcattaagtttcccaggctggtctcaaacttcaggcctcaggtaattctcctgccttggcctcccaaagtgctgggattacaggcatgagctatcacgcctggctccttgtggattttctatctagtagttctatcaattactgagaaaagagtgttgaagtctccaactataatagtagatttgtcaatttcttcctttggctttatcagtttttgcttcatgtatttgaaagatctgtttttggtgcatacacacttaggtttgctatctcttgttggtagattgatcttgatcttttatcatcatgtaaaattcctctccgtgtctggtaatttctttgctctgaagtctaccttgatattcatatagccactcttcctttttaaaatttaatacttatgtgatatatctttttctatgcttttac

SEQ ID NO: 12597 - DNA, 1110 bp, Homo sapiens
tcatcatagaggatgatgtaattaaaaaatggtcagtgtgcaaagaaaagaactgcttgcatttctttatttctgtctcataattgtcaaaaaccagaattaggtcaagttcatagtttctgtaattggcttttgaatcaaagaatagggagacaatctaaaaaatatcttaggttggagatgacagaaatatgattgatttgaagtggaaaaagaaattctgttaatgttaattaaagtaaaattattccctgaattgtttgatattgtcacctagcagatatgtattacttttctgcaatgttattattggcttgcactttgtgagtattctatgtaaaaatatatatgtatataaaatatatattgcataggacagacttaggagttttgtttagagcagttaacatctgaagtgtctaatgcattaacttttgtaaggtactgaatacttaatatgtgggaaacccttttgcgtggtccttaggcttacaatgtgcactgaatcgtttcatgtaagaatccaaagtggacaccattaacaggtctttgaaatatgcatgtactttatattttctatatttgtaactttgcatgttcttgttttgttatataaaaaaattgtaaatgtttaatatctgactgaaattaaacgagcgaagatgagcaccacctcccgtgtctgcagttgtatttcctggtgcttgccctgtgttggggactgttttgggggttaatctgagccaagtggcgctttctgtcctcccttctcaagtgatggccgatggttcacgcacttccccctgttcctgcccttgtcctcacttcccagtcacccactagttcatctctgcggcttttgcattttctccacaagcatctaagtgggcttagcactggtaaactgcaaaggcactattgcagcaggaggaacagtctgggagcttttttcagtcctggatttagaaatagattttcttgattaaaatgaaaattaacaagctctaaagaactgttgacccttgaactacacagggattagaggcactgacctgccgcacagtcgaaaatctgcagagaagttttttttgttttgttttgttttttttg

SEQ ID NO: 12598 - DNA, 4913 bp, Homo sapiens
tacagatgcttcagctacttacccatcagcccaacctttgtgggctacacatggaaaggcctcaggaagagcgacaacagccggagttcagatgaagactcccaggccacgggatagcctttgctgtgccctgtggcctggccgcagtgaggcatgtatctgtagttccttgctgagtaacaagaagtaaaatacatgtttgtatatctacatttacattctgcgccccagagctaagacagactgcgaatcacttttctgctgtgagggtgatggtgcctgatgcggtgtctcgcctatctccttatttaagcccttaactccttgccctttgagagtgtccattgctggccatggtcactaaatttgaagttccagtcctccctttggagtggacatttaaaatctgcagccattccttgcttcagttcccttccaccacccagggctggctttcctataagccacctccagggtccaggggctttctctctctctccgaagcccctggacctgtttccttgtcatttgaccctcgtctgtgcccgcggagacctcctctgaccaaggggcactagtatgccttgcgctatcatgactgactggcccagtatgattctgttgtcgctgatctcccggaggaggaggctgttgacctgaaaacagtggcgtggctcccctgtgcccagatctggccatgggtgaggcctgcacagatgttgaatgaacatctgtttggggcattggagggaaaaggaaaggaccctgaagccaatatctgattctcggctgcaccttctcttggccaccctggccctgaccgggccagcacgtgcacactggcctcttttcatttcactagtggccgagacaccctctctggcatttatcactgttggccggtgtgatgagtatagagtgccacccaaggcaccagtcacacaagctgatgggcgtcttggctctgccgtcatgtggatgttattgtcgcgcgcgtctataattacaaggttttattcctatttaatgttattgactatagcagattttggaaatcagtgttttccatgtgaccctctttccttgcatccctattccttgtcccccacccactcttccccccatcaagaaaagaaccagcatttgtaaagctgtggacaccatcagggaagcttgttgtaacggcttttgaaggccagtaaccattgttgtggttgtgttttgtattgcttgataccatgaaagtgtaaatactgtaatgcctaatctatttatcaaaactgactactggaccggagcccagaaaccatgggtcaagttacacgtgaatttgttttgtgaagaagggaagctggggcaggtaacacgcagagccgccacgtggaacggtctgtccgccggtctgtcccgcttgccgggcttctgttgcaagtcttggcttaaggagacttcctgtgggttgccatgtcgcacgtccgttagatcttgattttacaggtgagggtggttgccaaaggtgataagaaaagcagccaacaggctccctctcacttaagagagttctaattaataacactaaattcttcctgagaaatgactcctcttggtttggtttgaagtttttcagtgaaggaaaaggcctgagataggaagcagtgccctcgcttcatgaggtggcacatcttcggtggccgttggcctggtcgagctttggtcagctgcgtgggtgcctgtctcctgtctccagcggcagggcatggttcttggcagcctggtgtccacacggtgcattcctgtccccctcggccccaggctggctcagctctccagtgctgcggcgctgtctttgcagcattgccatgtcaccgtagcccccttcactcttggaagtttggggcttcaaggtttattctggcaagaacacctcggagccactgcattgttttgccaaaaacttactgcagattaagtaaagaacttagatgctaaattacatctaattttgtatgtttttttaaatgtgtctttgatgcatactttagaagcacactggctcgcggtttccatccctcttgccttgggacactcttgaggctggcagccctcctgcaatgagttgctctcagttccttctgtttggattttgctcaacatctccagtttctctgctctgaaaaatggggaaaactgctaaacatcccagagatttgcaatcttctagctctccaggtgagcagaaagaccaaatatccaaataaaagcctgaaagccattggtgatccaggggcaccttctcttcagcttgactgggcgtcttccgctgcataacactcaaggtgtctgctctagtcatccagaaacccactcccttctgaagcccctccttgggccgggttgtatcaggaggattcaaccccgctaacatgtggggtgccctctgtaggccttcacacagggaaggaagccctaccctttcaactcctgttggagtgagagtttcctgttctgattccactgtggccaacccaataattctgtccgaggaggggtaagggaataggaggtggggagcaaagagggcagcctgactagatgcccctgctgaatctggtactttctgcacagccttgagtgattggagtcccctaatgactaataaacttgaacatgtaacacacacacacacacacacacacaccattttaggaagtggttctcctactggaaaatatgctacagaatgaaagtttgtaattgaaagaaaaagaatgtattcatctgcttcttgggtttaagcacacacctgaaggggagatattgggggacacggtggccactcgcggtctgtgtcatgacacttcccattcacatcattggcctgcgttgctggggctttgaaccaccaccccgtactttgttttgcctgtagagtgttgtaaaatattttggatgtgaatgtccttgcaggccggttagtctccagtttccacagagaccacctacccaccaccttcccaggtcacctgcctggtccctgaaagaaagcatttgtgtgggcaatcccaacatgaaatgtagacagcgtgaatacggacaggaggtgatgccatattcacagtgggggatggagggcccccacccctgcttcacagaataatgggaagtgactctagtctttgtaagcaattttcattctcattaggaagttaaatgtagattcacagatacatttactttcagaatcctcaagaggatttcaaatgctaacttttagtttcttgggattgatcaaggcaagagaagtggctttaaccatgccagccagaatgaagcatcatgggtcctgatggtttcccgttttcatggtaacaaattcgcacagaggttttgctttatgctgtagaataccgactttcatgatgacaacttggtttatgcatgaatattgcagtatttccatatagcaaaataacatttctacccaggataatagtcacagttttccagggagggaatgatataattttcatgacaatgtcatgtgatgatagaatttctccattgatgaatctctagtatgtgtgtatactttatttacccatacgtatattttatgaccatgagctaagttgttatttctttcattcatatccctgctgaaatattggtactagcaacttaaagttggcaagtctcatcttcagtaatacggatgccatgggagtggccaggccagattgaaggtgaatatggagcagtagcagaagcctcattccagaacccatctggccagagaagcagcagcatcctgggggatggccgtgcatggggtgtacactcgctataggcataggcccggcatggctgtcgctggacgccagctgtgcacacccagccacacctgctgcacgccgcgttagtgtgcggctccgggcctgagcattcgcaaagctcgcttctccagggagcctcctcttggctttggaaaagagcccagggacttaacgtgctgcctgttgtactctgtcccctcatgactttttagacacagggactaggacatcgaccaccctctgcccctcctgcagtcagaacccgagtagtgcaagaacggccacccggttttgccagcgttcagcgtctgcccatggacccataaggcacattagcgttgggggtctcttttcagcagcctcacagacattcccgtcctttctggttggtgttgactgtgtttcagcatcactctaccctcccatgtccttagcattgctgtgcgtgtttccaggcacttaggacacccttccccacgttgccatcttactgacagttcaaatgactctccttttttgttcgttagtaacaatcttcatttgacaccttaatacatttctgactgttcttaaaacagtggggatgcctatattttccttgagtttttgtgactgactttggctatatatacctttctggggttttgtttgttttttatttttattttgattaccgagggtatttggggtggggttgttttttgagatgtgtaattcttttatggagtttttaaaaagaattttcatattgtttttctaacatggcttcattaaacgtttaagtattttaaaaatatgtaatatttggaccagatgttgtgaataatagtagagataaagctattttattctgtatttttaaaactgttccgtacaaataaaagctctcctggacacagttttgctcttcacgtgcctccttcttgggctactctttaagaaaagagtcatccctcagaatctgtaggggattggttccaagacctcctcggataccaaaatccgagactactcaagtccctgatataaaatggcatagtgggtcaggcacagcggctcacccatgtaatctcagcactt

SEQ ID NO: 12599 - DNA, 1230 bp, Homo sapiens
gagtccttggatgcagaggcggctgggctccctttccatcatttaatagtcacgtgactttggacaagctctctccaagccctgtttcctcaatggtaaactaaccataagactgttagtgagcaggacaccatggctcatgcctgcattcccagcactttgggaggccaaagtgggaggatcacttgagccccgaagttcaagaccagcctgggcaacataaggagaccttgtctctacaaaaacataaaaaaaaattagccaggtgtggtggtgcacacctgtggtcccagcttctcgggaggctgaggtgggagaattgcttaagcccaggaggtcaaggctacagtgagctgtgatttgcgccactacactccagcctgagtgacagagcgataccctgtctcaaaagaaagattgttagcgagcatcaggtgagctgatgcctggtacctgtccacactcagtggctgactctgtttatcttagttttccccactgggagggaaggaggcaggtagtgcagcgggtgcacagcgagcaagggctggacagccttgtgtagcaacgcagacctgatgagtgtagcagggcttggggttggccacactgccagtgtccccagccagggtgggccccactgaccctggaatctatggcagaggccatcagaaagctgtaagggcatttgatccagcccctcctgaggccggagaccctcttgcctcagccaagcttgttctctaaggcgggtctactcgcttttgttcctgcaactctagcttttctgggtggtctcccttcagttactccacccttcctctgttagctggtatttgtgatgtttcaagggcctgggagtctgattgagtcctcttgttacatgaaagtttaatgaatttggttttctacaacctttcttcttcaactgtcaggtccttcttgccccaaacatttccctgggctctgaattgctcatcctcctcctcatggccttctgcttcccctacctcccctcccctaacccccattcttcctttttaggcaggtgactgccctggcaaaagcagctctacacaggagtgaacagtacttatcaccaaataaggatggaagctcttttcctgttttaaatttggggagttttttcaatatttggcatgactctggtgttttaaggaatgtgttgtcatctccctgcctctgctacccccatcctcctaagtcccc

SEQ ID NO: 12600 - DNA, 1221 bp, Homo sapiens
agaattcaaatcaccgtgtttatatactttagaattactcttttcacctaacgttatctgagcaatagtgtttggataggagggtgtagaattttaaagtacaaagatcctttttacttgcagggatgaagtgggctgggaggggcagatcagtgtgctgtctctttgaaagtggttaaaattttctaagatttttttcatctggggtctcacgcaaggactgctcgtgccaaggtatcattttgtggtctcaacctgggaacatctctgtccatgcaggaggatccccaggcctggggagaagctctgagcaagtttggtgttctcagggatgagatgttgcccaaggacgctgaccccccaaattctgaggattgaccatcccggtgggcgactgtacttgagccaaagagaatacttggcttcaaagatagccaaggctcaaaactgcaggaagatggcaaccacttgataaagttgtttttctgtaatagtggcctgtacatggccgagctaacactggtcttcacgtttaatgagcaccttcttttctccttctggctcgcagagctctctcgctgagaccctggatagcactggcagtctggacccccagcgatcagacatgatttataccatagaagatgttcctccctggtacctgtgtatatttctggggctacaggtaagatggttcctgtaggatgtgtaactaccagcaggtgtttgcattgtctaccatctggaattgtttaaaaattccactttggtttttgtttattgaagacttttataaattcctcttttaagagtgatgagtaggggctgagcacagtggctgatgcctgtaatcctagcagttttggaggctgaggtgggcagatcactggagcctaggagctcaagaccagcctgggtaacatggcaaaagtccatctctacaaaaaatacaaaaattagccatgtgtggtggtgtgtgcccacagtcccagctactcaagaggctgaggcaggaggatcgcttgaggttgaggttgcagtgagctgtgatcacaccactccacttcagcctggttgacatagtgagaccctgtctcaaaaaacaaatgatgaatgggaattgttgacatcacagcaggaggaagaaaagaacaggtagaatggattaccagggaaaagaaagaagatgttcagggcacaagcaagagcagtgacataaag

SEQ ID NO: 12601 - DNA, 1257 bp, Homo sapiens
tatagctgaggactaaggaattctgcagcttgcagatgtttaagaaaataatggccagattttttgggtccttcccaaagatgttaagtgaacctacagttagctaattaggacaagctctatttttcatccctgggccctgacaagtttttccacaggaatatgtatcatggaagaatagaggttattctgtaatggaaaagtgttgcctgccaccaccctctgtagagctgagcatttcttttaaatagtcttcattgccaatttgttcttgtagcaaatggaacaatgtggtatggctaatttcttattattaagtaatttattttaaaaatatctgagtatattatcctgtacacttatccctaccttcatgttccagtggaagaccttagtaaaatcaaagatcagtgagttcatctgtaatattttttttacttgctttcttactgacagcaaccaggaatttttttatcctgcagagcaagttttcaaaatgtaaatacttcctctgtttaacagtccttggaccattctgatccagttcaccagtaggttggacagcatataatttgcatcattttgtcccttgtaaatcaagatgttctgcagattattcctttaacggccggacttttggctgtttcctaatgaaacatgtagtggttattatttagagtttatagccgtattgctagcaccttgtagtatgtcatcattctgctcatgattccaaggatcagcctggatgcctagaggactagatcaccttagtttgattctattttttagcttgcaaaaagtgacttatattccaaagaaattaaaatgttgaaatccaaatcctagaaataaaatgagttaacttcaaacatttcagaaaacattttaatgattttatgatatctttaatcccagtacctagatctaccttagtttctaggtagctggcattgtgggtcacactcaactttccctaactctgaggttatggacttgggcaactggaagcctggacatgccatcagctgagttgcaaggctgtgggaagagcaagttttagatgtctactcaatatccaagtggagctgttgaggaggcagttgcgatgcatgtgtgtgtctagagtttaagagtgggtcttggatggaaatagaaatttgggagtcagcatttggacagtatcttaaaagctagagggctgtttgagatcaccagtagagtgagtatagttggaggaaaaaaaaaaaactcagg

SEQ ID NO: 12602 - DNA, 1106 bp, Homo sapiens
aaaaaacgatccatttttcaaagtgctgccactgtgataactgaggagggcttggggcagggtgtggctttgtgttggctggctgctcagcagggctgaccatgcaatgaccagttgtctgcctgtgtccatttctagaaacaggctcactggattatcagaagcattggcccttgttttaccgggatgagcaaacagacctgcaattcagtaacttgacatgttggagtttgaacccaggtgtgctgaatctcagttccatgttctttgcgttacgattctgccttcctagcttcctggtctccgccagtcatttttctcccacgggttggccaaagagcccctaacacagggaagacttgcaagtttctcagggtcagccagcagggccatgaggagtggggcagcccttgccttactttgtacccagtctcggagagaaggggaggtgacaggggccactgggttccatggggcctgcaggccgaaagcaagggcaccctggagcagtgcaggcctgtgtggcacagtgccctcatcccgaggcccaactcagccccagccccagcctctgctgtggagcattcctgacgctcccaccccatttcctcatctctgtctcctctctaggcttctttggaaattgactgtccaaaccctcattaggtgctgtctcctcagcagatggtctctggagtcaggttctttgtcttcgatttctgtagctcccacgtgattcagtaaaggcatgctgattcatcatagggttcctggcagaagggcaaaactatcaggggaacaaagtagccagagatcacatgcggagccaccttctgacttggtcaagaactccttgctggtcagacctggctgttcctagcacgtatggttgtcaggaggttgagttggtactaaatcagctgtgaagattagcaactgcctgggcagtgagaaccaggcctctggtttcgggaggaatttgttgtgcagcaaaataaaatattgccatgttagtgtttatttttagtgttgaaatgccaccttaagttgacagtgttaatgctacattgacatatgatatacttagtatcagtcccaatatttca

SEQ ID NO: 12603 - DNA, 2157 bp, Homo sapiens
ccatttggatttttttaaaacaaaagtattaataatctggaagacagtgttgcccaggtcaggagtgttttcttggtggttccagcccccatcaattgaactgtttctgggctcagtcagacacagacattcatctgtgtctgaccaaatcaggggacttccccacctgtggtgggaggcacagcttagatgttttgtacacctggtcttttctagaaatccctgcttggagctgcagaagggttgccttctgtaggtcggaggaatggaggcttactaaccaggtaagccttctatgcatccacaccaaaatcctgcagaatgtaagtaagctctgctttataagatgggttcaccttcatcgcagactgaaagtttcagtttttatttttttcagaaagcacgaaaaattatttataatagtctggagaaaaaacacactgtaatatttcaagtgtatgcagtagaatgtactgtaactgagccctttcccacatgtctaggctccaatgtctcctgtaggtccacctaactgtgtgttttcagggacaatgccatccatgtttgtgctgtagacttgctgctgctgaatcctttctggggactttctcatcgggcagggagcagagggcttctcgttcatgcaccctttgcctgaacacccatgtagctgctgtgttgtgtatatattactcttaagaggagtgtgtgtgtctgtgtttgttttaaaagtcacttatttcttacagtgatttcaattgcaccatgacttcttcactaaaaccacaaagtcctgcttaaaactatggaaaacctaacctgattagagccttgactattttgaagattaaatgcacactttttatataatgtgaccagtttaaatgtagtttgtattgtactgggggacctttcgttgttgttgtttgcttaaactgtgattttttttcccctccctaatttcaggggtgagattgactttgggaagacagattagttctttgtcaggccaacaagtgatggagtgcgggagagagaacttggcacccaaatatatcaaactattccgtgccgtggatgttttcattgccaacgagggtgtaatgatttgcttctgcaccttggtctagtgctggtttgtggtgtttttgtttgtaaattagcctcactgcctccctgaaagtgcacagtcagcccaggtctctagagtgtccagcagaggatggagccctcgggatgtttcagctcacacatccttgagtgacttcccatatgtgtgtggggctgaagcggcttctttccgctgaacttttatttccatttcagcctcgtggcttctcttattcaggtccaaggccccttaaaaacaaaacatattatcgcaagggctttcatttcagtattggctgtgtcactggcaggatgcatcactctccagggcctctttttcggagctactcccaattccactcttctgtgattctggctgagcaagttcatgccggtagaggctcattaagtgaggtcctgggcaccccccaaacaggaagtgttttcaggcccttacatgcttatccttaaggtgagtaggtatctcagcagcacacccgaacagtaaaggtgatcaataacgaaactgtagttttcagattgaagaatgaacctggatcaccaaactagataccgaaagggctcctcatttgtctcttttgtcccattgtgggcatatggtgggctccttgagaggagggagtctcagctggggcctggctgcagagacctgctcttgaatagggctgcctttgggatcagggagccgagcatactgggcaaggctcatcatgttcctttgtggaagtggttacttggtgggggtggggtggggaaggggggtctaggaagccgaagctgagtgcgcactagagctgctagcaggcaggccagagggtcagcttgtgttttattttctgatttctcctgcatgctttctggagatgaggattttttgtcaggtagctaggagagcactgccaccttgtgtccatatagcacaatgtttctctttcctattcacagacaagattcaagaaaccatttttacgtgtgtacattcaaatcttcatgaatggcatcacttgctttagacccatttttttt

SEQ ID NO: 12604 - DNA, 1630 bp, Homo sapiens
gtggccttacctggcctctcaggtggatggaggctgttctcatctggggctgtctcttgattaaggctgtcacctgtttgtatagggaccatgtttcccaacgcactttgagtgcagtttaggaggtatcctttggatgctgaagtgttgggattttgaggacatgcggatgatttatgagaatagaggggcagagtttgtgaagtctagggttttttgtccagtgggtttcaaatttgttggctgtttaaagaccctgtctcctcccccaccctccccttccttttcccatcaaatgcctacctactgaggcgccttctctttttattcttgagccaatgagatatcagtgtgtttattaataaggattgcaatagtatagtgcttaatatgtgccaggcatagtgctaagggtttacatacgttatcccttttaatccagaaaacagcctttgattaggtattgttgtctccattttatagatgaggaaactgaggcagtatgactgaggccgagagcagtggttaagacagactttgggatcaaatcaccctaggtgcgggcaggtttctaggctgctctaagcttctaccttgaaggcagttgggtctgataatagtaccttcttcctggggtggttgtgaggatataacgaggtaatgcatgtaagcatttagtaccatgcctggcacatagtaagcactcaataaatggtagttacttttgttgagctcagctggtagtttgacctccgttggtgcaatgccagagatgggattgtcagccaccacactgccaccaccctgcacacagtctgggtccctccgagagaagcacgccaaccttaacatcccctacagcatcttggtgcttcacacaccatttaggaggccaccctaacgaggcaagaggacatgggggtgtgcagaagttctgttcttagtgagaatggctggcctgagaatccagctcacctcctctgcccacagtctggactgcttgtgggaaggccatctcctcctgtctggtggtacctccactctgggcagggagggcctgtctgtgactcgctctggaccccacttcccgctctggccaagggctgtcttctgtgcacatagctcaggagcctgcagcagttccctgtatgggtggatgtcctcaggggccaagaagagaagaatggggacaacagaaacctgctttgtaggggattatgtagactaaaagcctagaagttctgcccacatccttatgacgcagccaatctggagcttcatgtttccttctaaaagtagtaaccgggtagaagtgggtgacccattgaggacacatgatgtgaggtatttctgccggattctaggttagcaaagactcaaatgggtgactcatgaatgaagggagaacaggcacaggacttaatgaaaagagtttcttgaacttagttttctgaatgggggtggggagttggggcacgtgtgtgtaaggggaggctgcctcactttgaaggaatggtgttggctaacaggatccatgaaattcctaggtcagttgaataataactgaactactggtttgactgtggattatttcctgggtattagtgggacccaacagcacattgctatt

SEQ ID NO: 12605 - DNA, 1245 bp, Homo sapiens
catcaggggccgatgaaaccaaaggactaggagtcaggagaacaagtcagggattaggagacagcggtttggtttattgttatccagctggaggactcctaggggcagcagcaggaggaataccagggccacggaggggccaggagtctcacagtggagggcagactctaacagatgccagctgaacgctcgctggccctggatgtcatacgagttggggaccagaaatctgggctcagagaacccgtccagggagatttgaagccatgggttatcttctagagttgatactgataatatattttaatttttattgatgtttaataccttctgaaacaggagggtaagatcagatgggaagcccctctgttgaaggatcttgggaaccttggtggttttttttttttttttggttttttttttttgatcgagctgtggacatccttcttaattcgattctgaggatttgtttaactaaaaagttcccaaacacagaaagggcctccccacctgctttggggagctgtctgtgctgggagtgccaggcatcccatgggacccatcactgccagtgtctgtgcctcccagaggtcagccgtgtctgccctggctctgtctcctctgtgacagggcagagcatttctggtcagtttctccatggtgcctcccacccctttgtaaagtggatggacatgatggaattcagttgtctcaccctgatagcctgggtgttgatattcactttacccgcactcagacacaggcgaccttgaagcagttctcggtgtgtagagtccacgtgacagtccccacagcctccccagatagctgtgtgcctgtgcgctactgctgtgccattttcccaacttggcgtttcactaaatgcagctgatctctctctctgtgcactcgtgatccatgttgaacaatacatgtaggttctttttccacgcaatgtaagaacatgatatactgtacgttggaaagcatttaccttatttatatacctgaatgttcctactacacaaataaacatatattaaattctagatcatgtgtggttttcgatggtgggggtggcggaaggccaggggtgtggacgtttggttgcttatgtggagccagcattatttcccaggatgctgctgaccaccgcttgcttctagagactccctctgtccttggccttggcaacctgcccccccggctttcctcctgcccttggttgctcctcctcggtcttct

SEQ ID NO: 12606 - DNA, 1141 bp, Homo sapiens
ttgccagagcttaagagctgtttgtgtcccactgttagccgctttgttccctcatctttgtgtggggagtctgatatccatgtggatgccaacggcattgataacgtggagaatgcttagtttttattgcacagaggtcattttgggggcgtgcaccgctgttctgggtattcatttttcatcactgagcattgttgatctatgccttttgggcttctcagttcaatgaagcaataatgaagtatttaactctttcactacagttcttgcaagtatgctatttaaattacttggccaggtataattgccagtcagtctctttatagtgagaaaatttattggttagtaatataaatattttaaactaaatatataaatctataatgttaaacatatgttcattaaaagcatagcactttgaaattaactatataaatagctcatatttacacttacagcttttcatttgatcaggtctgaaatctttagcacttaaggaaaatgactatgcataattatacctgaccatgaaaaaaataagtacctcaaatgcatgcatttgcactggtgattccaactgcacaaatctttgtgccatcttgtatataggtattttttacatgggttgacatgcacacaacaccattttcattcagtatgaaccttgaggctgctgccatttttccacttaaccaaaccagcctgaaggtgaacctcgaaacttgtttcataaatctttcaaaagttgttttacatcaatgttaaaatttcaaaatgctgcagggtaatttaatgtataaaatattagtaagaaaaagtatgtattgcatacttagtagaatagatcacaacatacaaattcaattcagtgcatgctttaggtgttaagcatgagattgtacatgtttactgttaggtccttgcatctgtggtgctaggtgagtatgagaagatgtcaaggactggacgtattttgttgcctaaaaaaaaaaggctgtttgtaggcgttttaaatatgcttattttgtgtgtctctcactacctattacacactgttgctttgtgggtttgttttgtatgtgcgtgtgttatacagtagttaaatttccatgcagaaaaataaatgtcctgaattttcata

SEQ ID NO: 12607 - DNA, 1222 bp, Homo sapiens
tttatattttaagctaagtggaataatacaacgtaactaaaacatggcgggtaccgaaaggagggcaattcatggaagaaatttcctctgttcattccgttctcttcaacctaagcaatatggatgtgtgagtgtgtgatttattatggtaccaaaaatgtccaccttctttcctgcagcggaataagcttttttgaaatgctgaggttttattttaatagttgacaacctgggaaagttctgagtatttattttactgctcttttttgtgcatagaaaggtttagtagggtacttttttgcattaatttgccaatactcttattctttgttctaaataaagtgactagaatttttgtgtactattcaattaaaggaaacaaatgtcttttccccctctatggtcttatggatacacatttgcacacacacacatatgtatatagatgttggtatatatacacacatatatttatatatacacagatatatacatacacatgcaagtggagacatagattgtaccacctgtatgaatatgtatgtacacatggggacagaaagagtgtgcagtctatttgaactgtatcaaagtcttgtgcaggacttagaccaattctcattgtattagtgtcattccttgtcaaatgtccctaaagtgcctttcttgattattaatgctgaagaactctgtcatgattagatggttaccctttctaagctctgaaaaactctaatcatttgatcatgtgctgtagcaaagaaagtgtttagaatcagccaaggctcttgttcatttgagagattgagtcttgctcactggaacatggtcatcgtttgcgttgctcctgtcatagaataggcctgtatcatacagcaaggaacatctcagaaaaaaaattttttttccaaatagcatgtgctatgccaatgtgattactaagtacaattttgagtcctttatcctaattgctattaaagaataaaaatgtcggccgggcacagtggctcatgcctgtaatcccaacactttgggaggcccaggcaggcggatcacctgaggtcaggggttcaagatcagcctgacaaacatgttgaaaccccatctctactaaaaattagaaaattagccatgcgtggtggctaacgcctgtaatcccagctacttgggaggctgaggcaggagaaccgcttgaacccgggaggcagaggttgcagtgagc

SEQ ID NO: 12608 - DNA, 1153 bp, Homo sapiens
atatttattaatcatttcttctgcactagatactgtaaaccacccacaagaaccgtagggcgccgcacgcaccttggagggggcccttctgccggccacccgcctcagagggtttcaggccagggcctgaggtggctccggccccctcgcggctacgtcggctgcgcggtcatcctatcttgttcgtttctcccctttccccgcccacccccgggccttggctcccggctgcgggccaggagaagagagcgccgcgtacccgctgcttcccaaaacccactgagcctgatgcgcgcgcctccgctgtgccaggggcgccgggaagcccgacgacgacggtgtcgtaaaagcgtcgcgaaggcgtccgcccttggcggcttcctgccacctgtataagtggagtgtgctggggtgtgtaaagtagtatggaggcagcggtagcccagtgtctgagtggttgccgggtctccatggagaagcggctcgccagtgtcccaggctgctgagctctcgccgcccgagaccccgcggcgcggccgcagggccatgctagccttgcgcgtggcgcgcggctcgtggggggccctgcgcggcgccgcttgggctccgggaacgcggccgagtaagcgacgcgcctgctgggccctgctgccgcccgtgccctgctgcttgggctgcctggccgaacgctggaggctgcgtccggccgctcttggcttgcggctgcccgggatcggccagcggaaccactgttcgggcgcggggaaggcggctcccaggccagcggccggagcgggcgccgctgccgaagccccgggcggccagtggggcccggcgagcacccccagcctggtacgtaccgatgaggcggcggcgggccggccctgggctggggtcgccgcccctgcactcaggtaacaagctctgggtggtgcagctcggacgcttccgtttcctaacttttagactcttccctgaaaagaagttactggcaggtcattcggtcgggatgaatttcagggtcaccagcggggtccacctacggtctctgtggtcaagttagaaatcctctcatcccccttctatctgcacccgttgctggaagggccgcctctgcatattgcattgataaaggtagccttcgcttgtctta

SEQ ID NO: 12609 - DNA, 1231 bp, Homo sapiens
cggcgctggtccactggtgtgcccccaactcggtagtgcatgggtaccagatccgctactctgcggagggctgggcggggaaccagtcggtggtgggggtcatctacgccacggcccggcagcaccctctgtacgggctgtcgccgggcaccacctaccgcgtgtgcgtgctggcggccaacagggcgggcttgagccagccacggtcttcgggctggaggagcccgtgcgccgccttcaccaccaagcccagcttcgcgctcctgctctctgggctgtgcgccgccagcggcctgttgctcgccagcaccgtggtgctgtccgcatgtctctgcaggcggggccagacgctgggcctgcagcgctgcgacacgcacctggtggcctacaaaaacccggcctttgatgattacccgctggggctccagaccgtcagttagcccagcttctgggataacgcgtctcatcgaactggatctgagcgcaaaaaggaagacacagacggtcaaaaacgaccccatccgctcctagggtttctaattcccgtgaagccagaatgccttgagcacacatggaacttgccacactgagtgtctgggtccaaggaactgctgccctcccttccttctacttaactctgttcccagaaacctgatggtcaatgccagatcgctccccactgccgccaggccttcttgtgtgttgttggttcatttgcggttttcagcagtcagtgcctctctatccagtagaatagtgtatggacgtaggaagggatgaaacagagaagttgcataacccagcctctttgatcatgttagaaatcacatcctcaggtctttccagcggaagctccttcatggtcaagctctaagacacaacgagctctgttattcaagaaatcaattccagtggatttccagttccaattcctgagaactagggtaagggggagagctaatggttgcttcctaaggccttctgggtttattagttccatttcaggacatgacaagaaaatgtactcccggctttacagttaaaaccagttttctgggaacatttgtcaaacacagggaaaggctgtccttttaagttagtgtttactgcatttcacctaagactaaatggacaaatgaattataaattcattttttaggaggcataataaactttggaaatattttttcttaattagagggaagaaatgagcaaaagagaacccgaggct

SEQ ID NO: 12610 - DNA, 1863 bp, Homo sapiens
tgaaataatttaaactttatatgaacatttcgataagagtttgtggattttttctgtagataatatatttgatccggaactcaagtgcatggaaacatgattttgatttttaaaatctaaaaaaaaaaaaaattaaaatcatgcttccctctattgcagtatcagttatttagtcacagaatggtattttatgtaaattaaaattaggtgaatgcaatgcaggtaactggttttggaatgggaatgtgcagtgctttatgtttggggagttggagcagggtatcttttcatcaattagaaggaaagtttgaaacttctgattacctttatgttggtttctcttattatttgtctcttgctagatctgctaaaccaacccagcttgctcagagatctcatattgaagcaacatacaggcaatccacatctttctttccctttgaagtatagtcattggatgggatgagggacagggcctgttgggttcacagggccttgcactgcatgggcacatacttaaaagctcttgtgcatggaatccctgtctgttagccacaggcctctttagctctatacattcaaaataactactgtagtagaaaatagataagcttcagctgagttggcttttgatagtggaaaaaaaacaaaatttgactttttatggccaaaattccttgttgacagctgtgatgttctaatatgatttgggaatatgtcagtctacagaacctgcatcctgtaaaaacacctttggggtagacgataaaagtcatttttaaggcaaatacttaccatgtgactttttattaccaaatgcatcagtagtggagctggtatgttgtttcataggatggaaacattagaagtccagagaaaaataaattttaaaaaaaggtggaaaagttacggcaaacctgagatttcagcataaaatctttagtatgaagtgagagaaagaagagggaggctggttctgttgctcgtatcaataggttatctgtgtccctcatcttggtgttacagtgttatttctgtcagtattatgaatatgtggttgacccatcctgtcaaatgtaccaacattttcgaaagaattcattcaaatctcttatgccaacagaaaagttccttcttgtttaatatctctttacctcagtcctacattttgattctctggaggagattttagcttgtcttaaaaagccaaatttggagtcatcaagcctgctgaacctgatggggcagctttttgaacagctttctggaagtaagaacttcagttgaaaagccctttgatcgcttcagcccgggacatgcccttcagatggcttattctcagtaaagctttatgtagactgtgacactgtatatgtgtgactcgtacaactttgacgtgtttctgaagtggtttaatcgtatttgttattagcttctttgtggaaatgcaatttttatactaaaaacattgcttatttgcaatgcaatatgttataaatttgttgtttatattactggtattagtcttagcctaatgaacctaattatttttctttctgtattctttgcttcctcaaatagcatctgcagcaattggaatgagaaatccagatatgtgtttcaagtagtacattgcctgaatcacaaatcacttgatcacagtattgtatataatccctgatcctatttgtttcattttattgtaaattcccatttgcatcaaaacctaatgatagtgattggtaagtaaaaacaaatggtgtattgcttttcatacaagtgttttcacaaaagccatttgcctaggcagcaaaaaatattaatttgttaaaaaaaattttccttcgtgtccatcctccatct

SEQ ID NO: 12611 - DNA, 1068 bp, Homo sapiens
ttgttgttgatttttttttaagttttctaagcaatatttttcaagccagaagtcctctaagtcttgccagtacaaggtagtcttgtgaagaaaagttgaatactgttttgttttcatctcaaggggttccctgggtcttgaactactttaataataactaaaaaaccacttctgattttccttcagtgatgtgcttttggtgaaagaattaatgaactccagtacctgaaagtgaaagatttgattttgtttccatcttctgtaatcttccaaagaattatatctttgtaaatctctcaatactcaatctactgtaagtacccagggaggctaatttccttaaaaaaaaaaaatctatccatctacttctctcttacctgatttatgtgttagaataaattcatgaaattcgattccaagcatacgaaagatgcctaaagttgattctatgctccttagatccagacagaataatgagtacaggtttatgaaattctaaaagtttctgtcgtctttaaaaaggaacgtgcagtatatttctatctggctgtttagataaccctttccttgtattaattgtgagcacggagctcactggtgggggaggttctgaaactctctgccctcctgtggttgaatgaagatgttgcaagacttgcacaaaggaggttattcttctgacagcatcaacttttagagatggttctttttcatctttccaattcagttacttgacagtctccttccccagtatgctgaagtttgttaagagtcaccagtaattgtgcttttcagacagtagtgcagcttcaaaatcgaggccatcactgggctgatgggctgggagaaccttgccatgtgcctgcctgtttcctgcccccttagtcactgcccatttcctgcccccttggtcgctgacacaccttcacccaaagtgccatggttctgatggtggcagttccatctccctgacatcaggaagcttttctcgatcagagcagagcggggcctgcctgccctcgtgtcactggatttctttctcttataatcagctgaaacagagttctc

SEQ ID NO: 12612 - DNA, 1109 bp, Homo sapiens
gtacaaaacaggagtcctcaacttcactccaaacttgtgtctccttccggtttctaaatcttcatgaaacaagctatccatctgttgagtctaccccatcaatatccttcatttttgttcacttttctccattcctattgccgctagcctgaatttatgtctgcagaatttcctgtcttgattgttccaagaatttttcattcagtctctctatactgtctctttcttatctgtgcctccattcatgtcttctattggctattcagtgagcatcaggtactttaacagtgagatcttgctctcaggagtttacagtttactggaggagacaaatagacactactttataagtttacatctttgcccgttgactccattctccaaaccagctaaagtaatttgcacaaaacaaatcttattatagcattacctctaagatacttcaacagctccctgttgctatcaggattaatttgttttcctaatttgccaaatgtaagccatccctggcctgacccctgtgatgaagttttaactcctttatttgcatcacctatactaggctgtgttgaaatccaagaacataaagcctgctgcactgtggacactgtggctttgcactatgactttgcactcaatccccttcttcaactggctgactcctacaggcctttagagacttcatacagttgtcatcttcctgtaaagccttccttgatttccactccagtccagattgggtgccctactttagtcctcctgttgaacagtttgcaaattttagccacagcatgactctcttgggaaatggaacaatctggtgcatattagtgactaagttgatgtctcttaaatgaataaataaccaaatgccattattgcaaagcctgcagattgggtaaattaggaaaacaatctgatgattaagcaaaaaaaaaaaaaaagccaaagtttagtaaaccgaagccatctgcagacctattaaagaaaaaagtatttcatgattatttacactggtcattgaaaagtagcagaataatcaatttggaaatatgataagtaatttgaaaattctatatccattatttctggtaacagaaatcctgata

SEQ ID NO: 12613 - DNA, 1190 bp, Homo sapiens
tgtgataaaattatctacacacagtcaaagcaacgtgtcaatctgtagaaactaaatcaaacagtttgtggtatggtctaaagataaagcaagtggtctaccctcttctcaagtggttctcctggcactgtgtaaaccagtccccaaaatttaatgtgtataaaaacttcctggagatcttgttaaaatgaagattttaactgattcaatagatctggggtagactccaagattctacgtttctaagaaggtcccaggcaatgctgatgctgcttgtacatggaccatattttgagtagcaaggatgtggtgacaggatcatatttatgggagaagagaggccagggttgttaagtgccttcagataaggatttcaacacacgtaaggccatgtttctgatgttataggcgaaggagatgcagcagatggtgaaattggaagccgagatggaccgcagaccagcaacagtagtatgaaactccaaaatgcaaactgaagcagcaaacccacaaagcatcaaaagactcactcacaaacttctgaacacaaactccatggatgaaagctgtttattttgtttcctttatgtgtaaacaagatgatatctgaaaccagagagacttggaatgtctgactgacttctatttaacagcttgagtattgcatttccttggccaaacaaaaatagctacaaatccacaaaaatttactattccagtaaggcagagtccaaccattgataatacaacttaaacatgtttgctataaaataccatcacaagtaaatgagcttggtgtgaacaactctcctttgtgatgccttaggacatgtttgaactgcagcaaaaaacaaaaacaaaaaacagtgcattagcaatttcatagcaagtgcatgcactaggaaaagaaaactctgtctacaagtttattagcagaagtggtggtctgctagacaaataattttgcaaaatttttctacatctaagttacctcatcagtaagtgccatgtctctaccatgccatcagaggctaatttcctgtaaaagttgtggaaattgttagaacaatagaaaaatagagcagtgtatgtgtgccaaaactcatcattactcaaaggagaactgtgttaggcacatttaagaaagtttacatctgacattgctttataggaattgtttctgcagattc

SEQ ID NO: 12614 - DNA, 1195 bp, Homo sapiens
catggacttttcttccttttggccagagttgcttcagtagatctgcagccatgacttttcctctgaactccaacttttccttttccttttcctttcccctttcccctttcctttcctttcctttccttttttttctttctttctttctttctttttttgagacggagtctcactctgtcacccaggctggatggagcgcagtggcatgatcttggctcattgcaacctccgtcacctgggttcaagcaattctcctgcctcagcctccctcctgagtagctgggactacagttgcacaccaccacacccagctaatttttatatttttagtagagacagggtttcaccatattggtcaggctggtctcgaactcctaacctcaggtgatccacctgcctcggcctcccaaaatgctggaattacaggcatgagccaccgtgcccagccactgcacaccttatttctattggctttccaaacagcttcacccagaaatctcattgatcctcatctctaaagcttggtttatcttaccaagcctacctaccctctctataccttaggaagctaccactcatgtagtcaacaaagttaaaaaaaattgtcattgtcatcagtcttctctgaacacgtttcattgacaaccaagcctgtctctgattttcatctctaaagtgtcccttgaatatctctctctcttgttagtcctatggctactgatgatccttgccttctcccacttgactttgttaaaagaaaaactttagacaaaataaatataacagtttatttgagcaaataacaattcatgaatcaggcaacactcaaatccacaagagattctgagagctccgttccagcagtatgggcagggggctttcataggctgaatgtggaggcaaagtaaagaaattacttgattggttatagctaggcatttgccttatttggatatggttcaatagaaagtccctagttaatataacgaatttgctagttggttatctgcgattggctgaagctccattcaaaattaatcagtcacaaggaatgcctctaagttaagttttggtttgcttatttatgtaagggttcctagtacagaaacaaccccagactaatggtttcttgcttattttggcttaacagcttgttaatgataggtatgcagtaatttgtgataaagagggaaaa

SEQ ID NO: 12615 - DNA, 1179 bp, Homo sapiens
cttctcattacttgttgcctataagccaaaattaaggtgtttgaaaatagtttattttaaaacaataggatgggcttctgtgcccagaatactgatggaatttttttgtacgacgtcagatgtttaaaacaccttctatagcatcacttaaaacacgttttaaggactgactgaggcagtttgaggattagtttagaacaggtttttttgtttgtttgttttttgtttttctgctttagacttgaaaagagacaggcaggtgatctgctgcagagcagtaagggaacaagttgagctatgacttaacatagccaaaatgtgagtggttgaatatgattaaaaatatcaaattaattgtgtgaacttggaagcacaccaatcttactttgtaaattctgatttcttttcaccattcgtacataatactgaaccacttgtagatttgatttttttttttaatctactgcatttagggagtattctaataagctagttgaatacttgaaccataaaatgtccagtaagatcactgtttagatttgccatagagtacactgcctgccttaagtgaggaaatcaaagtgctattacgaagttcaagatcaaaaaggcttataaaacagagtaatcttgttggttcaccattgagaccgtgaagatactttgtattgtcctattagtgttatatgaacatacaaatgcatctttgatgtgttgttcttggcaataaattttgaaaagtaatatttattaaatttttttgtatgaaaacatggaacagtgtggcctcttctgagcttacgtagttctaccggctttgccatgtgcttctgccaccctgctgagtctgttctggtaatcggggtataataggctctgcctgacagagggatggaggaagaactgaaaggcttttcaaccacaaaactcatctggagttctcaaagacctggggctgctgtgaagctggaactgcgggagccccatctaggggagccttgattcccttgttattcaacagcaagtgtgaatactgcttgaataaacaccactggattaatggcctgtagtgtcgaggtgaattgtttgtgagcaatcaggggaactggccacagcactgaaagggttttaaagggtttggaattggtgttgggaaacgagcagggagatttaatgtct

SEQ ID NO: 12616 - DNA, 1103 bp, Homo sapiens
cattccccatatttaattaggtgtaaacattttagcggtgattaccatgcacattggaaataaaatgtcacaagttccattgctttgaatgcatctgttctacctgataaatttcccttgcctttgcaactctgattagatctactttttgttgtcgtgaagactcattcttttgaaaatagtgctgttacaaattcattttatattgaaccctaaatattcagtactattggccaaggctgaatggaaaaaattgacctatgtatctttctgatgataaatcacattgccctcagtttaggccattaacggacagcccagttggaaaacacatctcgtttaaagttctacacctgctttggagactcttgtaagtatttgttgcctttgtgagagtttttgtcttttaatgccacctaatttcttctactaatctgttttttttgaaagtggcggtcttgcctacccatcaccagcaaacatactctatagtgagggactaattttggccctctgctatgatgttgtactttaggtctctgtggatagagaaggacttctaatgtagactgccacctattttcatacctttgttcatggagaatgtagcaaaaagtcaaatataataaagtccacctactttttttttttttttttttgagacagagtgtggctctgtcgcccaggctggagtgcagcggcgacatctcgactcactgcaagctctgccttctgggttcacgcctttctcccgcctcagcctcccgagtagctgggactataggtgcccgccaccatgcccagctaattttgtttttgtatttttagtagagatggggtttcaccatgttagccaggatggtctcgatatcctgacctcgtgatctgcctgcctcagcctcccaaagtgctgggattacaggcttgagccaccgcacccggccaaagtccatctacaaatttaatgtgttgttggagaatgatctatattcctagaaaacctggaaattggtacaattcttaattgaggttatatcaggtgacttttcccaaaatcttattttcaatagaaaaaaatggtgagaagctacaaaagtccctcc

SEQ ID NO: 12617 - DNA, 1261 bp, Homo sapiens
aagtagacagtggttgtgtttggctctcgttttattccttttacatttgttgcttctgggatttaaaaaattactaaattcataagatagttaggtattaaacacttcagaatatcaatgtaaaattggaaaataaggaactgggggcatttgtttaggccatgacttctacaagcagatttcttttcttttagtttagaagacaaaaaatttcaatacagatacttcttttagaagtaaatttttagattttattgtcagtagaaaaaagttaaactcctactaatttaaactaagacagtttaaaaaggaagcctgaaaaagactcatactacaaataatttaattgatggcatataagaatatgcagtttgaaaaagccaaactcttctctccacttagcttttgatccccactgtttgcttatttgtataagtcatactgtgtagaatttctattttctttttccccattaaaagaggaccaaacaattctttatacaaatggagtagcaactagttttgtagcactacatttaatgtaatgagatacctttgttcatttttttaaatttgaaatatactttacctgatccactttgattgtatactatattctttgttaattttaattttgtcctgttcctagactgctagaatctggcccctggccatcttaaagtgccaacatatgcctgcagggtttataaaaaatggcctggagtgacacattttattatacctaatattcactgcatcagtatcacatctagctcccttacttgtccacagataatgtaaacaaaggagggaaaaacttattaaattctccttcgctgctggcttgtgctggtttagtgcctgtgtccctggcagtgtccagtgtgttcacttccagttgaagtatccatgtgtttctgggcagcttttctgctcagtgtgatcctgagatggcttccccgccgccacccagagtgtggtccttggccgcctcctgctcctgctctgcaagcctgaaactggcttgtctggagccaggagttagtcctggggtgtgtgtgtgcctgcgcacccatgcgcatgcaagtgtgtttgccagctcaggagctgtctcctctctacctggctagtaagaggtgggacagtaatggtcctcctgctggccccagcaaggcccatgagtgactgccctgacgtattcactgtgcctctgggccacttcttcccctgtagatgtgggcttgttgccttcagccggcttc

SEQ ID NO: 12618 - DNA, 1201 bp, Homo sapiens
acctttagtctgtgtagtttatattacaaaataatatgatacatcttgatttagaatttacattatagtatccaaaatgtttttgtcaaatgtatgcttttatcctcagattctggcatgcccctgtgactgagagtcacttctttttaagtatggagagtattaacagtgggaggagaaatgattagtttgagatttagtgttctgtataaaatatgaattgtcaggatatttgaaccaaactgggtcatacaatttctgtggctattttgaattgccttacaatgaatgaagcttactaaattccttgtacttttcatttaataactagattttattgttttaatttgaataatattaagtgagccatattaccaattaacctgaatataaacacttgcttgtttttaatctgagtagtttatgtcttaaagtatggaatggaactagtggtcaatttttattaatctaagtgtctcccatacttctttaagcttttggaaagtttgagaagttgtgattttgcaatgaataatctctccccttggtttcataggcaattgaaaagctgcaggccggtgctcttgcaactgacgcagtcactgcagcactggtggaacttgaggtatttcttttctctgttttatttaaaatatttgtgagtttatctttattgttcttaaatgacatgaaattgttgagttagtcaaccataaattatatgagcagtgtttcccaccaatattagcaaagttatgaagaagcctatgatattgttgttttcattggtgacttttctgagtaatataaaagctggttaaattcctttcttttcttttttttttgtgagattcatgaatacaaaagttaaggattggatacttaagtttcccattttcagtaggaaaatccttgaagttaacccccaaaaagtgatgtatattctgttgtttaaaaataaaagaaaaattccaactgtctagaagtgcctaaagtagaaggggaagattcttcacgaacctaacagttagatatataccctgaaattgtgtgctgtgaagtgtgccttgtcccagtgttatggttaggtttgtccccagtttactgtggacatcgaataattgagtggggaggctctcacgtttgccataattttttatactctagagtgaggttctctcagttctcttgatttggaacc

SEQ ID NO: 12619 - DNA, 1187 bp, Homo sapiens
gacagagcttactttgttgcccaggctggagtgtagtggtgcgatctcggctcactgcaacttctgcctcctgagttcagtgattcttctgcctcagcctcctgcgtagctgggattacaggtgtgtgccaccacaccagctaaattttttgtatttttagtagagatgaggtttcaccatgttggtcaggctggtctcgaactcctgacctcaggtgatccacccgcctcagcctcccaaagtgctgggattacaggtgtaagccactgcgctcgcccctaagcaggtactatcagtggacagagagatttaaattctaacctttttatattacccaattaaataattttatccgacttcaatgggaataagaaaaaataattttaataaatagctttgataccttttttgtattgctcaattaaataacttaaaaataggatttttgaacattatctttgcatgaatttgtgtaagtaacttatgtgttggtggaaagaaatgtataccatctttgcctgttttcctttagggtaattcctctcctgcaattacttttggatggaagtatgcccctttctcagtagaagatggtaatcttggagaatgaccatggagaaggggatgagttctggagaagggctgccttccagatcatctcaggtttcggctggtaaaataacagccaaagagttggaaacaaagcagtcctataaagagaaacgaggaggctttgtgttggtgcatgcaggtaagctttgtggatggcttggaagatgccaataatgttgatttttctttttctgccttgaagtacactgagaatcacatttcacacttggaggaggcaaaactgccagagaggaattggaagcaaagcgattgtttgacttggatatagtgaggacctccctctttactccccagttagaagatcttagaatggcagctcttcctaggttttcacttccctaacctattatttactttaactctatgtaatagatgtatttaggttaggtagtattaaaaccagacaaagtaatttttgaactctggtttatgttttttaaaaataatgttgctgtgggaggctgaggcaggagaattgcttgaacccaggaggtggaggttgcagtgagccgacatcatgccactgcgctccagcctgggcaacaaaccgaga

SEQ ID NO: 12620 - DNA, 1136 bp, Homo sapiens
tataaaaggagatacacctataatgcatatttgctataaagattaaagggcggctgggcgcagtggctcatgcctgtaatcccagcaatttgggaggctgaggtgggtggatcatctgaggttaggagttcgggaccggcctgtccaacatggtgaaaccccatctctacaaaaaatacaaaattagctgggtgtagtggcacatgcccgtaatcccagctactcgggaggcggaggcaggagaattgcttgaacctgggaggcggaggttgcagggagccgagactgagccattgcactccagcctgggcaacaatagcaaaactccatctcagaaaaaaaaaaaaaaaaaaaaaaaaaaagattaaagggcatcatgtatgtaaagagtacagaggagggcacatagcaagcactcagtaccttataacttttattattctttttcagcttaaaaaattatatgtctacattgaattcatatttattcatgaatgaatacatacgatgttttctgtgtgccaggtcctgttctaagcatgtttcaaatattgtctttatttgatctgtatggtatcctgtaaggtgaggacttaaaatattcccaatgtgaaattgtgaaattgaggcacagacaatctaaaaacttgcccaaggtcacattgctggtaagccactaagccagatactttgaaaatagtattagcatttatattatataaaatctcttttagtttccctttttttcctaatagtgcaagtttattcaccatgtttttagtttttctcaggaagatttaaagaagtgttaggtggtggccttggtgcttcagtggctatcaggtcagccagaggtgactcgtttttgtcaccagggtgtgctgtgattccaccagtctgaacttactgcagctgctgtgaagctggatgggaatctctttattgtctttgctgctgcttagcgaccacaggtttttcagcttggcgctttaccatcacctgggcaactgcctgagatcccaagttattttctttttgtgttgtaccatcctttcctgctcatttgtgtcctcgtgtaaatgaaggagctagcatgtctggcttgttagcagagtgcctagatgcccgagctgtat

SEQ ID NO: 12621 - DNA, 1866 bp, Homo sapiens
ctttcagtgaatgctgtttgtgaggcccatctatcttgatgcatgtagttacaattattttttctcgttactgtgtagtattccgtgtttgtatataccccagtttatccagattagaactggtcttttaaaagtttggttatcttagagaaagaggtaaactgctgccataattgtaaatagaagtgttgttttttctctctaggcataaaacatgaatgtcaagcaaatggaccagaagatctcaatcgggcttgtattgctgaaaagttaggtggatccttaattgtagcctttgaaggatgccctgtgtagattattcagtgccacaaattgaaagcttccatgtttaatgttatcctcttgctatataaataaagcaaatatatttaggccagggtctcactgagggggagctgtcttgtcatcttttagagtaaactattctataaacatatgcaaacagccctaaataaatctaaagtctaaagttttattgatgtgaaattaaattcttattggccaaatgcctgttttgatgagttgatttataaagatttttgttaagctcaggattttaaattacacagttcacaaacagtaaaggccatgtgaagagaattattacatctttattaacctcagcatttactttgtttcttttgcttaggaaattgctcataatctggttataattttggtccaaattctttattcttccttgagctaagcagaataatggaatataatatgtcttcataatataacaacactaatacactaatagtaagattaagttaggcagtcttctaccaaatgtgtaatggagattgcctcaaaattgtgtccacataatccacgctcatcttgcaaagcgctatttcaggcacatcattggaatacaggaagtagccctgcacctgccagtgagctcgccattcactgattggaagagtgacctggcatcttggaaatcattgtgtgtcttcaggagaatgtgcagtgtcttgtaacaactaattataatgcaaattagggctacattgtaatctgctttgttaatgaaaatgataaaacagaatattgacaagctaggacacctgtggtatctttaattgtatctccttcagaagtttgcttcttatggtataataaagtatggaagaatattgagtatatgtttactctgggcctgggagaacttaactttctagagcagtttgttgacttgtgtgcaatggggagaggtaccatgatgacactcacagggagccactgttcactgacacttggaagcggtcattgttaatatcacgggcgtaacactttgaacgatatagagatgcacaaacagttgaacttagaagtagcagtattggctttatgtaataaaggaagcatttttgacttacctctcgtgtaattttcatgtgtgaattgggaatacaggattttgccttccatatggggtaaggcattgaggtttgggtatttccaataattaagagttaaggttggctgagtgtggtggctcactcctgtaatcccagcattttgggaggccgaggcaagaggatagtttgaggccaggagtttgacaatcagcgtgggcaacatagtgggatctcatctactaaaaataaacaaaattagccgggtgtggtggtgcacgtcagtagtcccagctactttggatgctgaggtgggaggatcacttgagcccaggaggtgagctgagatcgtgccactgtactccagcctggatgacagagcaagaccttgtctcaaaaaaaaaaaaaaaagtcacaactccctctggtgaataagaaagttggtgtaaaagttgggaacgttttcaatgtttat

SEQ ID NO: 12622 - DNA, 1189 bp, Homo sapiens
gtttaggaggctggtttccatgcctttatccctcgtgcaattctctaaggtggatttgaatttttacctgtttgacagaagcagaaagcaaagctcagacttcccagaagtcatgcacatgaccagcagatggcagagcggccggtgtgggcagcccctcccgaggcccccgccctgcccggcaggtgcccctgtgcccttctcgccggcagttgcacagagaggtgtacacggagatcaagtcagatactttttcttttgaacctaactcagtttctcagggtctgaagctctgaagaaaactctctggggcttatgaccctttattcactttctgtggaagttcttcaaacccaactttttcttttcttcttctttttttaaagaagaacaaaaacatcccctagggaagcgagccaagtatcagtgtgagaagctgctagatgacactcttccagaaatctcttttcagccacttgaaaacgtgttgaggctgggactccggtcactgcccccagacggctgtggtcagacagcctgggattaaaaatcccctgccgttttctgcaggcattaggtagagtcctaattgctgtttaaactgtattctccttgggccagcctgtgtgccttgggaagggccttgcccagaggtcctccaggaattgtcgttcttttaaaaatattgtgatgtgggttttttttaactccaggtataaaattggttttgttgaaatttggaggaaaaaacaaaactttaaagaggaaaacagttcttcaatctataggatattttaaattccattagataccattaaatataccagtccccaagtttgtagccgattacgtttttctccaactaaaggaaaaggactgattgaaaggccctgaattgggttgttcttgacattatttgtactgagctccattgcccttaaagctgcggatgtgaccgttcgtggcatttggggtcaagtgcagctgcgcctccttggcctgcttcctgtcaggagcgctgagcagcgcttgggcaaggccgggctctgtggcctgagctgggcctggagtccactgtttgtgcactgcccagggcctgcctcagctgtgggcagatgagcaatgagtgagagcaggagtcgcagtttgcctccaggagcatttggtagatcttcatttcctccagggt

SEQ ID NO: 12623 - DNA, 1363 bp, Homo sapiens
ctttttgagacagggtctcagggtctcggcctgctcccaggctcgagttcagtggtctgatcgtagttcactgcagactcaaaatcctgagctcaagtgatcttcccacctcagcctcccagagtgttaggagtaaaggcataggccaccgagcctaggtgattttttttaaggctttgctgtgttgcccaggcttgtctcaaactcctggccgcgggcgatcctcctgcctcagcctcccaaagtgctgggattacagacaagaacctctctgcctggctgggtttcttttattcatttgttggacctgctttcttggtagcagtggtgtattgattcccagtaggatttatctgccaggagatccttacagatcattagttcagctgttttgctttgtgaattcatttgaaagtattataatttcggtacttagtaattagatggatttcttgacatgcattagatatttaaggcagtaatttaactctggttccatgttgattccattagtacatgggcttgcagccttgtgaaatgatgattcagtttatccattcgctgagtgcgctgcactgaccttcttccaagcctcagttcctgttctaggaacttgaggctatgtagcctgaaaatgccctgcagtctgcagtgttctactgtgaactgcttgtgtgttggcaggctaccggtaagaatggttggtgtcagcagggacggggccctctgagacccatctcacaaagatgagtggtgaaaatctgatcacttgctgcagccctttagttttttattaagccgatgcctgagtagctttaatagctattagctatgttagtagactgagatcttctgttagaagtctttagttctgttttccttgggggactaagaaattatattgcaggcctgaattacaggaaggggagaaccaatggctagggaatgagagccaatacctgtaaaagcagagttgggctgggcgcggtggctcacgcctataatcccaggactttgggaggctgaggcgggcagatcacgaggtcaggagttagagaccagcctgaccaacatggtgaaaccctgtctctactaaaaatacaaaaattagctgggtggggtggtgggcgcctgtaatcccagctactcaggaggctgaggcaggagtatctgggagaattgaaccccgggggtggaggtcgcggtgagctgagactgtgccactgcactccagcctgggcaacagagtgagactccgtctcaaaaaaaaaaaaaaaaaagcagagttaatatattgcttatagttagttgaaccagttgtttctcacacaccagtgccataatctaaagctgagattgaaca

SEQ ID NO: 12624 - DNA, 1244 bp, Homo sapiens
gaaagggctctgtccaaacatgtcgaaaaagttcacaattttgatgtgcaatatcattctgatgcagctttcgctttgatggttgttttctctccaataggaatacaaacataaaggccttcgaccgttgcaaatagactaaagtgaaaacaaatctgaatgaagatgaagttatttcagaccatttgcaggcagctcaggagttcaaagttttctgtggaatcagctgcccttgtggctttctctacttcctcttactcatgtggccggaagaaaaaagtgaacccatatgaagaagtggaccaagaaaaatactctaatttagttcagtctgtcttgtcatccagaggcgtcgcccagaccccgggatcggtggaggaagatgctttgctctgtggacccgtgagcaagcataagctgccaaaccaaggtgaggacagacgagtgccacaaaactggtttcctatcttcaatccagagagaagtgataaaccaaatgcaagtgatccttcagttcctttgaaaatccccttgcaaaggaatgtgataccaagtgtgacccgagtccttcagcagaccatgacaaaacaacaggttttcttgttggagaggtggaaacagcggatgattctggaactgggagaagatggctttaaagaatacacttcaagtaattatctcaattctgattctatatgtttgctatgttttctataatagagagcaacggtgtcaaaagaatgaggtttggttttgtttttttaacttactagcaaggaactcccttcagatagtaattaacattaaatagcactttatgtgtattaactcacttgatcctcatggtagtcctgtggagtatagatactgttatccacattttacagatgaaactaaaatagatcaaatatttgactaaataatacataaaattcacttgttttataagctaccaacaatattagaattgcttgttttccttgattattgaaaaaagtcacctggtaacagaattctagttgtttgctagataattctgtttagaatccagtaaatacccactgtcctacttattagcgtaaactgactcgtaaatttaaagaccttgaagcagaccagaacacatgacctatatttagaccttggtaaacataatcagaggttcttcataaggatctgaggataaatacactttaaccttcaacttctaatttactaacttggacaagtgaggagaatagctt

SEQ ID NO: 12625 - DNA, 1104 bp, Homo sapiens
aaatttggtcttaggggttgtcacttaaaaataactaatgtaatttttggccgggcacggtggctcatgcctgtagtctcagcactttgggaggccaaggctggcagatcacgaggtcaggagttcgagaccagcctcaccaatatggtgaaaccccatctctactaaaagtagaaaaattagccaggcacggtggcgggcgcctgtaatcccagctactcaggaggctgaggcaggagaatcacttgaccccaggaggcagaggttgcagtgagccaatatcgcccactacactccagcctgggcgacagagggagactccatccaaaaaaaaaaaaaagaaaaaaaaatgtcatttttaattgtattgtttcagggcgttttagagtatttgtttttcagtgttagctttgtttgtgtttcccccctccccttttccctgattttcttttcagacgtctttttacaagggaaacggttccacgaagccttggaaagcatactttcaccccaggaaaccttaaaagagagagatgaaaatctcctcaagtctggttacattgaaagtgtccagcatattctgaaagatgtcagtggagtgcgagctcttgaaagtgctgttcaacatgaaaccttaaactatataggtctgctggactgtgtggctgagtatcagtaagtatgagattggaggtgaattaatacagcgtaggacagatggtgcctgtcaaaggtgtgcctgtaggtactgtagcctctgtctgtttaatgtccagacctttgtgctaggtaaaagaattgggtggggcggggttgagaacaggtacaaggagaagagccacgtaacctttgtcatccagtactccaaaatcaaattgtttgctggagaaaggtatattctttgtttgtttgttttgttttgagacggagtgtcacccaagctggagtgcagtggtgcaatcttggctcactgcaacctccgtctcccaggttcaagcggttctcctgcctcagcctcctgagtagctgggactacaggcatgcaccaccgcacctggctaatttttgtatttttagtagagacagggtttcaccatgttggcc

SEQ ID NO: 12626 - DNA, 1203 bp, Homo sapiens
tataaagacctagacttcggcacgcgaaatcccagctatgctacctcttatttacctgaaaggaggacacgcaggatgggcagtcatgctggtgactcttgtactcccttgagggacattgggggggggggggcgtggtcccaggcaggatgcccagtctttgagctgagattggaaggcagtgaggctgagggtgccaagatttccccagggttcacccagaggggaaggggctacatgcccccagctgtgtgcagggaggacacatcagcccactaccgctgccaacaccaatgcctaaaacttgtttcatacattggggttttctatatatttcagctgggaaaagcttacatttaaccttttgaaaaaataaatacgtgattagcctcaactaaacattgctgactataaagacagtatattcaccatgtcgctggcaatatgtcattgcgtaacaccaaataaccccccagaagtagccagaggccagtttgaacatcacaattctaagtgttttagtaactatttctggcgtgagtcaacagatcatgtagatagagtcaattattgtttgtggagtttttcagctataggggaggggaactattaaaatccatttgtttctattcaataggtaataaaaattagttgtccctgggtttgggaaacttaaatgcccattacagccctggggaagggttttctgtcttatggagtgagtcttagcatttaagttatacagttgctgccttaaaatagtagcctgctacaatgacttctttgggtagccattttcataagaaataaaatacaagatatgagtaatgaagctttggttttgtttactttgtgtgtttataggataattttataaacctggaaattgtttgcactttttttataattcagaattttacaagcccaatagctttggtgagagttctgtgtaagtgcataaaagaaagcgtcctcggctgggcgcagtggctcacgcctgaaatcccagcactttgggaggccgaggcgggcggatcacaaggtcaggagatcgagaccatcctgggtaacacggtgaaaccccgtctctactaaaaatacaaaaaattagctgggcgtcgtggcgggcgcctgtagtcccaggtgctccggaggctgaggcaggagaatggcgtatacccggaaggcggagcttgcagtgag

SEQ ID NO: 12627 - DNA, 1430 bp, Homo sapiens
cacaaattcactgactgtggccactttcagaacacagagtttcatgaactgattactgttgtaaagtctttgctgaaagtaccagcatagactgtatgatttctgctattttgcatcccaatataggagtagaataatatctactatcagctgattactagacacatagaacatccagttaagttccgtaagtgcctgaaaaacaaacacaagtttcaacattcaatctaagttacaaatagcacttccattttccatagactctaaaactccccaaattgctatgaactaccacagtattttcctcatttgataagaaacataaggacagcttaactacccttctctatccgaagtgagtcagaaacagaacccaggtttcttgattcccactcctgagtaaaattaaataggttttatgtatgttgcaggtattgcacacttttcctctttgaaatcaaacttttctatttcactggggaaagaaaacatgactgaaagtccagagtgttagcttagagctcaaaatactagctgctgtttcaagctggccccagacattaaactcagactagggccttcacctctgacacttgcccctaagtccttcagacatgttgagagagactgagacaggagtcttccggagtcaggcaggaaggagaagcacagcaatatacattcataatatacgtacaactgactagatttgtttgagacaagagtggtgggatcagagccatgtggagagctcatggcctgtctaaattgttgccatgtggaaatggggcagagtgttgccaattttctgattttttgtgtggaaaaaaatctccaaattgtagtttttaaatttggggaatgcaaatatatatatatatacacacacacacacacacatacacatacaatccatatacatatggagtatgtaagttggcaataacagtatacatcaaaaaatttacaaacactgcaagacaaataaaatccaagccatccatttgtgaccacagtcataagcattcacttagccaggggcttttagataattgtctgtgaagtctgagaaaagactaagataaccaagatgaacataatgtcaaaggacgaaatcatggggacaatttggattttgttccaaaagacaagtgtttttaaaaagaacctttccatacttcgtgttctgttctatagagttaaaccttttaacttccatggccctttagatctctttcaagcacattccattttcttctgatcatacttcctcagaaaacctttttttggctgggtgtggtggctcatgcctgtaatcccagcactgtgggaggctgaggtggttgtattgcttgaggccaggtgtttgaggccagccagggcaacacagcaagaccccatctctacaaaatattaaaacattagctagg

SEQ ID NO: 12628 - DNA, 1195 bp, Homo sapiens
ttgataacctttttcttttgtaatataagcatttaatgctgtgaatttccctctaagccctgccttaggtgaatataacaaattatgatatgttgtgttttcatttacttcaaagtattttctattttgcctggtgacttctctttgatgcaaaagccatttagaagtgtgttcagatatttgccttggtgtcttttgctctaagaatggagttttaatgaactggagactctttgaggagaaggtatttgggtttgtacatggcaacatggcaggtttttcagtgaagtgatgcactgatgctggtgtcactgtatgagcttgaaaacatatcttcagctgcttagttactcttatatgcctatgctaatagaatctgaaggcaaacattggaatccttcttaataacgtgtcttctttggtctttttagtgtgttatcattgggcagaactggatcctgaaaaattcaagatgctaagcacctacactactttaagaatttggaactgaaacatgaagaggaagacagaaataagaatttgggaacctgaatagctctgcaaaaaacaccaaaggaccgttttatcgttttctgttgttgctgtggtggagtgatgcagtgggcactgccggtgggccagggggcgggtgcgcatgtggtagaaggtgtgcgctcgtgcctcccccacagaaaggctttgttggtttctaccacatcttggcttgcttttggaacaggctggcccagcatcatttgtcatcaagtccactgtggtgtattctgcgtgtccatggcgggggttctccaatacactcacactgtccatgttctttttattgccagggcccgtgttgaagtgtcaagagagcaatcatcaatgataatgtattgtgtgagacctttgcatcttgtaaattttctcttttttctaaaaataaataataataaaatcctaaatctcaacaaaccactttattatcaaacaaattctgctctgtttctgcataacgatgatgtccatagaaatgcaatgcgtctgacctctctctatgcgtatctacacttcttttcacataagtctctcgcaagagggccttctctaactggcccacacaggctcctgagtccaggtgggagcctgtctagccagtttacaattgatgacatggtacttggaagtgagatgtcaggaa

SEQ ID NO: 12629 - DNA, 1143 bp, Homo sapiens
gatgaacccactgacacgtgggcactggtgtggctgctctgggcagatgacagcaggaaaagattctgcgctttcagggagggggcagagggcagcttgcttctgcaccccaagttgtttcttctcatttatgaacccaagcatgattcacaaaggggctggcaaaacaattgtctaattgaggaatctgatctgcattgattttgctagttccttttatgttaggatttatggtttactcaaaaatttcatcatcatggaaattggctttccccggggtcttttgcccaggagaagttttacctcagttgtccagtgttttcccacatggtacctgacgcccgctaactaagcagaggctctcctcaccacgcagaggcgcttcaggtcatgacagtgatgcccctatcttagaacactcagaagattccagaaatacagggtcctgtccttgcataagttcctgcaggacaggaagtgtcccaaggctcaaaacaacacagaccacatccacacaaaaggcgcatgccggcttcaggcgctaggctgagacgggtaccccccgaatggccttgtgcctccaaaagcctcacgctgcaactttgctgctcctgtctgttgcccagagaggcctcacacaggcctcagaaatgtttcttgtcacacaaagcttttggtagccgattccaagcgagggatttaatccttacatttttgcccatttggctccaaggaaggcttattagacctgtttttttgttgttgttgtttttttttcttaaaaacaaaatgaatgaatgaatgaaaagagaagcaatggtgagccctctcctgctggggcgccctgggtgggccttgcccgtcctgcagcagagaaatcagtcagcagcgaagagctgctggcgcaggccccaggctgtgtcctggacccttgacctgcctcagagctagaggtttgctccaccccgcacttcacttgggaagtaaatccaagaagcttaccagagtccatcgccactgcgcaggctttgttctcacagcggccaggtacagagcaacgccctgcagtgggaagggacagcagcacgagagacgcagcccctaactcagggcttatgatgggtgggctggtcctgggaaagg

SEQ ID NO: 12630 - DNA, 1190 bp, Homo sapiens
agagaaggagaccctgtctcaaaaaaaagtagaaggaaatgaaggtaatgcagtatcttggaagcagagggggaaaaggtcgagaagaatgaggactgtgtaggactttgtagttgttgacagggatcatcatcatctcctttaagagttaatatacatcaggacccatggcaggaacattaccagttccataactggtttcagacagatgcaaggatagtgtgcagtgaagcatgtctgtgtatcatgcataattcacatgatgtaggcacttaagagcaacaccatttctgtaaatgacaacagaagagaaaaaacgaagaacctggtaaaattttgtcattgaaagttttgctgaagaatccctagtaaaggagcattgtggggcagtcctgcttcactcaatttgaaagccctagacctgtgtcctgttaaggtcagcgtctgctctgtgggtgacagcttaagtgctcattgcaggtctgacatcagtcagctactctcatatctttgatttgacttttatcagtttttaaaatttgtttttccatttcaaatcaacaggttccattttttgggcctctgtttgatggagccatagtgagtgggaagctgctgccaagccttgtatgtgccacgtgcatcaacgccagcagggctgtgaagtgcctcatcccactctaccagagcttgtatctttttgctttaaatgtgtaacttactaaccatcccagaatcaagattcctggcagtttttcataagaggtaagtattcaaaactgaattgaagagggaagagaatttttttcaacctctgttaaaaataacatagtggtttttcatagcatttgttaatttatattaaatataataattttatgctgcattaaacttagagtttactttcataatttactcacatacgtttgtgtctgagaagctgtgaccattatgagatgctcatatcttcttaggtattttgccccacgttcagtctcatcctgtatccctcttatttgtggcagtccattgtatataaggtgggatgctgagcaaaacgtatcgctcattcagagtgcctaccagaaaccaaagcaaatgaaatgaccctaataaatcaaagaatgtggcaggtaccacctgagaagtgcaagtaggtttctggaagatcagaggagatagaaattgca

SEQ ID NO: 12631 - DNA, 1371 bp, Homo sapiens
atgtgggtatcttaccacaaagtgacttgaattactactgctaggacagtgagaaaattgagaaccactgtctgtacatgttgtttacacagaacactttagttatttgtgtgcatttgtgattgttaaggttttttgttttatttttcagtaatagcatttgtgctagcctccaactttgcaacaagtctgtattaaagctctggatcaaagcaccttttatggggcctttccatgtgctgtacctttaacacatactcagtttccttatgatgtgtttttccatagaggtttaaagttaactgacttgcaggagtatcggtccagaaaataaactctttcttttgtttattttcagggatatcccagagaaggaaggaaataccctttgccaccaccctcaggaagatacaattggaattaagcttttgtaaagctttcccaaatcctttcatcattctacagttttatgctatttgtggaaagatttctttctcaagtagtagtttttaataaaactacagtactttgtgtatttcttttaactgtgtatatttctactgatctgatctcactgtttatgttgctttccaaagatgtatgttgcataatacagtggatctgaatttattattgcttataaaacacatttgatggaataggagtactggtttttcataatggttaaaaatgaaaccagctgtggatttcaaaacacagtgtattctagatcatctaagatccatgctgatttttattgcacaagaattaggtttgaactcgagctggaacctcagcaaactagagtatatattgttcagtatttctttggaaacatttcattaatgtacttgtcttacagaaatttctgaactttagtaaaaaaaaataaagttaaacttttaaaactctgttttgtgttgttattttgcagtatttcaactttgaaaatcttgaccaagcgtggttttttaaaattaacttttgcagaaaactatttctgtaatcagatgtccaaaccaaaggacaaagaagtcaatgaagaagtagattttaaaagatagggtcagcaagacataacaaaagctttaactttgttgtattatgtcagtgactgatctggctaactcagaaatctttgtgagataaattacatttttacaaatttaatgtagacttctccagttttaaggacttgttttaaatcttcaagttgacaattttaattaatggccaaatagtctatgctccttagcatatttttgtatgtcattagattgcaatttgtactcatgtttttccttgctactaagtacactataaattgcttaaatgtgtgtttggagttcacatacagcacttacatatgca

SEQ ID NO: 12632 - DNA, 1358 bp, Homo sapiens
acccacatctctacaaggaaataaaaataaagaaattagcctgctataggggcaaatgcctgtggtcccagctactaagtaggctgaggtaggagggctgcttgagcccaggagttggaggctgcagtgagctttgattgtgccactgcattccagcctgggtgacagagcaagactctgtctctacccccaccccctgtttttaaagaataaattctcgtcttgtagattataaatctgagactaagaatgatttactcaaggtgacatgcctattaagtgcagaaccagaatttgaaccaggtcttttgaaattaagtcctatttaagactccccagctccatgtatcaaccacatctaaggattggcacctcagtgaaggcaacagtgaaagtgtttggacatgtcaaaaagggagggaagggctctcagccttagcgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacactctggactatttctgtgtttatttgtggccgagtgtaacaaccatataataaatcacctcttctgctcttttagctgaaaaaaaaaaaaaaaaaaagaaaagggagggaaggagtgagctgagtggtggctgttttgccaacaggggtcagcttagcttgtttgttcatctagctggtgttcttatcctgagcttggttgtagccacacttccaatggagacagtcacattcatcacccatacacaaacacaacctacgacttgcagccacacatatgactgtgtctgcgacagatccaaagaagtatatacagtaggaaagctgttcaggcagtattggtcccagtagtcagttgactcagaaaactgggcaaggatttttattgcttttgggacatataggcagtgatacaaatggtaccttaggccggaaagacaattggctaggcctaaaagggattaggcatgtaagtgctttattcataacataaatagtgcaagccacaaaactactgttaccatgttccctcctccagggaccaagccaacagaaatcaccagtgtgggatgaagtttgacctgaattggagccacat

SEQ ID NO: 12633 - DNA, 1210 bp, Homo sapiens
tccagcctggaacaaaaccaacccccctacccaccaccacacacacacacacacacacacacacacacacacacacacacacacactcaagcatggttgggtctggagtatggccttggcataggtaattttcagtgtcccaagggattctagtgtgcatggggctgtgaatcacagctccaggtgggccaactatgtgcacactggtgcctggggtaggtactaagccctgatcctcacccctgtgcgggtgcttcctattatgctttctgcctttagccctcctcctccctcacaacctggtcaaacacatcagacagggaaagaagcaacatgtgtattattaaattatttgtcagaatttccagaatcagagtctctactgggcaagtagaaaaatagaaaagtttactactttgaaaaggaaactatgacaaacaagtatatattcaggaaagggactcctagaacttgagcaacaaaaaagagttcaacctcggcacagtggagtctgcagtgtctccgcaacaacagaaatgaacttgtgttcctcacatccttgagagtcgaggtttgcatttctctacagagctagggctgaatgaagcaaagagacctctgccacccccactagctggcccagtcctggaagcggaagcagtcacttgcgatcttccacactgtgttgctgggtgaggcctgggcggtcaggatgaagttctggttgaagtcccgttgtttgttcccctcaaacttcactgatccacagatgacaacaaggaccgtggtctggcttggtgtggcttcatcatgaacaggctggcagtctaccacgctgatttggaactcgctggaaggcaacatttcaaaaaactcactcaaggattcttgtcctgaaacagcattgccattccagaccagggtggctgtgcccatgtacaggcgggacagcaaacgccgccgcttatccatggtggtgtagtagacattgacaaactcctcagcagctctgcaggcctgatccacataggtcttgaaatccacagatgccatctctggttctatggaaggagggctccaccagggtatttcctctgccttggggaaccaggggctgcagggaagtaaggttgaagagaagccacgtgaatgccaaagttcattctgccctgacaatggaacattcctccttttctactactggcaaaat

SEQ ID NO: 12634 - DNA, 1425 bp, Homo sapiens
gagcttagcgagctgaccccacagacagactcgatgcccacacagcttcactctttgagcaacatggaataagagcttcaagcagttcccatcctgttagtctgcgtgtgtggtagctgaactcaagatgatgtggggctaagaaaaataattgtccatgtgcaaagatgtgggcaagaatggcctctgcagattttcctgaacttctgctaacttgcacggctttatcacagcatttttaaagctttccctcaaaaatcctgatctgcatgatctcagctactttattgacaaaaaggcagtgaacataacctcacttaattctggtgtagggtgtatgtgctaatcgttctaattcttgattacctagtttatagataactgctggtcttaattgcagagtacagagaactgaaccagctcctgatattgtagttagcagtcttcctggcttctcactctgccttatatttccatgtgggtttacttctctcataactactttcaaggtatttttcttccaagctgaaataaaactggggccacatattttcagtcatttcttccctgttgaattgaagcaaatcagattttctgtggggaccctcaaatgcaactgaagaaatagattgttgcattcattcctccccaccccccatttgtaggcagtaaacaaagtatgactgacagattgaacacctgcaaaactgctagcgtaatctcagcacatacgcagctaggaagtttgtcataaaatcaacttagaaatgagatgaggctgttcagtttgtcttaaaaaaatcagattaggtaaaagctgtcctaccaaagagtctagcaaaacaatatagtatttttttgcagaggcatgaaaaattaagacgctttagagtacttgaaagttgtgtagtcattttatttgcaaaatgaggtgactgtggcaaattatagaacacagagtattattacttttgccaggtttttctgacttgatttctgtaatttccagaaacccagacttctcatttccacacctagagatggaaacaggcaagtaactgacatgtctatttccttgggagcatgtgagaacatagcagtagggaccaaaagtctcagcacacttacctccgattatgccttaaagagttgattgtgaagaaccagtaactttgtcccaaatgcttctttggctgtttcatgcaggacttaattattgcttttaaaaattcacaatgaaaagacgattctgctgtatttgttaaacgttgacatttggttctagggccttgagtatgtgccacgtgcttgtgaaatgctatgattcacatgtaacatttaaacattaatttaaaaagggaaccttggagaattcttttgttcactagttccttttttctctacatttttaatttattaaacttg

SEQ ID NO: 12635 - DNA, 1357 bp, Homo sapiens
tagtaggcggctcgcgaatccccgccgccatgacaggacccggactacagctcccgaaaggcctcgcgcgtcgcgcctgcgcctgcgtccctgcggccgccagagggagggttaaggcgcctgggcgcacagcgagccggctgagggggctgtggcggccgcggcgggcgacatggacaacgcggggaaggagcgtgaggcagtacagctgatggcggaggccgagaagcgagtcaaggcctcccactccttcctccgagggctgtttgggtgagcgccagaccgtgcgtgccctggggggggggggtctccgtacttggcccccttcctttcaggctgaccccccgagtcccccacgcaacctctggggccctcagaccacgtctaggggccctcagcctgcaggcgccctccagaaatcctgtagggtcccccagcgccccctggagcccccaggacgcccaggggccctcagtccgcacgcgccctccagagaccccacaggcccccccagggtccctggaaaccccgcatcctcccaggggctctcagcccccacgcgcactttagagaccccctagggccggcagaactccccagggttcctcagcccccacacgctctccggatcccctaacacgcccccttagaatccccagagtctcacagggaccctcagcccccacgcgcctttcagagaacccctaggacccccagagctccccaagcgccccacgaagcccctagaacactctggggggggggctgtcagcctcacgcgccctctggagaccccagatcgcccccctcgccctggcccgggttggtgcgggggtcccacgacctagaaggtcagcggctccctgaggcccgcgggcgcggtagctcggggcgcgcgtggggcccccttctcagtgcgtagcgagtcgtattggtgcatttcgccacgctgaagcccgtatcgctcctgagaccggtccgggtgaggcgcgccggggtggagccggaggggtgggtgcgggggccgcccccggcgcctggaacgcgcacctgggggcgtcccgcctgcaggtgggccccgccggggagggggcggtccggcgagggatccagagctggtgtgcttgttggcctctctccaggggccttgcgccgagtacacctttagtaaatacttgactaatgaacgaatatattttctcagcatagtatttttccttctccggagattgattgatagccagagcctcctgtttgattaacggtaacgctgctgctgtttaagtcaggcgtcctttgggaatccctttaatttcctgtaattcttccgtgctctcctaaggaggattttaaattc

SEQ ID NO: 12636 - DNA, 1200 bp, Homo sapiens
agccacactctccttgtcatctcctcaccaccccatgtgctatgacttggaatttccagttccctgggttcttccctctcgcccttcatagtgctggcctgagggctggaggtggaaggagctgggggcagtgagctgcctccccctgccctgtacccttagggctcccgaggccttgcacaggctgctcctcacagggctgtgctggggcaggaatcctgcaggctggggtgggggcccagtgccaccaggtagagttggagccctgggagagggatggagcagtcactgcccagtccagcggtgctctgggatcagcgggggtgggtggaggggtagataagggcccagtgtttcacctccatccttcttcactcccactctgatgtcccgtgcctgggcatcttctgctttgaactgtaacccacactgattgtcccctctgtttcctttcacagaaagcattctgctctttccagatctacgctgtgccttggcagggcacaatgaccttgtcgaaatccacctgtcaggacgcctaggggtctgtaccgggctggcctgtgcctatcacctcttatgcacacctcccaccccctgtattcccacccctggactggtggcccctgccttggggaaggtctccccatgtgcctgcaccaggagacagacagagaaggcagcaggcggcctttgttgctcagcaaggggctctgccctccctccttccttcttgcttctcatagccccggtgtgcggtgcatacacccccacctcctgcaataaaatagtagcatcggctccctctgagttcttggctgtctggggatgtgcacacaggcagggtttccgcagttcctttatgaagcctccttgtcctgctggtgtgaagatgagaggagtacctgggagctgacgcggccacagcaaggccatcaggcaagctgctgctataggagtcctgagtctcagagcagggagagcagccaggggctgggaaacaaggcattgagccacagcagcccctggtgagggggtcagggagaggaggggcccaagctgctgcccccagaagctgggctggtgatttggtctgagctgctggtcagaccaggaggagggagctggctgtgtccatagacaggggccaggcctcggtggagctcgccaggtcatagattccatctgtgcttgcagagt

SEQ ID NO: 12637 - DNA, 1710 bp, Homo sapiens
gataacacagagctagttagctagtagcaaccgtgttttctccagatctgtctagatacaaaggtcagaaatcttatttttatacttttatattgtggaagaacagcatgcaacactcacatgtagtgtgtggatttacttgaacatgttctttttaacatgtagttatgaaaatctccttttttgcctctactggtgaggaaacatgaggatcagaggccacatttttaattattgttagtgtatttggaagtctgaattggagatgtttgtacctctgtctaaacagttcccttgagaacttccaagcctccggcatcttttcctggtgagtgtttctcctgtgcttggttgtgtataatggagctaactcctaagcggtggggtgaatgtggccgccttagttctgaagctactccagttatgttctgtttcttcaagctgtgatccagaaagatttttgtgcccccagatgcctcttgataggagaggcaacatactccaaatagttgggttcttcagggaagctattagaaactcaggtgacttgttagagcactaacttggtcagagccaaatcctggcaaacgctgcctgaccttcactctgtggttggggcggtgagaaccactgaggtccaatgatgagacttggaggtctggatccagtctctctttgttttaatgtgacttaggtgctgtcaacattagcaagataatggaaatcacgacgccagtgggtgcttacctccctgctaggcatgcaggggctggcggttggcaggggaaggaggcccagtgagccgggtcccttaggggagggagagtttgtcctctttgccccacagtctacccttcagggccttgtggcagtgccagtgttcggggggtgtctgggccactgagtacccactcggtcgtggttgtgctggcctcttgggtgagtgaacctgtgaagcccaggaggtggtgttggctgcagggtacacaaatactgagtggtggtcttttgttacaggcttagcaacaaagctgtgccctgggcatggggggctgtagtgtagctacagttgtgcgtttgtgaaatggcttagctttccatgttgctgagaggaacctggacatggtcccgggcatctgaatgatctgtaggggagggagttcaaataaagctttattttgttcattttctctttgtggtgatttttttgggtccagtaatgctactctttttttttcctgaatataatcctacagacaaaattggaaggggccttttctcctggggggttcacactcacagccctgactgctccttggtgagctcacctgccttaccaaggatggctgactgcgctgatgcatcagccacacgtggccacttaactgtaacttaaacagaatagaaatttggttcccagtctgcagttgctgcatttcaagtgcccagaggccatgcacagcaggtcagataggcgcactaccaccatcacttggaggccgcaggcggcactgggctagagcacaggcaagagcgagggacaacctggctctgagtagcgtgcatgaggagcatggcctggtccctgggtcatccctccgctagggtgggctggtccttcatcaggacacactgaatcagtgccacagaggcagaatctcagcagtctgggtctgctcctgacacccatctgccagcccctcgatctta

SEQ ID NO: 12638 - DNA, 1316 bp, Homo sapiens
agcccatccctggcttccaaggagccacagcctcctgatgcacaaggctttcctgtctgtgtgatggtcccctctccctctctgtcttttcaagctcactcggaaaattgacaatgttgagaccagctgggctctgggggccatttttcattacatcgactccctgaacagacagaagagtccagcctcatagtggccgagccatccctgtccccgtcagcagtgtctgtgtgtctgcataaaccctcctgtcctggacgtgacttcatcctgaggagccacagcacaggccgtgctggcactttctgcacactggctctgggacttgcagaaggcctggtgctgccctggcatcagcctcttccagtcacatctggccagagggctgtctggacctgggccctgctcaatgccacctgtctgcctgggctccaagtgggcaggaccaggacagaaccacaggcacacactgagggggcagtgtggctccctgcctgtcccatccccatgccccgtccgcggggctgtggctgctgctgtgcatgtccctgcgatgggagtcttgtctcccagcctgtcagtttcctccccagggcagagctccccttcctgcaagagtctgggaggcggtgcaggctgtcctggctgctctggggaagccgagggacagccataacacccccgggacagtaggtctgggcggcaccactgggaactctggacttgagtgtgtttgcctcttccttgggtatgaatgtgtgagttcacccagaggcctgctctcctcacacattgtgtggtttggggttaatgatggagggagacacctcctcatagacggcaggtgcccacctttcagggagtctcccagcatgggcggatgccgggcatgagctgctgtaaactatttgtggctgtgctgcttgagtgacgtctctgtcgtgtgggtgccaagtgcttgtgtagaaactgtgttctgagcccccttttctggacaccaactgtgtcctgtgaatgtatcgctactgtgagctgttcccgcctagccagggccatgtcttaggtgcagctgtgccacgggtcagctgagccacagtcccagaaccaagctctcggtgtctcgggccaccatccgcccacctcgggctgaccccacctcctccatggacagtgtgagccccgggccgtgcatcctgctcagtgtggcgtcagtgtcggggctgagccccttgagctgcttcagtgaatgtacagtgcccggcacgagctgaacctcatgtgttccactcccaataaaaggttgacaggggcttctc

SEQ ID NO: 12639 - DNA, 1104 bp, Homo sapiens
atctctacaaaaaaaagaaaaatcagctgagtatgctgccatgtgcctatagtcccagctactcaggaggttgaggtgggaggatggcttgagcctgggaggttgaggctacagtgagtagagatcgtaccactgcactccagcctgacagagtgagaccctgtctctcataataataataataatagaaaataagttccagatgtcatgatactccacttctcaatatttcaacaggcatctcttaaaaggaagtgcatctcccgcctcgccacactgaaggagtgctgtcacacttaagaaacttagcagtagttacctcatatcagtattcagaccatattctcattttttcagttattaaaaagtgtcctgcacaacaaggttgctggcagtagggtgcagctgggggtgccacattgtgtgtaactatgactctgttcagccatgtttagctatcagatcaacttgctggcataaaccagccacttgagtgcattcatggcacctgtgggtcaggcattcagacaaacacagcgttgacggccgtccctgctctgtgatgtggggtctcggctgggaaggctggacagttggggtgacctaatggccagggttggagtcgtcggggaccccttctgcttgtgtctgtctggggcctctcctcatggggctggacctggaaggagtgtcgtggggggtgtcagggagctagtgttccagggcagctggtgggaggcgcatggctcccaagccctcctcggaagtcacactctacgttattcccactgagtccctggagccgcgggggaggcttctctgatgggcaagtgttcaggtcacatttcagaagaggatgtgggatggaagaggcttctggaggcttctttggacaacacatcccctgcatggtccctttggtgttttgatctagaagacctgtttttccccatgacactggcttttggaagagccccagtagtggtcccgtgggccatcccacattctggatctgtccagttgttttctgagagtgtaggctactctggtcgtatgtcacttgtctgccttgtaaactggaaattaggcctaaaggctggagca

SEQ ID NO: 12640 - DNA, 1123 bp, Homo sapiens
ctaaataaataaaatacagtaaaaataaaagtttttaaaagtgagaaagtcaagaaaggacctttgttttggcttatctcaccatgatgttagcgacttaaaatccagatggtttcctgctggaagctgggaagcaacaggccctcacctcacagtgcacctcacctgcaagggacccccctggaggccagctcggccagctcgctgggctgaatggctgcagctgctagaggaggtggctggctctgtccccacaggacctgcaggaccgcaacgatgagctgcaagctgagctggaaggcctgtgggcgcggctgcccaagaaccggcacagcccctcatggagcccggatgggcgcagacggcagctccctggactcggcccagcaggtaggagcccgtccctgggagggggctgacccaaggcctgctgttgacaacaaggcccagagccaggaaaagagagtggagatgatgaagatgatgatgttgctgtgacctgaagggaggtggtctgctctgcagggactttccaaggaggatccagggatgccacagggtgaccttgcaacacggaaggtcacctgcagagggaggaggaagggacgctgaaggtgggcagccccagggctggcccaggctgttcccacatctcagagctgtttcagtgacacggtacttgctgagactgagaagagctaaatcccggagaatgcattggggcctcccagtactcaggcctgttcagacagaggctgtcggggcttacccttgctgcttctgggtgatgtggtagctggcaccaccccccaagtctgactgaggcagggaggcaccaagcactaagggagcggccccacctggccaactgcccctgtgctcgcagccaatgggattaggacaagctccaaggacccagggtccccggaacccacatcgaagtgtctctggctcctctgcagagagaatgggggtccaggtgctgcagccgcccttgaggtctgtggtgctccctttggaggatggggtggcctctgcccactcaatagcagcatacaatgcacatggctccgtgtccactgctgtgacaggggcccatggggacccagcagccccacctgct

SEQ ID NO: 12641 - DNA, 1232 bp, Homo sapiens
tttctgccagggagcttgaaagttttcagaacctcttccccagaaaggagactagattgcctttgttttgatgtttgtggcctcagaattgatcattttccccccactctccccacactaacctgggttccctttccttccatccctaccccctaagagccatttaggggccacttttgactagggattcaggctgcttgggataaagatgcaaggaccaggactccctcctcacctctggactggctagagtcctcactcccagtccaaatgtcctccagaagcctctggctagaggccagccccacccaggagggagggggctatagctacaggaagcaccccatgccaaagctagggtggcccttgcagttcagcaccaccctagtcccttcccctccctggctcccatgaccatactgagggaccaactgggcccaagacagatgccccagagctgtttatggcctcagctgcctcacttcctacaagagcagcctgtggcatctttgccttgggctgctcctcatggtgggttcaggggactcagccctgaggtgaaagggagctatcaggaacagctatgggagccccagggtcttccctacctcaggcaggaagggcaggaaggagagcctgctgcatggggtggggtagggctgactagaagggccagtcctgcctggccaggcagatctgtgccccatgcctgtccagcctgggcagccaggctgccaaggccagagtggcctggccaggagctcttcaggcctccctctctcttctgctccacccttggcctgtctcatccccaggggtcccagccaccccgggctctctgctgtacatatttgagactagtttttattccttgtgaagatgatatactatttttgttaagcgtgtctgtatttatgtgtgaggagctgctggcttgcagtgcgcgtgcacgtggagagctggtgcccggagattggacggcctgatgctccctcccctgccctggtccagggaagctggccgagggtcctggctcctgaggggcatctgcccctcccccaacccccaccccacacttgttccagctctttgaaatagtctgtgtgaaggtgaaagtgcagttcagtaataaactgtgtttactcagtgaacaaagagcctgggctcttgtgtgctccgggatggggaaaggaggggccgctggagagctgggtactggtcctggctctgct

SEQ ID NO: 12642 - DNA, 1429 bp, Homo sapiens
gaaactagtgactgggacctgtaaaactctacaaacattttctcaaaaagaaaaaaataaaagcaattataagcgtagttctctgacatccctctcactggtaacttttccttactttgcaggtgcataaggcaaatccaatacgcaagtaccagggtctggagataaagtcaagtgaccagcctctgactgtgcctgtatctcccaaattctccactcgattccactgctaaactcagctgtgagctgcggataccgcccggcaatgggacctgctcttaacctcaaacctaggaccgtcttgctttgtcattgggcatggagagaacccatttctccagacttttacctacccgtgcctgagaaagcatacttgacaactgtggactccagttttgttgagaattgttttcttacattactaaggctaataatgagatgtaactcatgaatgtctcgattagactccatgtagttacttcctttaaaccatcagccggccttttatatgggtcttcactctgactagaatttagtctctgtgtcagcacagtgtaatctctattgctattgccccttacgactctcaccctctccccactttttttaaaaattttaaccagaaaataaagatagttaaatcctaagatagagattaagtcatggtttaaatgaggaacaatcagtaaatcagattctgtcctcttctctgcataccgtgaatttatagttaaggatccctttgctgtgagggtagaaaacctcaccaactgcaccagtgaggaagaagactgcgtggattcatggggagcctcacagcagccacgcagcaggctctgggtggggctgccgttaaggcacgttctttccttactggtgctgataacaacagggaaccgtgcagtgtgcattttaagacctggcctggaataaatacgttttgtctttccctccctgattgtgttatttgatgtttttaaatctgttaagcccctttggaggtcacatcttattgggaaatgggtagtttgagaggtgggtccaggaactttttttttttgagatggagtctcgctctgtcgcccaggctggagtgcagtggtgcgatctcttctcactgtaagctctgcctcctgggttcacgccattctcctgcctcagcctcccgagtagctgggattacaggcgcccgccatcattcccggctaattattttttttgtattttaagtagagacagggtttcaccgtgttagccaggatggtctcgatctcctgaccttgtgatccacccgcctcggcctcccaaagtgctgggattacaggcgtgagccaccatgcccggcccaggacagtactttgtaatttttttctgtcttatgtcagaatatctccatattctgttaactctctctcagtaaccacttaat

SEQ ID NO: 12643 - DNA, 1234 bp, Homo sapiens
cactccgactgcttctccagccatgcgggagtgttgccatactgatctggggtctgtgggggaccaggaagggcacagctgtggccattccttttgtggcattctgggcctggcccctgaggctatgagcattagggcaatacacaggcctggtccagatgaagcagagctgtgcccatgaaccctgcctgccgcttgccacccactggagcacgccccttcccctggccaggcctcagtttccccatgatatcagtgagagtggggccccagttcgccatgcagcctggcactaagcatgcaccctgtcttctttctgctcgtggccgcagctggacatcgtggagttcatcccctctctcctctactttggctacacggccctcatggtcttgtccttctggctgctaacgggtaccatcggcttctatgcagcctacatgtttgttcgcaagatctatgctgctgtgaagatagactgattggagtggaccacggccaagcttgctccgtcctcggacaggaagccaccctgcgtgggggactgcaggcacgcaaaataaaataactcctgctcgtttggaatgtaactcctggcacagtgttcctggatcctggggctgcgtggggggcgggagggcctgtagataatcttgcgtttttcgtcatcttattccagttctgtgggggatgagtttttttgtgggttgctttttcttcagtgctaagaaagttccctccaacaggaactctctgacctgtttattcaggtgtatttctggtttggatttttttttccttctttgttttaacaaatggatccaggatggataaatccaccgagataagggttttggtcactgtctccacctcagttcctcagggctgttggccaccctatgactaactggaagaggacacgccagagcttcagtgaggtttccgagcctctccctgcccatcctcaccactgaggccacgacaaagcacagctccagctcggacagcaccctcagtgccagccagcctctgccagacctctctttccctcttctccccagcctcctccagggctgcccaaggcagggtttccagccaggcctcggggtcatcttttcaccaggagcaaacccaagtcttagttgctacaagaaaatcccctggaagtactgggggccaggttccccagacagcaggaattgcccctgttcagagcagccggagtttgctggac

SEQ ID NO: 12644 - DNA, 1112 bp, Homo sapiens
tctggggtcatactcacttctttagccagccccatcccctccaccccacacctgagttcttgcctcctccttttggggacacccaaaacactgcttgtgagaaggaagatggaaggtaagttctgtcgttctttccccaatccccaggaatggacaagaagccaacttagaaagaagggtctcacgtggctggcctggctcctccgtagacccctgttcttttcaacctctgcccacccgtgcatgtcatcacaaacatttgctcttaagttacaagagaccacatccacccagggattagggttcaagtagcagctgctaacccttgcaccagcccttgtgggactcccaacacaagacaaagctcaggatgctggtgatgctaggaagatgtccctcccctcactgccccacattctcccagtggctctaccagcctcacccatcaaaccagtgaatttctcaatcttgcctcacagtgactgcagcgccaagcggcatccaccaagcatcaagttggagaaaagggaacccaagcagtagagagcgatattggagtcttttgttcattcaaatcttggatttttttttttccctaagagattctctttttagggggaatgggaaacggacacctcataaagggttcaaagatcatcaatttttctgactttttaaatcattatcattattatttttaattaaaaaaatgcctgtatgcctttttttggtcggattgtaaataaatataccattgtcctactgttttgtcttgaatctcatgcaggggttggaggtctgaggtgagacaccttccccgagtgggttgagttgcacagtttcccccgaagctcattctcgtgtcacacttcagggctcaagccactgttgttccctgcctggtacaagtccattgcctagcccctccatactaaattgcagtcatttgctcttctgatcccacaagcaggaaatgacaatcaagtgtgttttggtagcagcaagatctggttttggattcccagcttcagtcttttactgtcagctcatctcactctatgaaacccagttcttcaattgtaagcaacagaaacatcggtcaaactggtttt

SEQ ID NO: 12645 - DNA, 1103 bp, Homo sapiens
gcactttgggaggccgaggtgggtggaccacctgaggttaggacttcaagaccagcctggccaacatggtgaaaccccatctgtactaaaaatacaaaaatttgcctggtgtggtggtgcatgcctctagtcctagctactcgggaggctgaggcacgagaatcacttgaacctgggaggcggaggttgcagtgagtcgagataacactactgcattccagcctgggtgacagagtgagactccccctcaaaaaaaaaaaaaaaaaaaaaaaaaacagaaagaaagaaaaagaaaactgcagataaccctatacattaatactggtatctcgaggtgactcttctgaccaagggtggttaagtgacacatagaacttttctaagagaagacagacaagttgacaggcatgccttgtactcagctgtgttcatgtggtggtctgtggaaagaaaagaagactcatttggaaatgaagctgtccctttccaagcagtctctggtgcttttcttctctcaaaatggatccgataaatatttgaatagagcagattgtagaatgtcgtgctgtcaccagaaagctgctgttttgggttctgcattgagccaaatatgtagaggacctaccaagcccactgagggactaggttttcatgtctctagtcatacctagaatgttctgagccgtctgagggccttcatgccggcagcagctagcaaagccagaaagcaagtctaacaggatctaagatgaccatcaggagaaggagtttgagactgtgtatgcaacccccaatagacccccttttactctgatctggagaatgtatctggcttcatattttcaagtcacatgtctctcagacccctggattcagaacccaaggccacaaatcataggcatgaagcactttcttaagactgacctaacgctggattatttcccgtccaatgcctgcatgctgcttgaattgctccacccacacctccatgaccaagggcgccagagtgctgcaactggggcgtgggccgctctctgcttttcctgtctgactctgacaagtcctccctcactgaatgtagaatcgttgccaagtttctgaga

SEQ ID NO: 12646 - DNA, 1179 bp, Homo sapiens
tcaatctccccacttccagcagagaaaaaacaaatgaaatactgttctttttgtgtacttactagaaaatgtttaactggaaaaaaagttctgcttgttttattggcacagcaccattgattctgtgattctttgtcatagtattctgtggcagtttctgagtatgatatgtagattgaaatatagaggctaggaaacttttaatagtaaaattttactaaaaatttattaacttattaaaatataacttgaaaaaattgtgaggtttttctaaatttcttggaaatttgatttatattgtcaaaaagcactgaagaagtgttagttatggatttcgggtatcacataatgtttattccagagttttctgagtgtgatttatgtgaatttcatttggttattcttttactattttcacagtgaaattgtcatgagattttttcttctgtatttcttgcttagcttcttctcatttaagaatgagttggagggattaggtctttaagtaggcagatggattgtataaccctcatccattcttttgtggttttacagtgggacttcccctctcgcatgcctcaatgctatgctacattccaattcaagaggaggagaggggttgttttataaactgcctggccgaatcagccttttcacgctcaaggtaagtgatatgaactctcttttggtgcagtgattcttggacttttaatgtgcataaaaatcacctggtaggtctggaataggggccatgaatttgcatttctcatatgcagtcaggtgacactgatgtttttcttttttttagacatagtctcgctgtgtcacccaggctggagtgcaatggggcgagatctcggctcactgcaatctctgcctcccatgttcaagtgattctcccacctcaacctcccaagtagctgggactacaggcacatgccaccatgctcggctaatttttttattttttttaatagagacggggtttcaccatgttggccaggctggtctcgaaatcctgacctcaggtgatccacctacctcggcctcccaaagtgctgggattacaggcatgagccaccgcacctggccagatgctgttggttctaaatggcactttgaggtgttctaatatgaatcagatattagaaattatttagtcatagcagctcttgtttg

SEQ ID NO: 12647 - DNA, 1203 bp, Homo sapiens
agagacgtgttgttttaaaactgggagattcagctgtccataagacagacattaatatcccgaatgcacttactagaagaggtttatttctccctaggtgaatttactcatgagatgcaagtcaggatacgacaggaaatggagaaggaaaagaaggtggaacaatggaaagaaaagttctttgaagactactatggacagaagtaaggcagttggagctatgagtcctggtctggggttttgaggggatagaggtagatggtctcaaaatagcatatacttatgtgttggacaagaatgtggagattgcagtgacacttgggtcatttatcttaatgccattcatagtgaagctaacagaagtttttccatggttagattgtgcaccacacagatttattttgttctgagatatctgtgtttctgggtccatattattcatagaaataagagacatgtccactctggcctgaaactgatggctgtgattttgatttgcaggctgggtttgaccaaagaagagtcattgcagcagaacgtgggccaggaggaggctgaaatcaaaagtggcttgtgtgtcccaggagaatcagtgcgtatacagcgtggtccagccacccgacagcgagatgggcattttaagaaacgctctcggccagatctccgaaccagagccagaaggaatctgtacaaaaaacaggagtcagaacaagcaggggttgctaaggatgcaaaatctgtggcctcagatgttcccctctacaaggatggggaggctaagactgacccagcagggctgagcagtccccatctgccaggcacatcctctgcagcacccgacctggagggtcccgaattcccagttgagtctgtggcttctcggatccaggctgagccagacaacttggcacgtgcctctgcatctccagacagaattcctagcctgcctcaggaaactgtggatcaggaacccaaggatcagaagaggaaatcctttgagcaggcggcctctgcatcctttcccgaaaagaagccccggcttgaagatcgtcagtcctttcgtaacacaattgaaagtgttcacaccgaaaagccacagcccactaaagaggagcccaaagtcccgcccatccgggtaggagactgtttgattcctggctgccctggagccaggttttctttgagggtcatgagattatagag

SEQ ID NO: 12648 - DNA, 3688 bp, Homo sapiens
gcagttgctgcagggtagcttgcccctagagaaggttcttccaccagcccacgatgacagcatgtcagaatccccacaagtaccacttacaaaagaccagagccatggctcgctacgcatgggatctttacatggtcttggaaaaaacagtggcatggttgatggaagcagccccagttctttaagggctttgaaggagcctcttctgccagatagctgtgaaacaggcactggtcttgccaggattgaggccacccaggctcctggagcaccccaaaagaattgcaaggcagtcccaagttttgactccctccatccagtgacaaatcccattacatcctctaggaaactggaagaaatggattccaaagagcagttctcttcctttagttgtgaagatcagaaggaagtccgtgctatgtcacaggacagtaattcaaatgctgctccaggaaagagcccaggagatcttactacctcgagaacacctcgtttctcatctccaaatgtgatctcctttggtccagagcagacaggtcgggccctgggtgatcagagcaatgttacaggccaagggaagaagctttttggctctgggaatgtggctgcaacccttcagcgccccaggcctgcggacccgatgcctcttcctgctgagatccctccagtttttcccagtgggaagttgggaccaagcacaaactccatgtctggtggggtacagactccaagggaagactgggctccaaagccacatgcctttgttggcagcgtcaagaatgagaagacttttgtggggggtcctcttaaggcaaatgccgagaacaggaaagctactgggcatagtcccctggaactggtgggtcacttggaagggatgccctttgtcatggacttgcccttctggaaattaccccgagagccagggaaggggctcagtgagcctctggagccttcttctctcccctcccaactcagcatcaagcaggcattttatgggaagctttctaaactccaactgagttccaccagctttaattattcctctagctctcccacctttcccaaaggccttgctggaagtgtggtgcagctgagccacaaagcaaactttggtgcgagccacagtgcatcactttccttgcaaatgttcactgacagcagcacggtggaaagcatctcgctccagtgtgcgtgcagcctgaaagccatgatcatgtgccaaggctgcggtgcgttctgtcacgatgactgtattggaccctcaaagctctgtgtattgtgccttgtggtgagataataaattatggccatgggaaacattgtatatttagtgtgtgtattttgataatgattgatcttaaatctgtatacagaatatcattgatataatactctttaggcaggagcactcttgccttcccccaaaatttacactgctaaagccctctgtcacttggcgacccttctggtcttgctggaggggtttcctgggtataacccattgggctgcccaaggccagccagcctgagctctcctgcaagacagagcctgatgtggcacggagtggggttgcggggggtggggggactgcctgactcccagagggacttgaaactgaagcaagaaggttgcattctccaccaagggagttaacctacctgaactaagtagaaatgccagtcttccactaccccctccctgccatcttttcttctgctactttggggagttgatggccaggaaagaagccagcacagggttaaagtaactcctggcattgcccaccagggggctggtgcacctgctgacctcagggtcacagttgagtcatttgccagttgacggagcaagtttgaccttggttctgttgctgaagcaaatttggaacttttctgtctcagtgtgatccactaacccacaggatcatttggaaccttgaatagctctgcttggacaatggggttggggaatagggttgtctttcctatgaaaatgccatctgtagaccttgtgagtcagccgtccagatgtttgcaggtgaattcctctgcttgacatcctccctgtcactttggaccctatgggagtgggcatctccacgcacctgtgtatgtgaaagtcattttacatttcaaagcagtgtgtgtttcttatttttatatttttaactctttattcttggatgtataaagtgaactttttggcttctgtaagtatgctctatgcacctctaatgttttatcatgtatttatatgttgtacacagtactggctgattctgtaaatggatgtattgtacagagaacatgaacgtctcttcctaattttacatcttcagcatcattgcattaaagtggtgtaatctccttctctacatctgttgtcagagccactgagtgctgtgctgctcgacgtgagggtgaaatgattgacttgtgacctgccaggttgcccgatgccctgttgggtcaccggctggacctgctgcagcctgcagagccacagtcagcctgcccacatgccaccgagcaaacgcatcttgcttttcacatctctcctcctacagccttaatggctgcttgctgccatatgtgacaaatcaccaccaccagtgttaagtgcttctggattcatgggtgagttccctgggcagcccccaggaaggccttccagatctggctccagggtcaccacctgtcacagcaatacctgggaccatgctctcctgggactgtgaggctccttttgacgtacttttgacatcaggcaggtttgggaagaaacaaagccatgcctgctcctgcctctctcccaacatgtttccagcaagtagatgcccctgtgtgtgttttcccttgccttgtttcctgccttatatcttgtatttcgacttattacagagttgagggttcttgcttaatttagatcaagtataaaatttgtatgacttcaagtctcattttatctgaaaggtttttttctcatttaatctgatgtggcattttcgtcatctgaagcatgagtgacaagttgggaatgatgtggtgatttagaatgcagtattggccaagtccaagttgtcaacttaagcgtctgtttaccaaagaccgggaacaggggcccaaacatgtccagtcctcttcttccctctgctggaacctttggggacactcaagggtacagtttgacactgatctggtccatgaggctgcccagagaaagcactgcttctgtatgtctcttgtggtattggaacaataaacccgtacaacctgcagttgtggtctcagtcatctgtggctgcctcgctggtgtgggaaggtcagctggagtgctgagctggaagggaaggagtagacgccagctctcctcaccttggctctggagctactcttcttatacttggagctcttcttttgggaggttagtccaaaaggaatgacttggcagcttcactggtctttagccattcatgacttggcggacttcaccacatagactgcagtcagcgttctactgagagcaatgagaatgtttccccttgggagtgcgagtcacaaactgtgacatccctctgcagcaactcatccaaacagcttcactgaggttgaggttgccaagtggcttcctaatggttagtggtcttctgtgggagggtgactagctctaaccttggaaaacctt

SEQ ID NO: 12649 - DNA, 2476 bp, Homo sapiens
aggtaagtaagtccagactgggtgtccaggagctggaacccagagagcgtcctgtccctaaccagccactgcagccctccagctctggccctcagctgcttgacaggacggactgctgggagatggcagccggttggcagggcccttgccctcacaccccgctgcccaggagccaggtctgaacttctgtgcacaggcctggcccctcagactcactcctgccaagaggggccacttcttcagggtgagccccggctatcaggcagccgtgagctccagggcgggctgcagctcccatccccttgcgccatgtttggagtaaagggatcagtggaagtggaggagccacttgggttctcctaagaccagcccttccggaggggccggtcctggaagaaacccataatccctggagtgtgaaaaagggcaaaaagaaaaagctggcctggtttccttcctccctgattgattgattgataggcacttcctcttgctcagtgcaatacctaccagtgctgctaaaccagggactcgcccagacctcagcaggcccccagggcctctccgtgcaacactccgtagccatgacagcagctctctgctgcccgcccctgcccagagctggcagaagccctctgttgcctttcctccctcagagcagagaggccccaggggagccagggccgagtggatcctaggatggccacggagagccactcgctcccagaacaggcaccccttcccaaaccagcttttctgcagccaattgcctgttgcagctgtggccactgcctcccggcactgtggcagactccccccaaggagggatggggggggcaccagtgaggatgccccatcctgcctcaggtccagaactctgaaaggtagggtgcccaccccgtgcttacttccggcccctagaggttgggggtggtcgttatctctcaagtggcctccaataccccatccagccacaccacctctgccttccatctgaccaatccccaggcctctggtcagggccaggacacctgagactcacccttagcacagcacaacctccagtgcccaaggcctctcccacaccccagccatccacacatctggccccacctgctcagtactactcaacatttgaattcgtgtaaatatttatttttgtgtgtgaacaatactacaaagtaatcagtaagatcttttgcaaaaatgttaccccaggcaattatttgtgaaaatcttaatgttaaaacctggcagagacaatcgccaccctagaattcctggtatcagttacttaacgtgtcacttctcctcccagaggcagtacccaagctagacatgaaccgtttgcatttcttggcagacaggagtgagaaagactggggaaggggctccctccccctacccacacaaggattagatctaaagatcagcataagctacagtttgaagtcatgtttttctgagttcaagctgttggaactgaccaccctccagcctgccttagtactgcggcaagagcgtaggttcaatgtgttttcaagagaaaggaaagaatatgttgttaaagtccattgggcctcccaggcccctccaggacaatggatttcatcatgtcgaccccacctcttgggtgggctcctcctttccagtgaaactacacctgaagccctagagatggcagaatcaggagcaagtttctgcatggaaacaggattccatttagctggctcagtcagggaacttgttttgcttttgttttaaaagatgcagcttcaaccccttccccctactcccgacttggagggcaccaaagagctggttctgatgaactaagctcactgctgtctcaccctcaccagagggactgccttctcccaaaaggagctcccaaagcccttgtcccacagccatttaaaaatcttctgaagggcctcagggcacaaagtgatcatttgggatcctaagttaaaaaggaaatgcaagagtaggatactccaattccagagtctttgcaggaggctaatcccacaagaagggtagcatcagagaagtgggcattggtcttagtggtggatcatcaggtagacaagtgatagtgtgtgtaacccatctgaaattcattttaccgtcaccactcttacaaaggacagtttattcccaaggacagtgctgacggggagggggacaggcagggagttaggagggttttcgaggatttcaaacaggtggaacccatccatccctattcccaagggccacttacaactctaagggtggttacaggattaactaccagttcattttcaaaatgctgctttgaactcagagggttgatacttttaatttgtaattttttgtaaaactttttacaaaatagtaaagtatttcaccagaataccagtttcaatccgtccatggtctgatttttatataatttagtggtgctttagaaactttgtttttgttgtttctg

SEQ ID NO: 12650 - DNA, 1173 bp, Homo sapiens
aagggggtgataaaacccgtaccccaaggggtagctgggaagatggcataaaaccaagcctgcccggtgggccacagcataggggctgctgctccatcttggggtctctcagagcaaagatcccaaagccaggcagctgtgaagctcccaagggtggctccgaggctctctgtggggtgatagggaagcctgggctgaggggagagaagaagggaggcagctcagagggctcaggctgggaggctccatggaggatggatgttctctggaggttgaggttgagacaggagcaggctaggggtgaaaggctttatgttgattcgaggcccctgcaggtcagcagagcagtgggggtctggagccaggggctgggtccaggttctgccgcttactgctgtgcagtcttgggtaagttacttcccctctctgagcctcagtttcctcatctgtaaaatgggatgacaatagctatggattcagttatatcctccttctatgctattgtatagaagtatctataccaaggtgtggacagtcaagccctcaatgaaaggaagctgtgatcgggattgtgactgagatggaatcagtaaccctagaagctgtgatgaagccaggtgaagcagtgccaccgagtgggtctctggagctcagactggccggggtttcagtggatctctgtgactcatgagctgaatgaccttgaagcaagttgctgcccctctctgagccacagttttctcatctgtaaaatggacccaggccaggcacagtatttcatgcctgtaatcccagcattttgggaggccgaagtgtgaggattacttgagcccaggagtttgagaccagccctggcaatatagtgagactgtgtctctataataactaaaaaaacttagctgggcatggtggcgccatgcctgtggtcccagctacacttgagcctgggaggttaaggctgcagtgagccgtggttgtgccactgcactccatccagcctgggtgacagcgagaccctgtctaaaaaaaaaaaaaaaagaaaaggatgcgatagtatgacctatctctcagagctgccttggggagctgaagagagactccatgtcaagtgctcagcatcggaaacaagaactgctctctgcttatgcctgtggcgtggccagtggcagtgag

SEQ ID NO: 12651 - DNA, 2056 bp, Homo sapiens
aggctttgtgatacctgatgaagggggcccacaggaggagcaagaagagtattaacagcctggaccagcagagcaacatcggaattcttcactccaaatcatgtgcttaactgtaaaatactcccttttgttatccttagaggactcactggtttcttttcataagcaaaaagtacctcttcttaaagtgcactttgcagacgtttcactccttttccaataagtttgagttaggagcttttaccttgtagcagagcagtattaacacctagttggttcacctggaaaacagagaggctgaccgtggggctcaccatgcggatgcgggtcacactgaatgctggagagatgttatgtaatatgctgaggtggcgacctcagtggagaaatgtaaagactgaattgaattttaagctaatgtgaaatcagagaatgttgtaataagtaaatgccttaagagtatttaaaatatgcttccacatttcaaaatataaaatgtaacatgacaagagattttgcgtttgacattgtgtctgggaaggaagggccagaccttggaacctttggaacctgctgtcaacaggtcttacagggctgcttgaaccctcataggcctaggctttggtctaaaaggaacatttaaaaagttgccctgtaaagttatttggtgtcattgaccaattgcatcccagctaaaaagcaagaggcatcgttgcctggataatagaggatgtgtttcagccctgagatgttacagttgaagagcttggttttcattgagcatttctctatttttccagttatccccgaaatttctatgtattatattttttggggaagtgaggtgtgcccagttttttaatctaacaactacttttggggacttgcccacatctctgggatttgaatggggattgtatcccattttactgtcttttaggtttacatttaccacgtttctcttctctgctccccttgcccactggggactcctctttggctccttgaagtttgctgcttagagttggaagtgcagcaggcaggtgatcatgctgcaagttctttctggacctctggcaaagggagtggtcagtgaaggccatcgttaccttgggatctgccaggctggggtgttttcggtatctgctgttcacagctctccactgtaatccgaatactttgccagtgcactaatctctttggagataaaattcattagtgtgttactaaatgttaattttcttttgcggaaaatacagtaccgtgtctgaattaattattaatatttaaaatacttcattccttaactctccctcatttgctttgcccacagcctattcagttcctttgtttggcaggattctgcaaaatgtgtctcacccactactgagattgttcagcccctgatgtatttgtattgatttgtttctggtggtagcttgtcctgaaatgtgtgtagaaagcaagtattttatgataaaaatgttgtgtagtgcatgctctgtgtggaattcagaggaaaacccagattcagtgattaacaatgccaaaaaatgcaagtaactagccattgttcaaatgacagtggtgctatttctcttttgtggccttttagacttttgttgccctaaaattccattttattgggaacccattttccacctggtctttcttgacagggtttttttctactttaaacagtttctaaataaaattctgtatttcaagagtatcatgtcttctgaaatttgtcttgccctgggtatatgctgttaggttcaagtgatgggaaaccagtgcttctttcttcagtgaggactgatcttttcacatcctttactgatttttcagatgtgcttatttcttcttcttcttcttttttttttttttttttttgagatggagtcttggtctgtcgcccaggctggagtgcagtggcatgatctcggctcactgcaacctctgcctcccaggttcaaacagttctctgcctcagcctcccaagtagctgggattataggcacccaccaccacgcccggctaatttttgtgtatt

SEQ ID NO: 12652 - DNA, 1215 bp, Homo sapiens
cagctcctgtaatccaggccgtggcaggagaattgcttgaacctaggaggcggaggttgcagtgagccgagatcacgccattgcactccaacctgggcaacagagcaagactccgtctctaaataaataaacaaacaaacaaacaaggcttctagttgcagtaggagggacgaattgagagcaagggtttaaggactaaatgcagggtgcagtacagtgtcagtgtcagtgtgcagtgctcaggaaatatttgttgaaggggaagagtatgcttcttcagtccaaggtggaagcatgaaggaaactgtaagcacattgatctagaccacagtttcaggtacagaggggagcgttaactaaagctcagagcggggaaagcacagggtgcttacaaaatggcaaatgctgtcatttaggccagaatcctactcacactgctgctgtatatcctcttcatctgtgtttaggattttgaaatgcatttttgttggattattgccccactagaaaaaacagttcagatctgttgcagtttcacatttgaaactactttcattctggaatccttatccttagaccttcctaataatttctgtggtcacactggacctgatctcttcctgtgctaaacaaaagcacacaatcacaaaactgtgtaggcataaatgagaggcatatgggagtggtgtaaaaggaactggaagagtcttaatatgcctgggtgggcgagctaaactaatagctcccagcagtttttctgaatcagacattgtggagccaggagtctagcatttggaattccactgcctgtgcaaagggtctgtcttttatcctccaaaccaccatttgttaactggttaatgacccagtggacccgttgacaacaaaggagggaaagctggtaaagatcaagttaaaaggaaaaagaaaagttcaaaggtaggaaagtaagaacaagaagggtttaatcatatcttcacctactctttattttttaacaatttattgtggggaattttgaacatacacaaagtagatggagtaatgtagtgacctcccatgaacctatcccctcagccccaataagctgcagttaccagacttaatgaaaggaaaccagaactctggtgaggcttaggtttggtttccagacctctctaggccttgtcacctttggccttatcccatcaaacacctcttttccccatttttagc

SEQ ID NO: 12653 - DNA, 1089 bp, Homo sapiens
caggctggaggcggcaggcggcaggcagcaggctgtggaggaggcccctcggtcagggagcggcctgcctcacccctgaatagctccttcggccccatctccatcctcagcagatgacactgattggcctcacggggacttgggtaagcaacaggcggcattcaggactcttctcaaccctgctgttcagacttgataagatctcagagtccacaggaaagaagtcactgttgcaataaaagcacccgtagtagcaaaaacataaaacaaataaaacttcccccacatcacagatgattttggacaagattttccaaccttgctggctactttagtttgggacctgttttttttctcatttgattttgcttgtgcagaaaatagtttccagcacatggattgatctgagagagaatgaggctcagttgtggatagtctgttttctctgagcatgttggccaactagtatcgtcaaattattgagtggatcatctcttggaaatgcagaacttctgccaccacttggctatttgcacagtcatcttgttctgtgtccttttatctctcagaccacacacatctggaacgctgtgggcatcttctgcccatgggctccatttggcacctgctgagccacagttgtcctgctggatgtgctgtgcaggttggtaggacttgcccccactgtcaaggcctggtctcatctgaaaagccctcctggacctcaaagaattcttcagacctcatagttacaggtcattatatctactatgttgatttatcatcaggcacacaacttctgtttccttctcttgtgttatctgatagcgtccctccttgagctcatcagaaaggttttatgaaatgtgaaccattttgggaaaagctgatcaatttttcttcctagcttcccattttcaaatgggacatcactcatatccctttcagaatgttaggaactgcctcccacattcttccctgtctttttgggttttgttttttgttgttgtggtggttttttaacacaaagtctcactctgttgcccaggctggagtgcagtggcatgatcttggctcactgcaacctct

SEQ ID NO: 12654 - DNA, 1098 bp, Homo sapiens
acaggtcacagagccattacaacagcttactagtttttcatggatttgttggattaacaccttaagcaggttttttattgttattttgtttgtttgtttgttttgagacgggagtttctctcttgtctcccaggctggagtgcaatcgcgcaatctcggctcacggtaacctctgcctcccaggttcaagcgagtctcctgcctcagccttctgagtagctgggattacaggcatgcgccaccacgcccaactaattttgtatttttagtagagacggggtttctccttgttggtcaggctggtctcaaaccccggacctcaggtgatccccccaccttggcctcccaaagtgccaggattacaggcatgagccactgtgtccggtcttgagcaggtttttaaaatctccagtggccataaaactagccagggtagctcatgcttttactggttggaataaggagccaaaaccaacaaaataatatttattagggctcgatgcccatttctgtggctaaggcttaggtttggtgtgcagagcctggcctgctcttgtgggctgtggttgctgtgacagtttcgttttctgaatctttgtaatgctcttccaccctgctcgtgctgcccagaggctgatctgcaaacctgggcagtattccacactgaagctcagtttgcaaaccttctgctgtgttaattctggtcagtttcacacagaagtcacgagggcctctgcccaggaccttctattcacatttcaagaatccctttctgaaattctccaactctctggtcaggaggaggagcaccattggggcggggtaggcagctagaggcgcaggagcgaatccaggttccttgcgtggttcccagcctctgctgacagcacctcagctaccaggtggggagtggaaattcagcctgcttagaggactgacctctacagttcatatttgcagtgacataaaaggcaaagaggagctggcatggtggtacagaaggtatcagtcaagcgcaggctcttcagaaacctagaaactaaaaagagatgcaacatgtgactggccatcagccagacatgtctagggtgagaccag

SEQ ID NO: 12655 - DNA, 1134 bp, Homo sapiens
cttggctgctgcccgctctctgcagcgtggatttcctttgcccatttgggccagaaggtcaccaggagttcatcactgcttagtgtcaacttgacatcttcagcttccagacagaaaacccatgctttactttgtacagccctgtcccagagttagtaagcctcggcttgtcacctgcttgcaaagggtatagacatcattctgggtagttctagaggatatcgcaacaagtgcgtttgaaggttcagcacagctggaattgtacggtagtgagctcttcaaaatgaaaacagaatgaccggatggccatctgtcctggaaactgtagaattgaataaatcactgaaaatagaacacttcttggaggctttcttcagaactgaactagaaacaaggtttccaggctcccaggtcagtagaccaaaccaacttccttagatttttttttttaagctgtttgcagaaaactgggtggtagcgtgtctgaaccaaacggaagaatagccagcggagcatggactgttccagcacgggccagatggccagctgtcgagagcagccctgcccagattgcggtgggggctgtgccagcggctccgcagggcccttccaactctggagtgtctgtagttcttgtgaaaccaaaacgttgactacctgcctctttcctcgggcatcgacgtgctcatttccaaagatgatggtgcaggtgaccttttccatcgtgagctaagagaaggttaggaggcctgaggggcgggccttgtgtcccctcctccccctccacagcccctgaggtggagcttccctcacagaccccatctggtcgagcctacggctgcccagtgtacactcagtgatgcttataccaaatagggcatgtgcgctggtgtctgttggggacagccccatccctaccttggagtcggcagagaagcagcaataagcattaggcgaatgattgaaagggctgctgcgccaagaggccttcagtccccttaacgtggctttccaacttcctgacgaggctacaaaggctccgctcacaaaagaaagccaataatgtaaataaatagaaaacgaagcctccacgcgtggtttttaaagggggatgatgaatgtgacaccacccac

SEQ ID NO: 12656 - DNA, 2116 bp, Homo sapiens
ctcccttaagagcaaacaaggcccgatcgatgttttcctgtgccctgaggagaccgtaggtgggatcagccctgggaagaccccatcccaggaggtcacttctgaggaggagaacagggccactgactctgccaccatagtgtcaccaccaccatcatctcccccctcatccctcaccacagatcccagccagtctctactcagcctggagcaaggtgggtgatgggtaggtgggtggggtggggcagggcccctcttctggggggtgggcaggcacgacagcccctgccttcctccctgctggggcatccccggcctgtgatgctccccgtctccccagaaccgctgttgtcccggatgggcagcctgcgggctcccgtggacgaggaccgcctgtccccgctggtggcggccgactcgctcctggagcatgtgcgggaggacttctccggcctcctccctgaggagttcatcagcctttccccaccccacgaggccctcgactaccacttcggcctcgaggagggcgagggcatcagagacctcttcgactgtgactttggggacctcacccccctggatttctgacagggcttggagggaccagggtttccagagatgctcaccttgtctctgcagccctggagccccctgtccctggccgtcctcccagcctgtttggaaacatttaatttatacccctctcctctgtctccagaagcttctagctctggggtctggctaccgctaggaggctgagcaagccaggaagggaaggagtctgtgtggtgtgtatgtgcatgcagcctacacccacacgtgtgtaccgggggtgaatgtgtgtgagcatgtgtgtgtgcatgtaccggggaatgaaggtgaacatacacctctgtgtgtgcactgcagacacgccccagtgtgtccacatgtgtgtgcatgagtccatgtgtgcgcgtgggggggctctaactgcactttcggcccttttgctctgggggtcccacaaggcccagggcagtgcctgctcccagaatctggtgctctgaccaggccaggtggggaggctttggctggctgggcgtgtaggacggtgagagcacttctgtcttaaaggttttttctgattgaagctttaatggagcgttatttatttatcgaggcctctttggtgagcctggggaatcagcaaaggggaggaggggtgtggggttgataccccaactccctctacccttgagcaagggcaggggtccctgagctgttcttctgccccatactgaaggaactgaggcctgggtgatttatttattgggaaagtgagggagggagacagactgactgacagccatgggtggtcagatggtggggtgggccctctccagggggccagttcagggccccagctgccccccaggatggatatgagatgggagaggtgagtgggggaccttcactgatgtgggcaggaggggtggtgaaggcctcccccagcccagaccctgtggtccctcctgcagtgtctgaagcgcctgcctccccactgctctgccccaccctccaatctgcactttgatttgcttcctaacagctctgttccctcctgctttggttttaataaatattttgatgacgtttgggccgggttttgggactctgttgggaacatttcggggcgggagaggccaaggttgctggggaaatgcccattctccacttcccttctccctgtccgtgcccgatttgatttgagcctcataactcgaagaaaggtcagcttcctcgctgttttggtcctaactcaaaagcagatccagtaaaggtttttgttgtagaaagccaagaatgctattcagtgctgcccgaagtgcagagtaatgagtggcctctcctttccccagccccagaggccactctgctcagtttgctgtcttccttccagacgtttctggacattagtaaacatgtaacaaatacagtgggctggttctgtgtcaggtatttaacagttctggggacacgggtgttacctcctttcatggtgctctcagggtctgaaagaggagatctgcataaatgagaaaatcgggaaaggcgttctggaatgggtggtgct

SEQ ID NO: 12657 - DNA, 1190 bp, Homo sapiens
cggtgggcgcggaaactgagctggtggtacctggacacgctgaggggctgggctccaacctggctctggcggagctgcaggctggggccgagggcccatgtgccatgctcgctgtgcccgtctacatccaggcctccgagtgacggacctgaggtgtctgtttcctgggcaggcctgatgctcctgtttgggtccagggcccctgggggcagaccggtgatccttaccagtggaagcgagccatcgagccattggcagaaatcctgctgaatgtcattcagaaacctcagcccatggtcgccctcctgtgcccctctcctgccggaaagccctgcaacattctagggttgggggcagggccatccacggtttctgggcagagccatggtggcaggagagagatggctgaagcctgagcagcccagagtcccgctggtctaggctggtggtcggggcccctgggagaggagacagggcattcctccccactctgtctccaggctgcctctgggtagcctctagtctgctgttcttcaggaggcctgccataaactcttcggagtttacgtgttgcaccttttcacagacggttccccacagcatcctcagacagctctgtgatgtagcttttaggaggcactcaggtgtcacggctagactgcagctatgagacagatctggcttcaaatccaagagttgccatgcacttgctgtgtgaccttgggcaagtcacttcacttctctgagccccgtgttcctcatctgtacaatggggcttacgatactactacctcatagggttgtcctggggatccagtatgatgaagtgcgccaggggcttggcatggtgcccggcacgcagaaagtgctcaataaatgtttttgtcataacgtgtccgggtggcctgggccaagctgtggcagtttccttctttgcccctaggtggcagcactccccctctgaagcttgtggtggctgaggggtcccaggcccctcacacagggagccctggagagatgataagggaagcaaggctgggcacggcagctcatgcctgtaatcccagcactttgggaggccaaggtgggctgatcacctgagatcaggagtttgagaccagtctggccaacatggcaaaacctcgtctctagtaaaaatacaaaaattaaccgggtgtggtggtgcacac

SEQ ID NO: 12658 - DNA, 1450 bp, Homo sapiens
tggagaggagtctggccacagggcagggctgtttgacagacaccatggagcacaggcagccctcatttccggccagaacatgttgaacgcaccagtcatcctaaatagccttttctgtcttcacacagccaagaagaaagaagaggaggacgacgacatgaaggaattggagaactgggctggatccatgtaatggggtccagcgctggctgggcccagacagactgtggtggcctgcgcagcgagcaggcgtgtgcgtgtgtggggcaggcaggatgtggtgcaggcaggttccatcgctttcgactctcactccaaagcagtagggccgcgttgctgctcactctctgcatagcatggtctgcacctgggagatgggcggggggaggggggcgggcggggtgggaagtgcctgctgtttataatgttgaatttctgtaaaataaactgtatttgcaaatccaacattgagcttctggactacgctgactccactgctgaatcctcaatggaaagggtcgactggttgcagttgaaatgacctgaaatgtagcctctgtccttgtaagtcagttgacttgccgcacatctctttgtgtacttgtacggtactggcagaaaagtcatttttcaaaagccataggcttttccttgcccttagctgtaataatgcatctgattttgatttcctccagagctgtgtttctgtccatcacctgtgtattggccctgtgtttaccactctggcccactcctcacccccttgctcccctggtcttctggagtttgtgacattgatttgaaatggatggtgttctcttgagagcaagtgagattgttagaattaagttccaactatacagttttctaacatagctataaggtccttgttgctgtttgtgataactgatagataactcattggaaacgtgcatacatttatattcagatgaaattatggtttgcactgtctattaaatatctcgattaattttcatactttgctgttgtgtttaatctatcatttgcctcgggagctgaccctttccagaccagcaaggtgtacagtggagtctggaaacatggaagacttaaccatgacatgtgtcaacagtttgaaccaaagagcagagcttgtctcaccagaagtctgttcaagtcctagattggccctcaccttgcctggggactctctgggtacagttcagggtgagttggttcttgggtacttcagggtcttccctatttcttctctgccagtgtccatgggcagtgccagcaggagccttactgttggaagccatggtgctcccatcagacaaggctcatcaggaacattgaagaaatggcctttcccatggggaggaagtgtagggcactgactgagaatctaggacacagaggtcacctcaggactgctgagactcaacatatgactctggcccagccc

SEQ ID NO: 12659 - DNA, 1128 bp, Homo sapiens
tgttaattgtaattatctaatattctgtgggatctctgtcttcctgtctgtgaaacaagggaattggactagataatcttgagtgatatttctacctttttacagttttgtggaagtggcttgagaatttatctctggaaggagaaagggctttgctaaagtattgagagtatctcagagggttaaattctgggttcacaaaagatacctttcagtatataaacagatggatattgctttttagagtggacagattgctgaaaaattgcttgtgagatgaatttatcaaattgtatgctgagttccattataaacttggagctgtagcctcatgggacaaacttggagtccaagactataaaaaaattacattaaaatatgtagcaaactgtttaaaatcacataataaaggaaaaataaaaaacattttaagattttcacacaatggtaataatggaaaaacactagaccagaaacttgcatttcctaagagctttagcttatggagtagatgcctctactgaggttacctggcccttgaagtgccatctgtagagactgaatagctctgttatttgtcaaggtaagactcattgctttattccaagtaaatattctcttttagaatgccaggtttggaagcttaatgttattggccagattttcttcattccagaggcatttatctggtatttagctgtctcctgtttattttattaaggattttaataagcttagttaacggtactgcttacatggtgtctcttgatctatttgtctagtttcctttgaaattctttgtgttagtgaaagcaagcccagcagtagatttaaaagggtcatttccataacttcatttatctagatttgggtttttttggtaagagatatgaccacactatactgagaaatcgaatgttgtttcctttttttttgagacggagtctcgctctgttgctcaggctggagtgcagtggcatgatctccgctcactgcaagctctgcctcccgggttcatgccattctcctgcctcagcctcctgagtagctgggactgcaggtgcccaccaccacgcccggctaatttttttgtatttttagtagagacggggtttcacagtgttcgcc

SEQ ID NO: 12660 - DNA, 1118 bp, Homo sapiens
tcctgaatgggataacatttgagatgagcattaaaggagtagactcaaaagaattagagtcaagcagatcagggggtcagatcccagccctgccattcactaacattgtggtctctctgaatgtgagatttctcccttgtaaaatgttgtggttctgcatatcatgtgagtaacaaatgagggaatgtatgtaaagcacctggcatgaggtcagcagccaatatgtggcaactcttggtaatatgacaagaaaacaagatgcaggaacaggtaggctggatgctataagggttaaggaaggtaagaggcaattcatttatccaggatatgggccgtgggcagtccttgagcccagcccagggacccagcttcaccgaggctctttttcttcaggtgggcaccatgtccttgaagcttcaggcaagcaatgtaaccaacaagaatgaccccaagtccatcaactctcgagtcttcattggaaacctcaacacagctctggtgaagaaatcagatgtggagaccatcttctctaagtatggccgtgtggccggctgttctgtgcacaagggctatgcctttgttcagtactccaatgagcgccatgcccgggcagctgtgctgggagagaatgggcgggtgctggccgggcagaccctgggtaagcctctcttcactatattctcctagtattctctagaatagctgctatcactatccagttctcaacccccttctctctttctctcaccgctaccactgctctgagattttataaatttataagctatgtttaagttttaaatagttataaaattaatccctatagggaagaattttagaagcctctggaaaacacttctgacctgtctctgctttctcagagcttcttagtgacaggctttacagttccagttaaaatgcagattctccagagaaagagaacagagtggcctagaacagcctgttacaccgggtacagatgacttaggttagaaccctttctgagagcgagcaggagggcctgagagcacaaggacagtgtgaatacgcttggttttggtgtcatgtccatgtgatatgactatgctagtggtctctcttgaagtatgtacagtgtt

SEQ ID NO: 12661 - DNA, 1812 bp, Homo sapiens
gaggaatatgtcacttgtcacacatgccgatcaccggacacaatcctgcagaaggacacacgactctatttcctacagtgcgaaacttgtcattctagatgttctgttgccagtatcaaaaccggcttccaggctgtcacgggcaagcgagcacagctccgtgccaaagctaactaatttgctaatcactgattttgcaaagcttgttgtggagatgtggctggacaggtttgccatcagagtggatataccgttgtattaaaaacaagataaaaaagctgccaagatttttggcgagtggttggtctgaagtccttgcaagacgctgatgctcaagctgttgacatactcattgcctactttaacacctgtcagagaaacgtgatatggggtaaggaggtgcttttttaaaatcgttcatagacttctgtaaaatgcaagataaattaaagttattataacagtgattctttcaatttggtttgtccttcagttttcttttctataaatgtgcttggtgaaatcagcaagaaaccaaccatataaaacagtgtgtgccgggctctgactgagaaactgaacaatggcaggcgcttcatctgggcagccatttttcttctctgcttctcttgagatacatagttaaagtagacacggcctcccacgcgagtgtggtgggaccttgagacttaggaggattgcctgttttcagtgtccagggaatgactccatagatttgaattcttttccgtatgtggggatggttgctactacctcaccgccaagtcctcccccagctgttaccacatgagggaatacaaggtgctaggtaccctccttcctcgttggccactaagaggtcttagaaacatagcctgtaaatgtgtcttgtaactggcacactaaaaaagatcctagttgagcatctctcttggtgaggaagcgatgtgtgtgcggttcaggaaactcctccaagaggaggaggagtccaaacagggatgccagaggaagctttccgttttcctagccaacttgtgttctgggtttgaaaaagacccaccacaaatgctttttctattttctgatttaaaagtcgcttttgaatatgaccatgagaaaccaagaaatgctgcttgtgtggtgctctgcttcctgaggatttggctggaaggggattctccgctggcacatgggagaaggccatcttctgtgtcggtgctgtgatctgccttgttctcacttgctgaggataagggcatacacgctgctcctcgctttcttgttgcccgacttcgtactaagcagctcaggagcagtcactcagacccaaatgtcttgactgtgttgtttttaatcactgtgacccttaaagtacaggccaagtgttgtcaaacaccttggctaaaacagtggagggtgatgggtaaagcagtagagggccctcaacccacacactggctgaaactgccaccaactgccacgatgaacccaactgctgtttatgcccccattttcctttttttgtatctacacccacacgattcccaatgttggatatttctacatgaataaagcaaggatcagtgcctcttatgtaattaacgctccattgcttttgtgtatgtatgtgtgtttgggttattctttacttagcgggaccctttaggagaaggaatgatactcttcagtttggtgacaggttgacaaatagactggtgatttcaacccgtttttaacttcattcttgaagcagattctcaggactgatgcagcccctgtaagagtccagttgagataactgactaaattgga

SEQ ID NO: 12662 - DNA, 1189 bp, Homo sapiens
ctgatggtggaacagatgcagagaggtcacacagccagtgcacagcaattcctggtgcgcacccgtggggcagcctgcccagagtgcagcagtcattgtagtactactcactgtccccacctgaatttgtggactgctgagggcatgcagccctctaggaattaggagggcagtggtgaattagctaatttagggccagggtagtctggagtttgctagtttgggctttcctgaatcttacttttccatgtatcatgtactttgccatagaaacaacagaatgagtggttgttcattcatttcactttggacaaggagttgctgagcatctataatgaaccaaatgctggttggggatgaacctctgccctcaaggagctcccagacttgtagtaatgcatgtgtatatttaatcagaagtgaagtatttgctgttaagcaacatgactcaaaggggaactttatacccctgcagttactaagcgtattcatgaataccactttatttttatagctgctgaatcgagtgttcaacatcatgagggaaaagaatccagatatggttgctggggagaaaaggaaatttgtcatgaaacctccacaagtcgtccgagtaggaaccaagaaaacttcttttgtcaactttacagatatctgtaaactgtaagttggttaatggagtaccttcatcccaaatgccagattctcattgcagttttaagaatgttaaatgtccttattgtcgactttattatagatggaaagaacacacaggtgtaggggttgagggagttcaccgttcaagcctgtcattttcttcaattcataagtctcagggctgttttattttattaaagataacggtcttgctttgtcgcccaggctggaatgcagtggagtggtcatggctcactgcagcctcaatctcctgggcttcagcagttctcctgcttcagcctcctaagtagctgagactacaggtgcacaccaccatgcccgaccaatttaaaaaaatttttttttttttttgtagaaacgtgggtcttgctgtgttgcccaggagggcttgttttattagtgcattcagaggtgagagaaatcaactcatgctgacccactgaggatggatcctaactagatgtagtgaagagtgaggaggctcaatgtagttctcaggagccttgggagc

SEQ ID NO: 12663 - DNA, 1250 bp, Homo sapiens
gagtgcagtggtgcgatcttggctcactgcaattcttaagactattgtctgctccagttgtgggtagaagcagctggctctgcttggccagcgtcctttgctcacaagaggctcctgggaaccccacacctgtgccctagtcatgccacatgggaggagtgtgggctggtggtcagtagccctcagttctggtgtctattctggaatttcatttagagtggcccaagtgcgtcttagctcctctctgggcatctgtaagtgatgataatggtcatggctgcctcacagggtttctatgaggaagaatgagatggggtatggaggatttagagtcatgtctggcagaaagcaagtaccccacacatggtagctgctcgtagtcattttttggccagactttgcctgagattcccccacacagaggctgctagtgctccagtcctttcagtgcagagcaaaccctggatcctgccgtgtggatcctgctgagggggaggcgttgtggggtatcaagccctggtcactcagggttgatgcctcagtccttggcgcccaggcagaaggggatgggaaaggaaagaatgatttcctgatatctatatctggggcggggggctgtacatggcttctgtctcacttaatccatactattgtgagccctatttacagaggagaagactgaggctcagagaggtgaagtgatttgcccaaggtcacacagctggcaagtggcagagccagggtttgaactcagatctatctggctccaagttgtgtcctgaccactgctgagttttcagaggggccggaggtggctggggatgggagttgggaaggaggtagttttggctctgccagagttgttccctggagcaggtaccagttgggaagtccaggccctgatgtgccactcaccctccagtgtatgcctggaagggcgaaacggacgaggagtacctgtggtgcattgagcagaccctgtacttcaaggacgggcccctcaacatgattctggacgacgggggcgacctcaccaacctcatccacaccaagtacccgcagcttctgccaggtgagcagggcggggcaggtgggctgggtgctggtggcctgggtggggcctgtttgcccacatgatggccgcaggcctggcaggactcccatcacctcaagcagcaggatctggaagatgggaggatggcaggctctggcattcatgctggggcctcctgacttctgagggtgcgagg

SEQ ID NO: 12664 - DNA, 1177 bp, Homo sapiens
ttttactggtcagacaagctcaccccacctcccctggggcagagaggccaagagcattcgttatacggatgagttcctccaggtggaaagaaacatcaggagtggggaagcatttttacatctaaaaggagatcaaggaactgtcaaatccaaaatgttagatagtatttataagtgttgaatcaccgagagtgatgactgagagaggaagatggagaaccagcagctaacatctttagggagtctttagggagtgaggagtggcctggaggttggtaggtgtcagcagaaaggcagggtagtgggaagtatcatgtgagctatttttcaaagggacgcttctttatgttgtaatttttgtgtccctgtgtgattaaatgtgttctcccacaagtcagaaaggtgcaggtaggcagggaccgtgtctttcttgagtactctggcttcataaatacttgttgcatgagtgagagaatgcggtgacagagtgctaagccctagtgtgttgagtccacacgtggatcggggtccatgcagtgaccgcccctcttggttggtgggatgaggggactcacggaactcccacctgtttcctcccgtagccgacatcggcctggctgcctggggacgcaaggccctggacattgctgagaacgagatgccgggcctgatgcgtatgcgggagcggtactcggcctccaagccactgaagggcgcccgcatcgctggctgcctgcacatgaccgtggagacggccgtcctcattgagaccctcgtcaccctgggtgctgaggtgaggcccacagctgtatcaccccagagtccttgccctccctgggttcagccagggaagaagacgactgtgccagggtggggaccttccaggtgtggagctgaccgcgggcctggaggggttcctccctctcactcggtttcctccgtttcccagtgctgccaccccttgtggtgagtgttctgcagattttctccctggctgggaaggtcactgttggctaccctcaaggcatcctcctgatggatgctctggcaggaaaaattcaacacccatgtcctacttagtctcttaagggccagcttgccttggcccttcgggggtcacaggcctaccctggacccatcatggctgctggatgatggcagctctgattggttcagc

SEQ ID NO: 12665 - DNA, 2968 bp, Homo sapiens
aaaggatgttgagcatttttttaatgtgcttattggtcatttgtatgtctttggagaaatctctatcctttgttcatttttaaatattgttgagttttaagttttttatatattttggataccagtcctttatcagatatatgatttacaaatattttttcccatttttgggttatttcactttcttgatggtatcctttgaagcacagtagtatatttttgtgcttctatagtagtgtataaagtagtatactacactactcatttgattctttgcatatttccttttctcaaactaacaattcttgcttttagttttaatcgcctggacctgccaccatacaagagctatgagcaactgaaggaaaagctgttgtttgccatagaagaaacagaaggatttggacaagagtaacttctgagaacttgcaccatgaatgggcaagaacttatttgcaatgtttgtccttctctgcctgttgcacatcttgtaaaattggacaatggctctttagagagttatctgagtgtaagtaaattaatgttctcatttagatttatctcccagtgatttctactcagcgtttccagaaatcaggtctgcaaatgactagtcagaaccttgcttaacatgagattttaacacaacaatgaaatttgccttgtcttattccactagtttattcctttaacaacaatattttatgtgtgtcaaaagtctcacttgggagtagtgtttttttcttttagacattctgcagacatgcagggaagtcctttggtaactgcaatatacaagattttcctattaagcctcttggtaagaggcatttgttaaaagtgcaagcttactcctgcttctggggatgtgagcaaaattcgggcttgtgttctccctctcattttagtctgacttgactattgtttttcctttctggcgcatgaatccatacatcattcctggaagtgaggcaagactcttgcatctctacaaagtagttttgtcaatttgaattcagggaaaagttggtcacagcctgcaaatgacttcatttggaagtctgattgtttcagttgcctgacaaatactacactttacaaacaatgttaacactgtgattccttcattgttttaagaagttaacctagggccgggcatggtggctcatacctgtaatcctagcactctgggaggccgaggcaggaggatccctttagcccaggagttaaagaccagcctgggcaacatagggagaccctgtcttttttttgggcagcgtggtgggggataaataaataaaaggaaaaaaaacttagcctagaattagaattaatttaattgaattcatctaaagatgtctctggtgatttttatatgttccgctatataattgatgctttatagttttatcataatccaacaacttcagttatatttaattattgttaaggagtttaagactagaaagactagagtgctttctagtccaaatagaggtcagtgaaacagcttttgacatcagattttcatttgagagggagagctgtggtactggctaaaaagaaaggaagataacatccagtaaccacaggaatatattctctgtgaattaaaagtcttcaaagttatcatttctctgacatatgttggagtagtcatttccattctttacattgtcatgaactggattgataaccctcatctgcaatattttcacccctaaaatttttaacagggtttcctttttttctcacgactatttaagtttagattgctccattattaactgattaatgcactttgaagttctctggaattaattattttaacttggcctagcttcgactgtcaaggtggctgttataaatttgacttcattggcagtggatgaagcctaagccagctgagtctctatcatagctgaaccctgaggacagcctcatagctcatgtatcagggacttttgccacatttcagaggcatagcatgaacaagtaatattaagccaagaataagcagcagaaccctgttccatatggaaaaaagaaaaacaattttttgtccctaatgttcttccttttacatcctggaacaacaataaaaacatttttttaaacttgtctactgtaagatactgccatcataaagcagagacttacatgagtgaaagggttgcctcatcaagcagctcagtgtaaatggggaggctaggctctccccagccctatggtttttttatttcatgtaccccaggaaatactgtgtggtttctaaaagccctggttgttaaaagtagggactctgcctttttgttggtagggagaaaaaacgctattgctttgtcttacagagcgaatgtctgccaactacccgttcattatataagtctgaacttggtaatatatggctaatgaagattaagccctctataaagacttcctgttgaggtgaattctcatactgaaatgtagttacctacaatatttactagagatttatgaaattaaattaagagataatgtaagaaaatacatttttttggttctatataatgcttcatgattcatttagggacctagaaatattgtgtgaaaatatataaatatcacccaaaaggctttctgccctatatttttaaaatacagaatagttatatttgaagtagccctggccctagttctatagggcttggctatttaatatttttatggaagaagtgtttagttctggaaaaggtaaatgcttgtatatatttttgcagcctgggatctccctactccattttttcctttaatttaagtggccacatgtatatgtcttccctgctgtgttaggaaaatgggggctggatatcccaagaatcagaggttatataaaaatactgcaaatagaccgcagacataaatatctaccaaatgctatcttaaattttggtccaaactgaacatatggaaatagatttattgt

SEQ ID NO: 12666 - DNA, 2411 bp, Homo sapiens
tgcaaattgttcctatccaggttcagggccttcagggggcctcttttcattttctcccacaggcctctctttctttctaggttgctggggagaaatgggtaccctatgatccccctccccttctcctccagtaaatacctggaagagggaacctgaatccctgggggagacagaaggggcaggggccaccagcctccccttcttgtggtgagactgaattttgggctcagacaccagcaacagcctcttgggatgccctgagttgcttcccatttcctctttctagccgtccttttctagtgtgtgctcactcttcctaggaacttttaagacttcttggtacctatgaacataggtcctcccctcaccccaactctaggtttccaggcctcacagccaagctgaagcttggagaaaactctgcattcccatgagggcaaaggcagctgccctccctgaccctatagccccaggcctcatggggggtatgtggggaagggatggggtatccccatggatgctgggatgaggacagaggaagacctgatggggtctcctattccagggaataagccaaattaacactaaaaacggatcaaagctcccacgccagtccactagggccccagtagttgacagccttgctcctctcccaagttctccttcagaacctagttgcttttattcttccagctaccacttgggcacttcacagccagcctagggtcttcggcacctccaagagctgaatctccctccaacccttcttgcctactcctcactgccagctgggacctaggctcagtcctgtgtggtgcccatgatccttctggtgggggaagagtttaagttatagggcatttggctcaaattttaaaaggccttttgtttacctatatttctggaggctcctgtattctagaacccaatctctcacctgcttggttgcaaggctcatatttttttgtacctttcctatagattctgtagcatttgagtgtggcaatattttaattgtgtatagatttctaagaaccaacactactcagtctcctgctagtctgactcctgaagcatcagcccttgtcatactgtattgactgtgtacgtgcctttcaccttgagcatgcttcaggatttttttttaaaccacagaacttgaatacatgagggaaccagagttcaaagtcctatgcaaccttaggagggggttagagagtctgttttgattgatgttttctgaggccctagaggagtttgtatcaatttgtgagtattaatgtcagtactaccagcactttgccaaaactgtcagagggacccgtttctagagtgagtcccagttacatcaaacagtgacttccagttattccccagtaagtctgagtggttccttcaagctgggtgtctttccagcctttgccagtctagccccagcagggcaccgtgtatgaatgcagtttggtgctgttttagagtatgcctgctccccagccccctgcctggaaccctctgagcaacttgctctgacctataatgtcttaggtgcaacacggaccccaccagagctcttggatacccccctagatccatgtggctttatgtgaggggactgaatgcagacacaccatagcccccttctactactttccctctcgccctgccacctagttccacatggaaccaacaagttgagtgcatccctgttgggtgttttgtgttgagactggctgaaatgaggagactttgaccatgtgacgtgtcaacagactcaaggagacaaccacctcaactgggtcatgtggcatgcctgtgtatgtgtgtaacagaattctgattgttagactgtaatgctattcctctatgggagaaaaaaattaatataaagaaaaacaaataaaaatatatttaaagcacatgatcctttctgcctgagttgagcttaagtatgagaagcatcttgtaatcttaagcacagtagtggcataggatattatgataaagctggccttggttctggtgtgtgtgtcatatgggagaggaagaggggagataagcttactgggaacagagccagacaatggggtctgactcataaatgactactgttagaggatccttacaatgcaagacacatacatgaagacagctgaaatagagatgagaataacagcatgacagaatgaccaaactcatccttgtggtctcaggcactgggttagagcaagggcaagtagccactggaggggaaaggatgaagtctaatcctgggggagatgcagcagaaggctgaagcccaggctgagacaaggccagggccccaagcatcagagtctcctcaagttgcaggtagggtggggcagaagcagctggctttggagactacacacattttgaagaaggacagccag

SEQ ID NO: 12667 - DNA, 1176 bp, Homo sapiens
attcatcctcaataattcaggttatgaaaggatcacagccaagcacaattcctgcagccccactgacaaccaactctggcctgatgcctccctctgttgcagttgttggccctttacacatacctcagaacataaaattttcttctgctcctgtaccgcctaatgccctctccagtagtcctgctccaaacatccagacaggtcgacctttggtccttagctcacgagccacccctgttcagcttccttcccctccttgtacgtcttctccagttgtcccttctcatccccctgtgcagcaagtgaaagaattgaatccagatgaggctagccctcaggtgaacacctcagcagatcagaacactcttccctcttcacagtcaaccacaatggtttctccccttttgaccaatagtccagggtcctctggcaaccggcgaagcccagtctcgtctagtaagggcaaaggaaaagtggacaaaattggccaaattttgttgaccaaggcatgtaagaaagttacaggctctcttgagaaaggggaagaacaatatggtgcagatggagagactgaaggccaagggctagacaccacagctccggggctcatgggaacagagcagttatccacagagctggacagtaaaaccccaacgcccccagcacccactctgctaaaaatgacctctagccctgtgggcccgggcactgcctcagcaggacccagcttacctggcggtgctctccccaccagtgtacgctcgatagtaaccactctggtaccctccgagctcatctccgccgtaccgaccacaaaaagcaatcatggtggcatagcatctgagtcacttgcgggtggcctagtggaggagaaggtgggatcccatccagaacttctacccagcataggtatgtacttggggcttcatcatctctttgtgtcagttttttgatgacctaatcccacaagagaaagcatgactccttttttacttggaggaaagagaatgggctaaatggcaatagcagtagttttatttattgaaagtacgttggaaaatatgcttttaaatcccatgttaagtttgcattcattaaagagagctaagggccaggtgcggtggctcacgcctgtaatcccagcactttgggaggccgaggtgagtggatcagttg

SEQ ID NO: 12668 - DNA, 1190 bp, Homo sapiens
ggactggggggcgttatggggtcccaggcgggtgggtgggagttaaggcctgtgctggccacccactctgtggctcccaggaaggactccgagctgagccagctgagcctgcgggtggaagacgagcagctcttgggggcccagatgcagaagaagatcaaggagctgcaggtgcgtggggatcgggtgggtgaggcctggggtcagaggcccacagaggtgacagctgccccacgtgcccaccccaggctcgggcggaggagctggaagaggagctggaggcagagcgggcagcccgggcccgcgtggagaagcagcgtgcagaggcggcgcgggagctggaggagctgagcgagcggctggaggaggcaggcggcgcatccgcggggcagcgcgagggctgccgcaagcgggaggcggagctggggaggctgcggcgggagctggaggaggcggcgctgcggcacgaggccacagtggcggcactgcggcgcaagcaggcggagggcgcggcggagctgggggagcaggtggacagcctgcagcgggtgcggcagaagctggagaaggagaagagtgagctgcgcatggaggtggacgacctggctgccaacgtggagactctgacccgcgccaaggtgtccgtgccttcctcaccccatacccaccctgactttaaaccaatcccgatcccagcagccaatactgttcccacaccagcctccacccagtaccttatcctgagccctgacctcttcacctggtacacaaccctcatttctcagcctcctaccagtcctgaccttaagccgtgactcccaagccctgttccctgactccaggtcatttctgatccagcatctacttccagcctcagacccttgaaccagcagtagttgtgaccctagcccttgactcctgaactctgacttaatacctgtcctctcttcctgtcctgaaccccagcaccctagccttaacccctgacctttctaccacataatcctgacagctgacctctgaccattgtccccaggtgactccgcagctaccatcccaactctcaccctgacccactgccctgggactggcccagccctgtcagttctgacacctgttaagcccagcagtagaatctctttccctgactttgaacttggggctctgctctccctttgattcctgggccc

SEQ ID NO: 12669 - DNA, 1512 bp, Homo sapiens
tcccagtctgctccacctcctggtgaggtctgtcaggcctggtcctgtccttggagccaccagcatcctcagacaagaatctagacagtgttgccagttccatccccaggatgcttgctcaaagccaatgcatggtctgagctccatgccaggccctggtgggggcagccacgttgacaccttcaccctgtccctcctcacccagcacatcctttactgcattgtggacagcgagtgtaagtcaagggatgtgctccagagttactttgacctcctgggggagctgatgaagttcaacgttgatgcattcaagagattcaataaatatatcaacaccgatgcaaaggtaaagttaacccagggctctgtggagtgtgctgggttgtccagaagttcacctggagtcctggtctgccaggctttaggcacaggttttacgttagagacgacgggggagtctgggcagtctttggcaaacattcattggaacctgctctgtctggctttgtgctagaccctgggaatgcagggatgaaaaccggggctgcttgtgggtagggagtgagggtgggaatgggtggcttgtgcgcctgccgtgacgcagcatggtgggtgccacggtgggagccgctgtagggagggactgggcctggtgtgttaggctcaccgagtgtgtgtgacagaaacccagctcaggctagctgaagtaaaattaaaagtaaaaattaaaggaatccagcacccttgagcgtaaaaccactggagagagtgtcggatctgtgctgaattccggggagtgcctcttagtacctgggtggtgaggggaggtccctcagcttatctgagcctctgtcttcctatctgaagcagtggggctggtagaggtcgctgatgccccttgtagtgactatccccccgggccatggccatacctggccagcagcccactgcctgctgtgagcttggtttctgtatagttccaggtattcctgaagcagatcaacagctccctggtggactccaacatgctggtgcgctgtgtcactctgtccctggaccgatttgaaaaccaggtggatatgaaaggtacatgaaaggcaggctgtcaaggcaagtcatgcagggtaagaatgctggcatcagacaccctgtctccagcagggagacaagaatgactgagggagctgcaccagatgcccacgtggccggcctcaaggtggcggcttccagggcaattggctttgctgccttgttcaacactttaataaggtgaaaatccattgttgctagcaagatgcaaagaaaaccagaaaaagaccttcctcttctgggctggtattgcctggcacgatgagttggccccctcgtcctcagtgtgctgtgcgtggcatcgcaggtgccctgtggtgcagcaggcatctgaaccctcctggacttgctaacgcacttccatgtgtatgcgcacgcgtttcctttttttcctaggagagggcttgtggcatccagcagatt

SEQ ID NO: 12670 - DNA, 1215 bp, Homo sapiens
tggaatcaatggatttctcaacctactgcccctctaaagcaagagtggacagcgtggctattcccaggggccggcaggaacttcagacaggcaaagccgactgcttactgagcagctggaggattcttccctccacaaggaggtgtgctcccatttttcttgaaagacattctgcgctcatttattttttaaccttcgatggagaatgtacaaggaaaattactctctgctgtaaggaaaacagtgcaggaagggggtgactagcagctgacccttgaccttggcattggggaggtgatgtggggaccttagtgaacaagaatttcagtgagctcagctccagccagctgcgtgtgcacaggaaactgggcccactgttgcataacttctgattttttctgccaagcaaaggcagaaattaagatttatgtgaaaggtcctgattttaaatgttggtttaaatattttaaaaaccttgcatttgagctaacagaacatgcctggagacagctgtggccccagggcacctccatcatatgcacccatcctctgtgagaggttttccggctgaaagccatagaagggctccaggaagcatgttaaccttctgaaaaatggcaccacatatgttatggaactgtgctgttttccctgaggaagtgagtctctggctttcatcagactcttcagtctgagtactctgtgggatatcaggatgaatgcaaacagccatggcccctgctctcatgaagggcagagtctgaaaacagagacagttgttcatccaaggattccaccgttgagcattagtgataagtggagatggtattcaggaggagaggaacggggtctgtgagagacatttgacagggtccaggactggccagaggacactcaggaactctcccctgcagaagtggcttgccagccaagacctgaagtgtcagcttgtagtgaattgagtgaacaggcatgtgagagggtgtgtgttctagccagaagcccctgaacgagggaagaccattgtggccagctgatgggagtgatgtgggcttggctctgggctgggctgcacaggacgttgtgggtcacagtcacagggtgttgtgggtcacagtcacaggcctggattttatatacagatggtccacttagaatttttcaacttcacaatggtacagaagtagaattttgaattttgatcttttcctgggc

SEQ ID NO: 12671 - DNA, 1167 bp, Homo sapiens
ccagcctagcaccattgccaccagcatgcgggattccctcattgacaggtacctggggcctctcctttcttctgctcagggttgggggttaacttgcattttgagagtatggggaaaagatgtcatctagaatgggagcctaccagtttgttctggtagcttctcgagtgtgagagcatatctgtacactgctgagcagataagagccagcatattcaaaaaatatttcttgagcatctgctaatcctcatctttgtggtttttcagggctaggatactagagcagtagctgcttgagcagcttgtcagagctggtcccgggatgagggctgaggcaggcacctcacttgagagtgaggtgggctctgtgaaacagctactgaccgtgcgctttcctttctcttcagcctcacctgagtcaccttccaagttgttccatgggctcctggctctggactgtggccaaccttctccacattccgcccaatctgtaccggatgctggcagggaggtggcagagagctcactgggactgaggggctgggcacccaacccttttccacctgtgcttatcgcctggatctatcattactgcaaaaacctgctctgttgtgctggctggcaggccctgtggctgctggctgagggttctgctgtcctgtgccaccccattaaagtgcagttccctccgggccattctgaatgtgatgtttggggccctcagcctgtgtacaatccctgcactctccagttgttccagcattctgggaagatagggtgggatgaacacaacacacacccaacccagttcaccacctccacacacgccattcccttctcctctaccatcaggatgtgaggcttcatcctggggcaagaaacactctccactacagttctccttttttcttttttctttttgaggcagtgtctccctctgtcacccaggctggagtgttgtgacgcaaggatggctcactgtagccttgacctgttgggctcaagcgatcctctcgcctcgtttatttttttgtagaaacgaagtcactgtgttgcccaggctggtttatactcctgaactcaagcgacccaccgcctcggcctcccaaagtgttgggattacaggcgtgagccacggcgcccggtctagttctcacagttttcacc

SEQ ID NO: 12672 - DNA, 1219 bp, Homo sapiens
ctcccggaagtctccctggacggaagtggaaacggaaacctttttagggagtccaaggtacagtcgccgcgtgcggagcttgttactggttacttggtaagctggtgtgaggggaacctgggagggtcagctccggtcctgggtcgggaggggtgggggccagaggattcagggccggaggttctggtgggggcccagtgggcgggacccgaggacggaggggccgggaggccgagaggggcggggtcgcggcggggcctgagggacggaggccgggatacttgggaaaggatccgccggccttgaactcccgcctccgccgcccctaggcctcatggcggtccgagcttcgttcgagaacaactgtgagatcggctgctttgccaagctcaccaacacctactgtctggtagcgatcggaggctcagagaacttctacaggtgcggcgggagccccggggcttacggtggcggggaggcgtgcgcaggagtcaagagctccggcagtgggagggtgccggcccctctgccccgccaccaccgagtccatgtccctacagtgtgttcgagggcgagctctccgataccatccccgtggtgcacgcgtctatcgccggctgccgcatcatcgggcgcatgtgtgtgggtaaggcaggtggaggacgccgagggagggagtggtctccaagcaccattaattacacccccggagggaacccggagtgacctagggattcccagggtatcatctgttatctctgggcactatagaatctctcaggccaagcgtcaggagatcggggcaaccctctagcaaaggctgctggataatagtaataacaaataatgtaaagtgctttcactcctgttctcattccttcgtcacaaagacactagaaggtaggagttactggcctaacttgactgatgaggaagttgagacttgacctaagtgactcagtaagttccacacctagttcctagtgttggagaaggatttttctcttttttttttttttttgaggccagatttttgctctttcgcccaggctggagtgcagtggcaagatcacagctgtctgcatcctcaacttcttaggctcaagtgatcctcccacctcagcctaccaggtagctagggccacaggcacgtgccaccacacctggctaatttttacatttttggtagagacgcggcctccctgtgttgcccagcctg

SEQ ID NO: 12673 - DNA, 1182 bp, Homo sapiens
attttaatagattgtatgtaacccagtatatctgaaatattatttcaacatgaaagcagtattaaaaattgagatattttatattctttttcttcaactaaatctttgaaatcttaaacttgtgccacatctcagctttgactagctgtatttaaaatgctcaatagccacaggggagccactgtattggacagcacagttctatacccagttttacggatataaaactggtgttgggcaaattactttccgtctttaggactcctgctttcatcagtaaaatgaaggattcagacttgtttgtcttctaacaaaaaaatgtggttccctccaggtatgagggagccttcagaggtgccctaaataatctgtatctcgatctgggtggtgcttgtgtgggtgtatgtataatacataaaaatttatcaggcagtacacttaagatttatacacttaatagtatctttgttatatctcagtaaaagtttaaaaaaaaaaagttcacttccagtttgatttggtgccctttgctaaactcactcttagatgaggagaccttcagtggaaatgtgtgatgtgaaaaatgcaaacagccaagactttttttgtcttcttcccacccaggatgtgtctagtccgaatgaagcaggaaggccggagtgggaagtacatgtgtcgtatcatagttcattttatgtgggaggatgttcagcagcgcggcagagtcatgggggtaagtgagtgctgtcagatgcttgtcctggacaattccagagaagggtttgagtttggagttttatctgttgtaaaatggccctgcttttagatttctgtgaaatgctgcctaatatcaagtggcagttccgctaaagtcactttttctgcctctgtggaaactaatactccacagatactttatgtgtttgtacacattatagtgatttgtcagtgtgaagtcatcctgtatggagatgggattgtaaagcccaaatcgtggtgataggagggatggatttggtgaatggagggaatcaaatgataatccagttaaggatactatacctttgacaccagttcaatatttgaaccagtccttctataaattagttctgatgggaggccctggtatggggcctgcactgtcttcaggaactgaaactcaagctccttgatcactggcaa

SEQ ID NO: 12674 - DNA, 1233 bp, Homo sapiens
tctcgggaacaggagaaagctctgttggccctccagcagcagtgtgctgagcaggcacaggagcatgaggtggagaccagggccctgcaggacagctggctgcaggcccaggcagtgctcaaggaacgggaccaggagctggaagctctgcgggcagaaagtcagtcctcccggcatcaggaggaggctgcccgggcccgggctgaggctctgcaggaggcccttggcaaggctcatgctgccctgcaggggaaagagcagcatctcctcgagcaggcagaattgagccgcagtctggaggccagcactgcaaccctgcaagcctccctggatgcctgccaggcacacagtcggcagctggaggaggctctgaggatacaagaaggtgagatccaggaccaggatctccgataccaggaggatgtgcagcagctgcagcaggcacttgcccagagggatgaagagctgagacatcagcaggaacgggagcagctgctggagaagtctctggcccagagggtccaagagaatatgatccaagagaagcagaatctggggcaagagagagaagaggaggagataaggggccttcatcagagtgtaagggagctacagctgactctagcccaaaaggaacaggagattctggagctgagggagacccagcaaaggaacaacctggaagccttaccccacagccacaaaacctccccaatggaggaacaatctctaaaacttgattctttagagcccaggctgcagcgggagctggagcggctacaggcagccctgagacagacagaagccagggagattgagtggagggagaaggcccaggacttggcactctccctagcgcagaccaaggccagtgtcagcagtctgcaggaggtagccatgttcctacaagcctctgtcctggagcgggactcagaacagcaaaggctgcaggtaagtcactccatggggagtaagggccaggggacacacccctgtctggctgagctcagggactgcccaccaccctgggccctgtggcacctcaggggtatgagaaagctgagatcatgagcacctcaacatcggtgggattcaggctactgtgctagtcgggagatacagagaggataagacccccacagtccctgccctcacagagttcacagtctagtgggtaaacaacgataatgcagtgtggttggtgcctaatgggggaagtttagtatgccccag

SEQ ID NO: 12675 - DNA, 1209 bp, Homo sapiens
acagcaggtttactcattttcctcagctgcagccttagagagcccaaccccagccaccagaaactcagccctcctcattgcatatcccgggccaacagcacttcagctagtccagagagcccctcctgactgcattctgccctgctcggcacagctcagtctgtccctgccctgagaaggaggcccaacattggggtgggggttggggtggctagtggccctgccttctgagggacttagatctgtgtactcccagaccagtgccacagactggcccgggagtggggctcatggggctctgcttaggatccctggtgtatgggggttgtgtggtgcttgccagctcctgaggagcctaggagcttgatcacagcttgatctcttagacctttttacaatgttgagtttataggcttagggtccatggtctttcctggagccagtgtcccttttttgggtaagaggcttggggaagactccccaaactactcgtctaggtgaggtatccctgccaacagacacaggcttgcagcctgacagggaggcgctgtttatggtggctgagcactagatctccatcccttgtcctttattgaaagttctcaagggcaggcaccgtgtcttcctctctgcatccttagctcacagcccagggctagcacaaagcagatacatggtgtacttctgttaaattaaaacatgcctcagagaagcaaatgccatccaggccttttggatgttttgtgtcaggtctccatggcgttgcccattatgctggtgtggggcctctccttgctgcagggcctgctgccccatagacgtccagtctgagttcagatgcttctggcccatagcccttgcccaggcccctaagattgtgatgaggttctgcaaggaaacttgcagaaaccccagagtgggaaggcctatgccaacaagagtgctgtttgtcttccttaggatgggagaggacagaagaactcagatgccaagtgtgtggctgaactgcagaaagaggtatgttctggattttctaagcccatattccctcccttgcactcaggccctttgtgcacctccagcagggagaggggaagttcctcccttcagagaacttcagtctccatgggaggcaaaaatagtcccagtcccaaccccatctctcatatgcctagggtgggagtggggaagaaagcatgatcctggccc

SEQ ID NO: 12676 - DNA, 1168 bp, Homo sapiens
ctgagggagcggattcgaggccattctgaccctcgccccttgtcctgcagtgaccattgtcagtggccttctcatgctgctactgttcctgtccgagctgcagtattacctcaccacggaggtaaggggcggggcttagtgcgtgggcggggcttggcattctaggagtaggacctttaggggtgggagtggggaaggagaggtttggggctaagtcttactgaggtagcgctgccccaggtgcatcctgagctctacgtggacaagtcgcggggagataaactgaagatcaacatcgatgtactttttccgcacatgccttgtgcctgtgagtacctcaccatgggtgggactggagagacccagggttctcatgtgggctgccagattcacacctccacccttaggttctggactggaccccaggacaacctccttctcctcatcccgttctgccccaagacaggcccagtatccccttcccctccaaaacccacatccccttgtccctagggtcccagtaccttagcctgattttcctgcttccagatctgagtattgatgccatggatgtggccggagaacagcagctggatgtggaacacaacctgttcaagcaacgactagataaagatggcatccccgtgagctcagaggctgagcggcatggtaaccaggggagggggccgggtctcagatcccaaagctggatgtacccaagcctatctgctagcaagtgaactgtggcaggcatagtgatacattaaacaactaagagctagagaagtcaagtgacttgcctagggtcccccagctagtaagagtcagagtgagctaaaatcctctatacatatcgagtcaggtaatctacctggctattattctcagaggtcctcaatacctgcagatggtagtttgaataccagaggtttgaagataggtcttatgtgctcttgccttggtagaactgtctagatggacccaggcttctttgagtgtttgctttcccagcccattggcttaattcagcccttaatgctcttcccctttggaatgcaggtggtttaatgagaatttaggttctcaagtcagattgcctgggttcacatctagctttgtctcctgcagtctgtgagcttcagctagaaagtggtaataaaacagtagt

SEQ ID NO: 12677 - DNA, 1435 bp, Homo sapiens
aagtgggccatcgggatttggagggggccctcagaattttggaaatggccctggtagcttaggcggtcccccggggtttggaagtggccctcctggtcttggaagtgcccctgggcatttgggtgggccaccagcttttgggcctggccccggccccggccccggccctggcccaatccatattggtggtccccctggctttgcatctagttctggaaaaccaggaccgacagtaattaaagtgcaaaacatgccctttactgtgtctattgatgagattttagatttcttttatggctatcaagtaatcccaggctcagtgtgtttaaaatacaatgaaaaaggtatgcccacaggtgaagccatggtggcctttgagtctcgggatgaagccacagctgctgtcattgacttaaatgacaggcctataggttcaagaaaagtaaaacttgtattagggtagccattcacatcattttttatagggtagatcttcatattgctgtgattaatgcatccagattgttttcctagtatttccaggttagaacctgtggattgtttcaattgcatatagcttggtttccataacatagagcattggttgactgtttacagaagactcactcaccaggataaacattgctgtatgttacagtaaagctatctggagagaacacataaatgattttggcataccattagagaaaccatttgtaaaactcaaatgaccacataaagcttatcaaggagtctagattggttttgttttataccatatgggatgaagaaaatagaaatgtcagtagaactcattgagggtgctcttgccagctgctgaaaatagaagttggctactctcagaatttggtttaaagctggacagatttgctttgttatagggtaaagctttgtctaaagtcctcattttcttttaaaattgaataaaatttctgtatacagattcattgtatgtacctttattgcttcttaagggtccttgctgtatagacagtcctgcttcagaagttgctgctttgtttgtctaattgactcatttgtaaatgagcagaactgttttgttggtttttttccctaaatataaaagtccacacttcgtttgtgctataacctcaaactttgatttctaatgtcacacttaaaactgtgtggaataagacttttgccataaaaataaactatggagtcctttatctaccagagcctttttggtttgaccgccacgatttaggttagtcagtttaaaaattgttcatgttgtttggatggtatcgaaaaccagaaaccacttttaataatgtgtttaagatacttgatttgaagtccttttcatatggactaattgtagtatcaatttcctcctgtcccgattatgtgaaattttggcctttaaacaaagaggggcccattcata

SEQ ID NO: 12678 - DNA, 1485 bp, Homo sapiens
acagctcctccaaatatgggggcttcctttgggagcccaacgtttagctcaactgttccaagcacagcctctccaatgaacacagtcccgccgccaccaattcctccaattccagcgatgccatctctgccaccaatgccatccattcccccaattccagttcctcctccagtacctacattgcctcctgtgcctcctgtgcccccgattcccccagttccttctgtgccacccatgaccccactgccacccatgtcgggcatgccgcccttgaatccgccacctgtggcacctctacctgctggaatgaatggctctggagcacctatgaatttgaacaataatctgaatcctatgtttcttggtccgttgaatcctgttaaccctatccagatgaactctcagagcagtgtgaagccactccccatcaaccctgatgatctgtatgtcagtgtgcatggaatgcccttttctgcaatggaaaatgatgtcagagatttttttcatgggctccgtgttgatgcagtgcatttgttgaaagatcatgtaggtcgaaataatgggaatggattggttaagtttctctcccctcaagatacatttgaagctttgaaacgaaacagaatgctgatgattcaacgctatgtggaagttagccctgccacagaaagacagtgggtagctgctggaggccatatcacttttaagcaaaatatgggaccttctggacaaactcatccccctcctcagacacttcccaggtcaaaatcgcccagtgggcagaaaagatcaaggtcaagatcaccacatgaggctggtttttgtgtttacttgaaagggctaccatttgaagcagaaaacaaacatgtcattgatttttttaaaaagctggatattgtggaagatagtatttatatagcttatggacccaatgggaaagcaactggcgaaggctttgtagagttcagaaatgaggctgactataaggctgctctgtgtcgtcataaacagtacatgggcaatcgctttattcaagttcatccaattactaagaaaggtatgctagaaaagatagatatgattcgaaaaagactgcagaacttcagctatgaccagagggaaatgatactaaatccagagggggatgtcaactctgccaaagtctgtgcccacataacaaatattccattcagcattacaaagatggatgttcttcagttcctagaaggaatcccagtggatgaaaatgctgtacatgttcttgttgataacaatgggcaaggtctaggacaggcattggttcagtttaaaaatgaagatgatgcacgtaagtctgaacgcttacaccgtaaaaaacttaatgggagagaagcttttgttcatgtagttaccctagaagatatgagagagattgagaaaaatccccctgcccaaggaaaaaagggattaaagatgcctgtgccaggtaatcctgcagttccagga

SEQ ID NO: 12679 - DNA, 1485 bp, Homo sapiens; identical to SEQ ID NO: 12678

SEQ ID NO: 12680 - DNA, 1209 bp, Homo sapiens
ttggggagagctctcaggagagctgacaaggacttacagggagctggagagctcaggataccttaaccacctgtgttagggtctaccagggcaagaggcagaggacagacagggacagaaggaggcaagccattgctcagagccttggggccaatgttgtcgacttcctatctaagccctcactcatttaatgcctcttctctttggcagccctctctgggagatggttcaggatggcattgacctcaagagcatcaagtggacccaacactagaagaatagggccctgactttgtgctggtctggcccctcctgcctcaccaacccgtgcacaaccagacaccttgttacacctagtggatgctctagattggtatagaccagttgacttcagcatcagtccacctctatgacagaaacacaagaaaactgtctttccctagcttcagttccttgggtgtggagcactccccatttcttctcgggtcttaaagtgtgtggacattttcatcccgaagccatagagacatttgctgtcatattgctgctgggcacatctgtgctcttggtgaggagagcaagaggaaccagaagaagtctctttggtcagggaccatgatgctctacatggacatttgagtcttcgtcttctgctgctgctcggctggaccagcttctttaacagcaagcataatccacttcaatgtaatattttctgtagctccaaaggctatctcttcatattgactgcagacagactgaatggacagtttcttagagggcttgtctcctttctacccttgtcctctttcctttcctttgacctaatggagctagaaatatgtctgtgactccaccagttattctaataatttgttttcttgaaaattgttaatttcaagactggagaaataaactcaccttctatttactctgtgactttatgagaggttgagggaaaagtggaagctgtacttgggaattgtggagaagaccgccactccatctgatttgcataaatgactcagtgggcttttgtatctcttcatttaagaattatttgaatgcctgccaggagccagatttgttctgggtattaggaatacactggttaacaggaccaaaaaagaccctgccctcactgagttttaaattttagtggagagatggaaaataattaaacaaataaacaatgttatagattgtgat

SEQ ID NO: 12681 - DNA, 1218 bp, Homo sapiens
ttagataaaaataaagaggcaaggatctactgtcatttgtatgcaatttcctgttaccttgaaaaaataaaaatgttaacaggaatgcagtgtgctcattctccctaaatagtaaatcccactgtatacaaaactgttctcttgttctgccttttaaaatgttcatgtagaaaattaatgaactataggaatagctctaggagaacaaatgtgctttctgtaaaaaggcagaccagggatgtaatgtttttaatgtttcagaagcctaactttttacacagtggttacatttcacatttcactaatgttgatatttggctgatggttgagcagtttctgaaatacacatttagtgtatggaaatacaagacagctaaagggctgtttggttagcatctcatcttgcattctgatcaattggcaagaaagggagatttcaaaattatatttcttgatggtatcttttcaattaatgtatctgtaaaagtttctttgtaaatactatgtgttctggtgtgtcttaaaattccaaacaaaatgatccctgcatttcctgaagatgtttaaacgtgagagtctggtaggcaaagcagtctgagaaagaaataggaaatgcagaaataggttttgtctggttgcatataatctttgctctttttaagctctgtgagctctgaaatatatttttgggttacttcagtgtgtttgacaagacagcttgatatttctatcaaacaaatgactttcatattgcaacaatctttgtaagaaccactcaaataaaagtctcttaaaaaggccacaggagatcttcatttttcaaatgttttaaagttacagaaatttgagaacagaattagcttcttttagtctcaattcagtacttgcctcttgggaaaatgttccgagtctgcggaaacttgccctcacgttgtcccccatgaattcctttattctattagagtctagccctgtgtattttagaagaatgtatcaaaactgaggggtttaccaaaaagaaaaggaaacagcctggccttaaaacctgggcattcttggtctcctgcattgtctgggcatatttatgaagaaattttcaccatttacaatacatacttaacaaaatggcttaacttcaaactggtttccaaaattgatttatatattaatatattaaataaggtgcatatattactgtattaaggggttttgagcttt

SEQ ID NO: 12682 - DNA, 1191 bp, Homo sapiens
tatatgtaatttatatcaagttatgtatttatttgcttgtgtatgaagtatttatgttttatatatgaggattatattgactattttgtccctgggcacatttttgttagaaaagtactaaattctacctcaggtggtctgcctgcctcggcctctccaagtgttgagattacaggtgtgagccactgcacccagccagttttcacattttctaaccacaatccccatgttctcaaatataaagctgtcattacttgtaatatcttttatttaaactaccacatcaacaagcctaatttgcgttagctagcgtcgtcatcatgtatgttgtgtttgctacttacagcttgcagtttctaccttagtattcagaagtaattattgaatatgctaaaaatataaatatatttttaagtatagtttgtattttaaaaattaaagcactgtctcctgtccttgcctcccctatcatgtagttttctgactcagaatgtgccaaaaaggctttggaacaacttaatggatttgaactagcaggaagaccaatgaaagttggtcatgttactgaacgtactgatgcttcgagtgctagttcatttttggacagtgatgaactggaaaggactggaattgatttgggaacaactggtcgtcttcagttaatggcaagacttgcagagggtaagtgtttcttgctattacgaatgatttactgtgggtattgtagtggaaaagaaaggtagccatgtaaactaagaaagggaaaaagattttatcttattttgtagttggcgttatccttggtcacactgcatattattttatagatgatgtgccttgtattaatgtatggaaatctatattatgtgttttgaatgccacagtataagttgcaagatttcttttcctttatgtagtgtttatatgtcatacttaggaataaatttagttgcagctattataatgttacaagtttttctttttgtaatttcttattttttgatgcagggtctggctctgttgcccaatttggagtgcagttgtgcgatcctggctcaccgcaacctctgcctctttggctgaagccatcctcccaccctaatctctaaatagctgggactaacagttgcaaacaaccaccaccacgcctggctaatttctgtggtggttttttttttttttttttttttt

SEQ ID NO: 12683 - DNA, 1175 bp, Homo sapiens
cacggtgaaaccccatctctactaaaaatacaaaaaattagtcgggcgtggtggcaggtgcctataatcctagctactcaggaggctgaggtaggagaatctcttgaacccgggaggcagaggttgcagtgagccgacatagcaccactgcactccagcctgggtgacagagagagactccgtctcaaaaaaaaaaaaaagaaaccagattggtctttgccaggagctggagggaaggaggaatgtggggtgactacttaatggctataaggtttcctgttggggtaataagaatttaccagaactagatccacctagttaagagttccaggtagtggtagcgatagatgctctggatcgagttgtaaagcccaaaatgaaaagagtcaagagattccttgagaagagagaaccaaaactcaatgaaaatattaaaaatgcaatgctgattaaagggggaaatgcaaacgcaacagtgacacaagtacttaaagatgtgtgtgcactgaaaaaaccatacggtgtactgtataaaaagaaaaatgttacaagaccttttgaggatcagacatcactggaattactttcaaagaagtcagattgttctttattcatgtttggctcctataataagaagcggccaaataatctagtaataggtcatatgtatgactaccatgtgctggatatgattgaattaggtattgagaattttgtctctctaaaagacattaagaacagtaaatgtcctgagggaacaaaacccatgctaatatttgctggtgatgatttcaatgtaacagaagattacagaagactaaaaagtcttcttactgatttcttcagaggccccacagtatcaaatatctgcctggctggattagaatatgttctgcacttcactgcactgaatgggaagatttactttcgaagatataagttgctgttgaagaaatctggttgcagaacaccacggattgaattggaagagataggaccctcattgaatctggttctgaggaggacacacctggcatccgatgacctttatacattatctatgaaaatgccaaaagctctcaagccaaagaagaagaaaaatatctccaatgatacttttggtacaacttatggaaggattcatatgtagaacgaagataagcaaactacaaacc

SEQ ID NO: 12684 - DNA, 2084 bp, Homo sapiens
cctgaagggtgtttagtagtcagcgttttcagaattgttttgttactatactttaacattttacatttcctgtttgtattattttgtgagagcaaggtgatcatgctgcttaaggtccaggtacaacctatttgtaccttttgagacaatatttgtgttacttttgcaggttacggttccacatgtaattgctatattttgttttgtttttccttactaggcaaagttaaaatgttccatgctttgaggagtgacccatttcactactttgttttcttatcactaaaggcaaaaatcaaagcacagttgtccattaacacttataagttaattatgggtttatgagtctgtaatgttatatgctgcaaacatttactatgtaaacgtgaagtagccaataatatctcaatagtagtaacagtatctttagcgacctttggaatagttaagcacaggtcattgtggacatgaattcaggcctctgtactaaaatctatttcagggaatgttctgtctagtgatttgctcaccatttgatatataatgaattataggacaagtataagctgatctgctatagctgtccatcagagagaatacacgtggctataacatctataacaaaacgacgattcctctacaagaggctgtttctcactgctaacgttggtgtttctggcgtgggaagaaatgcacaggcgtgcatggcatgcacgttcagacagctgcattgtaagagttctgtcatgcagtctgaaaagggaagaaacaggatggctttctgtagccacacctgtgaggcgtgatgattgttgtattattagattactgatttttcttttctgaaaatacatttgagttttaatcacatctgtggaagctgtaacttttaaggtagtcaatttcatgtcttgttcaacgatgtaagcagaaactgaattgccctaattttgccaactggccattattgggattattgtttaaatttttggtaaaggaagtaatctcctttcattcattgtgacttttgttcttagggaagcagagaagactccccaagttcttataacctcattgtgcttccctaatttaaagccatgttgaggggctccattcccaattcctgggtcaaggtgaattaaccctatgttggagcactggaaaccgttatttgcaaacattgctgttaccatttagaaatatgtgcactatcagctgggtgcagtggctcacgtctgtaatcccagcactttgggaggccgaggcaggtggatcacctgaggtcaggagttcgagaccagcctggccaacagggtgaaaccccgtctctactaaaagtacaaaaattagctgggcgtggtggcggacgcctgtaatctcagctacttgggaggctgaagcaggagaggtgctggaacctgggaggcggaggttgaagtgagccgagattgcgctattgcactccagctcgggcgacaactgcaagactccatctcaaaaaaataaaaataaaagaaaagaaagaaatatgtgcactacctaagttttgtctttagaaaaactatccacctataaaaaattaccttgacaaaaatagttccggtttgactaatcattttgtttctttaagtggtaagtgtatgcaaggtggatccttgatgagccaacattgcactgtggatacatatctatgtttacgcgctattagaacagaaggcgctgtatatagaaatgttgctttgaagcaatatttgcaaaacacgcagacttctgtatctgtatttggaaaaaataaaacaggttcttgttgctatgtttcagttacgtattgttgagttacagtcatgcatcatataacgtttctgtcaaccatggaccccatatacagggtggtcccataagattataatggagctgaaaaattcccatcacctagtgatgtcctgatggtcctactgcataggcctaggctaatgcgtggatttgtcttagtgtttaacaaaaatctaaaaagtaaaatatatataaaaaatttaaactagaaaaaaactcatagaataaggatataaagaaaatatatttgt

SEQ ID NO: 12685 - DNA, 1280 bp, Homo sapiens
tgttcgggtcaccaccggccgggcgccactcgaacgagccccggccagccgtcaccctaatcattcccgaaggaggggccatcagagctacagctcatcagggtcaatcagaaggggcgcccgcacgcaaaggtcacctgcaaaccgaagcggcgcacggataaggtccgggacttgaagtctatctccaaacattcaggctcctcctccgactcctcctcgaactggcgctcagaggcgccaccattcggaaggagcccaggccacgcgcagctcgccctcccgcaccgcgagggcagcagccgcctcatgcgactcgagaacgctagagggcgccgcttccgggagcccgcaagcggcttccgggtgctcgcgcgccgacctggacgcagagaagccagagactttcgcttccggctgccgcaggcgcttcgctggtgcaggtaagctccgcacactctcggccggtcccgagtccgactccctcaagggtgacgcgagctctgccctttaaccggaaacgtctccctgctcaccccacccccgcgcagacgcagtgctgagcacacagctaccggacaaagagtgacgcccggagctggagttatggcggctacggagccgatcttggcggccactgggagtcccgcggcggtgccaccggagaaactggaaggagccggttcgagctcagcccctgagcgtaactgtgtgggctcctcgctgccagaggcctcaccgcctgcccctgagccttccagtcccaacgccgcggtccctgaagccatccctacgccccgagctgcggcctccgcggccctggagctgcctctcgggcccgcacccgtgagcgtagcgcctcaggccgaagctgaagcgcgctccacaccaggccccgccggctctagactcggtcccgagacgttccgccagcgtttccggcagttccgctaccaggatgcggcgggtccccgggaggctttccggcagctgcgggagctgtcccgccagtggctgcggcctgacatccgcaccaaggagcagatcgtggagatgctggtgcaagagcagctgctcgccatcctgcccgaggcggctcgggcccggcggatccgccgccgcacggatgtgcgcatcactggctgagcggtggagctgcgggcggccagggccgggcgctctgtgcggactggggccatgatcgggcccgggggcctgagcctgggaccccaccccgtgttaatgaaaaatgagttttggcagcgcctgtggtctggtgt

SEQ ID NO: 12686 - DNA, 1631 bp, Homo sapiens
gttcagatggtctaaccattgttctatatgtgcattttagttaatattgtgtattaaaggataagtcttaatgctcaaagtatgttaaaaatagatgtagtaaatcagtccctttgtgaatgtccttttgttagtttttaggaaggcctgtcctctgggagtgacctttattagtccaccccttggagctagacatcctgtacttagtcacggggatggtggaagagggagaagaggaagggtgaagggaagggctctttgctagtatctccatatctagacgatggttttagatgataaccacaggtctacaagagcgtttttagtaaagtgcctgtgttcattgtggacaaagttattattttgcaacatctaagctttacgaatggggtgacaacttatgataaaaactagagctagtgaattagcctatttgtaaatacctttgttataattgataggatacatcttggacatggaattgttaagccacctctgagcagtgtatgtcaggacttgttcattaggttggcagcagaggggcagaaggaattatacaggtagagatgtatgcagatgtgtccatatatgtccatatttacattttgatagccattgatgtatgcatctcttggctgtactataagaacacattaattcaatggaaatacactttgctaatattttaatggtatagatctgctaatgaattctcttaaaaacatactgtattctgttgctgtgtgtttcattttaaattgagcattaagggaatgcagcatttaaatcagaactctgccaatgcttttatctagaggcgtgttgccatttttgtcttatatgaaatttctgtcccaagaaaggcaggattacatctttttttttttttttagcagtttgagttggtgtagtgtattcttggttatcagaatactcatatagctttgggattttgaattggtaaatattcatgatgtgtgaaaaatcatgatacatactgtacagtctcagtcccataaaattggatgttgtgcctacacacaggatctagaagaatatgtcaaactataaactgcttgtgattgtgaatgactttgttctttgcttgtgtttttcaatttcctataatgcacatactaacttttaaaaaataaaggttattttaaaagcctgtattaagccctcgttgcttgtagaatagagttagtatacgctacagaagcacaggttcatgctccttcatgcttgggctctgaggtatctggaatttctcatctttgactcctccctccattgcctgggtgttagccactgccacccaggtgctctgctgttcaggataaccttgcactttacaggttctgtggtttgctcaagccattccttctgcctgtaatgccctttccacagtttcacttggcaaaatcattcttcagagcccaacttaaattcagtatctccacaaagtcttgcctgtaagaacctgacactcccgagtgccagaactgaacgtcagaagatacggccttttttttgagatggcgtctcactatgtcactcaggctggagtgtggtggtgccatctttgctcactgcaacctctgcctcccaagtagctgggattacaagca

SEQ ID NO: 12687 - DNA, 1825 bp, Homo sapiens
tttgaccatctctaagcattacacgtgcctgtacttgtccactggattgaaggcagagaaggaagggaggagggaatgattcaaggccaaaatggccacatttagaagatacctcagatgataaccattgttatgtgtgtgcaattttatttaacagtgctgtgtatgtggtggacaagttatatgaaatatctagtctttctagatatttggaagtgcttgatgtatttaaaagtggtagtagaataacactttgtaaatagcttttaaaaactgatgggaaatgctgtttggaagtggaattgttgaaccacctgggaggtgggagggaagaaattgcaaatggtgttttgccattgtttattagaaaatttcagcttaatccattgtgtatatgttacatgcatttcatttaactttgctatactgtatatattgtatatataacggacaaattagtcccgattttataatatctagtctctagatattaaagaggttgccaatgtatgacagaagtagagttagtaaactaacacattttgtacactttgttaaaatttgtagaaaggctgtcttctgaaaaggacttttggaagtgagataacatcagctctaagtgacacgtgcctatatccatcaggttggtggtggagaggagttggaaggaatgaagggttctagaccagaatgttcgtatttagaagacactatcagatataaccattgttacatgtgtgtagtttattcaaccctactgtgtatatagcggacaaacttaagtccttatttgaaacatctagtctttctagatgtttagaagtgcacaaagtatgttaaaagtagaggtagtaaataacacattttgtagctatccttttgatatgaaatattgtcttggaaattgatcaattctctgagcagtacccattttgatatttgtgctggttcagggggaaggaggagcacaaagtgcaaagggctttctaccagtgtccagtgtgtttatgaggaggcacattgaccattgtcccttatgtctgcattttcatttactgtgctgtgtatatagtgtatataagcggacataggagtcctaatttacgtctagtcgatgttaaaaaggttgccagtatatgacaaaagtagaattagtaaactactacattgagtacactttgtgttaaaattcatagggaagacttcttaaaaacaagtgaaattgttaaaaccccccctaagcattacagatggcttatagctgtccacggggttggtagaggtgggaaagggaagggttctaggccagaatgttcctatttagaagacactcaaattacagtctgtgttatgtatgtataccatttattcaatgctactgtgtatataatggaaaacttaagtccagtttgaaacatctagtctttctaggtgtttaaaagtgtacaacggcctgtcgcagtggcgcatgcctgtaatcccagcactttgggaggccgaggcaggcggatcacgaggtcaagagatcaggaccatcttggccaacatggtgaaaccccatctttactaaaaatacaaaaattagctggtcgtggtggtgcccacctgtagccccagttactcgagaggctgaggcaggagaatcgcttgaacttgggaggcggaagttgcagtgagccaagatcgcaccactgcactccagcctggcgacagagcgaggctccgtttcaaaaaaaaaagtgcacaatgtaggttaacagtagagggcttaagtaacacccctctaagcatttgttttcagtacttcctaggagtggttgcattt

SEQ ID NO: 12688 - DNA, 1832 bp, Homo sapiens
gtagagacggtatttctccatattggccaggctgatttcgaactcctgacctcaagtgatctgctcgccttggccttcgaaaatgctgggattacaggcatgagccaccttgcccagcagtgtttttttttttgttttttttaattaaaaccataataacatagtaccaagatttgggaaaacaggaagcagaaaaaaattactcctgaatatgattgggagcttggagtgtttcctttcaccagttttcctttgctctttcttgcacagtcataatttctaccgcatcatcagtactgtcctgcatttttctcttaatgttgtatcggaagctgccttccgtgtcgttactgaggattctattaaatacacgatcaactcatcccttttcctgctcatggatattccggctgtttctagtttttgctattatgaataacagtgcaatgaacattgcataaaatgttcttcctgtatttcagatgatgatgtctcttggggtgaagacccaggaagagaatgctgggtaaaaggctgtggctgccttagaggctctcagtaaacttgccaaactgctatgccaacctttaacccccagcatccagggtgaatggcaggaactgttttttatttttctctctctctctatttgatttttaaaaatttctctctctctctctctctctctctctctttttttccccgagacagagttttgctcttgttgcccaggctggagtacagtggcatgatctcggctcactgtaacctctgcctctgggttcaagggattctcctgtctcagcctcctgagtagctgggattacaggagcccgccaccacacccggctaatttttttttttttttttgagacagaattttgctcttgttgcccaggctggagtgcaatggctcaatcttggctcactgcagcctctgcctcctgggttcaagtgattctcctgcctcagcctcccgagtagctggggttacaggcatgtgccaccacgcccagctaattttgtatttttagtagagatggggtttctctatgttggtcaggctggtcttgaactcctggcctctggtgatccgcccgcctcggcctcccaaagtgctgggatttcaggcatgagccaccgcgcctggctaatttttgtatttttagtaaagatggggtttcaccatgttggccaggctagtctcaaattcctgacgtcaggtgatccacccaccttggcctcccaaagtgctgagattacaggtgtgagccaccacacccagcctgttttttatttctcttaggtctgaagagcctgttccttgtgtgtagggactgctcccaactgtcctctgtccatgcattcattcatcctaaggcgggaggcagaatagggctgtggtgtcaggctgcctgggttcaaaccagcctcccctcttaaccaccttgtgtccacttcctcagctgtaaagtgaacatcatgacagggagctacctcacagggtccctgtgaggctttctgtgcatgaaagcatggaagacacttgaaatactacggtaagccaggatgacaatggtcaggcctagagagaggaaggggctgatctctcaccacctagtgatgcaggggcagagctgaggccagaatcaggcttcctgcctccagtgctctctttccctgatgccaggctactgctgtggatggtgtggtttatggcgtaggtggccctctgttcaagaatatgtgggaggggtggagggcctggatggatctataaggtggggtctctccctttcctcccagagccgtcaccttctttctggggtgct

SEQ ID NO: 12689 - DNA, 1161 bp, Homo sapiens
ggtgtttcgacttgacgtgagccgggatgctctaggaatctttgcaggattttagtctgctgaggagcatgacagaactgtgttttgggaaggtccttttggcaaccgtatgatccacaggagagggtggacgtgatcttacaggagaaaccttaactgtggggacttggagggctggggagggatcaagattggcactcattaaggtgtccctctggtagtgggtggttcgccaggttggagaaggaggagcttggagtgggtaaggccacagggtcaggaattctgtttcaggcctggtgagtttgagaagggctggtctccctttagtcatctggaagattgggtagcatcttttttgcacatctggcctgtttttcctttgaattatttcttttgaataaatccccatcagagcttcctctataatagcagtaaattgggactaagtgtccaacaataggaagatgattgggaaagctttggaacatccactggataaaataatacgcagtggtgaacacccacagaaaaactgcttgcagtggatggagctgtgcaattgcaaagctcttttgcatccttgattcattttgtgcttatgactgctctgcgacagaggtggggccggggctagatcctttctgtgtttgaagagaatgacgctagactccagtctccttgaaggcagagttgagttcacattttattcattgtttcgtcgcagcatgttgctcagtggtttgcaaatacttgtccgatgaaagaatgagtgaactaatcaagaggggaagtgacttgatcaaggtcactcaagttgtaagacatagtgcctgccatattcttgctattccctacttgccacattcttctcactaaccactcactatcttcgaggggaataggacagagaggttcccagtgaggacctggcacttgcatagaacagggtttaagtcttctttctgtttttactagctgtgaggcaattggcaagttaattaatctttcaaagccccagtttgcccagctgtaatgtggatagtccaagtacctggttttagggttgtcatcaagattgaataagttaaggcatgtaaacatcttggcatggtaactagtacatagtgaagtatccatgaacattagtggagatgatga

SEQ ID NO: 12690 - DNA, 1096 bp, Homo sapiens
ctcaggcctggtgttctcatctgtgcagtgagatcataagcatcccctgagagtccacgtgaagtgactgtggggctaagtagagatggctgcagtggaggccaccatgaccacagggcctagggcattgcttctggggcaaacccagcctgggatccatggagaaatcccaggctggagaggctctggaaccccggtattcctcccagcccagggctctgctctgctgccccgaggtttcaaaggcgggaaacccagcacgtgagcccgaattctgcagggaacgagggagcttcaggtcccggagatgggggttctcgccatctgctcattttctgcggtggccccactgagtcctgtgccccatccccaggtgcccggcggcggcggcgagtggagcaccacgctgctgtccccacgcgagacggatgccgcggccgagggccctatcccgtgccggcgcatgcgcagcggcagctacatcaaggccatgggcgacgaggacagcgacgagtccggcggcagccccaagccctcacccaagaccgcggcgcggcgccagagctatctgagggccacgcagcagtcgctgggagagcagagcaacccccgcaggtaggcgcgcagctccacccttacggtcccgcccagaggcaagccccgcccactacgagtcttgctccctgggaggagccctgcattaaaataagccccgcctgcgtgggagccacgccccctttgagccacgcccactcatgagtcctgcttcttgagagaaccccttcattgaaataaggcccgcccggcgcggtggctcacgcctgtaatcccagcactttgggaggtcgaggcgggtggatcacttgaggtcaggatttcaagaccagaatagccaacatggggaaaccccgtctctattaaaaatacaaaaattagctgggttggcggcaggcgcctgtaatcccagctactcgggaggctgagacaggagaatcgcttgaacccgggaggcggagattgcagtgagccgagatcgcgccactgcactccagcctgggcgactgagcgagactccgtctcaaaaaaaaaaaaaaga

SEQ ID NO: 12691 - DNA, 1146 bp, Homo sapiens
atccacccacctcggcctctcaaaacgttggaattacaggtgtgagcctccgcgcccggccagtgttgctatttcttaaggcacagtgagggaggtggctctccgactgaaacagtgggaaaggagagggtcacatggactgtcaacagagaagtggctttgagaaggcaatgtgtccctgatcctgacctagctgcttggaattctcttcccagctgcttctgccttgggagaaagaagcagaggaaaggagggaaggatttgaggctgggtgggtgggagtctttgagctgtttttatcatagcatacagatgagttgcccaatttagctgtgtggtttgacaagttacttgctggctgggagagggagtgggatcttaaccagccctcagcccttccactaatgagccttttccctagcttggcagtaccagcaaagggagttaagggagtctgcctttctctggggtcagcttcatccattcatgggggccttgagcccggccccactgtctttgctgtaaagcctgagccatggcttccaggttgtctgtggccccagggcacctgttcctcttgaggagtgtagaccgcctctcctttgccccctcaggcacctgggagccagcaggcatgaggcccgtgttaggcctcaggaccaagttcagcctggcctccaagacacatgcagggggctagcttcttgaggttgctgtgtcctccgcatccctcgggaaatggagtcacagccactcctgagtatttgaagctctgtttggccagcttataacctttacaataaaaaacaaaatgcaggccgggcacggtggctcacgcctgtaatcccagcactttgggaggccaaggtgggcggatcacgaggtcaagagttcaagaccagcctgaccaacatggtgaaaccccatctctactaaaaaaaaaaaaaaaaaaaaatacaaaaattagccaggcatggtggtgcatgcctgtaatcccagctactcaggaggctgaggcctgggaagtggaggatgcagtgagccaagatcgcaccactgcactccagcctgggcgacagaacaagactctgtctcaaaaaaaaaaaaaatgcagaaacaaattcattctgacctgataaatacagt

SEQ ID NO: 12692 - DNA, 1138 bp, Homo sapiens
gctctcacctctcctgctctccctaacccacttctccttgctggatttctaataaccaagctgggtttgggttgcgggtggtggcccaggcatgggaggctgggcaggggcgggcgggtggacagatgagcatttgctctgtgagaccagtcacccacgggggccatggctgggccaggacatggcgtcagctgccctgatgctggtggtcttcctggccccactgcagtaaacaggcaaccttatgaccttgtcctcgtgtgtgtgtgcgtgtgggcttgggcgggatggggcaagggctgagccaagaatgagatgggggctgtgggacccgcttcaggcgcatggtgagcagatgatgcatccgtttctctgtctcccgtgtgtccgggtcaaggcggcctctggtctctggccctcttggtgactcactccttcctgtccccaccccatccaccccctacccacagaagcagcgtcccctctcacagtatgtcctcccgacgggacacagactcggatacccaggatgccaatgactcaagctgtaagtcatctgagaggagcctcccggactgtacccctcaccccaactccatcagcatcgatgccggtccccggcaggcccccaagattgcccagatcaagcgcaacctctcctatggagacaacagcgaccctgccctagaggcgtcctcgctgcccccacccgacccctggctcgagacctcctccagctccccagcagagccggcacagccaggggcctgccgccgagacggctactggttcctaaagctactgcaggcagaaacagagcggctggaaggctggtgctgccagatggacaaggagaccaaagagaacaacctctctgaagaaggtgggtgccacatggatggtccttgggcaagggtagaaggtgttggcagctggtttcagctggtggccagcagcttccgaacttctgagtgggggtctcttaggttctcttcttgggctagtttttgagctcccttcttactttcttcgcattcttccatccatccacctatttaaccaaacctctttccagaaagggttgctggtgatagctgtttgttgtgcaggctgtgaggccacccacacctgggtttga

SEQ ID NO: 12693 - DNA, 1105 bp, Homo sapiens
cttttttgggtccctcccagctttaggttatgaagattttactcacaaaaaaaatcaacaaaaatcacgaaactagaaaactttttttttcctcttgctggccgtggtggactagatagatggacgtcggcaactcccggcccagcctccatactgcggtctttttactcgttctatctgatgagaactcacactagcttgtttacaagatgacgacagtccaagggcagccttgggcacctgccatgtccctcctttccccagctatccccgctctgaccttgattttcattcttatgtttttctcttttcccttcagagctcacacagtggtcaccattgtggcaagcggctttctgggtctcagccctctctgcggttgagggcccagaggacagagagatggacatgcgtcccctccctccccccgccaagtgctcacacacaacctcacgcgcacacacacacacgcagatggaggcgcctcactgggaggtgccccgccagccctgggcagtgtcaggcaggactcactcaccgctgagcagatgagggaagttttagtcttggcgggtggaaatgagacgaagccacagttatcacactccagactcctgcccttttattttctccagccccttcttccttcagcaaaatctaggactcccgagtggcttccagggggccgtcagtcctcagccgcgcctgtgtccggtgcccgaggggcgggcggcggtgtctgtatgtatgtgtacatatgcacatagaccttagagtgtatagttaacaaacgcccatctgctcacccatgcccacccagcgccgccgccgctggctctcggggcacctggcaggaggcgggtgtgtgaatagcatatatttttacatgtactatatctaggtgtgtgtacaagtgtgtgtaaaaatatataccttgtgtgtaagcagccctttttttttttggtctccacccccctccccccgccccgcactcctaagggcccatctgcccagcctctgagttttctgttctattttttttttaaccccaattatccttctctctctcctgcccccgcatcccactcccagggtgtcacgagcc

SEQ ID NO: 12694 - DNA, 1751 bp, Homo sapiens
tggtgtccactgctgcggaggaactgccttcagagaaggtggggctggaaaagggttagaagcctcctagctgggattgtctttgtttcacctttctttaaattagaattacagaagcccctgcccagtgaacagataacgattggtcttatgctcctccctttcccccattttttcttttgctgttttgttttttgttttttgtttgtttgtttgtttttttgagacagagtcatgctctgtcacccgggctggagtgcagtggtgcgatctcagctcactgtaacctccgcctcccgggttcaagcaattatttgcctcagcctcccgagtagctgggattataggcacccgccaccatgtctggcttttagtagagacggggtttcaccatcttggccaggctggtcttggaactcctgacctcgtgagccaccacgcccagcctcttttgctgtttcattgctgacagtgttcaacaatatgccccatctttatatatcctaagaaacactaatcctaggttattgctagccaaaatatttttgtcctgagtagtgtcactgggccaaaagatagatcaggacgacagcctttagttttcctgaaatcaccaggtcaggcacaaggagaaaaggttcctggatactgactaacttgggtgggtggatctagccaggagaaagacagtaacatgtgttctgtactttctgggaagatccctgaagccatcacagaggctccccaacttctgagtcgcccatctgttgctgtgggagtgtgaacggatcgctgaaggagagggagctttgctctctctaggtgggcaagtttcctgggctctctgtgttgcctccctctggcttcttcctcccgtgccctctccccgtgtgccccagggggatcagggatcctcaccctcctgaggcccagtggggaagaatgaacatggcttcatccaggttaactgatgctgccatttgcccagcctcttccatcccagccctgtcagtgagcccaggtctggtgcaactgctgcaggatgcctgtagtagggaactctggaagtgtattgggctgaggtgggattttccctccccacagtgcactgagcaatggagggtggtgagggagccatgctgctgaattctggttggcatttccccattatgtaaaatggggtgttgggtagggcagactctgcttgggtttggttgtaagataaacctggaggagaagcacagttgtcccattgaattatttgagcaaaaactactgtaaataacttttttgtcttttgtcaaataaaatttttttttgtttttttaagcagaaacagggttcttgattgatccaccagggctcagggcccaggcttgaagacaaagcagtcactggcttcttattttgctttacatcttttactctccctctagtagccagctgtgagttctgtgcacgctgtacccccattccctttcaccagctccattctgtatcccattcaactcagggtaaagggggcatttgcatctcacattgggccagtcttccctggaatcaacagttaagctctggggttgctaagtggtgaggatgtaaccttgaggaactggcaactttgtcctccccctctctcggtaagaaacaagcatgactgcagtgtgaacccggcacagagagaagcagctatgagatggaagctccagtcatgtctgaaaccaggaccacctgtaaacttctctattatg

SEQ ID NO: 12695 - DNA, 1420 bp, Homo sapiens
cagctgacaagttatagtattttcacattggtagtcgcagcacctgctagcagtgtaatatgctttacttgaatcatttccacatctgcacctcaattccctgggcctggggttgccatttggtaggggaggagcttatcaggagttcctttgcaagtgcaggagggcagtcctgggttctgttagtgacagcgtgatttcagtgaaataatttagaccccccaagcagactgtgcaacggatagcccctggagagtgccccgtgtttacattctcatctggcatttttgttttgtggaatcggcctgtgttaagccaggtgacctatgaacagtgcttgtctcctcactaggtcatttggatcatcttttacactgccatccattatgactgatggtgtacagctcccaagtgctccctatccagtccaaaggaccctcttgattacagcacaggaacttgatcgttggggaaccccagccccttggaacttggaagacccgtgtttcctggaccgcgaatcagtgtgttgggcatcagtgttttctgcaagggttgtgacctgaaactttttaaaaaccacccacctttggggaagcatttctgaatttatccatcaccaaccatttcttcttggataccatcaagtaacagctattatttgccaagtggagctgtcatttaatttgatgcacctctggattcagatgaaacattaaattgtcttcctcgattctccatcgggtgtagagtttttaaactatcaatggcatttcaagtcttctgaaacagcatggctgtatgtgcgtggtccatagcacagtacatgcagcatctaataagagtttccattgtagaatgttttcacatacttgaataaatcaaatctttaattgagaacctgttgatgatacctgataaagcctttcccaccccacctgtagcttgggaaccagtaggagcactggagggggtgcctcccaccccatccctctttcttcctctccctgatcccttagcggatccagcagacctctttctgtttatggaggcagcagggaaatcaagggctggatttggtgtaggctgtggtctccgtcttggcattgtggagagagggcttagcaccttctgatgcccctgcccagcactgaggtgcctggcctcactgcagtgtgctagacttaagaggtgttattttttattcggccacaagatggcaaggccagtgtgctagggaatggtaagccacaaaatgaaatagagatctgagagctaggctgggtgccgtggctcacacctgtaatcccagcactttgggaggccaaggtgggtggatcacctgaggtcaggagttcgacaccagcctggccaatgtggtgaaaccccatgtctactaaaaatacaaaaaaattagcca

SEQ ID NO: 12696 - DNA, 1420 bp, Homo sapiens; identical to SEQ ID NO: 12695

SEQ ID NO: 12697 - DNA, 1349 bp, Homo sapiens
ggcttaaccggggcttcatcttctagtccccttggttctctgttacagtaccatctgccagcatgactcggctcgcccgatcacgaacccactcaacctcgagtagcctcggctctggagaaagtcccttcagccggtctgtcaccagcaatcagtcagatggaactcaagaatcctgtgagtcccctgatgtcctggacagacaccagaccatggaggtgtcctgctaagcagatgctcctcccctggaccattgcaagtccatccttcaaatgaccactccataatataacatttcatccagtaaactggcctctactatctttaactcatgcatggccactgaacctctctctagtagcctggatttatcattctctctgcctgcccacccccttttttgtatagcccaagaaccacttccatgccatactgtaacattccaacatctttagctgatcagatctctccatatcctctcttgccagctttttcccgtgctcccccaactatgtatcagataagattctttgatcccgactctgtgtgtgcgagcacgcgtgtctgtgtttgtgtgtgcatagttctgtggttttagacacgctttcttgtagtgcttctgcaaaaaacaaaaaagggacttattttgcattctcaatggtgtttttaagggaattaggcagaacagatttctaggttgggtaggccactgcattctcttttgtttgcaaattggtcaacaaaatttgcaaagtgatttcaggagagagcagctttgaggaatgtggaaaatcataattgccgtctggaccattgattgattgtgaccagtagcagaagggtgcctgttacatagagaggctccttctgtccaaatgaatttctgtatactcttctataaataaaagggaggaatatattctgctggaagcccatgaaccatcgctgaggttctgatacaacatagagttttttccaaggagtgaatgtggtttaattactggactctcttagcacaggaaggtggaaacaaaatgccaggcctctgctctgaagagcaaaactgctgtcgctgcagtatctgataccagacatccacatatccacaagaagtgcctcttaggtctgtgacagagagtgtgtctccattcctcagttcccagaaaggggagaggtttggcctaaaaagcatgtagatgggggagaaatgggtggggggagaggaacagccattaacacagtatcatgtttaacaagtatagccttgatttcagtagatgtaatggaagccaaattaaattgatacagaacccatttctcagagtctttttttttttttgagacagagt

SEQ ID NO: 12698 - DNA, 1539 bp, Homo sapiens
gtgtgtcacaatgtccctacattaagttttcaataaatgttacgttatttcaattgaaatttattttttggcctcttttctctgcaggaaagagaagcatgcaacaattagatccctcaccagctcgaaaactgttgaagcttcagctacagaacccacctgccatacatggatctggatctggatcttgtcagtgactttatgagagtttctgccacaaggtgcccaagaggagaggaatgggaagagtgccccagcacgtggtgactgcgtgatttctgctcgttgcctttgaagataactggcaggactgactgtagaacactttgacttttttcaaaaagtgatggaatttgtacatccaaatgaatattgtatagacaattttcccaggaatgtgcaaaatgcttgaaagttcaaacttcttttttgaaatgatcttcagatccagtggcccattcttttatctttatcctgtgaaggtgtttttcaggttttgaaacaatccaaaaatcatttaggaccaagtctaaggaaacattttagtggccaagttggattccgattgtaaaggaatgatactaattttctagcatggctctgaaggtgattttaggtagaagagttttgaggctgggcgcaatggctcacgcctgtaatcctagcattttgggtgactgaggcgggtggattgcttgagcccagaagttgaagaccagcctgagaaataaggtgaaaccctgtctacaaaaaatacaaaaagttagctgggtgtggtggcgtgtgcctgtagtgctagctactcagaaggctgaggtgggaggattgtttgagcccaggaggttgaggctgcagtgagttctaattgcgccactgcactccagcctgagcgacagagtgagacactgtcttaaaaaaaattaaaaattgtaaaaaaatgaaaaaaaaagttttgagcattatttgcatcattgggatacatatgtcacttcacaagatgttcaatttgaaggaaataccactcattctctatgtcctgttgtctgtagtgtgcttcagtttttcatattgagttgacctaaatcctggattcatgacaagaaaggagtaagtactactattcattgttctatttgtttataatctgtattataaaattgcacataattaaaagctttcccttgtcttcatctatgttttgagtgtataaacaaaaagggagtgccgggtgcggtggctcacacctataatcccagcactttgggaggccaaggcgggcagattgcctgagctcaggagttcacgaccagcttgggaaacatggtgaaaccctgtctctactaaaaatacaaaaaattagccgggcgtggcggtgtgcacttgtagttccagataggagggtgaggcaggagaattgcttgaacccgggaggcggaggttgcagtgagccgagatcgtgcccttgtactccagcctgggcgacagagtgagactgtctcaaaaaaaaaaaagagggagggctgggcatggtggctcaca

SEQ ID NO: 12699 - DNA, 1203 bp, Homo sapiens
gcccttctgagatttagcactttctttttaacaactatacagtggatatgtgccataatttctttaactcaagacctgttgatccggtttcatcttgcttttttaagcaagcacattgccttttttttttttttttttttttttttaaagaaacagtcttgctctgttgcccacgctggagggcaatggtatgatcacagctcgctgtagcctcaaattgtagatggaattacaggcacatgccactgtgcccatagactgctctatgttatctcccttttggttcttcttgaaagagggatgaacagaggtcacacatgtgataggacagtttgggctgactcaaaaggtttgtgcacaaggcacacattcagaaaatcacttcgcacttacctactcattcatcctttcagcaaacattcattaaacggcagcagtgcccccagctggggctgggtctgggttgcagaggtgaatctaccagggtcccagccctcaggtgggtggttcaagcctcttagggagcgcagaggcctggggtgggtgtttctggcacccctcgggcccctccccatggtgatctttggtttgttctgcctgtgcctctgggtgcagccacctgacttcagggacctgccggaatgggagcccaggatccgagaggctttccgcactggtgacttggactctaagcccgaccccagccggagcttcaggccttaccgagctgaagacaatgattcctatgcctctgaggtgggtctaggcctgagcaagcatgggattgggtaggaggagagtgactgagccctgtcaaaagcagagtggtccatatatcacttagctggtgaggatatgggtttggggcattccatttggttccaggcttcttggcagccaaggccagaagggaaataaggaagtttgggacattctcatggcctgatccaaggaaacttataaactcatctgcataaattattttttcttctgtactaaattccactgggaatttaacaatttatgtaatttaatggaactactcatgtatgtagcaggaaggcagcagtctctatagccaggcagtttgggtttcaattgtggatccactctattctggctgtgagatcttggataagtcattttacctctctgattctcagttttctcacatgtaaaatgaaggtgcctcacagggttgtt

SEQ ID NO: 12700 - DNA, 1171 bp, Homo sapiens
tcagcatccctcttgcccttccctccctcctctccccacgctgcagctggagcgctgagctcatctgcgggcctggggcctgagctggatggacacctctggccaccaccctgagccccatgtgctggggtcgttctggggggttttgggaagttatcagaatgctgctttccctggcatcgtcttggagggcttgatggacccgagtggggagggggcgggcgctgcctaggagggtacctctgggacttccccaacttgctctgccagctccgtggtccatgccctgacttgcccctaccgcttggtgcctcattttccccttctgttaaatgtggcttttgaccagctgaatcctcagggcttttgagctcctgtggttttatggagcagaggggtattggtggggtggggtggggggtcatgaataaaaccacaggcctcagtgcccccccccaacccccagctctccctctctgctggtcctcaccgttgacaggacctacagaacctcggtggggcctttgcccagcatgaggagggcaaggtcacggggcggagagctgctgtgccacgtttgctgtgtggccttgggtaagttccttcacatctctgagcttgtttcctcatggaaaatggagataaaatgagtccctccctctagaggtttttgtgaggataaaatgaaataattcaagtgaagagagtattaaatactaggtctggaaataaacatgtattggttgtggttttctttttctttttttttttaaggcagggtctcactctgtcacccaggctggagtgcagtggtgtgatctcagcaacctctgcctcctgggttccagcaattctcctacctcagcctcccaagtagctgggattacaggcatgcgccaccatgtccagctaattttcgtatttttagtagagatggggtttctctgtgttggccaggctggtctctaactcctgacctcaggtgatctacccacgtcggcctcccaaagtgctgggattacaggtgtgagccaccatgcctggtctggttgtggttttcttattgctgagaagaactcacacagcaagtataagttcttctgagcaatacatcagtaggactactagtagtagtaggctagtaggactggttggtagtagtagtagacta

SEQ ID NO: 12701 - DNA, 1233 bp, Homo sapiens
gctgcgtgtcctggccttctttccccgggacctttttttttttttttttggagacgaagtctcactctgtcgcccaagctggagtgcagtggcgtgatcttggctcactgcaacctccgtctcctgggttcaagtgattctcctgcctcagcctcccgagtagctgggactacaggcatgtgccatcatgcctggctaatttttgtatttttagtagagacggggtttcatcatgttggccaggctggtctcgaactcctgacctcaggtgatccacccgcctcagcctcccaaagtgctgggattacaggtgtgagccaccatgcccggcctcatcaggacctttgatgcaacttcctgaaaactggaccctagcttcttcgcaaggatgctaagctagattgagctctggggtgggagacaggtgcccagagtcccccctcccactcagtgctatcccctccagggactgtgggattgtcccctgtccttctcaaggcctttctgtccctgggtatgaagggattgagtctttggtttccctcccctgctgctgtgcccagagtgtttgcatttgggctgagaagtggagctctgcggagttttttgcatatccttttttggggtccaagtgtgatgatctcatctggagccttgacagactcctgggggaccggcagaagggacggcagatggctgccctggcctcttgggtggggctggcatgccgcccctgtggccactgccggcccactccacagagcagcccttccggggctggggtgagtggcccgggcccgggcaggagacgagtggcccagagccagggtggcagatgggaggcagcccaggcctcggcctgagggagggaccatggtggccagggcagtatgggagcaggcgggccaggcggaggctcccgttcctctgtagtgtggttgctgcctcgcagagtgaaggttctgggcctctcagctcagctctgtcattcttctgggttggtctgcccgtcggagggcttgttgggcccctggaacctggggaggaggtggtacatttgggtaaggtttggaatctggcagggctgtggcctgggtgttgctgggctgggacttgagccccaccactggggtctgaagcacccatgggcattagcttcacagaatcaaggaattagattcaaacacaggagcgctgactagaagtagttttctgtaggggagtagaacaggg

SEQ ID NO: 12702 - DNA, 1191 bp, Homo sapiens
tccaactcgcctccgagaagcatccaaaagcagagtccagctttttaaagatgacccaatgtgaatgtctgtagtcagttgtttacaaactccctctcctgcacaattcatttagaggcttcaatcatagaattctgcaaattaatgacaactcatgctttaattttgtattttgaatgtacacgcatgctgaagctaagtaacttttaatcaaagaaataagatggtattaggcaaatcttactatactatgaaaagcattaccttgcctatttttaatattattaaagcctttctccttcagtagtctattttcttagaataacaactcttttatctattctgaactctattttttttcttttttaagagacaaggttttgctctgttgcccagcttggactcgaactttcctgggctcaagcgaccctcctgcctcagccccccaagtagctgggactaaagtcatgtgccaccacacccagcttactctgaacttttatgacagatgattgttttttgtttttaatgtagaaatgagacaagggtacaaattggaactagaaattgacattgtcattgacaaacatggctaaaaacaaaacatcaaatcctgcccccgtgaagagttccctgtcacctcaagtttgaggatagtcctctaagagtgacctaagcataagtgaaagacacctcccctcacccttctagccccctacaaggtgccaggttggggtaaagagttggagatgatggccaggagtggcctccaacacgctggtgagaggcctgattaggttttggggaagatctgagagctctggcctcttcgtgagtggaacataaagccgcctcttgttgggagatcctaccccagtgacagaggaatcccccaaactaggctgtgccctggctccgtggcggctccagacccgggtagtgcctttgtcccctgaatactcactcccccggtccagagggccttcccactgcccagcctggagaaggcctcccctgacctgctctctcagtatcctggagagctggccagaggccatcacaggcatcatcctcagagctcctcagacctgggactttgtttttgctggttcagtgcattttgtgtatttaagagcaaacactagccaggcgtggcggcgtgtgcctgtagtcccagctacttgggaggct

SEQ ID NO: 12703 - DNA, 1181 bp, Homo sapiens
agggagagctgcttaaggaagaggtgcttgagctgaattctgaaagtaaaaattaagccaagttgaggtaaaaacatggaaaaatgctgagcaggaaagaacctggcttcttagaggacagagaagaagccagagagcaacagatagcgggaagcgcgagggaggagatctggttgagaggctggcaaggtgtgaggattcaggattgggtttgtccttagaggcagaggacttacagacatctttcagatgggaatagtaggataaggcctgtgctttagatgcttggaggctgctgggaggactgtccttccaccagttgaagagcaggctccctgccttcccaaggcttctcctcaggttaaacccctggattccctcgcccttccccatgtgatttggttcccagatcttggtgtgcatcatcattgggactgtgtatagcaccttggaagagtgtagagtgtactgaatggttgtttccccccaaggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaaggtaaggctgcttttgtcctggtggtcagggtggttcaggagaaccttcatcccctcactatattcctttggggtagttcaaaactaactcttgctcatttgaggataaccaaggttaatccaatataagaaatatttggccaggcgtggtgactcacgcctgtaatgccagcactttgggaggtctaggcaggtggatcacgaggtcaggagttcgagaccagcctggccagtgcagtgaaaccctgactctgctaaaaatagaaaaaattagctgggtgtggtggtgcatgcctgtaatcccagctactcaggaggctgaggcaggagaatcgtgtgaacccaggaggcagaggttgcagtgagctgagatcccgccattgcactccagcccaggcaacagtgtgagactcagtctcaaaaaaagaagtttatttcagtttgacagatctgtttttgtttttgtttttttgcctaatgtatgttaaggatcatac

SEQ ID NO: 12704 - DNA, 1219 bp, Homo sapiens
cctttttttaattatgagagtccattattgtgagtgggaattccattcctgtgattttttttttccttaagaaagtatagtttatgtttctcctaagtttttacttttcaagggttttaaataacctttttgtacagtttttgcttttcttctggtaggtcttgattttttcctttccatctgcctttaacacgtaaaaatgttcaaagtgtacccccacacgaggtttctggaagtcattttgttgaacataggagaaccatataagtagaaaggtaacttgtcagcatcttttcacatgggagtgttgtaccgaagttttgcaaacatttcatcctggtgtctggggattagagggggatgagcatgtgcgaggcggaggtgactttggcagctgctccgcattctgtctttgccatgcctgccacaaattgccaagacctgttctaaaactctgtgtctgccaattctttcttagatctctatttcaaatgagaccaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcgtgagttgtcatctcgagcatttctcaggcttcatttgtctcgggtcctatccgaagagggctcattcattggttcagcaaatactttctgggcaagtacttgcagtaaatacttccgtgtgccaggtgctctgcaaggcaccgcagacatgattgcatgaaggcaagtaaggtccgtgtcctcgtggagctcacatggacacagtcttctgcaagcctcgcagacagaaggcaagcgctgagccagagcatgagcacaccaccacctagagatccagttgccttgtgcggttggagggctagagcaagggcagataactgagaaggagccacgtgcatgtcttgttgaggcttggctagggcaggatgacatgttggcagtggaggctctgcaaagtgggggctctcaggatccctggaagttgtgaaagacagcatctggtgggtgaggtggttgctcagagggtggagtattctaggaatcagactctactactctgcaaaaggcttaggtgaaggagaagcacctttcctatttgttataaatggaaatattgtaacttca

SEQ ID NO: 12705 - DNA, 1125 bp, Homo sapiens
tgatggtgttctcactggatgcttcacaggcacgttggttgcctagtcatgttgcctaggagagcagtatgtctctctttgtcttttggagcattaagaaattctgggaaacgctgtgctttgtaggttgtattcaaatggatggccatggactccatctgtgtcatgatgcttcctgggtgcacagcagcctggcccactggctttccacccaaagcagctggcgtgttctgtgccatgactcctgggcttgggcctgcatacaaggggccaaggaaggagccctcccaaaactgcagaagatagtgctctcctcaaatgtctgtttgatatactttactctgcctaagcaccatttttgagaaagtatgaagtgactgagatggtcttcagatttagagtgagagatgtcacgaagctgtctgcagtggggttgacagtggttcgtgcatctcatttctgctgttacttgacatccagcatatttctgttttgttatggcaggaccttgttgctcgcctggatgaactcgggggcgtgtatctccagtttgaagaaggactggaaacaacagcgttatttgtggctgccacctacaagctcatggatcatgtggggactgagccatccattaaggaggtacctatctaacaattttcaggcatgaaacccaaaggggtcatcagctgtatctgctaaggatggcttttatcagagaggaatgttcagacagtaccttgggatgctgtcactcagtgtcctgggttagggattaagaatgagaaatagaaagatgtaatgcctgtcttcaggaaatgggttgctagtgaggtagacgtgtaaacaaaccatgcttgctttaaatggggtatgtacatgtcacgaggtagtatcaaggaagccacgtgtattactcctgtttcatctccctttcttcccagtacccttttctgcttgtcgcctgaatgctttccactctggtggctcattcagatccttctctgggctcacaattgcttctcctcccttcccccttatgctcagcaacggctaaatcttagctaatctttgctgatggacatagttcactgagaggcatgtgtgtctatcacacatccgccaaga

SEQ ID NO: 12706 - DNA, 1203 bp, Homo sapiens
tgtccaggaaaaaaatatagcattaaaaaaagacaaagctgaaagtacccttctttcttttgtgtctcctacctgccttgtctcgattttgctcacgtgtgctgctggcatcaatcctgtaattatttctccttgcggttctgccagcccggctctcctgtgtgcctgcagaggccacacgtgagctcctctggtgcctgactttgttggagttgagagccttaggtccttgaagtgaaagcccagaggtacaagcatctgtacacagcatttccccagatcctgctggaagtttattctgcacttttctcagtccaggctttatcagtccaatttgcccccaggttgcagacagttctccacatctgtctgtccacaacagaagtgttactatgggagagggtggttgaggcaatgaagtgaagtatatattttctgcctgttctcagagatatactgatcctctctgaagactaactctatatgcctctttcagggtgacatacccagccaaagccaagggcacattcatcgcagacagccaccagaacttcgccttgttcttccagctggtagatgtgaacactggtgctgaactcactcctcaccaggtcaggaagacacctagacagttctcttaacctgaaatgtgaatggatactagagtttacaatgtggtctataacatggactagagagaattccacgttcctgctttcaggttttgaccgaaccctgacagtccatcaggttctcccacatgacactctcacccttctactggttgtagtcctttacctgggatacacccttctttctaaaaagttagctggtattgaggagaggtacttaaggcagatttgcacttaattaaggtcattccttcctccctccctccctcagatggactcttgctctgtcacccaggatggagtgcagtggtgtgatctcagctcactgcaacctctgcctcctaggttcaagcgattctcctacctcagcctcccaagtagctgggatacaggcatgcattaccatgcccagctaatttttgtatttttagcagagacagggtttcaccatgttggccaggctgttctcatctcctgacctcaggtgatccgcctgcctcagcctcccaaagtggtgggattataagcatggcactagactcgaggctttttctttctgatttaaaaaagg

SEQ ID NO: 12707 - DNA, 1222 bp, Homo sapiens
ttttctgccttaaagttgaagaaatcaaagcacaaggaagttaagtaacttgctcagctaataagtagtggaagcaaatctgtcttccaagccgaggctctctccatgacactgggctgctctgcttgattagaactctgccttaccatcaatacccaagcctcctctactaaatctttagctggaggcacaaggaaattgaaaatgggcctcttacagttccacctcatttcctttcttttcaccctctggtgaagcagttaattgggcagcaaagtgaccaaaaggctggcgggaaaaagaaattgcagcaatagcaaagggcttaaatcatctgcaaactgggcagtcagcctccaactagtcgagaattggctggacccgtaagttaaatttccttccttgtaccagcaaaaagttatctctgagctgggaactagggtggcatggccactccttctactctctggggcaggtctggcagatcccagagctctcactgtgacaaagcgctaataaccgtctgctgcccggtggattcaatgttaggcccagggagaatcttgaaattatcagatgaaagattgtattattcttccatctagacatttgtccgactccataaccagaagactggccaggaagtggtgtttgttgccgagccagacaacaagaacgtgtacaagtttgaactggatacctctgaaagaaagattgaatttgactctgcctctggcacctacactctctacttaatcattggagatgccactttgaagaacccaatcctctggaatgtggtatgtgcctgaatgtaccccgacccaggtgagagtggctgtgccccaggcactggtggctctttttcaggggcatggggctcttcaccttcgccttgcctgtgcctcctataaataagcttgggaggtgaggcactgtgtgcagtctccataaatagtcctggggtcatgcacggggcttggcaacatggtacgtgcttaataaatattaagtgagtgaaggaagtataaactttgtgagtgctagtatctgtgaatttctataaacattatacaggaaggccgttttcatattatagcaggcactattggggttacgtagatgtgaaagttaaggccctggcctttgagatatggcatagctcatgggagggatgagatctgaattctgataacaattcaggatgatgtagaaaagtgaa

SEQ ID NO: 12708 - DNA, 1100 bp, Homo sapiens
ctgagtcccatttttgagaatctttctgtgttaggttagatgctgagtgtgacttggcaagaacacggccacacggcaggaatgtgcaggtttctgtaatgaatggtcaggatgtcatgttctaagctacagaagggccaagtgttggttggcagagctggagtctgggagattgatgatgagcattatttaaactttgctctttgttcatctaattgaaatttacactgtgtttttggccttgcactgtgagaggtgtgcctggaattacctcatctccttatgttgtcacataccactttcttagttattattgagtttgttttgttatttgtatttaagttgtcatcagcttaattatgaactagctgtctcacattcttttgtaaaatgagatggggcatacataaatagacttgggagataaatgattattcccttataaatgggatcttagagcgggagagtaccttagtctctctgttgtcaccagttaggaactgtaactgtgaactgaaaccttcagtaattctgtgtttgtctccattttctttcagaacagcacattagttccagaagaaagatggaaattctgaaaactgaatgtcaagaaaaggagtcaagaacaattcacagtatgagaagaaaaatggaaaaaaaaaactttatttaaaaaagaaaaaagtccagattgtagttatacttttgcttgtttttcagtttccccaacacacagcagatacctggtgagctcagatagtctctttctctgacactgtgtaagaagctgtgaatattcctaacttacccagatgttgcttttgaaaagttgaaatgtgtaattgttttggaataaagagggtaacaataggaacaaaggcctgattgagagcttattctcatacttttgggtggtggggtccttgggtatatgacatgaggacttagttggaaatgctgttgatgccagcatatttctccaggcctttcttggtccttcttgccccttgctcctaacagaactgagaactgcctggaaaggccagcttccttttttcttctccagcagtgagcaccagctgtctgcataggagccctgt

SEQ ID NO: 12709 - DNA, 1561 bp, Homo sapiens
ttgatccatctaagcaggactctcctttttatcacctcacaggaggctgaaccgtctgagcccagaagtgctgaggtgacgaggaagcccaaggctgctgttccttctgtgaacaagaggcccaagaaagagactaagaagaagcggtagaagaggaggcctgaggagctgggcgggcagggagagggtcttggggacagccctcctgggaatctacattgtgttcccccgcattccaggctcagggtctgaggaggctgtgacgccctatgaccgcagagatctagacagtcgtaacagtccccaggctccagctgggcaatccaccacttcctcttccttctgcttctgtgacggtttagagtcaagggggctgaaacacactgtgagcatagactgtattaggtttgttcagaagccgggtcagctcacagagtcacattttcttgcttagtcatgtgtccctccttgagttgccccctccttgtgggtttacactacatttgggagtcattgtctaatgctgacaagcacaccctctcccattatttgtgcactacagatctcctcctgatcagtcacctttgttgctgctgtgtagacagagccaggcctcacctgtttgtttaggccaagatgccatggacatgcagcgttagtgatcccactagctgtgacagccaggcccagaaaatgcctggcgtgagagccagcagacagccaggccagggtaggcagtgcctgcttctgctccatcaggtgcaggggatttggctgaaggcgtgcatatttcctgggcacaaacttcctgagcctctgaaatgggaggctcgtcaatttcagaccaacctcttttcaacccatcatagcacgttcaaggtgtgccttttacttctacctgtacatcccccatcccttcaattctttcattccctgaccagtgagagggttcctgggggaagtatggtgaataaactgacatgcatgcttcagaacctgcctgtgttgtcttttgctgagggagaggggaagcctagggccctgccccggggatgagggaaaggcttgacccccagagaagtgggacagtgggggtgaggatggccagaataggatggcttcggtaagagcagttctgcaggctgagccattctggaagaagttttcaggaaggatccggctaagtgcttcgtgtggcccttagtcactggaaacacttgtgaatggccgtgggtgtgttagagtttccactgggtccaggccccactcattccccaggttccttctgaggaagatgctgcttgtcttcaaagtggcttgagaaaaaccaagtgcaatacagtaaaaggccttacgtggcattggccaggtctagtcacttgccctgaatcagctgctgaggaaaagccctgacctcttggtaactcggatttgcccagctcatttacagcctgccagacagctttcccaaatgccaggactgatgaggatcttaagagatgagcgactatcatctctgttttggagatgggaaactgaagtccagactactttgagaatg

SEQ ID NO: 12710 - DNA, 1280 bp, Homo sapiens
attggtcccattttccggttgtaagtactaagacccaggaagggaaagccacttgcctagggtctcccagttgccaagtgacagggccaggccttggctgtaggctctggactcctagtccagcagagccactgaaaaaggccaccacttccctgctctgggccttttgccggagcttcatttcctgcctcggtgtgtgtccccacatctctatctcccttcggattcccacaaccctttccttcccctccatggcccccaccccttatctccgtgggaaacccctctggcttccccttgagctcctgggggccacttcctctggggagcctcagtttcttcatgcctgaagtaggatagtgagtcatggttcccaggatgtcccaagaggacagaaataaagtgcttagcacacattagggactcaatcagtggaggcgggggagggccaggcacctgctcaagtcctgcctcctctggcagctgatgccctgtcctgtgattcagtttctgaagctgtgaaatgggcctagggcttgtacctggtaaggctaacaagaggatggtatgaggctgtaccttaggtccccacctggtggctggctccgtgtcgctgttcctgggggagggagacccagtagaggcctcccctgtgttcaaggcctcattccctgctgtttgtccaaagccaagtcacttagtctctctaaacctcagcctctgcacacctcccttgtgaggattaaatcagctaatgtattccccgtggctcaaatctactgggtgcttagaaaattttatatttttctttccccattctcctccctgttggggactcagatattatctagtttagggaagcttctgggctttcatccccctggcctagagtgctgtgttgagaagcattctgaggctcagtgttggcttcatgggaaagagtgctgtgatagattagtcatgtctgccatgggcacaggataagagagtattgtatgtgtgccatgagtttgtcattcttgatctattctgaccttctcctttcacagatcggggggattgaggctagaaagacccagggcaaatcatctacgctgggagaaaaatgcagagctcttgtcttcgatccaggactctccccagccagccagcctcctccttcccacagtacagcctggtaaggctgagtcagggatagatgaccggggaggatctcagagctgggagccagacctccatctccctactccttgctctgggtccttgggcaagtgactttc

SEQ ID NO: 12711 - DNA, 1141 bp, Homo sapiens
ctgtgggacctcgggcctcagttgtcgtctctgtaaaggtcatttagtcgcttagcagacgtgttcatgcttgctgtaggcagtggtcaacaagcctttttttttttcatttaatcctcatcacgaccaggagtgacgaggattggctgttattcccattggacggatgagaaaactgaggctcagagaggggacttgggcagcaggcaggacctggcactcatctgtgtctgggtccgctggggcctctttccctggtcacctcgctttcctggctgcatcggatctcgtgcctcccctttgacctttgccttctgccctctgctctgtgccctgtgctccctactcccgcagagcactgctcctgctttcgatgccaacagcatttactgtgaactgacctcacttgcctgaagaagtgtggggagggtggggaaggggtggttggctctccagccccagagtgctctgtggccctgggagggcatgggtggcacctgagccaggctcccacggttccgcctgcagatcgcctcaggcatggcgtacgtggagcggatgaactacgtccaccgggaccttcgtgcagccaacatcctggtgggagagaacctggtgtgcaaagtggcggactttgggctggctcggctcattgaagacaatgagtacacggcgcggcaaggtgggcaggggctgtgtggtatgtcgcgcttggcctgggacaggtcacgtcccgctctgagccccagttttttcctcagctgtcattcctcatggtgcttatctaacagagcggtcatgacaggaggtcagagctgccctgacctttctcgttcctgcaggtgccaaattccccatcaagtggacggctccagaagctgccctctatggccgcttcaccatcaagtcggacgtgtggtccttcgggatcctgctgactgagctcaccacaaagggacgggtgccctaccctggtaagaaggtcctcatggcctgtctgtggtccctgaatccctctgccctggtggccttgggcaagtcatgactcctgctgggcctgtttccccacccgtaaaacaaagaagttgagcgtctgatgttaggctctctcgatggtccatgctctcagcttcggggacag

SEQ ID NO: 12712 - DNA, 1156 bp, Homo sapiens
acatggtgagcctagccctgggacatcaggagactgggctctggctctgttcggcctttgggtgtgtggtggattctccctgggcctcagtgtgcccatctgtaaaggggcagctgacagtttgtggcatcttgccaagggtccctgtgtgtgtgtatgtgtgtgcatgtgtgcgtgtctccatgtgcgtccatatttaacatgtaaaaatgtcccccccgctccgtcccccaaacatgttgtacatttcaccatggccccctcatcatagcaataacattcccactgccaggggttcttgagccagccaggccctgccagtggggaaggaggccaagcagtgcctgcctatgaaatttcaacttttcctttcatacgtctttattacccaagtcttctcccgtccattccagtcaaatctgggctcactcaccccagcgagctctcaaatccctctccaactgcctaaggccctttgtgtaaggtgtcttaatactgtcctttttttttttttaacagtgttttgtagatttcagatgactatgcagaggcctgggggacccctggctctgggccgggcctggggctccgaaattccaaggcccagacttgcggggggtgggggggtatccagaattggttgtaaatactttgcatattgtctgattaaacacaaacagacctcagaatctgatcaacagtttattgaacatctactgtgtgctggaaagcgagatggggcggaatgcgagaacaaactaccccttgaggggtctttgggcagcactagtagctggagggcttcaggccaaggcaggggtgacatcagattggagacagctacggcagaatgtggctgtttgtgaacatctgcacctgtgttagggggtgagcacctgggagaaggacaaggcacatcacaggacttccctgagcatgacaagttcaggactcaaatgtccgtggtggatggtagcagtgacattggggagtgggtggggctgtcaagcctgcctagaggagatcacaaatacacgacgagaataccgttgtgtgtgctcttcgtgtgtttcctaggagtgcagggcaggggtgctgggtcgatccacaaaagtcctgaaaacgctgaagaaaaatccaaagacccttcccctcc

SEQ ID NO: 12713 - DNA, 1259 bp, Homo sapiens
cgcgccttggggggtgtttatgaggaggggtggctgggggcgctcctcattcgccaggagaggaaaaaaataatccatctgctctttccataccgacccccgcctcctgagttccatcttagcccccttccagaagattccgccgtgcttgcttttggattttgctttaaaatggaggggtaccacgactctgggtagagtacagggcgagaatgggggtgcaggtctcttagtgtggcgcccttctccccagtccctggcctgcaaatttgagctcagtctccggtgccactccaaagcctaccttggggatggatggaaaaccgaaattagggaggggtcatctgccccatagagcaaaaaacgtggtgcccctttcagaagctttggcataataggcccgtgctcggcgctcttttcctgatactgaatgagttttaagcccaggtcctctgcttcatgagggtgcctgagcgcgtaacccgtctgattctttacatctctcttacggtagcgaggagatgagaatctgcggtggaggtcgctactgtagggagctgagccagagcactgcgctttgggcgcaaaagcagtagtcacccggtatctgtaggagggatacaggaaggattggcgcccttcgtatgcacggaaggaatgagctctacggagaagtggttggaatatgcttggggatagttttctgctggacaggtcgtttcgacctcagtcttccgctcccctcccccaagccctggtaggtcggccttagccagtggggttctttgtacccgttgcgctgtgcggctggatcaccgaacggggttacgctaccgctaccggagggttgtggctaccgcagccccgtttccaagtgaggcgggtcccttttagaccgccagtcttgtgggtccctcgcacagcgcggattttcgggcgggaagaccggaatgcggtttgtgagtgtggtccccgcgcaccggtagccagccgaaagcacctctttccagcaagctgcctggcccagggaccaactggcatttgcccctatgtggatagaaaattaattttcattaaaagctcccagaggtcaggttctatacagtgccagcagcagatggaggtgtaatgatccaaacgagttcagtttggacaaagtagcatagtgactttttttctacattgactttcggagaagttggcagattctggcaaagtgacgctgggctgtttgaaaaaggcaagcttagcctaggctg

SEQ ID NO: 12714 - DNA, 1192 bp, Homo sapiens
cccctcaaaagctccgaagggagggtcagccttcatggagaacacatgttggtatgttcatgattctgtgggtttagtgtggaaaaccacagaaactcccagttttgaggcctgccaagatatggggttcagaagggaggaggtgtgggcattgcctgctgatgagtcacactggggcgagaggagacctgcctcaccttcaggctatggtagcagctatagccacccagcctaagaaagatgaagtctcagattgcacatcctcttcaagtcctgatgagtcctgattgccactgctatggcagtttctagcgtgttagggttcactggcatctcaaaggccctcttcgagagggaaactggagatgaagggtacaaggtgacatgtccaggttccctaggctgattgatggcaaagtcaagaccagaaccgggatctgcacctccccacccctataattctctgataccgaatgaagttttagatgcctttagaggtgctggtgattgggctaagaaacttaagggcttgcttaggggagggaaacatgatcaggcttaagggggcaaggtactttgtgcttcagaagtatttgtgacagctgtgactaagggattcgaagaagtggcaggaagagagatttatggccctccaactccctcccttggtgttgacccagcaacaggtgtgtagtgacagggacacataaagccagagacaaggctgaacaggcggcagggccatttggtgagacagtcagctgaccccgtgtagaaagagccctgactcactggggagtgggagaggaagacaagtccgaggccgagcactgcccaccctgacgtgatggcaggggagagcccagggccacggacctggtaagcattcctaagaatacggaggctggtgctgggaaaagcagaaacccagtattggggagagaggtttctggggtgaggtggggccaggagaccctgcagagtagcaaggccaggcagattgtctttgtagtggtcctggtggatgtggggcctgcagcattaagctgggtgaagaaggcgccacgctgcacctcttatcccatactcattgtctaagccactgtccaccctgcccactactcatttctttggggctcctggatggagacctgaagtaaggctttgtgttctgaaatcacccccttggtcc

SEQ ID NO: 12715 - DNA, 1216 bp, Homo sapiens
tctgttctgaaagatagaatgagggtgatgtgcataagagattgtgcagctgaacagaaggaacaccgagtcggctgcaacttcagggaccctgccttggttcagcccagggacctcggcccagtcactaacctcctgatgcctgcatgtggcagcagctggaccatagtatttgtgtttgctcagctagctagagtttaaagcatacatattttctcaagggatgttaggaagattcaagaaatgatctatgtgaactgctttaagctcttctcttttttttttttttaacaaaaatgggagggaaatcaagatattaatcatattattcatccaacccaagattcctttgaattattccccatgtaatctgtatttatgggtagaagcagccatgccttgggagcagagacctccaaattcataactgtcagaatcacaaaccatgggcaaggaattaacagcagtaattctattttttttttcccccaagcagagacctagatgaaatcgaattaccaagcattctttagctctcttgctgccttggcaatgttcactcaccaggttggaggctgtttctgcaggttttacgtaccctgggaagcaagtgtggtgactttcttcgcagccggttctgcaaagatgtcctgccaaagctggctggctccctagtcacccaggcccccatcagtgccagggctggaccagtttactcgcacacgctggccttcaagttgcagctggctgtcttacagggcctgggccccctctgtgagagactggacctaggtgggtaccaggcagttccacctgaacacacacacttagcatctgtctcacccctgccatcatgccctctgctcagtcgtgcccccctcccctcccctctgtgtacctccttccgtcttattttggcctcatttgtccatttatcttgatgtgttctttggcgggatggagtagagagcccagagcatcttgcctagctgttgcagtttctccagacacagttggtcactgcttgtcccaaatgaagtgtaagggctgatgcttgttttgtttttcttttctgcaggtgagggtgacctgaataaagtggctgatgcctgcttgatttacctcagtgtcaaacagcccgtgaaattacaagaggctgccaggaggtacgtctgcctgatcacccgcatccctttacgtttgttctaaattacag

SEQ ID NO: 12716 - DNA, 1128 bp, Homo sapiens
atacctcagttttaaaaagatgaaacctgaaggtttaaatccaaactcctgaaggttaaaatccgaactcctgaaaatagtccacagattcctattccttcctccctcaagtcttgcctcgagcataattttcttgtgagacccatcctggcttcctcaggatatgacttccacactcaggactgtaagcttaggcctgtcctaatcctgaagagactttattgtaactgtacatgtacttccctcactagacagggggctcagtttcattgcacccctagtgccttgtgcagtggctggcacatagaccccaggtaaatgtctgttgaatgaatgaatgcaagttcacttcatacttgctttgaacttgacatttttactgaacagtttccttcctccagcctgcaggatgtttcctcaatgaggggaaggctgctgcacaatggcagtttttgatactcctgaggaggcctttggtgtcttacgtccagtctgtgttcagctcacaaagacccagacagtggagaatgtggagcatctgcagacacgactacaagctgtgagtgacagtgcccttcaggaacttcagcagtacatcctcttccctctgcgatttaccctgaagaccccaggtcccaaaagagagcgtttgatccaaagtgtggtggaatgcctcacatttgtcctttcttcaacatgtgtgaaagaacaggagcttctccaggaactcttttcagaactctctgcttgtctgtattcacccagctcccaaaaacctgcggctgtgtccgaggagttgaaattggctgtgatccagggacttagcacattaatgcactcagcttatggggacatcattctgactttttatgagccctccattctgccacgtttaggatttgctgtatctttactgttaggccttgcagaacaggagaaatcaaagcaaattaaaattgctgccttaaaatgtttacaggttctactcttgcagtgtgattgtcaggaccatccaaggtcattggatgaacttgaacaaaagcagctgggggatttgtttgcctcttttttacctggaatctcaactgcactgaccaggcttatcacaggagactttaaacaaggtca

SEQ ID NO: 12717 - DNA, 1194 bp, Homo sapiens
cagaattaaaataattatgcagtggttagaactggaatgattcttgacatatacatgtatgtgattgtgtttatacatgtagaggtgttggtgtgttagaattgatgagttgcagtgaatttatttcctgttttaaacatctggttttttaaaatcatttttctatctttaagagttctgatccacttttaatttccagcagaatgtctggcattttaattaacgtcttcttaaaaagcaagctatcacaactgataagatggagttttgataattttctgtctgtaaaaattggccattgacttttggtcctatttgatttcaattatggcatgatccctcccactgcacgaagaatgtagtttgtggtcaagttttgggtatccaggtattacaatatgtaccttatttggttttaaatgtgtaaatcatttagtcagttgttgatttcttttttttttaagtaggtctgtcctaattaaaagcaaaaaatcttaagcttatatatatcttttcatcttttctgggcagagaggcagatgaaggctgtaaaaaacctttagaaagattgctgaacatctggcaagaacgaagtgtgtatggcggcgagttcatacagcagctgaagctgtctatggaggactccaagagccctccccccaaaggtagaaacatcaccacatgtttacagctcttggtctttgcctactttcgaatcaaatatgaaaagctgcagtggggtttgctgtgaaccaccagcgattttatgattcttcagagagacagatgatcatgaatgatggtgagaatttatgtagtgctcacagcgtgtaagcctggttctagtattcatgctattcatcctctcacaccctgacttttgctctctgttctccttggcttgcttctgtctttcagagactttccttgcacaaggaaaggaacaacaaagttgttcagagttgtggtgaactaggaagtagcctggactaagattttgtccttgctctgccattaactacaataggaccttggataagtttcttagctttttaagaacttgatttaattaaatgtagatgtgcttttgaaacatatccttaggattgtcagcatggtgtctgtctaaagttgattgtttgtttgttttggagacagagtctcaccctgtcatccaggctggagtgcagtggc

SEQ ID NO: 12718 - DNA, 1730 bp, Homo sapiens
agagggcaagtcatggttggaaataaccttctagcccctggttctatcccttcttccgcccagccccccagcctcaagaaagaacctcagactctgattctcctcttcagcctctcatcttgagcacagttcagaacagtggcgactggaatctggtttatattcatatttgcaaagactacagactttttctcccacttcatattttcatgcccccctgttggttttccattcttaactgtctccttatacctaagaagttatgaaaatcatgtgtacttctggaagctttcgaaagaatcttgtccctcatgacagcattttatcatgaaagcagcttctcctttctgggctgggcttgttcaagttcggtgtgggcttccactaaggcacttgtcctggagacgttggctttcccagctgcatctgccccaaaaggttgtaggcacagctgtcgtagcgttgccataaagagtttgccaaatctctgatcctccctttccattgcttctcctagtgatgcacgaagattaggtgcatttattttgtaaacagattggagaatctagcaataagattcaaagctaatctggagcataaaggcacagttcagagacagaataacagggatcacaagcatgaattaaaaggaatttatttgcttcaagttcctagatacaaccttcccatgctgcacttctccactgtcggagcacgttccgaaaaacagaatgccttgatccctggtgggtgcgaaggcagttgttagggatggcaggcattggtgggctccaaaagatgaaggccccacacacaggtgtgctgcatttgggatctgtgtgggtgtttcttggaccctttcttctgggagtagggtacacactaacgtttaatccgctgtctgggtgcatgtccacagtacggtggctaaactcgaacatcactgcaaataggacgctgagcaggtccgtctgtcatgtcacgccactgcacaggtccttgtccccacacgacggggagtacttgcgtcagatgttattgaatagctcgtctcgggcaggggaagcggggagttggggatattaattgggggttttaattctattatcatgtcagctgacattatgactatataatgtagttagagacaatttttatcttgcttatagtaaaggttcagcctgccaattgtaaatcattctaatttggcaggcttatttttgacattggaaagggcagaaagcgatttgccccagtagtgtaataggagttatagaccagaggctgaaacccaaactatataaaaaggaattcagtggagggggctttgtaatctccattaatttgtgttgctacttccaggatcaccaaaaattacatgtaattttacatgttaaacacattgaaacataacctatgtttataaagcataacgggcttcccttccagaagctctcctgcttgtcatgaagtgagaacaatgaaaagtcatagcagatactcagtttaactctgtgtagaacctagtagtgtttgagctgttattcagatttgaattcagactgtgtgttgtttgcttatggacactgcctgtcgttctgtcactgttaaattaatgagtctataaggtttttcttccagaggccataggtgacatcactaaaattgcaagataaattgtaatctttgctgctgctgcactccccaacctctcccccaccccccgtggt

SEQ ID NO: 12719 - DNA, 1203 bp, Homo sapiens
tgattcttttgttttgttttcagacggagtctcactctgtcacccaggctggagtgcactggcgtgatctcagctcactgcaacttctgcctcccgggttcaagtgattctcatgcctcagcctccccagtagctgggattacaggtacatgccacctcgcccagctgatttttgtatttcttttttagtagagacagggttttaccatgttggccaggctggtcatgaacttctggcctcaagtgatctgcctgcctcggcctcgcagagtgctggtattacaggagtgagacacggtgctctgccgattcttatgggtatgattaagaagaacatcccaatcacagcctggaatagaacactttcgtgatacaattcacaacctccttctgggaggacatgagcattcctgataaatgctgaagcaattttctgataaactttaacaagattaaaacctctttggggaaattagctacccaaaccatttggatgattatcatacattctttgtcttgtattcagtttaataatgattatccaaccattctcttttcctttgaaatatccataacaaaagggaactactgacttggctttgtgacaagcttaaaataaaacttcaacacatgcttataattaatttttgtgaaaaaatgtaaaacagtcattatagagataggacataaaaatagtagctaacacttattaagtacttgttgcttgtcacatgttatattaaatgcccaaaaactctttataatgaattgggttataatacctctgtttgacttaaaagatgctgatacagtttgaatatttgtcccctccatatctcatggtgaaatgtgatccctaatgttggacatggagcctgctgggaggtgtctgggtcattgggatagatccctcttaagtgacttggtgccctccccatggtaatgagtgagttcttgctgttagttcacgagagagccggttgtttaaaggagcctgcacctcctcctctctctctttgctccctctcttgctatatgatgcgcctgctcttcctttgccttctgccatgatcggaagcttctgaggcctcaccagaagctgagcagatgctggtgccatgcttgtacagtctgaagaactgtgagccaaataaacctcttttttaaaatttaatttaatttttttttttgagacggagtctt

SEQ ID NO: 12720 - DNA, 1123 bp, Homo sapiens
tccaccttggcttcccaaagtgctgggattatggatagtaagtccaggcctggccgacgtgtggatagtatcacacaatccctgacttcctaatccagtgaattctcaacatttcacccagagttgatcttccatctcattctcttatgagggaagcatttgagtagtggttctcaaactgtggtcccagaaccaggtaccatcagtattacttgggaacttgtaagaagtgcaagttcttagccctgtcccaacctactacatcagaagttttggatctggagccagcaatctggcttaacatggtctccaggtgattcgtattcatgctaaagtttgggaaatcaaaccatgttagaaatctttgggaatcagaagcagctgctgcaattctaggctgcaaatctggtcactgacttgtttccaggtctcttagtttgggcccttcctaagctgctgtcagtgcctcccctctcaactcactcactgccctattttgtccctgtattcgaaagtgatcgtgggctgcctttgccctggtcattgatagtgcagggagaggaatcaatgaaagcgcttccccgtgtttgaagggtccactcctatcccttccaaactctggagctttcgtacatgcctttattctcaccagtgatgttacctcctggtacctggttgtcgtgccagacccctgtttacctcattagggatggcaccaggttcaacaggccggagaagagacctggagccagtgaaggaaacagggtttatctggggaacttgagggcagtcagcagtctagtggtggggggctggatgggggcacctcatccacttgtaaaatgcatgcagattatatagcaccttcccccagtaacctccacatggcaaccctcgtttcctaagaagctattgttacatgcatctaccatacactggtgctgtatggttcattgagtgtcccttgtgcctagcatgggactcagaggctcctgtcaaaggacagtgaagcagggacctgccacactgagtttatgtctctgagctagttttggagccacagtagtggttaccccttcctagagctccccccagaagctctctctgcctccccatcacactc

SEQ ID NO: 12721 - DNA, 1111 bp, Homo sapiens
aggatgtccatctggggtaatgtgtaaattgcagtagctatttttcttaacgtttaagcatcattctgtagggggaagaaaaaacagaaaagaaataatagaaaagccaaattctgtattatatatctgtatgtggatacagatatatacaaatgtactctgctgatcaaaaattcagttgaaaaatgcttcttgtaccatctgttaaactgacaatgccactgtaaattaattgtaacctattttcaaagaagatttcagagagccctttttaaaaatattaagacatagttgctaaacaaaagcacttattggattcaagtagctatttaatgacaccaatatttgatctttgtgtccagggtcccatgagcctacgtggcatattgcaaatataataaaaccctccttttctctccccagccattacaacacaagctagcatggagtttcgacggaaagggtcacaaatgtccacagacaccatggtttccaatcctatgtttgatgcaagtgaatttcctgataactatgaagcaggaagagctgaggcttgtgggacactgtgtaggattttttgtagcaagaagactggagaagagattctgccagcttatttatccaggtcttggaatttttgtttgttttttcatttatatagttttgatagtgaagccattgttggttggccgactgaaccgatgagtgatgttggtctgaaatacctacagatgtctgtaagtgatcgacatttgcctgaaatctttcattttacctgtctcatcagatttggtaaagacccttaagaccctttttgttttagaagtgctatttatgtcatcttatttgaatctttttaatatggagagatttcgaaggaccacaattatttgttaacaaatttttagcacagtattcccatgtaggcagtccagaaataagtcagctgtaaatcctgcctccaaggagcttattttctgggcaaagccccaaacaaagccgtgtacacatgtaacaatgatccagcaggaattaggatattgatgggagaggcacagataatgtgctgtgggcattcaggggaagaagcagcgcacatttatttactgta

SEQ ID NO: 12722 - DNA, 2121 bp, Homo sapiens
actggaaagtgactcctacagtcccccccatgtccgccggaaacagaaaatcaccgacattgtcaacaagtaccggaacaagcagctggagccagagttttatacttcacttttccaggaggttggactcaagaactgcagttcttagaccactgaatttctaagactgttgaactccagtttgggaactataacacagcagaacagtttgataggtgatcactgtaaaaataaaaacaaatcactcccaagagcttactgtttaatcaccagaatagaagaaacacattataacccatttgatagaagactttgggctatctagtgaaatgggctcccagacacaatcacactcctgctgataatgatgatatacattttagccataaactttcttttaaaagtgacaattttagttaaacataagccttttgaggagaaaggcttttatgcatctcagttaaacacgtgcattggtagtatcaacaaatttgcaatatagaagttgaagatagttttttacctcactttttaggaggttgtattcaaaattaaaatctcagaatcttacaggacatttaaagactcatgttgatagcatggaggagaaggaaagaagtcacagccttctactcagttgtaggtcttcttgtcatccagctgtcacactgacaaaaagaaaagatgatacatgttttttgctcagataagaagcctgacattaaaagatgtcatatttttttctccacatttcaaaaagttgtccttctcatcactgcacagatctgtctgaaagcctcagtttctgagtgacccaggaacagatcagaaatggagcatggccttgtcctttaatggggatgcaaataaagtttgtggggttaaaagttataagacagcagtgataccccactctctccattattgtccagcggggtgacataatgacaggttaaatatttgtgattcattgattaaatattatttaaagaaatgtaaattcacaataagggttgaaaattatttggtttcatccattgtctcttatttcaggaccaagcagcaaactgcagtagtttgtgaaggattctaatatggggttcaggaatagcctctcaacgctactaattcagatctctcccagagaactactggatttcctcataattgacaaacatgagtgaccacctctttgggtggctactgttagaaatggctgttgtcatgttttctggactttgccagccaacagatccctgccaggttttggaaatacttctattacctcgctgctacttttctgcagggataaaacttttgaggtggccagacccagaacatccaaggattcctgttacagtgctacagtatacactgctcatttatcctattctcatgtgctttcttctttagtaagattattttaagaaaataagtgatatttaaagtccaaagaggaatgatcacagttgtataaggggtgttttcccacttgaactctgatgtcagtcgactgtgggtcagagctacaaccatctgtttggtttgatgttttggtggtttacttacggagtggggatagtgtgagacctaattccctgtgcaaatgtctcttattccagaaatgtgcattttgtcatctataagcaagaaatatgggcatagcagctcttggtttaaagtttgccataacctgttcatgtttgttttaagctcaggtaaagataacctcctctttctatgactccagtttccattcaggttatagtattattcaatagttgattttctttttaagctgggcaataaattgatgtttccagatggtaacatgggagagggcatataggataaagatgagcaaattctaccctaaaaatgttctagtagttcacaggaagaagatgaggtttaataactttcaaggtaattctagattgacattttgaggggaaaatgggctcttgttctagttgaagtgagcagagaaggctataaattaatatgtaacttacagcattccagaggttaaaaataactgatgcagatgtacttcttcagtgtgattcttcagatcaaacttttacttttggcatagttaatttcagaaaaatgtgctgt

SEQ ID NO: 12723 - DNA, 1424 bp, Homo sapiens
tgcattcaggagagccatggtagggctagagttgggtcttgcccagccctgcagtttcatagtcccagccttcctggtgctggggagggaggactgtgaatggctgttctcccctcactgctgagtctcccaggaccccctttggagatgcccatggcatgggcactgcccacaggctcagccagaacctcttggtgtacccgataagctgcaggttatcccttgctctgtgcgccttttatttgtccttaaactacctccttagagctctgaaggggtctcctagttccagattttaatttggggaacagatctgggttctttttaaccctcttctttctcagtctatgagaaacttgccctgaggggcacctgggctaggggcttgggactggaagaccatccccgccttgtgccacaactttggtcatgggatctgctctttgtcattcttagccccctactgtggcccccatagccccataacccagagagggagctggacttcagggagcctgagtgatgctttcccaggagcagggcagctggctggaccagaaagtagagggcccatgggagtgactgcacccttggtggctgctggaaggggagaggttctcagcatcaggccacctccaccccaatgccaggatagatgtattctagagtaggggtggaggcggcccaggaggctgaagacaggtgcacagatgcttcccacgaccttgccatttggggtgggctcttcaacatctcaggctgtggctggaacaggacaggatgatctaaaacacacgtaccattggctgtaaaacagtatgagcccagactgacgctgaaatccctcatgagccaaccttagctacaaggtagggagttctgagggaagccgcgtgctcctcaggagagagctgtttaggttttccgatctttttgctcaggggccaaacactgaaggcacgtactgcccaacccactgagcgcctgaggccattccctccttttccgcatgcctcctgcctcctgggctattcctctccacccagaaggctgggaatcccagctgattccctgacaggagccgacttcacacacaggtgactctcaggcattggctcatgttttcagccagggataaaccatcccttcttggggctttaagtccctggggagctttccctgtaggtctcctgggtgttgagagacaagttggagaccaacctccaatgaatgagccgcggtcattcattaattcactcacgtaatttactgagtagctgcaacatgccagcctctacgttaggttctgcggataaaggaggaataagacagagtcaggagaactgttccttgtggtttccgtcccttggggaccacaggcatcagcagtcccattcaagtcacctgaggcaaagtgtctgcat

SEQ ID NO: 12724 - DNA, 1154 bp, Homo sapiens
tgtataggattcagtaggtctaggagggggcctgggattctgcatttctaaactcccacatgatgccaatgctgctggtctgtgaaccacttgttgaatagcaaagttctagaagaaggtcttattaggcttttcatatgggaaatctgggcttgcctagtatggatatatatttttttattcatattccacccacctaactttgaagaagaaagatgcctatttcttttccccacaattcctttcttccactccctgccctatcccttcctccccttcttgaacagaggctgcttagcttagcagtggcaggagtccctctgaggatttgatttttaaaaaccattgaagaggtgtaaaggaccctgcttgctgaaaggaaaaggaagagtgactgggcctcccccaggtcatccctgtcctgagcaggcacctgggaacaattaactggcatagtctccagagaatgacccaggtaaatatatgctaaagagaaggagaatttgtacaagtagatataaatcagtatgttgtctttgttgttgttgctactatgtgtcaccagacctttatataccatgagaaggcaaaccattattaaagagaattcgctagccctgggtatttatgcttagaacatgaatactatacctcactttttggaaccacttttttctctaggtaaagtcatgaagctgagccccaaagcagaggaagtagctacgttctttgcaaaaatgctcgaccatgaatatactaccaaggaaatatttaggaaaaatttctttaaagactggagaaaggtactgtagcccatgtgttaatatcctagtaccttgcaaaacaatcaagtactaagtaataaattatcattttgcaaaacatttcctgatgtaaaatttgagttgtatggattttgttgtatttaaacttgcgtattttttgtcttcatttactatattatgtagggtttctgtccaacaagagtacttgtatatctttgctattggctctcatgtgatggcaggtaggtgggggttatcagattaggccaaacagaaaacctcaactccagttgcgcacaggaaagtttgtcgctgcaggactgccccgtgtctgctgttgcaaagagaaatgttaatctgatgtccctc

SEQ ID NO: 12725 - DNA, 1165 bp, Homo sapiens
gggtcacagagttggcagcaaggctgtgaaattgatgtgggaatgggggtgattatgtgctttgtgttgacagaagttagtttttgggacatcccatgtgggtttttcccaggaacataaacattttagagaattagagctagaaactttcttctgggaaagccttagaagtcagttgtgcttggcagtgagatgggacaatgtgcattcttaacaggttaaatgtgccaaactctctcttcagtactattcttttttacgtttgcttaaggtcaagttcctgctcttttgttcaaagtcttgctttgtcacccatggtggagtgcagtggcgtgatcttggctcactgcaacctctgcctcctgcgttcaagcaattcttgtgtcttagcctccctattagctagctgggattataggcttgcgccaccttgcctggctatattcaaagtctgtctttactacactgtcccaaagtaatctacatttgggtttgggtctttacagggtgagaaggactggcagaaatacgagactgctcggcggctgaaaaaatgtgtggacaagatccggaaccagtatcgagaagactggaagtccaaagagatgaaagtccggcagagagctgtagccctgtacttcatcgacaaggtgagagcatcttcccatcggcattgtctagtgttgagcttaacaaagggagtttctgctctgccccaggccctgtgccacatactgtatatcacaactcaacatacatatatttgtatgtaaaactgaatcaaaagttgcacaaaacaatgcttagccttactgtgagcagtagattctgatctttttttaactctatttcattcctttagaaagttggttataacttataaaattgtttaaataaaccatgcaggtatcaccattatatagttttaaagaccacgctctagaggagatcaatttcttggtactcacgagaagaaaaaaaagttcatgtttttcccccagtcttgtattttaacataagttctgaattgtctcaaaattcacactagctttttgagtttgattgcccagagtagcagcactccctcatttgctgccttatttaattttttttttccttttctccatccctatttcagaggacagaatagaaagaaaaggagcat

SEQ ID NO: 12726 - DNA, 1452 bp, Homo sapiens
ttgctagtccgggctaaagtttccatctaggtcttttgtacctctttctgctcgttttgccttgtttggtgctagagatttggttagctcttaaaaggcaatatagtatagtggttaagaacatggagaaaaactgcttgggttcaaatttcaggtcacttaccagctagctgtgtgagaaaatcagtaaattacctaacgtctctgcctcagtttcatctgtacgtttttcacttgtacatctgcagaagcacctactttagagatcactgccaagattaaatgagttgatcacataaaacctttagaacatgcttggtgcactattaatttgcatcctcactagacagatgtgaaagagaagatggaacatctgaccctgggcctcagatatgggccattgctgagtcaccctaatcccccccttatttctcctttgtttgcaggtgcaagaagtggggtgtcccaattgagaagatttacaacaaaacccagcgggagaagtttgcctgggccattgacatggctgatgaagactatgagttttagccagtctcaagaggcagagttctgtgaagaggaacagtgtggtttgggaaagatggataaactgagcctcacttgccctcgtgcctgggggagagaggcagcaagtcttaacaaaccaacatctttgcgaaaagataaacctggagatattataagggagagctgagccagttgtcctatggacaacttatttaaaaatatttcagatatcaaaattctagctgtatgatttgttttgaattttgtttttattttcaagagggcaagtggatgggaatttgtcagcgttctaccaggcaaattcactgtttcactgaaatgtttggattctcttagctactgtatgcaaagtccgattatattggtgcgtttttacagttagggttttgcaataacttctatattttaatagaaataaattcctaaactcccttccctctctcccatttcaggaatttaaaattaagtagaacaaaaaacccagcgcacctgttagagtcgtcactctctattgtcatggggatcaattttcattaaacttgaagcagtcgtggctttggcagtgttttggttcagacacctgttcacagaaaaagcatgatgggaaaatatttcctgacttgagtgttcctttttaaatgtgaatttttatttctttttaattattttaaaatatttaaacctttttcttgatcttaaagatcgtgtagattggggttggggagggatgaagggcgagtgaatctaaggataatgaaataatcagtgactgaaaccattttcccatcatcctttgttctgagcattcgctgtaccctttaagatatccatctttttctttttaaccctaatctttcacttgaaagattttattgtataaaaagtttcacaggtcaataaact

SEQ ID NO: 12727 - DNA, 1149 bp, Homo sapiens
gaccccaggcagggaagcccaagcacatgtgtgtgtgcacatgaagccccaggttggcagtggcagggagagcctttctgctctgactggtgcttctcacctctgcagtgtgcagtcaaagccctctttgactacaaggcccagagggaggacgagctgaccttcatcaagagcgccatcatccagaatgtggagaagcaagagggaggctggtaagccagtggtgtggtaggcccagagtccaagggccccagtggagctggggccccaaagacatgcatttgtgatgtgcttgtctcctgtgtgcaccagcagtgcctgcctcaccctggcttaggcatgggaacccctaccaaaggataccctcctcatgggagttcggggtggttgctggaggtcagcaccctgtggctcccacaggtggcgaggggactacggagggaagaagcagctgtggttcccatcaaactacgtggaagagatggtcaaccccgtggccctggagccggagagggaggtaagaccagaaccacctgagtaacagcattccctattcccagattctccttggcatgcccccatcacacagtcccaagcacgcacgtgcatgcacagacacctgtcacatgggctggtcgcacagcccatgtggccatgcacgtagtctcccatatacctgtgctacatttggcagtcacaggtacacccacaagatgtatttgtcccatgcacacggatatcccctcacacacatatgcagtagccatgctgaccattggtgggctttgcttcccacagcacttggacgagaacagccccctaggggacttgctgcggggggtcttggatgtgccggcttgtcagattggtgagctcccatctgtttctcttgcccactgttccctagggtgagattcttctttgtatctctttcctgctcctagggaggaagctgatggctgaaccccaaagtctgccctcactccaagctctccccatgctctggacatccccttgacaccctgggctccctttgtcactgtcagctttgacccctgcatgtttacctatgccaggcactggggaacccgtcagaatcagcagaacaaagttgatgctgctggttggctgacatccccaggcctaatg

SEQ ID NO: 12728 - DNA, 1183 bp, Homo sapiens
aggctgcctcagccagtggcacaggagactccaaggagctactgacattcctaagagtggaggaggaggaggagccttgctgggccagggaaacaaagtttacattgtcctgtagctttaaaaccacagctgggcagggtgagaagctagatgcccctgcagtttggccctggagccagggcagaggaatgtagggcctgcatggagaagggttctgccctgcctgaggaggaggacacagcacaagggcacattgcccatggctgggaacatgacccagcctgaaagatacaggggatcatgttaaaaatagcagtattatttttcgtctcaatggtattgtaactaagttatttactcctcctgctcctcacccctgtagggaaaccttggagaggagagtggcaggtgggctgcctgctgtgttaagaggacttagtttgtgatgtaaggcactgtcaggaatggggggcgggccagggtgggaagagaagaaatagcagagcctattttggtgaggttttttgtttttaagtcaaagaagactcagtatgctttccctgaggaatgaaaaagggattgaggagttgcctgactcctgggtgggtggggtacaggcagttaggtgctgaatgaagctgccatccttgctgcagcttctaactggtaaaaagatccagggatggagatgggaaggttagaaaggcagccctcacctctgaggacagaggccggggtccaggcccgtgggcgcaaaggtgcctcatagcatagccagcattcagcacacacaaacctactgcccacatttgggctcagggttggccatttgctagttctgctgccctcttaagatctgactgccaaataaatcatcctcatgtcctttttcctttgacttgtatgctctttcgggggctcaggaaagcctgttgcatgggacatgctcactagaaacagtcgccagatgattattctgcagtagaagcaggtaggaaatttctggaaatttctcaggttaagcagcaagagctgtaacccctcctctgggctaacaggagttgtgggtccactctctcctgcccaccctctgagggtgtgtctgagcagagtacatcctgcctgggttctttgtggccagccagttttggtggtgagctggaaacaaccagagcccctttcc

SEQ ID NO: 12729 - DNA, 3106 bp, Homo sapiens
aaaacagacactttagctgaggacaagcctggtccaggtccattttctgatcagtctgaacctgcaataactactagtagtcctgtggcttttaacccatttctcatcccaggagtatctcctggactcatttacccatccatgttcctctcccctggtatgggcatggctctgccagccatgcagcaggccagacactcggaaatagtaggtctggagagccagaagaggaagaagaagaagacaaagggggacaaccccaactcccacccagagcctgctcccagctgtgaaagggagcccagcggtgatgagaactgtgccgaacccagtgcccctttgcccgcagagagagaacatggggcacaggctggggagggggcactcaaagactccaacaacgacaccaattagaacttttttcatttaagaaattattgtgacttgtaagtttcttatcccataaaggtttgttacttccctcacttcacctccataagaacctgtgtttccataagtaagattacgtacctgatttcctgtctgagaactatggtaacagatgttaatagttgcagggtctcaccacttcattagataagtgttgtctacctagtctaggaggcacagaattctcattctgttatccagttcattccagcaatcatagttaatacagtacttggtgacacgccctacccccttctcttccaagtttcccactcacttgaggaggaaaaatggcaaaagaaagctgtctagggttttaccattgaagggtggaagaacagagacaaagaggagctctttttctgtgagctgggttgcacaggaagaatgtcacagggaaccaaaaagcacagaaaaaggaagtgctggtgcatatttttgagttaaaatatttccctattttatcatgattactaagtgagtagtatagacagaagtatataactaatggttgaaaatacatatattcatttctttataaaaaacaaaaaccttaccggtagtaatataatttcccccttggtggtttttcagacacctgcagcaagaagaaatactgactgactaggcattattttctatacatccctctcaccagtgaaaagattcctcttgctgcgagaaagctttacccaccatgagttattgctgtcgacgggggtggggcaaggacccgcgctccgtagagctacacgctgcttcacaagcacacggctagcgctctgctctcacctggttcgcttacagatttctctagccattaatttgcctctctgtgtttaaagagcaccaggaccgaatggattttcacttcaggctttccttcaccaagaataaggttctttctggagcctgcaagaagacagttgcccaacactttgacacttgctagtaggtcctttgatcaagagtgtctgaggctgtcaaatgtgtgccaccctttataatacagctatgaaaagttacttctccattaatttctccattctgtttatatcttacagttggacccaaattccaaattatcagttaatcgaaactacattgcaagtcaacattattttctcttcttcctcagcttctccatgtttaggaactgagaaagaaactgcctaagcagcacttccccatgtcctttcaccttcatgttaacgtcccttctgatggtctcactcttcacaggtagttcacactctgagacttgaagtaagctcatggttcagtactctgggggcgcagggctgcgcaggacccttggaaatgttgcaagtgttactagtaccagtttcactttttgttgtcacaatttactgtattttttactttttctgttacagttttgctaatttatcagaaggtccaaaagtctgacataactatttcattttgcattatttatttatgatgcttttttcattgtcttttatacatttgggattataaattatgtaaatgttaaaatgagcatctcaaagaagtctgttaaatcatgactgaaaaaaatcaatcagatgtatcttcaaaaagtggagtcccagttttatgaatcagagatataaaccagaaattctataactgatcatagaagaagaatccagtaattgaacaaatcctatttaatgacatccttgtagcatagatggtctataatgctgaccacagatttcttagaaatgctgctctctctatttaactaacattttgttcagttttgcctccagtggaagcagaaagggttttttcagctgttaaatcctaaaaatcaatataatttatttatgtaagaaaaataactcaatcaatatatttttgaaccttttaagtactaattttctttttatcaagtagaaaaaaaaatgtatttgccctaaatccttaaaatacaaatgctataaaaattcctgtatcttgaaagccttactgcaaatgagtattatagacatccagcagagtctggttttctttgttgtcgttgtgttgttgttgttttgtatggaaaagctgctttccccgggttccacttataacctccggtaggtcacagggttcaatgtggatctgacttaaaaacccaccagcatgctcaatcccttgttatccttatggaatctgtatgttaactctctgggtgttcaggcttctatttgactgctgttgtgaccctgtttgcaaaatgaatatgacactctgtggattatttgctctgtaaggcacaagtgcttcttatgattattttgacgtttccaagagcaaaagccaaatttaaactctcttcagcaaacttgagccttttcatctaattccatgtcactcacggccataactttccttgaccattcttcaccccatgtcttacataataaattgtggtcttgatcctggatttaaaaacaaaagaaaaagtttaaaagtcacatttgtatttgaggaattcagtggcacttgggtgtctcctgctgcctggggcattgatgagtacatggtatgcccatcgcctttccgaggtgtctgatccgtgctgggcaccctactgagggcttgtcgaatattcatcatgagggttgacttggcctgtctcttgaccaactgaccagaa

SEQ ID NO: 12730 - DNA, 1109 bp, Homo sapiens
tggcatctatcaccataaaacttcctcctatacaggtagtttggtttttgcaagtggctaaaggttatttggtgctcagtctggtggctagattagatgatcatacagaacagcacaatttttagttaaaatcaaaggcctacctttgaatgatcctgatttagtatgctaacaacacgttggcacagctccacaagtgtaaaggccgtgtatgtcctgtttgccactctgtctccaaggcctagcacaataggaactaacagagagtgggaactcagtaaatatttgttgagcaaatccatgtattcaaactgggtaactctctttgtctgaagcatgaattggaagggtaatatgcttgtttctctttcttttacagttgtcaaatttaaaagttttgaatcactccccaatgtctgatgcctctgtcaattttgactacaaatctccatccccatttgactgcagcactgatcaagaagagaaaattgaagatgttgctagtcactgtctgcctcagaaggacctgtatactgctgaagaggaagctgctaccctttttcctaggaaaatgacatcccataatgggatggaggacagtggaggaggaggtactggagtgaagaagaaacggaagaaaaaggagccaggagaccaagagggtgcagcaaagggaagcaaggacagagagcccaagccaaagaggaaacgagaaccgaaagagccaaaggaacccagaaaggccaaggagccgaagaaggccaaggagcacaaggagccgaagcaaaaagatggggcaaagaaggcacggaagccccgggaggcctcgggcaccaaggaggccaaagagaagaggagctgcactgactctgcagccaggacgaagtccaggaaggccaggtacgttcctttctcccttctctgagcacttgcctatgccagtgcagaacgatttgcctttggcattagcccaagcccctaggcataaccctgctgcactcctgtgggcctaagcttcacatctcacctgtataggatggggagcaggggtaaccccttggtgctaatgcaaggggctgtccttggaggttgctgttttctcattgcat

SEQ ID NO: 12731 - DNA, 1147 bp, Homo sapiens
tgctcgttggtattctggtggcttcttgctcacacataagcacttgtctcctgggcccacgtctgttctgctgtatgggctggtgggttgcaccgggcaggcctgtttcctgcaggggccttttgagttggtctttttctttttctttcttttttttttttttgcagggggaagtaagaagggattgactcctttctgggtcaacttaccagtgtctctgttagcagctcagcagcttacaccacatggcagtgctggatgtcatcagattaggaatgactccatcttgaccaatttgtttggagatagggggccttgacatggtcggggcgaaaaacagcgaccacagacatgaagcataccttgggggcacaaacctccgtcctcactatcaaagcacctctacttcctccttccagaaaggaatacttagcaagatcattatggacatctgagagtatattatatggaaggagtgctctgcagccagagaacaatgttgtaaaacacaaagtgcccttctgaaaggcattttctgtgtggcttgtgagcaagtaagttttcccttcatgtggaaagggcgtaatgaggagaagagaaagggagaaaggaaattgaaattccatgtggcaggcatcacgccaggtgctttgacaaacattattttctgaaatcctcatgccaactctgagaagcagatatgatgcctgccattttatagatggaaaactgaggctcagagaagctgggtgaattgccccagataggcaatgatgactctgcagcaggtgccagtgtgtgccctgtccacatcctttgggccttaccactgcagtatgcaccagccgacttccaattgcatctctttctccaaagctagaaagtagtatccacccccagctctcatggcatggttggtgggagttggtgtataaatacctcagctccctcacccctcaggtgggagaactctggggtgtgtactctacactggatgtcagggtgccctggtggagttcagctctatttgctgacagcgataactggcttgagaacacacccttcactggcttctttctttctctttatcacttggcctctccttaaccagtgccccctaggattaccttccaaataaatgatttgt

SEQ ID NO: 12732 - DNA, 1154 bp, Homo sapiens
agtctgaccaatcttgtctttcaggattttatgcgacaagcaggtgaagtaacctatgcggatgcccacaaggaacgaacaaatgagggtgtaattgagtttcgctcctactctgacatgaagcgtgctttggacaaactggatggcacagaaataaatggcagaaatattaggcttattgaagataagccacgcacaagccataggcgatcttactctggaagcagatccaggtaacttgttgaaggacactgtgggaaggaaacaatatttgccaataaaaagggagtaattgagtgatgtcaattgttgcctacttgaattaaagccagcttttagtttgttttggctgtgcatcattgcgttcttttctggatgttttgaacagtgtatttaatttcgtagtaaagaaaaacattattctttggcttatctatttttgccagatggcacggatgtatttaagttggattgggattaagacttcattgtttttctcctaataggtctcgatctagaagacggtcacgaagtaggagtcgcaggagcagccgcagtagatctcgaagtatctcaaaaagtcgctcccggtaaataacgttgtgttgagtcactgtgaatattaccgtacttgtttatggagtatgtgtacattctcactaagtattgagaaaatcggtctttccttgtccagttccaggtcgcggagcaaaggtcgatcacgttctcgatcaaaaggcaggaaatctagatcaaagagcaaatctaagcccaagtctgatcggggctcccattcacattctcgaagcagatctaaggatgagtatgagaaatctcgaagcaggtctcggtcccgatcccctaaagaaaatggaaagggtgatataaagtcaaaatccagatcaaggagccagtcccgttccaattcgccgctacctgttccaccctcaaaggcccgttctgtgtcccctccaccaaaaagagctacttcaagatcccgttctagatctcgctcaaagtcaagatcaaggtccaggtcgagttccagagattaactcagaactccttgtttgcacattattatggaacactttcctacttaggcagttactcttccatgtttatacttggcctcttctgcaagaggaatctct

SEQ ID NO: 12733 - DNA, 1957 bp, Homo sapiens
taacttttgtaaagattaagctcatttagtgttgtttttttttttttttttttttttttttttttttttttagtatttcagcaggatctgctggcagggtttttttgttttatttgtttgcttatttttaaattaactgttttgagctttgaatacttaaggctttagagggagaacccaattttcaattatgttggctttttataaagcttgagttatgtaagatttaaataaaagtttgctaccaagatgattgccttattgaataggtcactattaaattcctttaaatgttgatatctgccatttgtggaaacaacgtaaattctacttaagtgtaaacaaggcaagcctcagaccagcaataaattactcagtttggataacattattttgtgcagttaatcaaatttgccaaagtctttatctgcccctttaacaagttgagtaaaaataaaaggtattttttagtcaatgtgttccatgattttgcttaaattaatacttttaagtaatggaacttttttcaaaggcaaatttaaactatttaagaaatagctcctaatacttgggatcttgtttagagaatccactttctggaagttctcagcataattagtgttgagagtggttcagttgtctttaatgtttgtcatgtggaaatggaagtagcctctttttgttctgaaattgagtttattcaaagtgtaaaagcacatactgcattttctgctgaaagatcattatgtttaacaggcacttaatctcagtaaagtcagttgccagttaagttccacccagtagtcagtcccctttgtagttagtgggattatttgataattggttagatcatacttgtaaattttaatgctttgtgtaattggtttgaaaaacagtgaaatgggtaaacgcaaaacttttgtactttattacgagtaaagtgtaatgagtactgtggaaaccaaatttgaatactgcaaatttgtaggagttactaggttagcaattagtccatacatccataagcctgatgagttgaaattgcagtttgagaagtgaattaaccttacatccctttgttcagataccttaaaagttactttatttaaaagcatttattaatcttagtctgaaatcaaaatatagattaattggctcagctttaatacctttctaggaggtgtcacaatgtagggtaccaagggttggattgtgatggggcatggtcgtacactgctcattgtgccacaggtgtgactggaaagcatgatattctagggttggtttgtagattcaaataatccagaaatatacctaataagattgagtgaaaaatttgagtcaaatatctagggcattcacagagtagctgtgagttcttggtaatgtgaaaaaggccttgtttttcagaaattcctgggtttcctgttaaaaaatcttaaagcccaaccttaggaatatagtgccccaaaaggcggatgcttcttccattatcttattttctttgatactttatttaattagatgtttataaagaaatgggtttatttttccagcataaacctcagaatttaaggaaagaaaatgatgtctgttgttatagttcattgttttgcctactcagcagaagtgatgactcttaaaaattggctttgaccaaagttctcttgttttcagggaaagaacataaaagctttttgaactacagcctttttaaaagagggatgggaggatattacagtaagaaattaggctttctaaaagtatgaaacatccttcaactgggctctcttgttaataggacatcatatggtaatagactggtttgactatattgttagctgccacagtaagcaggtcattgtataggtaaatgcctgcacccataattttctagtaatagccacgaccaatttattaacagtcagggcctatccttgcctgtagttctcagtca

SEQ ID NO: 12734 - DNA, 1236 bp, Homo sapiens
accaccatgctcagctaaatttttttgtatttctgtagtgacagggttttgccatattgcccaggctgatctccaactcctgggctcaagcgatccactcacctcagcctcccaaagtgttgtaggtgtgagccactgcacccagctgggaaaatcattttgatggctgaactgacaaaagggaattattgtctagaagaatgggaaagtgagtagactacggagatgtagttgattgctgagcgctcaagatcagagatcatgaaattaaaagaccagttgatagggttgtatgtttctccagctgttttcagccatgtgagtactggtgtaattggagatttggatttagccagtactggggtttagccaagtgagttttgttcctctttgcacataaattggcttatttaaggtttagtgtcagtgatcatgaacagtaaaatttcttggcaagagaatataaatgttgcagatttagacctgagacagtggagacttgacagaataaatgcttgctcttgctgtgctaaaaggaaccctcttgtggctttcagatttctgactacatgatgctgccctacacagccaccctatcaaagcggaatcgagagtgtctccaggagagtgatgagatcccaagggactttaccaccctcttcgacctgtccatcttccagctggataccacctccttccacagcgtcatcgagtcagtacctgtgggcctctgagccacactgcactccattctgagtgtttggtttggaaacatgaacctgggaacgggaattagggtcacagtaaatgtggcatgcagaacatgttctcagatctatgatgaggtcaacaaagaaactgggctgggcatgaggggttgatgtagaggaactgccagaggttattagcccctgcgtgttccagattctggaccaggcatttagcctgaccagcttgtttcattttgccccagacttctggttttagcacagagagtcccaagtcccaggaaaatggagtcccaagtccctcagtaaatggagatggtggtcacctcatttctctctgggtatctgggcaactggtaatgctattaactggcacttagaatgcaggaaaaggaatgataaatgggctgtgttctgggcactctcagtctagtgcggatgtgcaggtggaactacaagtttaaagatgaaaagatctgtaaagccgttagggaagccgtgggatggg

SEQ ID NO: 12735 - DNA, 1432 bp, Homo sapiens
tgacagagcgagactcgtctcaaaaaaaaaaaaaaaattctatagtgactgtgtcacttttgcagcaaaaaaagagtgttttgttgtttaatgtaagcaggcaaaattcaagcttaggatttcagatgctgagtggaaagaccaattaggttctgagcctctcctggaaggaagctggctgtgccggatgctcatttggcagtgttttactctccacgtctagcatggtgctggaggctggggccatagcagtgaacaagatgattgcggttcttgctgtgcctctcagagctctgtgtagtgggagacagaagtgtattggcagttaccgtggtctaagtgccatccatgaagggaacccagagatgagggttttgatgtggctgctcagcagtgaatgatgggatgggaggtcaggtaggttcccagcagtactcactctggtggcatgctaggacagacacccgaggccaatataagaagtctggtgtggtctttgcaccagtgctttcaactctgtttgttactcatcatggtgggtggtgggcagtggtcacaagccctgccatggtagggcaaaaggatcaaaatttgatccttgggttggattcagccctaaagccagatattatgtatatgtcctaattaataaagattcagaatctctaaagtccaaagcactgaagagtttacatttcaggctttatactgaaatactaaaattctgtgtcttattctctcatccaggaacatgacatcgatacaagtgaaacagcattccagaacaatttctgaagaccatgcctcttgaagctttttctgcctcctgattctctctttgtaaactattttcaaattgtttttcaactccttatcaaaattgtttatacactctttcctccatgagctctggaaggtatatgcatcttctgtaatactcagataggtataagatttttcacaaaatccttatgtaagatacattccatttttaaaaattaaatgtatggttgcatctgtctttttataccctatgaaacagtcttgatttttttttctcaaccccagttctggatttgagtcttttatcaaagacataattaactctcaagcttgttgtaaatactgtacagctttctggaccggttgaaaggatacaacagtggctggacacggtggctcactcatgtaatcccagcactttgggaggccgaggcgggcggatcatttgaggtcaggagttcaagaccagcctggccaacatggtgaaacctgtctctactaaaaatacaaaagttagccaggtgtggtggcatgtgcctgtaatcccagctacttgggaggctgagacaggagaatcacttgaatctgggaggcagaggttgcagtgagccgagatcacgccactacactcccgcctgggtgacagtga

SEQ ID NO: 12736 - DNA, 1137 bp, Homo sapiens
cagagtgctaggattacaggcgtgagccaccgcgtctggcgtgttttattttgtgtagagatggaagggggcgggagtggcctcgcgttgtgtctcacctcactatgttacccaggctggtctcgaactcctggcttccagggattctcccccacttggcctcccaaagtgtcgggattacaggtgtgagccaccttgcctggcgccatcctgattttttgttcaggaagagttattccaggagtgactgcctctagaccaccccaggtcctgggctacttctcccatgaggggctcagtggaggaacccctcctgtgtgaaggatggcagctccacagccctcagcccatttcctggccacttgctgtaactctcctctgccctagtgccccacttcccgctttgtctctgactcacccctgtcctggagcagagcccagcacgttgaagggcaaaaggtagggtatgttggaccacaatgtggttgccaccactaactggactctgctttttcagctgggattaggatatgaggacttgcaggtgtctggagttaggaaggttcagagcctggctctatgaacttggcaggtggcctcacccctctgagcctcaatttccgcatctgttaagggggataatgagaatgtgggtgaagttgatggccagcacatatggtaaagtatatcatctcacagaaatgccccagctgtctgagatgctgaccctatcaaacagcattggaggctgggtgtggtagctcatgcctgtaatcccagcactttgggaggccaagagttcaagaccagcttgaccaatatggtgaaactcctcgtctctaccaaaaatacaaaaattagccgggcgtggtggtaggcgcctgtaagcgcggctattcgggaggctgaggcaggagaattcacttgaacccaggaggcagaggttgctgtgagtcgagatcatgccactgcacttcagcctgggtgacaaagcgagactctatctcaaaataaacaaacaaacaaacaaacagcattggagcaccagggagtgtccatgcagacatcatttcatccttgaaagaatatttgctgaccttctgttagaagccaggcctttgtgctggatgctggaga

SEQ ID NO: 12737 - DNA, 1174 bp, Homo sapiens
ggcaggtgctaccacattcgagtatttagagcctcctgatggtgagggggttcccctcaggacctccttctcaggccctcccacccctgacccacaggtgtctgggagggagggggtgtggcaggagctgccatatgtcttactgcctgggctgctcagaaagcatgtcaccagatcctttcctgccccatttcctcatctccccctcttctgtgtaatctgaactcttcagggaataaaaatgctctcctagaaaaaagcaggggtccctgacgtacaaggaattaaagacttgtgatggtggccccttgtgttcggttggtagggagcggcttcccacaggggaccgagtttgccctctcgtgtagcaaagggaaaccgcccatgttccggcatgtgggcttgcagtgagtggtggctgcatggaacaggacacacctacccaaggtgtgcctagtcccaggccataggcccctgagcctagtacttaaccaggcccccagcccgaggtcccagaagttctcacagattggtttgttcttctgttcttttcccagaaccgcactgaccagcaatgccagtacaggtggctgagagttttgaatccagaccttgtcaaggggccatggaccaaagaggaagaccaaaaagtaactgctgggacagtgccttgcacacagtgggtcttcacccaccagtgtacctggggactgtgagattgccttgtgttggggttgggggtgtcaagctgagcattgggtgtgagttgtctaccagccagtctggacactcttatgctgccctggctccagccctgagattccaagtttcagagtgtctccaggcttcctcactcatggtctgagggctattgggctgattactcggcttctcttgttccacccatggaggggagcagtagcagtgcagcgttgtcatgagaattaagcaggtgatgcttgtagggggcttgcaggttctgtacatttgctctcagcaaatggcagctgctgctatccctgatttaatgatgattgcaccctgtgaccttcacagggcacagatgccttcttttgatcgccacagcagtcctgtgaggtgggcagaagttgttagtcccattttatagatggagagagcaaggctcagagaggttggggatgtccccaaccta

SEQ ID NO: 12738 - DNA, 1195 bp, Homo sapiens
gctggtgtgggaaagtctgtttcccacctttagtttggactccgtgtgtgttgttcctcctcatccctctgctcttttctacttagcttattgggttgagccctggagagggaagcaggactctggcgcctttgtttacccccacttgatctctactctagaaagggtctctggtattcttggcctagatttattccaggcaataaatgagagggatgcggtcagatcctcaggtaggccctgtgggctacacaaagtcatcctgggtggcatcccctgcagctcgctcagtgttgcctgaggggatgtggtaggtggcacctctcagggccatggcaaggctcaggtggatgtgaagggctatggtgggggcgagagaggggccggtgcaagtggctacccagagacttttctctaaggtcatcgagctggttaagaagtatggcacaaagcagtggacactgattgccaagcacctgaagggccggctggggaagcagtgccgtgaacgctggcacaaccacctcaaccctgaggtgaagaagtcttgctggaccgaggaggaggaccgcatcatctgcgaggcccacaaggtgctgggcaaccgctgggccgagatcgccaagatgttgccagggaggtaagctgtcttcttgggggttgggacaggttcccgggaggccaggcccgtgtttctgatggaggagggttcctgggtgggtattgtggtcctgtgctcttgttctgtaacacccagcctcggctccagggctcccagaggcatgcatagtcaggaggaagggtggttccccagggaaggccctgtcttctgtcagcttaaaagaacagatggtgataagggaggcctcagcaagaaatcgggaaccctggagtctagttctcatcctgttcccagctcactgtgtcttcttggttagcctcttctcttcgacttcagtttcttctaacacagaataggcttgagatgtgggatagatgggctttctttaagaagaaaatgatcaaaaatcaggtagtactataatctgctaaaaggtgttttttgtttttctttttcttaaaaggtttaataatgaaaaacatcagtctttgtcaccactctgttaaatgactctactaaaacagactcatctttttgagttctttatctctttaagtgatgtgccatttttca

SEQ ID NO: 12739 - DNA, 1183 bp, Homo sapiens
tgggttcaagcgattctccttcctcagactcccaagtagctgggattacaggcatgtgccaccatgcctggctaattttgtatttttagtagagacagggtttctctgtgttggtcaggctggtctcgaactcccgatctcaggtgatctgctcgcctaggccgcccagagtgctgggatcacaggtgtggtgagccaccgcactcggcaatttttttttttttttaattaaaaaaaattttgttttttacctgaacctgacagtagctggtgccattttataatttttgccatagcctgaatgattcagttgcttatttcacagagcttcgtggaaatgctctgtaaattattagggctagagacttgtgagacttcatcttggaactgaaagagaccttagagttcatctagtggaagattcatttacaggagcaggaacttggcttagggaggttagtgatgtgcctgatggcaccccacccacagagctggggttcaaaggccccctgctgccccctgcaggacagacaatgctgtgaagaatcactggaactctaccatcaaaaggaaggtggacacaggaggcttcttgagcgagtccaaagactgcaagcccccagtgtacttgctgctggagctcgaggacaaggacggcctccagagtgcccagcccacggaaggccaggtgagacagctgctcagcctttggcttggtttgatttcacattcatctgacaccatctcattgaacaccttgtccacagctattggtcagtttctgccacagagtctaaaagtgggctctgtgcttctggggccttgtgagacttctgcacataactggcacttgtctgcctgcagatgaaggatagcagagcaagctgattatataaaactgtgaattagttaaggagatcctcagcctccatctctccttgctggtggccaccttcttacctgttgctcattttaattttttaaaactgaaagcatgtttgcaataaaaaaatcagaggtggctgggtgcgttggttcacacctgtaatcccagcaagttgagaggctgaagcgggcggattgctcaagcccaggagttggaggccagttcaggcaacatggtgaaaccttgtctctatctttttaattaaaaaaaattaaaaaatgtattgagttgtaattt

SEQ ID NO: 12740 - DNA, 1231 bp, Homo sapiens
ataaagttatattcaatccagggaatttaagcctaattcaggatctttatctacagtttatattccatttttccctgtccatgatgcagtctaagaccagacattgcatttagttgtcctatccctttagtcagcctttcttagtgtcatgatgttgacattttggaagtatatggtatggctaattattctgtagaatgtttctctatttgggttcatcacagtttccttcttagattcaggttgtgtggtttagctggaaactactatatagtctatatctcagcgaaatgcaaatggtgtattcttgtgtcttacagggaagtcttctgaccaactggccctccgtccctcctaccataaaggaggaggaaaacagtgaggaggaacttgcagcagccaccacatcgaaggaacaggagcccatcggtacagatctggacgcagtgcgaacaccagagcccttggaggaattcccgaagcgtgaggaccaggaaggctccccaccagaaacgagcctgccttacaagtgggtggtggaggcagctaacctcctcatccctgctgtgggttctagcctctctgaagccctggacttgatcgagtcggtatgttggtcacaacacttcacagtgagcacagaacacccccagcaggaagtgcttctctctcaggcccacatccttttgctcattccatcgccctgctaacagttactgacttgatgctgaatgcctagccctgacccaagggctggggacaccagggttgtcagcatgcagtccctatccttggggagctcccggtgtgtgcagcaggagtttgtggtggcatctgacctctatgtatggcacagggcggggtgggaaggctgcccagaggaggtggcactgaactgagtcctaaaggttgactggcaggtgacagcacaggacagcgtggtatttgtggcatcacacatggttgggtctccctgaagaggagcccaggaaatgccaagtcttggtgctggtcttggagtggtgagtgggttctggttactcagggtggggcagccattgagcccgtgttgtggttactgtgttggctgtgtggttgtgtcctttgaggagggcttcttggtgtgacaccccggctcctggctgcatcggccaggcctgctgtgtagagcgggttttgggaggtgaaagaccagaggcctggtcactagggtggggagttcagtatgggg

SEQ ID NO: 12741 - DNA, 1099 bp, Homo sapiens
acacgcctgtagtcccagctactcaggaggctgaggcaggagaattgcttgaacccggaaggcggaggttgcagtgagccgaggttgcaccactgcactacagcctgggcgacagagcaagtctctgtctcaaaaaaaagtaaaaaataaaaaattagccgagaatggtggtacatgtctgtagtcccaactactcgggaggctgaggcgggaggatcacttgaacccaggagttcaagcctgcagtgagctgtgattgtgctactgtactccagcgtaggcaacagagtgaaaccctgtctctttaaagaaaagaagaatctatgaaaatatagatgtatagtcatagaaaactttgaggaaatgcatgaaatattaatgattggtcctgggctgtgggatcatacttgacacttaaatatttcccgtaatgaatgagtcctcttgtattaagagcatagtaattgcaattcctaacctccctccctggacaggaccctgatgcttggtgtgacctgagtaaatttgacctccctgaggaaccatctgcagaggacagtatcaacaacagcctagtgcagctgcaagcgtcacatcagcagcaagtcctgccaccccgccagccttccgccctggtgcccagtgtgaccgagtaccgcctggatggccacaccatctcagacctgagccggagcagccggggcgagctgatccccatctcccccagcactgaagtcgggggctctggcattggcacaccgccctctgtgctcaagcggcagaggaagaggcgtgtggctctgtcccctgtcactgagaatagcaccagtctgtccttcctggattcctgtaacagcctcacgcccaagagcacacctgttaagaccctgcccttctcgccctcccaggtgcgtggaccccactctggctgcttattgggtcggtacagacacctagtgttcagtgctggggcaagggtgagcaaaacgagacctggctctgccctcatgcagcttatgctctggtaggaagaccaggtaactaaaaaagactcagaaaatgtgataatcaggatgaaagagaaggcttatggtgctgc

SEQ ID NO: 12742 - DNA, 12392 bp, Homo sapiens
tcacaggtcagttcagagctagttttatttcttctgagaaggagccactctcccacagttggcttcctgtgccttaactgcgtcgtcagcactcgagtagagatggcaaaagctaggattagggtgacggaagcccagaggtctgtgtgaacctgcttggtgggctcctggcatcgatctgtcccagtccttgttctcgggtgtctgatgggtcaagaggggacctcagtatcagagcagacgttttgggggagaggctcaaggatctctccccatgatcccctgaggtctcagggatactcatgcaggtcatcattttgtcttgttccctctctcttctttggcagtttctgaacttctggaacaaacaggacacattggagctggagagcccctcgctgacatccaccccagtgtgcagccagaaggtggtggtcaccacaccactgcaccgggacaagacacccctgcaccagaaacatgctgcgtgagtgctgcagtgcccccaaccttcgccgtcctctccctcagcaacaccagaccatgggccttgggaccactggtggaacagtggggagggggcacccttggaataacactgaagactgttttaagaaagccctctcctttctggccaccacgatttatcatttttatcgatatagttttgggctccacctttgcttttcctcatttgtattttttaatttgatagtttccttttttgtgatcctcctgcctcagcctcctgagtagctgggactccaggtgcatgccaccatgctcagctaattaaaaaaatatttatttatttatttatttatttatttatttatttatttattttgagatggagtcttgctctgttgcccaggctggagtgcaatggcgcgatcttggctcactgcaagctccgcctcccaggttcatgccattctcctgcctcagcctcccgagtagctaggactacaggcatccgccaccgcgctcagctaattttttgtatttttagtagagacaggatttcaccgtattagccaggatggtgtcgatctcctgacctcgtgatcctcctgcctcagcctcccaaaatgctgggattacaggcgtgagccaccacacccggctaaaatttttttaagaggtgaggtcttgctactttatctgggctggtcttgaactggccttaaagtgatcttcctgccacagcctcccaaaacgctgggattacaggcgtgagctactgcacctggccctcatttgataattttctgtctcaggaatggagagtccaaattagcctgaaaaacataatctcttccgcttcctaaggtttcaggtgcaaattcgttgtgtttgagcagccttatgtgcagggcgaaagtgcccatccctctatcaagagtggagactgcattcctgtcctctgagcttacggagcatgacattttctgtctggaagcctgtacaggttgctcgccagcctgcttttacaatggaagtgcttttacaataagtttacttccttgggtcatcatgattctaaattccaggtagagagagttgcttaactattcctctgcttgatacatttgctggaggaggaaatcgctattttgtgattcagaaatcagctcaggaattttagccctgatagtgatacataatttcgggaaaagatttgtgaatcccttagtcagaaatcagtctccaaagtccggctcagtggctcacacttgtaatcccagcgcttgggaggccaaggtgggaggatcacttgagactaggggtttaagaccagtctgggcaatatagggagaccctgtctgtacacaaaaaaaaaaaaagttttttttttttttgagatggagtcttgctttatcacccaggctggagtgcagtggtgcaatctcggctcactgcaacctccgcctcccgggttcaagcagttctcctgcctcagcctcctgagtagctgggattacaggcacgcgccaccacacccagctaatttttgtatttttagtagaaacgaggtttcaccgtgttggtcaggctggtctcaaactcctgaccttgtgatccactcgcctcggcttcccaaagtgctgggattatatgtgtgagccactgctcccagccaaaaaaaatttttttaattagctgggcgtggccgtgtgtgcctgtagtcccagctactcgggaggctgaagtgggaggattgcttgagcccaggagtttgaagctgcagtgagctatgattggctactgcactccagcctaggtgacaaagcgtgactctctttctagttttttttttttttaaaaaaaaaagagaaaaaagaaatcagtctctaaagagttgatctaaagcataacttagataggtttcgtgagaaatgattgtccgttcaaaccagaatcttggacttcgcatctaagcccttaaacagagatgctgtcactacaaaaggcattgatacttctctctctccctttctttcttatccatgtggcctcatttgctgcctccttccaattccttttttccataggaagaagcatctccagtgctcttcattcctctttagatccatatttccatctggttccttctgaaggccatcctttaaccatgtagtgtgggcttgctggtgatgagttctaatttttatatttttttgctaatttttctatttttttgtagagatggggtttcgccatattggccaggctggtctcgaactcctgactcaaatggcctgcctcggcctcccaaagtgctgggattacaggcgtgagctgtaatccagctgttattcctttgtagagagtctctttagttatccctcaaatttgacaggctgtatggtggtgtggtatttctctatttttttcccccccggctttcatatcagactaaagattcaaaccttgagctgaggaagtgtttatttctttagtttttctttccctgtctgccccttctcctaccttaggaattccttcatatataggctggattggtctctgtgtctttttcgtcttcatacgcctcttcaccatcttaagccatttccttaatcttcggagaacatgatgggattgttttctgattcaccagtttggttgtctgtggtttccaacttgctgaattctctgatttacagagctgcattttttatctccaagcaatcttttgaattcccttttcaagtcagcctccctgcctccctgagttttctttttgagacagtcttgctctgtccccaaggttgaatacagtggtgtgatcatggcccactgcaacttctacctcccaggatcaagtgatcctcccacctcagccttctaactagctgagaacacaggtgtgcaccaccatgcttggctaatttttttgtttttttgagagacagggtctcactgtgttgcccaggctagtcttgaactctgggactcaagcaatccttccgcctcagcctcctaaagtgctggcattacaggggtgagccacaaggcccggcctctccctgagttttctaatgtgtgtatatacactcttttttttcttttttccgagacaaggtctctcttagtcacccgggttggagtgcagtggtgcaatcatggctcactgcagccttgaattctgggctcaagtggtcctcctaccatagcctctggagtagttgggactacaagcaccaccatggctggctgatttttttatttttagtagtgatggagtctgtgttacccagactgttctttaactcctggcctcaagtgatcctctcctgtcagcctaacactaatcccagagtgttaggattacaggcgtgaaccactgcctttggccatgtgtgtgctcttagtccttgttgatgccacgaattagagaggttctggaattttctcatgttcctcagaaactccatgtcccatggagatgcttgagtggctcagattcacctctgtgaattgtggtttgaactgtaagatgtgtacatttgacttgtgcttatctgtcttcactcttccttacagagggggatctctgtgtgtcccagatgggggataacaagggtttgggaagagactgtggatccctgcctaatctctaggtcctgaggaaggaagaaaagaatggtctgcatttgttctagttttttatctccccatggagtggctggccagctgcgggaagtggaggcggcgaggccccaggctgctgtttctaggagttggcctcatcacccaggtccctggctacctggggtgtttctctcatcctctgagtgccctggttatgccatgagagtcagccatggtggtatctccaggtgactaaggtcacataccagcacacaagggttcgtgtttgtggaacctggtagcttccttcagagctgacatttgcccacagccagcctggcccagccccataccaccagccctggcgctctggggcgtgaggtgccttttctgcccccctgctctagggcaggtggaaatcacccatggtgggtctacatctgatagaagcatcttatagttctgcttctggaccagaccatcctgggtttttctctgttctgctgaagggttccctccacgtgtccatcacctcggtgaactcttgggagacctgggaagatgctggcctcacctctcgcccctcctttccctcattgtgctgccaccatccttctcacacaggctctccagggagagctgggcaggatgggatcttcctgggttcccaccttgctccgtgccccctctcactgttcctgaagtgtggccacggactgccttgttttctggaaagtcccaagtctggaccatgactgagcagcattctcggctatctgccacctgtctggggctcctggcccctcttagactcccctctcccttctgtttcccccgagcccctgacttggacctgcagggtggggagagggatgggacgagaacctgtgctggggccaaaggtcgcactgggggaaggtggagccagggcagcagagtgcctggcgtcggcccctatcctgtcactagttcccccgttctggcccctggcaggtttgtaaccccagatcagaagtactccatggacaacactccccacacgccaaccccgttcaagaacgccctggagaagtacggacccctgaagcccctggtacgtggtgtggtcgctgccgtggatctctgcacagtgggatcccttcggttcatccaaccatgttcagtccacaggacccttccctctgaggtctcatttgattctttctcctgagaagatgcagagatcctgataatataaatggggaagctgaggctgctctttgtcacttcctccgactgctcctgagcacctgagtttgcaagcacgcgccggctggtgctagagacatggtggtatcccgtgacactcagcctcaggatgggggagactgatgtgaaatacaaataacttaaacactttcaggcaaagataagcactgggcctagttcagagaagtggcaaattgctactctggcctgtctctgaccaactcccagttctctacagagcacgggaaagcccctcggggacgtctttcctgcagtgtgcaggctgcccttctcccctgctcttcccagttgatgggatggttgtgttttctctatgaaaaaaggagttggcaccttgggctttctgaaacacacaggtgttttagaaatcagtggagggtgagagaaaggcatggttgtggaggcactggactgtgaacaaggtctgcagcgggtccccctgctgtctctctccactgcatggagcctcctatgaagcccaaggtggctgggggctgaggctcccttgggcctgccatggaactgattctgagtcaagcagactttccacggaccatgctacatgagccgaggtgaggcactagttagtgctcctttcctgttgcagtggagatttggctcctctgtactaaaatatctgcatgctctccaaacaggtgtgagggcaaatcacatgaccttggcagctgtaattaaagtttgtgggggcttttcggatgacttatgaggagtggctgtgattcgcacctttcactcttagtagcactcgccctcccctgttctctgttgcctgaagctggagaggtccttggaaccccgaggcctgagaaagggaaatgggtttgagagcccccattagtgtggaacaaagggttgagtgagcctgggctttgagctgtcggggtcctaattcagcagctgtgtgactgtgtgccaggctgttgatctctgagcttctgtttctacctgcttaaaatgacggttactgcacagggctgtgtgagggttacagtgcgtctctgggctgctcccagccatggcaggcccctgggaatcaaggtcatcagctgcttgtccaaggcagcagttagtggttgtgaatggtgcgtgtgagatctgcatcctggcgtcaggcctccttcctgccttacccaggacagcccagttgcagctgggttggtcccacagtcccacacacacacagcccgagtgtggtgcctcacgtgggctgccccgtgcctacccacagccacagaccccgcacctggaggaggacttgaaggaggtgctgcgttctgaggctggcatcgaactcatcatcgaggacgacatcaggcccgagaagcagaagaggaagcctggggtgagtagggtaggggtgggagagcctgggcagggggaattggagccgtggcatgggggaggcgtctggggacaggttgtagaaagtgaggcgctggggagaatgggggcgtagcatatcccctttgccccctttcgcacggtggttgttgaggaaactgacaagataaggacagtgtctctgggaccctcctctgctctgctttgaaggattcacttacttatccagcattgtgttcggaccctgctcaagttgggctgggctggatgtggtggatggagcagcaattacgacccagactggatctccccttagtgttcagggggcagagacagatgctagacagacacaccatgactgaattcacagggtaccaagggccgcagaaagggaggttccaaaggaatcttttgggtggaggcgaggcggtcgggatgagccagccaggccaggcagtgcctggctgagtgtcaagctgcatgagctgggggtgggggagtgggttcaggtgaggtggagtctgcaggggctcctgggcaggggggcagggaagggactgtcccaagcctccgttctatgccagcctccctcccactgcgtcgttagctttcatgacagtgcgcgatcccttcgagtctcctagtgctcctttttcccagactgctctcctcaagggagagctgggaacggtgggatgtacagggtgttaggtaaggaggggaggtgggcggtcagcctgggcgggacttgcccgagctggcaccccatgtgcacgtggagagaacttggcctctggcctccagggtcctccctggcctctccttggtggggatggttgtgagccatggcagcccctgctgagtgcactgttgggtagagtggggatgtgactctcagagccgctccctggtatcggagcaggccctggacctgcttctgtgaggtgcacggttaggaatggggcgttccttgattgtattaggcattgtagaggggcttgtcctgaggggtttgtgttcccatattactggcctgtgggtgctattttaggtgttactggggtgattctctgctgggcctgtttgaggggctgtgtctggtccattcggggtgagaacaggtcacttcgtggtggaggttcatgctgtgttcctgctcactgtcgcagcacctggcaggatagggtctaccttgggtacagagtctaatggggccatggggcctaactttcccagccaccccattcttctgacagcagattcccactagctgggccttgctccaagtctgcactgcagcagggcctggttttgtgaccatccatggccatgaccatccaggtgctgaccatggggaatccagacactcaccctaacccccttctatctgccaacccctagctgcggcggagccccatcaagaaagtccggaagtctctggctcttgacattgtggatgaggatgtgaagctgatgatgtccacactgcccaagtctctatccttggtaaggcttctgctccttggaactgttgagttttggagaggaccctcaaggtggagttagtgtagtgactctccaactgggcttctggaaccctgggctctgcagggaggggctatcagggagggtgggtccgggcacccactcatggcttcagtcagcagctctgcttgtctctcacagaaggttttgtttggcagagttgcgcggctaggacatgttttaaaaacatgcatctgggtctcctgcgctctcccagagagggtcagtgatgtgtctttttttttctttttttttttttgaattggaatttcgctcttgttgcccaggctggagtgcaatggtgccatctcggctcactgcaacctccgtctcccgagttcaagttgttctcctgcctcagcctcccaagtagctgggattacaggcatgcatcaccacgcccggctaattttgtatctttagtagagacggggtttctccatgttggtcaggctggtctcgaactccccacctcaggtgatctgcctgcctcggcctcccagagtgctgggattacaggcgtgagtcaccgtgcccagcctagtaatgtgtcttaaggtatagccaggcacttgggcacattagtcctgggatgggtgctatacagcccccaggccagtggacttgctgtgccgggtgctacagtgaggtcgacctcagaaagggggttgttgcctgtgcagagcctgggtccccagaagccagggtgtgctgctgatccctctctgctcacaatggggtgagttggcttgccctggctcagagtggggaggcggtgagaggcatggcggcgtcatgaacaaaggttaagggttgcctgatcttccaagtagactgctgccctcacggtccttgcagagaaaccttgtcctggctaggggtctctgacaggctggggacctgcagccaggttactgcaaagaaaaaaacatcaccgcagggagtgaagagcacagattgagtcaggtgggcctgggtttgagttatgacaccatcactgctctctgggatctttcaggttccctgagccccagttaaaagcctataaaaggggtgccaagcctaagtcaggagggcacagtgccaagcagagcagagagactggaagggcgtgggaggggctttgtgcaactccgctgtgcttggggttgaagctgcgtctttatgatgcttgtggatgtttctggtcccaggaaaactaggaacagccttggctcctcctgaggctttatgtgacaaagccaacgttattgagtatgttattactggataatgctcagtgatactccacatttattgattatgttattatggcctgggggctgcacggcacccatcccagggctgatgtgcccccacgtacttgactgtgcctccagacacaccactgaatcaggctctgaaacgcacacacgtttctttacttgattacttgattttttttttttaagtaagaaagttctttagaacaagattaagttctttgcttaatttttttttgagacggagtctggctctgtctcccaggctggaatgcagtggtgcaatctcggctcactgcaagctccacctcctcccaggttcgcaccattcttctgcctcagcctcccaagtagctgggacaacaggcgcccaccaccacacccagctaatttttgtgtttttagtagagacggggtttcaccctgttgaccaggatggtctcgatctcttgacctcgtgatccgcctgcctcggcctcccaaagtgctgggattacaggcgtgagccaccgctcctggccctttgcttaatcttttaagtataaagtaagcttaagctcatgtaaactccctatctgaaagcagaaactgaggcttggaaaagtgtgtatcctctttcaggtctcagcagccaggtggtggtgctggggtgggattgcgggtttttttcttccctctcacagcttctcgcaaaatggtgactccttgacttggttttggtttcagccgacaactgccccttcaaactcttccagcctcaccctgtcaggtatcaaagaagacaacagcttgctcaaccagggcttcttgcaggccaagcccgagaaggcagcagtggcccagaagccccgaagccacttcacgacacctgcccctgtgagtgctgtggccatctctgggggtcctgcagtgcccgccttcttagctcagggctgagtgctggccatccctgggggtcctgcagtgcccgccttcttagctcagggcctttgcataggctgttcctctgcctgggtgcttttcctgctacttcccgtggctgcatttgcttaacttactcttctgatttcagtctcaatgctgcttccttaggggtaagccttctctgaccctacattctgtagagatacccccattctgccattctctcttttgtggcctgggtttcacttgtaactaagtcattatccctgtatttggtttgcttagtacatgtctgtcctcaagcaggggctggcttcaggctgctgacccgtctcactgctccttctcacccgcctcctggctgtggcttctcctcgaggctggtgctgcacggggcgggcagtgcatggccatgtctccttgtccagcgtcctacttacagttgaggaagcccacagccaggaagtgacttgtccagggtcacagggaatgtggagagagaataagaaggctctggcttctaggggagggaggcttataactctacccttccctggccaggatcaccagggtctgttgggaacacatagtccctgcctggatggtaaccctcttgcctcctcccagatgtccagtgcctggaagacggtggcctgcggggggaccagggaccagcttttcatgcaggagaaagcccggcagctcctgggccgcctgaagcccagccacacatctcggaccctcatcttgtcctgaggtgttgagggtgtcacgagcccattctcatgtttacaggggttgtgggggcagagggggtctgtgaatctgagagtcattcaggtgacctcctgcagggagccttctgccaccagcccctccccagactctcaggtggaggcaacagggccatgtgctgccctgttgccgagcccagctgtgggcggctcctggtgctaacaacaaagttccacttccaggtctgcctggttccctccccaaggccacagggagctccgtcagcttctcccaagcccacgtcaggcctggcctcatctcagaccctgcttaggatgggggatgtggccaggggtgctcctgtgctcaccctctcttggtgcatttttttggaagaataaaattgcctctctctttgtgctggtctggactctgcctctctactgggccctgctcatggttccctggtgacctaggggcctcttctgggatatagggacctgaatgctcatcctcagaggccagccttatcggcacagcccaggcctgagcccttgaccctgtttccacagaggggcacaatgagatgagagcaatttctctcgtctctgcacccagtgggcatctctgcaaagctctgagtattaatagccatggggttgggcgggggtgggcagagactgggggcggaggaggacgatgggttggtgcagtagggccttgcctggcccttgccttgggtggctcacctgcccattaacaagcccctgcctcaagctgagcgtggcccccaggtcagaccagtaagcaaggaagaggggtgaaggcagctgggcagaaccctctagccccattggccaaggctgagcaggaggccaggatgggccagagcctctgcccttgtggccctaaatccctagggttgtggctacagagcacagtgcttggcaggtggttgggaagagtcactggggattgaagaggggaagatgccaagtctgagaatgtctaaatgaggaattgatgttttcagcagcaggcttcatgggacaggcacatgaacatccctgtgggcagaggttgagcagacttggggcaggtcctcacctggggcaagagatgcggccaactctagagggatggggactgagttaattagggtgccagagttcagatgtgtctggcctcagacacacc

SEQ ID NO: 12743 - DNA, 1215 bp, Homo sapiens
ctcagtcgctgcacgccagaactctgtctggctctccccgatcctgttctgagcaagctcgagtcttcgtggatgatgtgaccattgaggacctgtcaggctacatggagtattacttgtatattcccaagaaaatgtcccacatggcagaaatgatgtacacctgatagcaagaagctaattcatatgctttaaaccaatgaaggcttgtcaaagagatttagttaatggcagaccttgtggccactttgtgtgagaagacatctctttctgctcactgtgcttgcaataaaaacttttcttggcatctcagttaatcttcattctttcaacttactctcttgagttcttacatacacttcaaggcgagcagatcaaagaaaaatcccccttatttagaaatgttcctgggggatgaagaaaccataattacttgagactggcagcagtgggtatatggtaaaagcctttgtaaaacagtgcatttttcagatttgtttaaggtttgctagccaaggaaagtaaaatgtgattttgtaactgcactaaacatttgtcatgctgtagttgccagcccagaatattagaagttacaagactgatttaaaccgtctctgatttaatgcaagatatattgtgtctataaaggtttctcttgttattgttaagccagagatctaaggtttagattcaatttgaataaactagctggcctgccctctattgtttgagagagttattaaccatcactaaataagcccctgctggtgctattcatcctaagacatgttacatgcagtttcaagtaagcagcttggaatgggctgcttcagttggagggagggggtgtaatatttgaaacgagtgtgtgtcttcaccatctccagcattttaaatatatggcggttttttttttttttttttgttatcagttgtaatacaggtctcatacctcagtttcagatgttatagatggttacctctttgagctgccctgtcaccccagcaaccctaaaagagaattttgtacattctgtatcccacagatttggtcagccatttcaaaattccctccagtttggtaaaaaaaaaatctgtcttcggtttcagctggatgatgaatccttgtttttcaggtggctccaaaaagaatgttgcatgtgttcagaccatcctgagcagagccaccaaatttagtgacagtgtctagccatg

SEQ ID NO: 12744 - DNA, 1281 bp, Homo sapiens
ctccgtcagtaccagccacccaccgttgtattaaaaacgcccagcatggactgagttcttaccaggtgccaggtcccgtgctaagcatgtcatatgtattcacttaactaaccttacagagatgcaatggagtagaggctcttccatttaacaaaggagtaaacagactcagagaagccacatcacttgtaaatggtcccacggagatggaatttgcaggtctgtgattgtggaattctggagtgttagctccgcaaattcactacttcactcagccctcaccacaaacccccacccagtaaggtgctgccacccgcagtaaggatatgaaaaaactgaggctgggggtggtggacatgacttgtaagatgtttctagaaagctctgctgtgacaaccagtaactgttttttaaaagcccagtccaactctctgggctcggacctagttcgcggtgacatggccaaacctaccaagaaagtcgggatcgtcggtaaatacgggacccgctatggggcctccctctggaaaatggtgaagaaagttgaaatcagccagcaggccaagtacacttgctctttctgtggcaaaaccaagatgaagagatgagctgcggggatctggcactgtggttcccgcgtgaagacagtggctggcggtgcctggacatacaataccacctccgctatcacggtaaagtccgccatcagaagcctgaaggagttgaaagaccagtagacgctcctctactctttgagacatcactggcctgtaataaatgggttaatttacgtaacaacaacaacaacaaaaaagagcccagtccaaacccacagctgctaaaatttggccatggctacccaaaacccccacatttactattacccctatacccaccacattctcctaggatgggaagaggaagcaaagagttctttggtgaccatctccctggaagggtggaatggggtcatgggggctcttccatgagaggggccactatatgtagagaataatgtgtggccattatgagggggcccagtggtctcatgtgggcatggacatctagaggctgagagaaacgggctgcctggctgaactggtgaaggagccagtgtgggcgtgctaaggtaagccacattcccaggactttcggagtacaggctgctggctggagtgtttcccatgggccagtgttggcagagagcacctacaaggggtcctcttgggtcctgtcccctagagcctcctggaggggcagaggtgtggcagcagcaagaag

SEQ ID NO: 12745 - DNA, 1606 bp, Homo sapiens
atatagagaatggatttagagagatgagaccaggtgcagtccatatgagatgtgaaatagagaagtggaatcgtagggacggggagaaattgacaggtgagggctacttagcaattagaatttttttttttcaattttaatttttttttttgagacggagtcttgctctgtcgcccaggctggagtgcaatggtgcgatctccgctcactgcaggctccgcctcccgggttcacgccattctcccgcctcagcctccctagtagctgggactacaggcacccaccaccacgcctggctaattttttttgtatttttagtagagacagggtttcaccatgttagccaggatggtctcgatctcctgacctcgtgatccacctgccgcggcctcccaaagttctaggattactggcatgagccaccgtgcctggccagcaattagaattttaacactggcagttatgaataatatgaaggagaggtagatttctgagtgattctggtttaaccagctgggtggatggtggttccacgtattcaggtggcaaacaggaaaaacatgtgttcgaagaagaatggaggtaggtggtctcttaagaatggttaagaggcttgggagtcagactgcttgggtttgcatcccagctttgccgttttctggctatcaaacttgtcagctattatttgttgagtacgtactatttgatttatgaccacaggcagctgagcctcagtgttggtgcctagtgtacaagattgttaaagaataaagttattttgcaaagtgtaacccatttttagcactgacatagcactgacagtagctgctgatctcattatgggctaaaataagacaatattcaaaggtcagagatatctagccagaatctgatggaggctggatttcagattttgttacagaattagacagaggaacacagaggggacaggctcagttagggtggaggtgtggggtagggaagcaggacttgatataaattattggaatcattgtcttttaaaccagtggtttatgtcagggtatagcgtttcaagggatttgagggtcagatggggaaatgtagccccttattttgccagtgtgaagcagataccctgcttttctttacagtagcggagtcagcttaagagctttaaaggtcctaaacttcaaaaacattacagtgccccatcctccgccttaatgtaattcaaaatacaaacaatactaaactgtaaaataaatgtaacaaagtccaataaagtttttatttttttctcatgatgataactgatattaatttgaagtaacaaatgctctttaaaagtcgggaggcagtgtccctgctttgcttggtcctaccttaagaagtagtgaagtctgcctcttagtaggaaaaccagtagtctaatcaagactcaagtgaattatacatgtgaatgctgaattatatacaagcatgagtaagacagcattctgaataaggccaggatcatcatttaaagcaggggagtattttgagtcatcagatctcagggtggcctttcattccagatgagtacctttatgtttcatcactatgaaagggcttgcctagccttggg

SEQ ID NO: 12746 - DNA, 1488 bp, Homo sapiens
ataagaactaaaaatagcagcttcctctggtccccttcaaccctactggggggtagtgccagccaagtttcactggagaatttcttggccttggctggggggctgcaggaggctgatagaagtcaggtagaccaggcttttctacctgactctctcttgttttcttagccctgatgcaaagtttcagagcatgaccagcaagtggccagctgtgtgggtcaagatcagctccagctgggtctgcctcctgctttacgtctggacccttgtggctccacttgtcctcaccagtcgggacttcagctgaacctctgagtgccaaggacaccactggaactcacaaaggtctccttcaccgaaaacccatataccttttaagtttgtttcaactaaaatattaagtgaatgctttgcaagtttgactgtatgcaggtttatatcagaaggtgagattgaataatgcttgatgcagaatcgaaacttctcatttatctgtatattatgtttacttctaaggatatagcacaaagggaacattttttgtttaaagtgaactacagctgtgctgtgaagagagttctttataaagcctgtaggttcttttaactttggtttaaaatgtaagataggaaaatgttggatatttgaggccatgcttaatatatttatattgcagtatcctttaaaagcaaaaaaaaaaaaatgcatttatattacagttttcctctatgaaagtccttacttatatgatacaagcactgtgttttgtgcttaaactcttcagcggggtagcatcaaagttcttggggaaggatcgtatatgtgggtcccttccctagaagaatggttgctgatatggctactgcttctacatcttgagttttttaatttactttttttacactgtagcattgagactgcttgattcaagtctggtgctttgccagatgtattaatttccataaatgctttgtgagtttggttaaaatgaagattcacttgggaaaacactgcagctttagtctgtgttactatcttgttatgagtatgtaaaagtaaaatgcatgtgaatttatcatatttgcactatgaaggtatttggttaaaatacaaagacttttaagattttaaggccctttcttccaacagcttttatagttagcagccattctttattttctggatagccaggttttatcacgcttctagtcaggatgctcctattccttctaaaaattacggtctgactagtgagcaaagtcttgaatttattcaaaagtcctaaataccttctctaggtaagacacttggtagatgagagacggaaggcattgtcaagaaccattttcatgagaggtggtgtgcaaaaaggtagaataaaagagttctttcaacaaagatttactgtctattctgtactagaccctgtaggttttggggtacagtgttaaacatgatagaggctctgccgtcttggactttaatagc

SEQ ID NO: 12747 - DNA, 2121 bp, Homo sapiens
ttagtctttttaaaaaaaacatcctatactaagggcagaacccactgccccggcctcaattaccttggctgaaggaaagatggcggtaggagagaaaagtgaagaggcgtgagtgtaagaactgggagattccttttccagcaggcctgggtagctgccttcccagcccagccctccctggggcctgcgggagcccttttgcatgcaagggaggatggaggctggcccctctttatagaagcacatttctgccacctcccctgggaggcacccagaagcctgccactctttacctagtccctgctgtgtagggcgtagtccaggttagctaggtagagttagtgctccaagccctggggcctgttcttagctcatgcatagtccttacagagtcccaggaccgggggtggagaggagcctcaagtacattccaggagaccactgtctcctcgctggcctgggcctagatggggcagcctggctcacaggaggccagcccctcctcctccgcccccttccttcccttgtccccgtagggttatagctggagctgcctgttatactcggctgttctgatttattattcttggtactgactttctttatgagggactcctaagggttgtaggaccttggcagagggggcctggtctccattagagggtgttgttttctcctgaggacacccaggctgcctttggtcccaccctgttcctggtcccggtcccggtcccagtcccaccaggcaactccttccacccggaaattcttcccttcccttagcctgtggaaaccctgggtattctttaaagttctggtcaatgtatatcacctccacagagctgcttaccctgcactgggaaggggagatggagacgccccctttacccaggaggtcttcagagtttcctgggaccgcggtgggtggaatcccaaggctgggggtggaaggagcagggctctggagggattcgcattcaaggcacagaattggccccttgcctgtttgtttttctaaccagtgtgatttctctgctgttcgtttattacttaccattggaatattttgagccaggagagcgccttctctctccagccatcaccgctgtggttgttcaggggtagcttttcaaaaacagggcagagcctggctgtcccaaccagggggagcaggggcttggccctgacagcctgagcccttcccctggtgtctgcacagcctttataaagagagagagagctccgaagcaataacaacacctgggggtggtcagtgagggccccctcaatgattttcttgtttgttctgtgaaatcccgctcacctcctggaggggtggagcagctgggggctggagccctgtttctttgtgtcatcgtgagcatgtgccccttcccaggggctgtgaccattgggtgtgggaactacggtctgtcctcaccaagggatgggggtttggggaggagagtgacattttcatcattagcttcggagaagcttcaagcccatcctgtccccgctactgcctggccccttgctgactcaggctgcactgtttgaagaggagcagagaggctggcactaggggccactggggggctggggtctccaggggatgactgttttcaatctctgggccaagatcacatgcaggataccatgggaaggagccatctccactctccttctccagaacccccttgaagggcctttgggaccattagtccatttccattttacagacaaggaaatcaagacccagcttgggggaaaagccacccctggagtcacctgtgtgttcagtggcacccccagcctgggtcccctcctcccaatagaggctgagccggagccagggcagtatgaggtggggctgccactgcccatacctcctcctcccttctttctttgaagcctaatggccccccaaaagatgggcaggacaagctgtagcccatctgagaggttgggaaactgaggcccagaaacaggaagtgactcacacaagacccctcagcaagggtgcaaagggggaagaactaggggctccattgttcttcaggcgacaggagaccgttgctccagtgcatgtctgctgggacaaggattcctggcctcgaa

SEQ ID NO: 12748 - DNA, 2589 bp, Homo sapiens
gttttaagttgttaaatttgttataaatgactgctgaagttttgacctttgcaatcatccctgtctgcagtgacacaggaataattttaaactgtcgagtgagataagattatacatactgggccacttacctagggaacttttagtagccctgctttgattatacttcctttctcttgcagctgtggacatcggaaaaccagggagacgaaggagacgctggggagggagagaactaatgtttctcgtgctttgtgatctgttcagtgtcactctgtaccctcaacatatatcccttgtgcgataaaaaaaaaaaaaaaaaaaaaaagagaatcgtacgtcgactttcgatttttcacagcctcagcctaggaaaaatggttcatgggataaacagctggtatttgtatctaaaactcagattggtcacataaatgccacggcattccgaagttttgattttgattaacattgacaggattactgtgtgtttaattttttaaaaactgaacactgtgattatggggttttgtaatttagcagaactcttactggtagaaaaaatagacctgaattatgtgtaactttttggaaggtttaatctgatatcaaaataatcattgaaatacaattccattgtaaagttgtacagaaagttatagagattatattgtgatgctggaacttggagtgagacacacatcatttggcatttgagttgaatggtaattcacagtaatgctgccgttgttcgggacttaaagacacttgacctgtttgggctgttgccacttaaaagttcatgaccacaaatgtccacagtgtcttcctctgaggaaactcgaatcctgaaatggaaattctttgtggcagataactggcttatgacaccttgaaaagttcaagtgctcatataacacaccacactgaaccccctttcctacagcaatatgttcactatgttaccaatttgcaacttgtgcttcaatagtggaatctactttcattgttaacactgagctaaagaaaaaaagccgtgtgttttatgaatgaccttatctgtttcctggataatacctttaagaataatgtcctgagtcaggcgtggtggtgcgtgcatctagtcccaactatttgggaggctgaggcaggaggatcgcttgagcccaggagtttaaagctgcagtgccctgtggttgcacctgtgaataactgcactccagcctgggcaacatagcgagacctcatctccaaaaaagaaaacaaaaaacaaaaaaaggaatgatgttctgtagagatggcctttcacttgaggagtactcagttttcaggttcttcctagctcggggcttttaaattttgaaatctaaacattctttcccaccatcctttttgactgttgaccttggttttctcttctaagtttctgtccctctgcttccttactttttttcctttttgaattctatctttatctgtcttttgttcactttttaatgctatatatgggcaggggtgagagacattactgagcaccttggtgagcaagcctggctttaaagattggagaagagcttctggcaccagaaccctgtcttcctccagttctcaacacggtgttgctcttcagtcataccggaatctgaatcaaaaaagtatttttaaatatccatgatttctccctgtattgaggctagccctgatcatgctttttgtgcctgtcaccaggtctcccaagtgcactcatccaggtcagtgctcagatgtgtttaaggagaccctatattcagggaagttgcgtgaacactgcagtggggagaattgagaatagtcaggcctatcagtctcacagaatcacccctctacctttgatattccacttagctgtagagtccatctgtttgtccatctgctgaaatgagaaaagaaaaatttatgcactgatttaaaacaaaccaaaaaaaaagaaaaaaacaaaaaaaaaaatccctcctttctagctgaacaaaaatgtgcagttaatacttggcgcttgaaaatgcagtagtgaatgtggaaccaagcctgtctgtatatctggtagctcttttcttgctttgttttttcttaccagtattctgcctaacgtttgcttctgtgatggttatattgcctagcaagcacacccgtggttgtgaaaatagtatagcaaaaaagaaaaatccccggttattgatgtactagatttgtgtatgtcttttaaacagttctagtttcaccttacacagaataatcaggaaaagtgtaaaaattcaaaagtgaaataaaaattttatcagttagttgcctgtgaattgatgtgtcaccaccatctctgttgttaccagacctagctaactattctgatcacacttatttttaactctgttttctttaaaaataggcaaacagttttatttcattatttaggaccagaagtcaaggtgttatccaggggaagaaattaccattaattaaacagcctctttacacccgttacttgatacctctctaccttccacaacaaaccatgcaggtattaggtcctctttagtgacttctaagatttgg

SEQ ID NO: 12749 - DNA, 1092 bp, Homo sapiens
ccatagaggctaagaagagacggcaacaaaacttctgagcaaggccaggctgtgagggccccagctccacccaggctttgggtgaattctggatggcttgcctcatgtttgttagccagcacttctgctctgtcgtctctccacagcacctttgtgaactcaggaatgtgcgccagtgggaagggctctcttgacagtcagcgtgccatcttgatgtgtgtatgtacattggtcaggtatattatctcaaaggatttatattggcgcttttaactcagagttttaaaccccaggaacagagactcctagttgagtgatagctgggaaagttttacattgtctgtttttcttctcccaatagctttcaattgttctttctggaagacttttaaaaaaatataaatatgcatatatatatataaattataaatagattccccacgcagtgtggtggcatctctgtacaggtacagttttaaacggtttgcctcttttctgtaagattatggtactgtggaacatgagggcagaggacaccgggaggctgttagggggtcactgaatcccaggagccaacctccccctttgcagggctgcatttaaaaattaggtttgggacagttcttgtaccgtggtttcagccttgtgtggtcatcactggcttctggagctattggtgatgtccaagggaaagctttgagagtttatgtttactctttgagtcccaggagaagcctggcaccctctttgcaaattggcctttgctctttcaatgcctttcatccatctccactctctcaactgcctaaagtcacagcacagatactgcccagtgccttaagaggagacatgatctctaccagggactctcagcaaacacgggactgtgttcagtccacaaaggaaaagcgtttttgaagctctcattgttcatgtaaaaatcatacacgtggcatgttgctccacattccttacacacaggggtagaggggattgcttttgtgacccacgttcaaatatgtgactgttttcttttctcttttactgctaagcagcctggaaaggataaatgaatattagactaagatttgt

SEQ ID NO: 12750 - DNA, 2821 bp, Homo sapiens
cactgcaacctccgcctcccgggttcaagcgattcttctgctgggattacagcatatgccaccatgcccagattatttttttgtatttgtagtagagacggggtttcaccatgtcagtcaggctggtcttgaactcctgacctcaggtgatccacccgcctcagcctcccacactgctgggattacaggcatgagccaccgctcctggcctctctttcttttttaaacaaagaactttgcacttggccagagaggaggagaaagcccattttctcccttcctaagctagatccaaataaaagaaagttcagttttcccccataactattcttgggtcatgaactttgatctggagtttgttttgtttcaggaatgtgtgcacccagcttgctgatccaacaaagtctattgcttaccagtctagcttgatgaagccttttggccagaagtcaatttgttttggatcagagaaatttcctgacaaggtatatttgttttctagtgacagaaaggcaaaggaacaagtcctagttgttgttgttgttgttgaatactaaatttaagatatgtcagcttgctttcaatgagccttgggcttctgttattgcttgagcatttggaactcgagcttccagagaaatttgaggtcctcgcttgttctctgccttcaagaaacaatgacctgattctgtctttaaaaaaaaaaatctcagaattctttttttgtttgtgtttttttttttttttgagacagagtctcactctgttgcccaggctggagtgcagtggcgccatctcggctcactgcaacctccgcctcccaggttcaagcaattctcctgcctcagcctcccaggtagctgccactacaggtgctgcaccaccacgcccggctaatttttgtatttttagtagagacagggtttcaccatattagccaggtgggtcttgaactcctgaccttgtgatccacccgcctcggcctcccaaagtgctgggattacaggcgtgagccaccttgcctggccaaaaatctcagaattctttaagactgttttaattgctccatcagtaattttgaagcactttcctttttttttttttttcccctttttgtccctttccccaagccaccaattggatggatgaatgtttgacggggaagaggaagggtaggaggatgcatggatgagtggatgagtggatcgatggatgtattgataaatagatagaaccagtcatctgaagcaacttaagaattgtagccttgactccttgagactgtagatttcgatccaggaaacatttatttagcacctgccagatgccagaaatttataccatttaaaactcagtaagtcttttaaatatcaggaaggagagaagcgacatcatgatacatcctatgggtattaaaaagccaatagaatattatgaataattttatgctaataaatttaacaacttcaacatcataaacaaattccttgaaaaataaaaagtaccaaaattcattcaagaagaaatagataccagcctgagcaacatggcaaaatcccatctctacaaaacatcaaaaaaaaaaaaaattagtcgggcatggtggtgcacacctgtaatcccagcttgtcaggaggctgaagtgggaggatcacctgagcccagggaggtcaaggatgcagtgagccatggtctcaccactgcactctagcctgggtgacagaatgagaccccgtctcaaaaaaaaagaagaagtagataatctgaatagccctatatctatagaaacttaatagtgctgggagatataggtattattatcctcattttacagatgtgaaaattgaggctcagagaagtaaagtctattgctcaaggtcatgtggctagaatatggcagagccatgattcagatccaggtcttctgattcttattccagtgtcctttctagcataccatgttgcctctaaagattgcagctccttatttactagaaaattgttcctgcccaatctacatctccacctcaccccatcttttcttaagcactatgtttgtgtttttatcagtattatattcattgtctttggaatacatgttcttgtttgtgtttggaaaaaaaatctcttttaccagcttgcactcggaccaacttggaaaaaaaaaagcttaaatgtttttgctatgtacagtttaaaaatgtgaagtttgtagctttaactttttgtaagaaaatctaataacactggcttaagtgctgacttgaaatgctattttgtaaggtttggatgtaagtaatcaattgaggtcagcagtttgtatgagacatagcttcctccattgcccccactccttttttcttttttaagtttgagatgcttcctgtgtttttatgttagaattgttgttctccttcttttcttcttcctatacctcatcacgtttgttttaaataaactgtcctttggaccacaaacccttattaacgagaacctcaatatatagcctggataatggtgttgtgaacaatctttgtgacattgactcagtggtgtgtttattctaagatccaaagctggggagaggttggtaaacttttgttgggcttctattatgtgccagggtactgagctagttatcaggaatataataaagatgaaccagatacagtttttgcagggcatttggggagttagccaagcacaaaaacacacaacattgaacataccatggtagaagaaggtacagggcctgtggatacacagaagagggagtgacggttctgctgggatgtccaaggaaactcttctagaggagaca

SEQ ID NO: 12751 - DNA, 1961 bp, Homo sapiens
actggcttggactttagcggggagggaagccaggggattttgaagggtggacattagggtagggtgaggtcaacctaatactgacttgtcagtatctccagctctgattacctttgaagtgttcagaagagacattgtcttctactgttctgccaggttcttcttgagctttgggcctcagttgccctggcagaaaaatggattcaacttggcctttctgaaggcaagactgggattggatcacttcttaaacttccagttaagaatctaggtccgccctcaagcccatactgaccatgcctcatccagagctcctctgaagccagggggctaacggatgttgtgtggagtcctggctggaggtcctcccccagtggccttcctcccttcctttcacagccggtctctctgccaggaaatgggggaaggaactagaaccacctgcaccttgagatgtttctgtaaatgggtacttgtgatcacactacgggaatctctgtggtatatacctggggccattctaggctctttcaagtgacttttggaaatcaaccttttttatttgggggggaggatggggaaaagagctgagagtttatgctgaaatggatttatagaatatttgtaaatctatttttagtgtttgttcgtttttttaactgttcattcctttgtgcagagtgtatatctctgcctgggcaagagtgtggaggtgccgaggtgtcttcattctctcgcacatttccacagcacctgctaagtttgtatttaatggtttttgtttttgtttttgtttgtttcttgaaaatgagagaagagccggagagatgatttttattaattttttttttttttttttttttttactatttatagctttagatagggcctcccttcccctcttctttctttgttctctttcattaaaccccttccccagttttttttttatactttaaaccccgctcctcatggccttggccctttctgaagctgcttcctcttataaaatagcttttgccgaaacatagtttttttttagcagatcccaaaatataatgaaggggatggtgggatatttgtgtctgtgttcttataatatattattattcttccttggttctagaaaaatagataaatatatttttttcaggaaatagtgtggtgtttccagtttgatgttgctgggtggttgagtgagtgaattttcatgtggctgggtgggtttttgcctttttctcttgccctgttcctggtgccttctgatggggctggaatagttgaggtggatggttctaccctttctgccttctgtttgggacccagctggtgttctttggtttgctttcttcaggctctagggctgtgctatccaatacagtaaccacatgcggctgtttaaagttaagccaattaaaatcacataagattaaaaattccttcctcagttgcactaaccacgtttctagaggcgtcactgtatgtagttcatggctactgtactgacagcgagagcatgtccatctgttggacagcactattctagagaactaaactggcttaacgagtcacagcctcagctgtgctgggacgacccttgtctccctgggtaggggggggggaatgggggagggctgatgaggccccagctggggcctgttgtctgggaccctccctctcctgagaggggaggcctggtggcttagcctgggcaggtcgtgtctcctcctgaccccagtggctgcggtgaggggaaccaccctcccttgctgcaccagtggccattagctcccgtcaccactgcaacccagggtcccagctggctgggtcctcttctgcccccagtgcccttccccttgggctgtgttggagtgagcacctcctctgtaggcacctctcacactgttgtctgttactgattttttttgataaaaagataataaaacctggtactttctaaa

SEQ ID NO: 12752 - DNA, 1532 bp, Homo sapiens
gttcttctaggcgtctggtatcataacccttgcttcacacttatctcgtcacttctgaccactatgctgccgtcctaattgtccctaccctcccaaataacctaaggccaggacaacccagtgacaactcactgctgtcctctccccacagtgccctgggcttgctgtacttcatccggcgaggaaagcagtgtctggatttcactgtcactgtccatttctttcacctcctgggctgctggttctacagctcccgtttcccctcggcgctgacctggtggctggtccaagccgtgtgcattgcactcatggctgtcatcggggagtacctgtgcatgcggacggagctcaaggagatacccctcaactcagcccctaaatccaatgtctagaatcaggccctttggacatcctgctgacacttgggccccttaacaccttgggctgctcagaccctccagatgaggtccagcccagatctgagaggaaccctggaaatgtgaagtctctgttggtttgggagagatagtgagggcctgtcaaagaaggcaggtagcagtcagcatgacagctgcaagaatgacctctgtctgttgaagccttggtatctgagaggtcaggaaggggacctctttgagggtaataacagaattggaaccatgccactcttgagccacaatacctgtcaccagcctgttgttttaagagagaaaaaaaatcaaggatatctgattggagcaaaccacttctttagtcatctgtcttacccccctgggacagctgttacctttgcagtgttgccgaatcacagcagttacctttgcagtgttgccgaatcacagcagttctgttggagaaacgcttggtttccggatccagagccacagaaagaaatgtaggtgtgaagtattaggctgctgtcagggagaggatggcagatggaggcatcaagcacaaggaaaatgcacaacctgtgccctgttatacacacgttcatgtgcacccaagaacctatgactttcttccagttccttctaccaggtccccatcctgctgccagctctcaacatagcaggccataggacccagagaagaatcccagcgttgctcaaagtctaaccatcataaagacactgcctgtcttctaggaatgaccaggcacccagctcccactggactccaattttttttcctgccttatttagaattctttggcgggaagggtatgatgggttcccagagacaagaagcccaaccttctggcctgggctgtgctgatagtgctgagggagataggaatttgctgctaagatttttctttggggtggagtttcctctgtgaggggcttgcagctatccttcctgtgtatacaaatacagtattttccatggttctgcctgcacttactttgtaatgccacggttgagattgagagagatcagcgcagccaggcaagggaactttaaagaattattaggccaccttctccctttcctggaccccagagtcattcctccatttggttaaaata

SEQ ID NO: 12753 - DNA, 1102 bp, Homo sapiens
tgaaagagggagcagaggtagccccaggacagtgagtggatttgtgtctctatccagtgtggataaatcttggaaggagctcagtaatgtcctctcagggatcttctgcgcctctctcaacttcatcgactccaccaacacagtcactcccactgcctccttcaaacccctgggtctggccaatggtgagataacccctacagccctttccttcttcctcttacctcctgcccaaacctttgcctccttttccctcagtttcctgcttcctcagcctgggctagatcctaagtcccctgtgtgtgcaggcccccaatactgtgccatctctgcatgccttttcccaaggagagaagggagtcctactcccagttgggactgtccagactgtggtgctagaggtggtgtggggagcaggagggtcattcccatctctggaatgtggatcccgaggggtcagagcccaaggcccaccccagacagacctctgtctccctcagacactgaccactactttctgcgctatgctgtgctgccgcgggaggtggtctgcaccgaaaacctcaccccctggaagaagctcttgccctgtagttccaaggtgaggccgcagagcctggcagccgggggcggggggtgtatagagaacctgcgccccatgccaagtgctccatacagggcttctcttatctctttccatctcctccaggcaggcctctctgtgctgctgaaggcagatcgcttgttccacaccagctaccactcccaggcagtgcatatccgccctgtttgcagagtaagtcatggggagtagaggaagctgccatccaggggctcagagaaggtacatgtaaagcatgtggtcagtgtctggctcaggctgagtgagtactgagtggtagatgtgatgacggttattcagggcattggccaagcaccaagaaaacagtggttgcctagcaagcactgaataaatatttgtcatggaaaatagtggttcagaacaatagctatgcgggtgcaattgctagctcagtcacttgccagctggcgtaaccttgggtgaatcatttcattcccctgagcttggtttcccaccctg

SEQ ID NO: 12754 - DNA, 1255 bp, Homo sapiens
agagattgagctatgccttctgttgaaaggttttgagcctaagagaacattggaaacactgtgttgcattgcccaatactgccggaatgaggatggggtgagatggggaggagcagccagtcctgtctcaccgctcttcccctgaccccaggttcccagtctctgatggctctaactactttgtgcggctctacacggagccgctgctggtgaacctgccgacaccggacttcagcatgccctacaacgtgatctgcctcacgtgcactgtggtggccgtgtgctatggctccttctacaatctcctcacccgaaccttccacatcgaggagccccgcacaggtggcctggccaagcggctggccaaccttatccggcgcgcccgaggtgtccccccactctgattcttgccctttccagcagctgcagctgccgtttctctctggggaggggagcccaagggctgtttctgccacttgctctcctcagagttggcttttgaaccaaagtgccctggaccaggtcagggcctacagctgtgttgtccagtacaggagccacgagccaaatgtggcatttgaatttgaattaacttagaaattcatttcctcacctgtagtggccacctctatattgaggtgctcaataagcaaaagtggtcggtggctgctgtattggacagcacagaaaaagatttccatcaccacagaaaggtcggctggcagcactggccaaggtgatggggtgtgctacacagtgtatgtcactgtgtagtggatggagtttactgtttgtggaataaaaacggctgtttccgtggttctttgcctcttgtccttgagtcctgggaagagctggggactggggattgtttgctgagtgcctgaacaggacctcctaccctatgcctgcaaccccctccacaaaaaacaaaaaaccctacctcctcccacctggccggaaatttcttctcctgatctgctccccctgtcctccccatccccatctgattgtgattcccagaactccccgggttgtttgggagtgtttctgaaagcataatccatggccatggaaatgaatcatcctacttcttgggggcattgagagtcagtccacatcagcaagggtagagtggagaggtgggagggctctgggtggtgggtctctaactgtagtgtgcatcagagtcactgggggcacttgtgaaaataatgtatgttcctggggtccagatcctactaattcagttggt

SEQ ID NO: 12755 - DNA, 1149 bp, Homo sapiens
ccaactgcatggataggctttgcagtcaagaagaccttggttcaaatgttagctctgacacttacctaaccttctcacctccctgagtcacagttatctcgcttataaaatgtagctaaataagatctaattgatcagataatcccattttaacctaaagaagaaggcatggcagaacttcctaatagtagaaggattcttggggagagaaatggccatgacccctcaggaaggccacagtggacatctgggaccacagtatacccaggtgcctgctagggatggtctgaccacagtatacccaggtacctgctagggatggtctgaaggagaagagtatgtctagaacctgtagaaaatgcaagcagagcccccagaaggtgaggctttgctgtgtgggtgtgtgggatggggtggggtcaaggagctggtctaggatttaagctgcaggtactcctgcctagtctaatggatattgttgttgatggtattgttataattttcttcctccagctccagccaccaccaggctgagcagtgaggagagaaagtttctgcctggccctgcatctggttccagcccacctgccctcccctttttcgggactctgtattccctcttgggctgaccacagcttctccctttcccaaccaataaagtaaccactttcagcacgttctgtctctgtctcccctgacttgggttgaggtgggtgggcaagtgttaagggtgtgaccagatcatccaggcatgaagtccagagaaggatcatctggtaggtgttagcattctcctggtggatccctgcatcaaccctatgaatctggtcattattcctccaggaggatggatgagaaaaacgaggctcagacaggtggtggggtgcttccaaagtcactcagattcattgctgggggtgctgataagcagcagcatgcaccaggtgccagacacggtgctgggaggtttgcttatgagatcctctgggtcctcaaaacaatccccagagcagttaacaacatacccctgtcatagacctggactccatgaggttacttgccagtggccacacagaaagatggcaatccaggatcctctcttgttgatactttaagtcaaagttttattttatataagtaatatagtca

SEQ ID NO: 12756 - DNA, 1134 bp, Homo sapiens
tgcccgcctcggcctcccaaagtgctgggattacaggcgtgagccatcgcacccggcctgttttaacattttcataaggtaaaaacctttcttagctcaaaggtctttaaaaaagcaggcaatccagctgggcatggtggctcacgcctgtaatcccagcattttgggaggctgaggtggacagatgacttgaggtcaggagttcaagaccagcctggccaacatagtgaaaccctgtctctactaaaaatacacaaattagccaggtgtggtggcgggggccctgtaatcccagctactcgggaggctgaggcaggagaatcgcttgaacctgggaggcagaggttgcagtaggccaagatcctgctgccactgcactccagcctgggagggtgagactccatctaaaaaaaataaaataaatggcaacccctggtctaagataagagataaaacatcaggtggtgaggttgaggtttggggcttggtagcagttgccccagtcatgagatgactcacttaacccgtctcctttaagtgagctgggctgggaggcttcctacaggggaagaggcccctctggggagctgactcagccaggctccctgaacttttttccttgtcccatcctggggtcaataaaactgaatgttgcatattctagcacttgtctagttttttttttgttccatagaaggcagtttagggtatatcatggagagaatagactttagagtgttatacaacatgtgaatcctggttggttccttccctgcttgatttttgtgcctggttctgccttttactagctatgagacttattaggataagttacccctctaaacctcaacctgattatctgtaaaaatggggatctccacagggtatgttcacagagcaggcatacctagtgggtgctcaattaagtattaattttccttccttgcctatggtcctatgacctgccttcaacatgctgggaaatttaaggcaagaggagaattcaaatacctaggacttaatataagaaattctggccaggcatggtggctcacacctgtaatcccagcactttgggaggccgaggcaggcggatcacctgaggtcgggagtttgagaccagcctgaccaaca

SEQ ID NO: 12757 - DNA, 1715 bp, Homo sapiens
ggaggaagactgtcacgtggcgccggagttcacgtgactcgtacacatgacttccagtccccgggcgcctcctggagagcaaggacgcgggggagcagaggtgagctggcaccggaggctggaggggatccccgagcccgggatcggtgcgcggcagaggaggctcgcgggtgggagctggcgctggggccggggcttccctcgcggaggcgccgccagcaactccccgggggctgctgcacggaagcgctgaggagcgagtcaacagcccctctgctgcctcccgtagatgatccgagccgcgccgccgccgctgttcctgctgctgctgctgctgctgctgctagtgtcctgggcgtcccgaggcgaggcagcccccgaccaggacgagatccagcgcctccccgggctggccaagcagccgtctttccgccagtactccggctacctcaaaggctccggctccaagcacctccactactggtctgccgccctgccttctgggcgggattgggagaagagatgacggatgagggatggggggtagttctgcagacccctgaggatgcctgggagccgggagggctggaaagggcccctccaactgcgccaaccctgccctgacccccctcccaggtttgtggagtcccagaaggatcccgagaacagccctgtggtgctttggctcaatgggggtcccggctgcagctcactagatgggctcctcacagagcatggccccttcctggtgagtggacagcagggggaaagcacagttcccaaagtaaaaggctggggaaagcgagagaggggctttgtgattttccaaaaagtttccttccttctaagcctcgggattttcctctatgccattggctttgctgcctgtacctctcagaggttttacccacatgtaaagtgcctctcatggtggccctttccctccacccagctggcccttgggacttactcagccatctctttcctcctcaggtccagccagatggtgtcaccctggagtacaacccctattcttggaatctggtatagctggagctgtgggtgtgtctgggcacttggatggggtggcatttagctaatttttccctcccctctagattgccaatgtgttatacctggagtccccagctggggtgggcttctcctactccgatgacaagttttatgcaactaatgacactgaggtgagtctggtgcctgcccatctgccccaggctccccggtcctccatccatggcatgatgctgggagagagagcatggccttggagtctacttttcgctctgtcatatgctattgtggtatggtggccagtcacttcctcttgcacaaatagggtgggttaatgtcattatctctgaagttctttccagttcaaataccaaagcttcctgattccctctgtcttgctctgccatccccaggtcgcccagagcaattttgaggcccttcaagatttcttccgcctctttccggagtacaagaacaacaaacttttcctgaccggggagagctatgctggcatctacatccccaccctggccgtgctggtcatgcaggatcccagcatgaaccttcaggtgcagggtagctgcaggagggaagggaggtagcttgaggctgtggccttacagttagcaaggtcagactgactggtcaatgtccccatccaacccagcttcctgcataacctc

SEQ ID NO: 12758 - DNA, 1173 bp, Homo sapiens
gctgagagataactgggccggaggcaaaggagcaggacccacccgtcctttccctctggctgccttttaggctgggtcatgggtcaccatctggcccctgtatgggcaagtttttttggagaggggtggggagggttctgggaagaataaagggtttgggatgaaggaattgcccccgagtgagcagttatatggggaggagggaatggtggggtcaggagctcacgaacattgctcctcagggcgccggccacatggttcccaccgacaagcccctcgctgccttcaccatgttctcccgcttcctgaacaagcagccatactgatgaccacagcaaccagctccacggcctgatgcagcccctcccagcctctcccgctaggagagtcctcttctaagcaaagtgcccctgcaggccgggttctgccgccaggactgcccccttcccagagccctgtacatcccagactgggcccagggtctcccatagacagcctgggggcaagttagcactttattcccgcagcagttcctgaatggggtggcctggccccttctctgcttaaagaatgccctttatgatgcactgattccatcccaggaacccaacagagctcaggacagcccacagggaggtggtggacggactgtaattgatagattgattatggaattaaattgggtacagcttcaaatcccgtcttctctgtggcactgggggttagagggggcactacaggctatgaatgtgggaaaagaggggctgagaggggttggggtcctgaatgacagctgccagcttggggattgagggctcagacagctgctgtggacggtgtgggggcagtggacgccctgacatcagcaggccggttcttctcaatcacctctcgcagccctttggcaaagtggagatcagccccgatggtgaggaatccctgtgttggggagaggggagcctcatttattcattcagttattgaggccagagtttagagatcaagagacagagtgtttgtctttcaggaactcaatctaatggataattccatgtcaaggtgttaaaatgaggctgtaggagtgtagactatgggtgtcaaggagggcttcttggaggaggtgacctctgagctaagacctgaacaattagtaggtattgggatgggagaaga

SEQ ID NO: 12759 - DNA, 1219 bp, Homo sapiens
ctggtcccctggaggtccaaactcatcacgcggcggtagcacgagggaactgggaacgtcccctcccccgtgtcccaaatcctctgggagccagaacgcaagtcgcatcgcctctctgagcctcagtttccacatctgccatatggaggcaagattattggttccaagttccccgaagagttatctggagggtaacgatccaggctagttcccacttatggttggacgtccaaggaatgggtttaagcggctcagataactcctgcgaccccaccccacccccaggcccgctcgccatggccctcttcggggccctcttcctagcgctgctggcaggcgcacatgcagagttcccaggctgcaagatccgcgtcacctccaaggcgctggagctgggtaaggcgcaggggcagacagggacggacgggagcggacggggttggggtcgccccaacagtgggcacgggagctaagtaagggtttctctgctgcttcagtgaagcaggaggggctgcgctttctggagcaagagctggagactatcaccattccggacctgcggggcaaagaaggccacttctactacaacatctctgagtaagtggggggcggggcctcgcgatccggggcggggcctcggcggtggaggcggggcccgagaaatctcagggtctcgggagactggaggctgagtgggatggggcgtggccaaatcgatgaggcaagacttaagaaaccggatggggccgaaaagataaaggccaagccagtcatcataggcgggaccaggcagatgggcgtggccttgaaaatgtagagggggccaagaaggaagcaggaccagtggatgtgaggcgtggtcgaagaacaacagaaaggtggagtcaaggaacttcccaatagatgagagtggagtctcgggcacggggtggagttaatcggaggggtggagaaactgaaggctctaagtatggtttaggatgagggagggggaataaggaattgagatgtgagacggagcttaggtgatggaggcaaagtgaacggactctattaaaagaccgggtgtagcaaccccagggtgtgggaggggagggggtgcaagcaaacaagactttttttttttttttttctgagagggagtcttgttctgttgcccaggctagagtgcagtggcgcgatcttggctcactgcaacctccgcatcccgagttcaagc

SEQ ID NO: 12760 - DNA, 1457 bp, Homo sapiens
cgctcccaggccggcatcgagtgtcatcaatttctaccacctgctctctcttctgcccaaggctgtgttgcttattccttacaaagtttatactgcatttggggctgtatctttttttgttttttgttttgtagaaaataaatatctccgggggcagtacaggtgtctgggcttgtatttgatggggtttctccggtccctgtttctactggatttggagccaggcccagctagccaagtttggaatggcatttgtcatgtcagtagccaccacctttgttcattgtgaacctaccaaggctttccagcttcatacacattgaccagagctcaagctcctgcctgcaactcctgcctagagttgaagaaaagcaaactggccttggcaggcacagtgtcatcataccctcaccccatatgtttggggtctgcttgaggattcataaatcagccactctggattgttgaggaatggccatggcagccacagaaaaaagaatttttctctctgagccaaggttgttttttgtttttttctcttttcttttttgttttcatttcattggaagatctccaatggactgaacagctccagtcagcagcagttaccacaaactgtgaatctgggccccaccactcttccctgttaaccagttctgtcagcatccccctctccagcagcacttccatgaagttggttctgagactctggccgtgaacacccgtttcttcagtgatttgttttgggcttttggctcaaaaccccaggctcttgtttttgtctagactcttattctgtttcctgagcagcaggaggtagggaccactttgatgtcagacttctggtagctggacatgttctcgagatgggtggctgttcgcgacttttgtaccagagtgaaattgttagaaggagggtttctggctgtggttctaaatggagccccaggaagctgccctctccccagggtttgtgctcagtagagccctgtggatcacagtcttgaggtcctctagcaggggtgagggagagcagcgacttcagctgagtccctgccagtggttaagcaaacaatggtttcaaaattcaaggtccccaaatggcagcattttatgttctgacctgtttgtgttatatagtggttttttttttcctctttggaactcttgtgttgttaataaaatgaaatgattactttttaattaaaatgaaaaaagtaaaagctttgttcatcttttttgggtgtgaatatgctctttgcaggatgctttccccaagtcagaggtgagggctcctgtctcgaggactctggtctgcccccttttgtcctcagcatatgatccggcctcaaacctctttgaaccctgccttctcttcataggtagctcacttagaggctttaataacagttcagagcaaaggcctgttggctaattatagtgctgtgttcaacatc

SEQ ID NO: 12761 - DNA, 1156 bp, Homo sapiens
aattttcgatcattatctttccatttattagttttaagaaacatgtaatgacaagtacttgccccactggagccaggctccctgggttgaaatactaactctgctgcttgtgtagcctttcaacaagttatttagcctctcagcctcggttttctcacctgtaaaatgggagacatagtagcagtatccatgtcatagggatgttgtgaccattagaggaggtatgtgtgtcacgtattatgttcaaatgtgtgcctggcacatagtgcccaataaatgttggatttcattaaattgcctattttttcattaaacatcattgtgcgccagcaccataaactttgtcctcagatgagaaagtgacactcagagagaagtaacttgcccaaggttacacggttactaagtggccggtccaggccctcagctccttatgcctctgactcagaagccctggctttttacttttacgcttcttgcctttcttttatcagtattttttaggtaccagtgggtaccaggacattgttaagtgctgggagatctgggtgggggatattcagtagccaacaagcggacacattgctgccctttcagagacttaagatttcatgaagttatttgtgtattcatatttctgttttcagcctcatgatctgtttcgttaagcagagattgtattatagctggcttgtttattgctgtatccccattgataacatctctcagtttctagaaaagtatactgagcctggttgactttcagtaaagattcattgagtttattggagctattgttccttgtatagtagcagaaactgaggcttagagaagttaatgtaattttaagattagattagacaactaataagaaaagcagctgggatttgaaccctgtcctctctgactacgaagatgaacctcgaagctagcacactgcttggcctcctgtttgtgtcctcatcagtagaaactgctctgactgggctgtgccttgctctttgtttttgttttttgagacagtgtctcactttgtcacccaggctggagtggtgcagtggcacaatctcagctcactgcaacttacgctccctgagttcaagctattctcctgcctcagcctcccgagtagctgggactacaggcgtgagccacc

SEQ ID NO: 12762 - DNA, 1202 bp, Homo sapiens
gattcctcctacttgcttctgtgccatgggtataatttgcaaatagaactgggttaatgtggtcaaggacaactgaggtggaaacactggcctggataaaagcactttgggccaggcatggtggtttatgcccgtcatcccattacttttggaggcagaggtgggtggatcacctgaggtcggggtttgagaccagcctggccaacatggtgaaactctgtctctactaaaaatagaaaacttagccaggtgtggtggcatactcctgtaatcttagctactcgggaggctgaggcaggagaatcacttcaacccaggaggcggaggttgcagggagccgagaccgcacccttgcactccagcctgggcaacaagagcgaaactccatctcaaaaaaaaaaaagtaatttgtatgtcaataagccccaagaaatcccttacttattcttttcacagatcttttctcaccttcatcctctgaaacttttgcattttttgcatagagaaaagagttgaaggttcaagaaccacatacacaagaggatacgtcatttgcaaaaatatccacagttgccacagaaagatactggcaaaaattctgactgacccaggttaagattcaggatgctgccggtggtggaggttttgtccgttttcgtcgtgataggagctgacagttgaggagagaagggctttgggctgccggataaactccctgcttgtcccgtcttggtggaggctggtgaagctgaaaaagtatggcattgttaaaagacaggtttacaaataaacaagtagaacgtgtaggtgtggtgtagggagagaatggagagattatgaaattgtgtttgatttcagcaaggccgctacagtatcacgaatggggtggggtggagcatagcaggttggccatttattttcagcaaagggctttaaccggatgtgaaaccgttaaagccacaaatgaagaaggtctccccagttactctattaagcacaaagctctaagacaaatcggctaagctgccactgaaattggtttggcccattcacggatataaatctcaacataaatagcgattaaaccaacccccacatggtccagatgtggagaacgggagccaggcttacaaatgcgtatcatctgtttgtggaaagacaccacggccagctcacacgcagccactgcacctgccagggac

SEQ ID NO: 12763 - DNA, 1579 bp, Homo sapiens
ctccaggctaactggaaggcagcactcccttttttatatagtagaaaaatgaagtttattataagtttttatattttctacttgttcatttggtgcaaactcaagatttcttttaataggtgcagtctttgagataatttgtttttacctgtattgccctttatcttttttaggtaattctttgtactcctgctgtctacctctcctcacaccccagcaccccccattttttcaaaccttggtatctgttgggtgaacagtataatcttttcatctgcttttagaatgtgggatatttccagtacctactttttttttttttttttgctgaatccaaagatatataaataaaatatatatattttataaagatcagaatgatataaaggagatacatgtttcttcctttaaaaaataaacggaagttacattgttaatgttcatattatgatgccacttttctaaactgcatctggattgaaaggtgtaaatatcaataacagtgctacttagttatcagtatttaatatctgaggtgagttgggggtatctatattaggggtagggtattacagaagataattggcttgatgtcctagaagttctttgatccagaggtgggtgcagctgaaagtaaacagaatggattgccagttacatgtatgcctgcccagttccctttttatttgcagaagctgtgagttttgttcacaattaggttcctaggagcaaaacctcaaggattgatttattgttttcaactccaaggcacactgttaataaacgagcagggtgttttctctcttcctttctaatatatggagtttcgaagaataaaatatgagagcaatatttaaattctcaggaattgacttatactcttgagaatgaattcagtttcaatcaagtttacattatgttgcttaaaaaaatagaaattattctttatcttgcaaagaattgaaaccacatgaaatgacttatgggggatggtgagctgtgactgctttgctgaccattttggatgtcattgtaaataaaggtttctatttaaaattggagcctaaagagttttttttttttttttttttttttaaatccctgttgggttaagggtaaaggaggttaaggaagcctatttcaaataatggtaacagtttctgagaagttaaaaaacgccactagggagttgctagggagccttggcctgtttggggcattgaaacaaatgtgggtgcttttagggattatctccgtcatctgttaaatgagaaatgggttggactggtgattgatagttgaaatctgtcaactacttgtatcaggttagactacctgatacacaaagaagggttggccaaggcgaatttctttgcaattgattaatacttttttaaaaaatgaagtaccaaagctggtatactatgagacttacctgtagtcccttgaagtatggtagactttttagtcaatctacaaccatctactccccttttaagaaaatcttctaaacccaaggcattttcttccaaaaagatgttgactggtagtatcttgaatactttaaaaaaacagacac

SEQ ID NO: 12764 - DNA, 1837 bp, Homo sapiens
gtgaactgccacttgcaacctctggtctactcatttcttcctttatatgcatataaacctgtgtggctttaataggacattagtaacaggtcacctaagcctttcttcggtgcttctagaattaaggtacagaatctttacatatcacaatctccttagccactattctgtccagatccttaaatgccatccttgccaggcattgggtgtataagtaaacaaaaaattgaggtgactaggtggtggcaatcccgttctaagtaacctagaaatattcattctcagcagccttgaagcaaagcttcctcagctataggaccgattaggaagtcatgataaagaccatgatagctaagtgctaagatgagtttgttttgttctttaggggacaactgtgggaaggctgggaaggttaagaaacaacagaggtggacctccaaaaacatagaggcatcacctgactgcacaggcaatgaaaaaccatgtgggtgatttccagcagacctgtggtattggccaggaggcctgagaaagcaagcacgcactctcagtcaacatgacagattctggaggataaccagcaggagcagagataacttcaggaagtccatttttgcccctgcttttgctttggattatacctcaccagctgcacaaaatgcattttttcgtatcaaaaagtcaccactaaccctcccccagaagctcacaaaggaaaacggagagagcgagcgagagagatttccttggaaatttctcccaagggcgaaagtcattggaatttttaaatcataggggaaaagcagtcctgttctaaatcctcttattcttttggtttgtcacaaagaaggaactaagaagcaggacagaggcaacgtggagaggctgaaaacagtgcagagacgtttgacaatgagtcagtagcacaaaagagatgacatttacctagcactataaaccctggttgcctctgaagaaactgccttcattgtatatatgtgactatttacatgtaatcaacatgggaacttttaggggaacctaataagaaatcccaattttcaggagtggtggtgtcaataaacgctctgtggccagtgtaaaagaaaatccctcgcagttgtggacatttctgttcctgtccagataccatttctcctagtatttctttgttatgtcccagaactgatgttttttttttaaggtactgaaaagaaatgaagttgatgtatgtcccaagttttgatgaaactgtatttgtaaaaaaaattttgtagtttaagtattgtcatacagtgttcaaaaccccagccaatgaccagcagttggtatgaagaacctttgacattttgtaaaaggccatttcttgggagttttttggtgtgtctgtttttttaaagtattcaagatactaccagtcaacatctttttggaagaaaatgccttgggtttagaagattttcttaaaaggggagtagatggttgtagattgactaaaaagtctaccatacttcaagggactacaggtaagtctcatagtataccagctttggtacttcattttttaaaaaagtattaatcaattgcaaagaaattcgccttggccaacccttctttgtgtatcaggtagtctaacctgatacaagtagttgacagatttcaactatcaatcaccagtccaacccatttctcatttaacagatgacggagataatccctaaaagcacccacatttgtttcaatgccccaaacaggccaaggctccctagcaactccctagtggcgttttttaacttctcagaaactgttaccattatttgaaataggcttccttaac

SEQ ID NO: 12765 - DNA, 1198 bp, Homo sapiens
cacctctacctagttccaaaacatttcatcaccccaaaagggaaccccgtacccacaaagcagtcactcctcactaccctctcccccagcccctggcaatcaccaatcttctttctgccgctatagatttacctattctgggtagttcctataaatagaatgtaacaatacgagcccgctttgtgtctggctggtttcactccgcctgcttttgacattcatccacgctctagcgtgaatcagaacctcgctcctggttctggtcgcatattccgttgtacagatgatgtaccgccatttgtttacccgcaagcagctctcgcttgaaatcctcttgagtcagtggcttcttggctccaggacttccgtcttgccggtgtgatcacctcgaggccctcccctgcggtccaggatctgcgagcaggcgggtagattccacgacccctcgagtcgcaggcaaagctgagcctcatgcttggaagcccggccctatcttgatgaaggacccactgccctgggagcctggccagcctttcctgcctccctaactctgccactcctctaatgcccacagagtacaaggccagctatgtccgcagtcgctccatccgctcagtggccatcgaggtggacggcagggtgtaccacgtaggcctgggtgatgccgcccagccccgaaacctcaccaagcggcactggccaggggcccctgaggaccaagatgacaaggatggtggggacttcagtggcactggaggccttcccgactactcagccgccaaccccattaaagtgacacatcggtgagtgtccaggtggaagtcgagggtgaaggggacaggacagacctcggcaaagggcttcccacacctcttgggcccctgaggaccaagatgacaaggatggtggggacttcagtggcactggaggccttcccgactattcagccgccaaccccattaaagtgacacatcggtgagtgtccaggtggaagtcgagggtgaaggggacaggacagacctcggcaagggcttcccacacctcttgggcacctgggctgctccccctccaccacctccgagccacacgtgatcccttctctcaagcaggtgctacatcctagagaacgacacagtccagtgtgacctggacctgtacaagtccctgcaggcctggaaagaccacaagctgcacatcg

SEQ ID NO: 12766 - DNA, 1192 bp, Homo sapiens
acagtaggccaggtatggtggctcacgcctgtaatcccaacactttggtcaggagttcaagaccagcccggccaacatggtgaaaccctgtctctactaaaaatacaaaaaattagccaggcatggtggcagacgcctgtaatcccagctgaggattactcgggaggctgaggcaggagaattgcttgaaacctgggaggcagaggttgcaatgagccaagatcgtaccattgcactccagcctgggtaacagagcaagactccatctcaaaaataaaaaataaaagacacactgtatcgcaaatgtgtttagtattttgataaccgtatttccaaacaattgattttctctgtaatcctatatcttgtattcaatgcacgtaataacattggagaagggatccattgctctgtgtgccagagggctccatggcagagcaggtgtgcatgctcaggcctcggacacacaatagtttaataaacatcgtcaggcactttctcacgtggcctcctgatccatctccctccgcagctttcttcgggaagtatcttaatgaatacaacggctcctacgtgccacccggctggaaggagtgggtcggactccttaaaaactcccgcttttataactacacgctgtgtcggaacggggtgaaagagaagcacggctccgactactccaaggtaagctgcaacctttccagcctgggagtggctgtgtggcccagcagttagaggcccaactcaggagccagactacttgggttcagattgtgactcaggcacttaaaagtgtgaccttgagcattttacatacacctcctcctcagtttttcatctctcagccagggacagtggctcacgcctgtaatcccagcactttgggaggctaaggcaggtgaatcacttgagtccaggagttcaagaccagcctgggcaacatgacgagaccctgtctgtacgaaaaaaatacaaaacttagccgggtgtggtggcacatgcctgtggacccagctactagagaggctgaaatgggaggattgcttaagcccgggagtttgaggctgcagtgagccaggatcttcccactgctcttcggcctaggtgacggagcaagactctgtctttaaaaaagaaaagaaaaatgtattcatttctcaaaaaatagtgtctgtttccaagagtttggttt

SEQ ID NO: 12767 - DNA, 1117 bp, Homo sapiens
acattgtctgccgcttaaaatctccattttttctttgcggtattgatcacagtacaataaaatagtcttgtttggagtttattaataataatcacaaatggggccaggcgtggtggctcatgcctgtaattccagcactttgggaggccaagacggacggatcacgaggtcaggagattgagaccatcctggctaacacagtgaaaccccgtctctactaaaaatacaaaaaattagccgggcgtggtggcaggtgcctgtagtcccagctactcgggaggctgaggcaggagaatggcttgaacccaggaggtggagcttgcagtaagccgagatcgtgccactgcactccagcctgggcgatagagtgagactctgtctcaaaaaaataataataataataaaaaataataatcacaaacccgttttggggttactgcagtaaacaaaacagacaacccctggccctcgtggagcctaccttcttgggtggttgtgggcttctcgttggccatgcatggcctctcggatgctgccacctaacaccctccccttcttgttccattccagggagactgccagactcgggaggaggcagtggcgctcggcgtgggtctgtgcaacaatggcttcatgcaccacggtaaccacccccacctgcagcccagcccccgggaccttgctccctggagctgatggtttgggggagtatgggaggactgaagccaggtctgtggctctctagacccccgggggtttggggaggctcacgaatcccacctccctccccttcccgttctgaaccgatcgagaaatggcttctggtgtccactggggaccaaaatggctggaaggacatgggctagatttgaagtccaacccatgggtttcctgtgcccttcttcctgggggggatgtggccttccagggtaggcagcaaggccagatgaggcaggcctggcccgaaggcctccgtgaggaaggaggagctgtgccctgtgggacagtgggcaggtgggttgtgaatgtgagaggcaggaagcccttcctgggatgtctgcctctttccccggcctcctccctcagataagtgacttttctttccattgggagagag

SEQ ID NO: 12768 - DNA, 1273 bp, Homo sapiens
actttacccctcaccagcagggtgaccttggggcaaatgacttgacctctgtgccttggtttccccagctatgaaacgggtaataataacacctcctctgggtttgatgcagcacttaggacagcgtccagcacgtggtaggagctcagtcatgtcagccaccgttattattacacacaaatgcacagacgtgcagacacagcaatgccaggctctgccatctggcagcagcagcgcgaaggtaacgatttatttctgtgtgctttgtctgtctgtgtttaccgaagggagtgatattagtgtgtgtgtgtgtgtgtgtgcatgaatctgcacagttccaagtcagctagctggggtgccgttttctgcatgcatatctccttgcataagtacagtgtatgcattattcatgcacatgcgcacactctcaccctctcacatattcctgggaataaatatgtgttggggttcccgggtggtgatagcagtcacctgagcagccagtaatgtttcagttgactggggagggtgggagctgatggggacagggtgggtagaggtaagcagatgttctggagaatctgggtggctgctgctggggatgttgggatatggcagggaaagtgttgagtgcactgagggctgggctgtgggacttgggtgcaacccacagcttgtggctgtggctgtggggaaaggtgctgggatttgactttcactgtctcggcattcagtgttggagtggatggaacagccaggcttcctctagggcgtgcctaacaggcccctgatcctttctctgcctcccttcaccttccctttcttctcttcagcatattgcaggctctaatttaggcaaaaactcctcagagtctaagaaaagctgaagcatgcagaatgagcacaacagaatttagctgtctcgagaggcagcctggaccattgaatttatcttttttttttccgcactcatgttgaagactttttttccctgttaaacttcttaaattaccttgcagccctccaccctcctttttccttggagcctggggagagtggagccttttgttcctctgtttcctctcttccgttcctactttcgggggaggctcgtggaacttgaggttgcttctgaaatagagaggtggttagactgggtcagccctagaatggatttgacaacttactcatcatattgttagctgacacttaccaagcacttaggatgcatccggctgtgtcctgagcattctgcattcattaactgacttat

SEQ ID NO: 12769 - DNA, 1174 bp, Homo sapiens
gttctgcccgccttggcctcccacagtgctgggattataggcgtgagccaccatgcccggccaaaagtccctcttgaagaggtttcacggggtcatttctggccctagcgttggtctggagcaaatcccactagtctctcagccttcagcactgtcgacatacggggctggaccattctttgctgtgggggtgctgtcctgtgcattgtaagatgtttagcagcatcgctggcctctacctaccagatgccagtaggacccctcttccccagttgtgacaaccacagatgtctccagatattccaggtatccactagaggtggttgggtgtgaaaaatagcccccagttgagaaccactgggctaaaagctcctttgactaccacctgtgctctcagatcgtgtgggggcattagcatgcctgtgtggaaatacgtgagattgatgtgtttatgtaagtagcataatacggtttgcccttttcacccagcagagtgtctgggaggctccctctcttgcggttcatggtttagagcacagactctcgagccaccttgcctgggttcagatcccagctcttcccctgtgtgaccttggggatgttgctttgcctctctgagtcctggtttccccatctgcaaaatggggatgaccccagcactcctagggttactctggggagtacagtgactgtgtgcgggctcacccctcctcccggaggaagtcccaaggaagaagcagagccctccagccttccagccctgtgtagatttttgagcttatttttattttcttggctccttgaggaccagaagggaatctgtctgctcttcttttgtcttgtggtcagacactcaatctgtgtttacccgcctgattccttccccaggatggaactgacagacgatcccttgattctgggccaggggaggcgagactatttcaggctggcgggactggggccactgaaagctggtgcaggcaggtggccattggccgtcaggacccagggtcttgtgcttccccccttgctgggagggtgggtggcttctgtgcatctctcaggaggagcgaggccggggtcagggtgtgggcagttgatgctttcatccactaatcgacttattcattcaataaatggccattcagcacccactgtgtgccaggcactgtgc

SEQ ID NO: 12770 - DNA, 1143 bp, Homo sapiens
acaacatttcgcttatagaaaacttgatgttttgtcctcatagcactgatcacagtccttaaaagccacttttagcccctgcagctacttttctgcagccactgaagcactttctcctcggctcttctccatcccttaaagcaaaattggcaaaccggtagcctcagggctaggcagcttgcaaaccagtcttatttaagccataatattttttaaatatatttttattgatacatatagctgtacatatttttgaggtgcattgataattggatgctttcatatagtcaaatcagggtagctgggatatccatcactttaaatatttattttttctttatattaggaacatttgaattattctttcctagctattttgaaatgtacagttggttaatgttaactgtagtcatcctactgatctaacgaacaccagatcttattttttctatttaacataattttaaaacaattgaaggtgtttgaattacaatcagaggtttcacttaaaatctggatttcgacctctggaaaaatcagaacaactagcacctgtgagctgagggactctaaagattccagtcagctggagctgaggagctgccgcaccccttcctgtactgggtggagagggggtcctgtcattctttgatcttacacccaccgtgttttttcttgacatttcccgtctggcctccatgggcctttgtagttggtgtaacttttgtgtttggtttgttttatgggttttttttgtttgttttttttttttttgagaaagtctcactatgtcacccaggctgaagtgcagtggcaccatctcggctcactgcaattactgcttcccgggttcaagcgattctcctgcctcagcctcctgagtagctggggttacaggtgtgtggtaccacgccctgctaattttcatatttttagtagagatggggtttcaccatgttggtcaggctggtctcaaactcctgacctcgtgatctgcctgcctcggcctcccaaaatgctgggattacaggcatgagccaccgcgcctggcctatagtggcatttcaaaacagattgttttagagctcacagcccagcaccaatgctagcgaagacctcattgctttagataggtttaggact

SEQ ID NO: 12771 - DNA, 1237 bp, Homo sapiens
agtcactgcacctggccaggcaattttttatctccattttatagctgaagaaactaaggctcagtgatttgcccaagatagcacagccagagtgggtgctcaatagttattgcagtggctgggctcagaggctcaggctcacatctataatcccagcactttgggaagccaaggcagacagattgctgagcccaggagttcaagaccagcctgggcaacgtggtgaaaccccatctctactaaaaatcaaaaaaattagccaggcatggtggcgcaagcatgtagtgttagctgcttcagaggcagaggtgggaggatcagcttgagcccgaggaggtcaaggctacagtgaaccttgatcacaccactgcactccagcctgggccgcagagcaagaccctgtctcaaaaaaaaaaaagtaattaaaaaaaacatgttaaaataattttaaaaatagcacaagaatgaatagttctcccctgaatgtgagatgttaatcaattgtttgatatgcctccccctctctaattcttctagtgtttgcagtgaagctcttgcctatttcatcactgtgaattctgagagccatcgggaggcctggacaagtctcttgttgttacttctaactaaaaccctcaaaataaatgatgaaaaggtatgaacaagtaaactctgaccaattttcactaggacataaagtttgggttggctttttactcaagagtttgcagtaactattttctcagttctcccaaggatggttacgtgactagcaccattctagatgcattggagagaagttaatccgttatggacaatgggtgccacaggatattagggctttttgcctggaagaacagtagttgagaacggctgaagtgtagacctcatgtgttgctgttaggaatggtatggtgagtttcagtgcaggaagagagggttaagattgtgaagcaccagttttgacctaggaacctgctttacaaaataaaagagctgttgacttttggcagcaagactatccaaatttaattaaagttaaatataactgaaagaagctttaatttgcaaggtttcttcaacttctttttttttttttgagacagagtcttggtctgtcacacaggctggaatgcagtgacgtaatctagctcactgcaatttctgcctcccaggctcaagcgatcctcccacctcagcctcctgagtagctgggaccacagacacgcgccactat

SEQ ID NO: 12772 - DNA, 1246 bp, Homo sapiens
ggccccaactttctaatagcaagaaaagcaccaatattgtaataagttccagggtgagattaacacttctgaaaaactggtgcccaaaaaaaaaaaaaattgtctaattttatctgtttctctcccacctcaagttcaaagcacatgcttcaatgtactacccctacttgtgtgaaattatgcagtttgacctgatccctgagctccgagcagttctgcggaagttcttcctacggataggtgttgtgtataagatatggataccagaagagccatcacaggtaccagcagcactgtcaccagtgtggtagccctggctgcccaggccagtgctgcagctctgcagaatgttcagcatgccatttctgactggcacatctcgtgaagtttcatagaaacaaggagttggcatcttggatctcagaatggcctggaaacggatggcctctacgctgttccatcacagtctccaactaaggcttatggtatttcattaaactgttgcatacccagttagcacagtaggtggggagtctgcttcatttctatcattccatttttctgattaaactgtcaaatctgtcattgcatatgccatcgttttctagcaaaatcccatgattggctataaacgttttgtaagaagtcactctccttgaaaatactgaacatagctgtataggtttgtgattattagagaatatgttaataaaacttcttgtaacggctaactgccacctaaaatatgctgggttttctgttgtttgagtgtgttagagaaatttgaatgtttttgtcagttacgagtcagccgtaattagattagtttaaggacaggtcaggattagagaagagttgtttttgtgttttgttaatgtctgagtgatttttaaagtattttacaaaaagatattgaaaatttggttgaaggcagagtttagtaattaagttagaattaagagttttgcgaggttaaaaaaatgtgcctcgtggatctccctgttttagtaacatggagagaaaaagtctacacgaaaaagtgaacaatttaatgaagatgattagccttccttgaaataagtatttgtggatgggtgttaaattaaaatttccagaatacactgtccatctcacacactctgaaatctaatatatgaagtagtaatgaaaatgaagtagtaatttaaccagagttcatttatccttgaataaacctttttattttcacctcagaaaagtgagtgta

SEQ ID NO: 12773 - DNA, 2554 bp, Homo sapiens
acagtccccattaaaggaccctccagagagggacagtaactgtgcatgagaagccgctcccataagcctcctcagccagatgtcatgggtggaactggagctgtgtcggggccagcacagctgaactgtgacaatggcaggaggtggcatgtgcccagcacttccattaatctgagcctaggagttgaattctttggcaaggttggattctgaggtccttattatgttaatgatggtgcaatactctcacctgcagtagaactgagttctgctgcagcttgtgtaaaagtgggcagtacacaagtacgtcccaaagcctgtgagcagtatacgtggatgctcacccatgagaaggagcacacacgcctcattctctgccctcacccactgctcacctagagcatcgctgagcgttagacaaagtgttacacagaatgattaaaactttcagacttctacctatgctctttagtcctgtaaattgggttgtattgatgtcaactctggtgccttagaagttagtagtttgggaacctatctgtaaaatcagatgttttttctttgtagagaaggatttctggtgcttttgcttactaagagaccgatattcttaagttgttttcttgttttaacagccttgagaaatgtttggttttggccagcagaattcttgtctacttttttctttcccaaaaagtgttttttaatttctctaccaaagaaaaaatgagcaggtttaggtttttacatgacttatatacattagataaaaggagctgtataatttagcaggaagggactatgggagaatactttactgtgagtggaaaatgttagcacatttgactggtttgccctggaatccactgcacctttacactgcaccatgaaacctacactccctggtatcatagcgcgtcatcacctcaacaagtcagtcgtctccattgatatttgtacaaaaggtatacatggggaacacgtgttcattcattaagtccatcttgcgtgcagctatatccctgattggttatttttcctttccttctgaggttctcatgtcattttcttcatcggatgtgactaaaatttttctggtgtcttctgccctctctttaattttgcctcttgaggggtagcagatgtgtcagtgcattttattacttgctgaaacattcaggcttacatttcttattagtttagtattttaaaagatttaattttctgaatgaggcatttgaattgtaccagcaatggacttttaaaaaattggatgtaaaaccattcagggtgatttttcttgtcagtggacagtgacgaacagagatttgaaatcccttacctccaataataagccattcagcctaaattcatttttatgaataaatctcttctttctcatggtaaatgtggcttgtgccactcaaacactagtgaaagggtatgtacaaccgcaacatcaggccaggacaccatttatttaaccaagtaatggaggagagtgaaacattttccaaggccttatttctttttcagaatgctttaagtgttgattatatgtgctgggtctctagagaagtttttatttgttacaatactgctgctttgagcaattttgtttctcttcattgtctgttagggaaatcaccagctttggcatcttaacaacaaacagtggatgggtaatttttatttctgatacgcatctttagagtcaaatatatcttttccctgtactcctcatgtacaaccaaagaacatacattatgaaaattgtattataatatctggaaacacaacattttcctctggcaggtgacttttgtacgaaatgaaaaaaaaaaaacctgtattttttttgttgttcttttgtgattaaggatatacatttagtagtctttgttattaaaggaacctgctgataagtacaagtgtgaccatctcattcaaatgtttgttgttatgatgcaaatggatattggtttcaatagaagctggatccttaatactgcattttctgaattctgttttaatatttgtgttaaagtagacatagctgaactcacatggaatcctggagttttgttatcagcagctttgcagtttgggaaacaaagaaaccaaagctgagtgttttaaagaatgaacatatctggaaatccttgctctcaaaacaaaacaatataatctatcaaaggtgttttactcagtgttctaatttttaaaaaattttatctgcatatttgcatcaaatatttatgtgtaaaatgtatgttttacctccttaaaatgcctaaaagttagttaatagttactttggtttaacctatacacaatgattaagtgcatttaatattggtaatttaatgaaaaccattccttgcccaatggatgtataaatttttgaaagaataagcagaattatataatatgaaatgctatgtaaagttttctatgtaaaaatattatgtataatactattaaaatatcccatgctttgatcaggtggtacatcaataaaattttaaaaagtatagctgtttctaatgtgtag

SEQ ID NO: 12774 - DNA, 1205 bp, Homo sapiens
catatggtttgtgggctgtaataagagtaccaaaacttacataccaggccaggcgcggtggctcacgcctggaatcccagcattttgggaggccaaggtgtgcggatcacttgaggccaggagttcgagacctgtctggccgtgtctccctctaaaatagaagctccaagaggggcaggaagttctcttccgtcttagaccctatgtgcacgaccttggatcgatcaacattgaacacctcctacgtgccaagccctgacatcaaaatgggtcagaagccagcagccgctcgctgaatctgtgttcctctttggaaaacgagaaccgtgaagcctgctggcatggtcagagccaaagagcattgtcacttgtgagatcagcgcagaaacagagcggggccccgattggcccttcgaacttgggtggggccagagcattcctggccccgccccctgcagcgggccgctcgctcatgcgctctggcctcaggctcgctgtcgcgccattttgccggggtttgaatgtgaggcggagcggcggcaggagcgggtagtgccagctacggtccgcggctggggttccctcctccgtttctgtatccccacgaggtgaggcgcggggcgtgcacggcctaccagagtggctcttggggcccagctgaggaagggatgaggcgctcccggtactaacgagcgctagggagtgagaaccgcgcctctgggcgagagcggaatgtgggcccggggttcgggtggtgcgctcaggcaaggtcttcggcttccctagggagcgcttgccgcgcctcgcggcatcctaggtctctggcccaggtgcggcgaccccagggcctgtgagggctgagggcaactgaggcgcggcctaacgcgagcctgcggattgcccgccctttcctctccatcacggcgctgattggctgcgccgccgcctctccgctcgggaaggccgctccttattggtcgcgctcgcatgtccattctctgcgacggtggctgctagccgcgcgagctgagtgtgcggcggcgaggcctgcccgggcggggactgcgggcgcgtggagctgcggctgcctcgcgtcgtcccttgccctaactctagtgaagcccccgaactcacccttctctaacctctgtacttgtatccctgactgtaaaacgggcatcgtgatctcactttgctgaattgtt

SEQ ID NO: 12775 - DNA, 1429 bp, Homo sapiens
gtaagtaccttattctacatcattaaccagtaaggactttttaattaaccacaataccactatcacacctaataatagtaattccttatggatcttttctttagacctatttttgaaggcataaaagcagttgagtttctggagaatttttggatggtgattaatgacttgactggctgctcttcccagagctgtggcagctctcccgtagaagatggggtttgtattggcgcaccaagatctccaacagccagtgtgtgtttcccatctcttgtaggttccatcaatggtgagcaccagcctgaatgcagaagcgctccagtatctccaagggtaccttcaggcagccagtgtgacactgctttaaactgcatttttctaatgggctaaacccagatggtttcctaggaaatcacaggcttctgagcacagctgcattaaaacaaaggaagttctccttttgaacttgtcacgaattccatcttgtaaaggatattaaatgttgctttaacctgaaccttgagcaaattagttggtttgtgtgatcatacagttatgtgggtggcttctagtttgcaacttcaagggacaagtattaatagttcagtgtatggcgttggtttgtgttgagcgtttgcacggtttggataatcttaaattttgacggacactgtggagactttctgttactaaatccttttgttttgaagctgttgctatttgtatttctcttgtcctttatattttttgtctgtttatttacgcttttattggaaatgtgaataagtaaagaattacttgtgttacttgccaagcagtgcacatttcatagtttcaaatctgtaatcagcaataaaaatcctaaaatatgtacctaagaacatcttaagggcaggttttcagtgctctctcatgcttttataaaaatgaagaatttctttaaatttcttccttttcctttcctggactctgtaaaatcctaatttctaaatcatgtaaactcagattatttagtctttttttttatatgggggaaggggacattaatatagatttggggcttatttactagaattttctgtagcagttcctaggtggcagtgtgagttttgggtaggtggctcctctgggagaaatgctctgcctcgcttaatgggatggcggtcgagagtacttgagactgtggatgttttgatctctttcatctctgctgttccctggagagtggaggttacttggaacttttcaaaccctgacaccttagaaccgtgaagtccagtccagtggtggatccggccggatgcctggtgagcttggttgcactggctccctcccttggcctggcccatggaattgtacagcattcgtttctgaggaatgaagaatcagaatatctaaattttgtgaggcacagtttatgctggaattg

SEQ ID NO: 12776 - DNA, 1133 bp, Homo sapiens
tatggcaagcatttaatgaacatttacagatggaggaagaaacaactgcaggaaggagagaaaggaaggccagaggcaggacaagaggaagaagcgacagcaaggaaggaaaaaggaagtggaggaggaaagaaggtaggctgggttctcccagacccgcttcgagtccagcaggcagcgcgaaactcccaccagaactacaactcccggcaggccccgggactcaggacgggccgctgcggtccaggcgggacagggcgctcctcccgctgggcccccggcgtgccttgcgagcgcaggctccgccgcagtgccagccggaacttgtggttcggaccgtgggtgggggtggggccggggccgggcctggaggcgggcgggggccgggggcgggcgcctgcccctcccccgtcacttcctgccgggctgcgggcgcctgagcggctcttcagcgtttgcgccggcggctgccgcgtctctctcggctcccgcttcctttgaccgcctcccccccccggcccggcggcgcccgcctcctccacggccactccgcctcttccctcccttcgtcccttcttcctctcccttttttccttcttccttcccctcctcgccgccaccgcccaggaccgccggccgggggacgagctcggagcagcagccaggtgaggcggccgggccgggccgggcctggtggggccctcgcgggcgccgccgcggtggggaggtgggcggcgggtggggcctaggcctcggcgggcccgcgcacccctccgccttctcccgggcctctctctagcccgcggggccttcccggaggaggcgggtcctcttgcgttccctcgcctcggggcgccctgaggcctggccccgggcgcccccatcccctccagccctcaccggtgccacaaacaggtgctgcggccgcctttcctcgtcccgcatggcgcgcgcggggatgccgaagttattcccggggctggggcgcaggcgggggggggggggggtccctgcttcaggtccccgagggctggagcctctcagtgtcgccggcccaggtctgtagcttagtggttaagagcacggcccaggtgtccaaaacgggtgccgaacccggctctgccccgttaggc

SEQ ID NO: 12777 - DNA, 1161 bp, Homo sapiens
aagtgctgggattacaggcgtgagccaccgcgcccggcctaaaatttttatatatataatatgtatatgtattttcagagaaggccaaaattttttctttttcaagttaattatgaagagtttgttctcttattcgatgtttcaatgaaaatttctttttcacctctttatttttatctgcagagggcagccactacattagatgagaagattgagaaagttcgaaagaaaaggaaaacagaggtgagaagaaaagtggctatttttcgttgttagggcccactctttactctcaccacgaccccagcatctctctggaagcccttatagagcggggcatggctggggcaggcgcactcttctgtgtgtttgctgtgaatctgtactgagaatccccacagccgttcattcaggccggagagcttcctatcgctctacttaggttctggatttctagaagtttctcatcaccctcactttaatttttttcccaggataaagaagccaagtctgggaagttggaaaaggagaaagaagcaaaggaaggctctgaaccaaaggagcaggaagaccttcaagagaatgatgaggaaggctcagaagatgaagcctcggagactgactactcatcagctgatgagaacatcctcaccaaagcaggtagacgttacggcggaggtgtcagtaatggggacaggagatcagaaggcatcctcctttactttgtagggtttcctccactcttctgcacagtttatctttaagctgttctgcctactacattgaactcctttctttcttttttttttttttttaagagatgttggctgggtgcagtggctcatgcctgtaatcccagtactttgggaggctgaggtgggtgtatcgcttgaagccaggagtttgagaccagcctgggcaacatggtaaaaccccatctctactgaaaatacaaaaataagcttggtgtagtggcatgcacctgtaatcccagccactcaggtggctgaggtacgagaatcacttgaaactgggaggcagaggttgcagtgagctgagattgtcccactgaacttaaccctgggccacagaatgagaccctgtctcaaaaaacaaaacaaaagagatgtggtctcactccatccacaggctggagtgcag

SEQ ID NO: 12778 - DNA, 1109 bp, Homo sapiens
ccacttctggctaatttttgtatttttagtagagatggggtttcaccgtgtttgccaggctggtcttgaactcctggcttcaagtgatctgtcctccttggtctcccaaagtgctgggattacgggcatgagccactacatccagccgcctgcttgcacttctcactataagctggttcctgcctccgggccttcatgtttgccatttcctctgtctagaatcttcccctggatcttcccatggatcatctgccttgtcattcaacctaatgtcacctcttcagagaggccagcccttagctgcttccccctcgtccctgcactctctctcacagcatttttcaccccccaggaattggcttctctgtatccaccctggaatttgagttccacaggacagggacagtgcctgtctatccagtgccaggcacagtgaccatactttgtggatgaggagggggtacatgttgaataagagcctagaaacagctgccagctcagtcctctcttcctgccagctttgttgacgaggaccttcactgaccatgtgatgctgttcacgcaaaccaagaagcaggcccaccgcatgcacatcctcctggggctcatggggctgcaggtgggtgagctccatggcaacttgtcacagacgcagcggctggaggccctccggtaacatttggggtggggactgaggctcccaccatccttctggggcagagaggatagaaggaagaagaggaccctgagcattctattagaacattagcaggggacacatagcatgatcttggccttgaacattttaacctaaccactgtgaggtcatgtcttagatgtgtttagaactctaacttcatagtcagagatgaccctcatgtccttggatgcttgtccctagcatgggagctgttgtgtggcgtgacagaggaagctggcttggaaaggcaacacatggtctcttcttggaagctttctgagagtggtgaacattcctgggtctgattgaacaagatttagagtcaaagttagcagccattacttgagcatctactttgccaggcactgtgctgcgtgctttccatgtgatttcttgtttagtcctcaga

SEQ ID NO: 12779 - DNA, 1217 bp, Homo sapiens
cttgggttgaaacaggcctgagagtgttctgaccgcttgttttcccccacttctgatacagtatattcacttcaccattacaattagctaagtacctgtattacagcctacccctggtatgagatggctttagtgattcccaaggatataaatacgatggttcttcagagggcctctggcaagaaatgccaacttagaaagacaggaagcaggtagccaagtgcttctgtagaacttgtggaagaatgtagcacatatgagtcaggtcaaacacggtctcagtacttaatgccttcaggagtgttgttttctctatttcaaatgagtttgtgaacatgtactaagattttagaggattaaagtaagcaatgaagcgagacctccaggctggatggaatattcctccttcattcagcctggaatttgacacttctcttaaagccagaattgtatgaatgcccaggtgtcttcatgtagccttccctctgctccttttggtggagcctagtagtcctcactgtttaccatgcataactatgatgatcgaggattagatattcaaaataagaatttgtaaaccttaccaatgatttgagaactttcaagggcaactttggatgcagttttcatctgagtgctggctttgcacctgatctagttcagttcagtatcactatatgtggtgagcggagtcatgatctcaattcttagaagcacagattcagcatctctcccaggaggcatcaggaaaggttgatttgtttcattttgaagcagcgggaagatctttatttagtgacatctgtctgacttgcgagccttctaaaggctcatagcctcagactcagtgacggccagaagagagcactttctcataaacagtgctttccaccacttgttaaaggtactgtgttgatacgatggcagtaggaccgttttagcaggcactgtgccaagtcctgtgtgaagcaccagttgctaggcactggttgtacagcattcaacaagaaagtaccacccccatgactttcatggcatgcattttaggaacaagaaacaggctatggtcaaagatgtttaatgataactagtgctagtactagtataaatgctttccacgtatttactcctgacaagccaacaatcctataaagagataccattattattcccattttatagaaggtgatactgagggacacagaggttaggtcatt

SEQ ID NO: 12780 - DNA, 1162 bp, Homo sapiens
gcacagcacctccttgtaacaactctatagccctctttgggagatgacatgagtggaactcacagccaccactaccaccactttagacaggaccgaggccacatactccccattctctcgtggctttccatctcagcctcggagggcaacattgacagtcctcctggcttcagctagagaaggatgctggaacaagcggctggtgttgaaagagtgggttgaccaatttggtattgaatgttgcccagccacccctaggaacacctgtccatcacctcctggatggattccactgttagacagctacagggaatgattggtcatggggaagtctctgcgccataagccacgatcccagcgcaaaacccttactcaaatgtcttcattgacttcggtatttcatagtacctgagattttattttgagataccatcagggtgagttgcaccacttgtactcaattctaattgccccctggcaatctgggaagggttcagaaggtgggcacccagccaacagcatgaactcagagcattgttttagggttggaggaggaacacgctttctttacatcactagtgtagactcaaaagatatgcaagtgtcaaatatgcaaaagaaatagtttattcaaagagactgtgtgttactgaagaacagcataaaaatatgatttttttacttgcaaaaatgaaaggaaaaaaataccacgcattgaaatgcccagttcagactgaataattcctgctgcagcaaggaaagtacctactataatagaaattctgttttgttttctgtggttttcaagttaaaaaaaaaaaagttaaaataaaaagcactttatgtttttcaaaaataggttctgccagggacagtgtcaacatcttgcactttaaaataagcactatttcccatagcccaattgttgggactgtagttggattgttgctacctgcccatttctggccagcatgggtaatattgtgctggtattactgtctgccatatcaaagtctgtgggctccttccctgcccctctgaaaccttcccttaaccctcatgggtcaggaggggttcttgccccttgggtggggcctctcatgaagtcaagtatacaggagacatgcacatctcaaaaggacacagtgacagttggacattg

SEQ ID NO: 12781 - DNA, 1356 bp, Homo sapiens
tatttagaaaataaattgcattgcaaagctcttatcggctcatatgagagagcaggttcctgcccttgaaaatgccggtaagctatagcatatgttttttaagacttaagcatttcatgctttaaaataccttcacaagtgaacattacacacagaagttcatttggttttcctttgttttatggtgcatatagcaataaagacccccctccaccctgcaacccccatcccccaccgggcctttgtccctgccttggcttttctccccttctcattctcctctcccctttcctcactgaaggctgtgagttgctttcaatgtgacaacactatgatgtcatttggaaggatttgccaggacagactgattctgagtcctgggtgccgtatgtgtatgcggcagtgttgtcaggcgatcttgtttgaagctctatgttgccataattaccatcaagtacacactgttggcaaaaggctaacacctgactttagaaaatgctgatttgagaacaaaaggaaaggtcttttttcactgcttaaagtggggtcactttgatacctttgcggtcatgtctgtgtctgatgagtgtagaatctctggatgtgcactgtcagtcatgtgtccaccaggcctcgaatatcatatgggaaatgtcatagttaaaaacgtacagccaggcccgtgtgctgttaatagtgtgaaattgtcatgttaaaaaaaaaaacaggaaccaaatgtgaccttgtgcatatattggtagctgaaaatcttcaaggctactgatgggtggccccttaatcttgtctttgattgctgtgtgcagggaaaggtgtccccgtttgttcatgctgttttggggggtgggggggtatttgcaagaatactcattttgacataataggtcctcttgtcagagatcctctaccacagacattaatagctgagcaggagccacatggattgattgtatccactcaccattgacgatggcattgagcgtagctagcttatttccatcactacgtgtttttgagcttgctcttacgttttaagaggtgccaggggtacatttttgcactgaaatctaaagatgttttaaaaaacacttttcacaaaaatagtcctttgtcattacattatttactcatgtgtttgtacatttttgtatgttaatttatgaatgattttttcagtaaaaaatacatattcaagaaccaaaccttggtggtcatttctctttgtgtaggacagtttgggtccttgggggtctttcctttttcctttcctttcctacaggagttcaacttaaggcagctcagctgagctctgggtcttgctggggtaaatactgcctg

SEQ ID NO: 12782 - DNA, 1788 bp, Homo sapiens
aagcacctggcatgaaacacaggaggtgtttctgaccacagcactcagcctggcatagcagaattggccgtgcgcccaccttgtgctgcagaagtgctgccatgggttgcgtcctctgctgtgggacgccctgctccatcctctggctgcagaggcatggatcctcactcagagccacctcttctctgttccctccctaaacaggtatgctctgctgaggaagtcaaaagaacggcaagggctggatggcctcaacaacctgaactactttgcaaacatcacatacgacgccttgtataaaaacataactgtcaacctgacacccgagctggctcaggtgaacgagtactgagaggagagaatgtacgtttgctttacccaccgccaccaagaaagcagtccgatgagatttttttttggaggggggagggtctacacagcaagagaacagaaatactgtgtctcatgaaggatcacagagttcagggggaaaatgtgacagcacacgcacaaacgccttcactggatcagccgctggaactgagggagtgagcttggggacttccttcgtcagcactggctttctgttttcacaagacagacgtctgtcccgctgctctctccccatctcctaccccacatcctgtcttagccgcagtctccagaacccatgatgaactgtgatctgccgtggtcctgccgtggtcctgccgtggagcctgtccctacacatgaccttggagcctcttggccttcagagcagaggcaaacccaccacagggcagctgcgttttaggaagagcaaatgaaactccacaccattcttctagatctctggtgttctctttggtttcatttttttaaaaaattaccttctttgggtggggattgagggtggaggggagggtgtttgggaaagataaatagacataaatatataacaatcacttcttgaagaagtataattgtaaataagccatgtaaaatgcctttttaaaatttaattttctagctggctccaattcaaattgaggatttatgtattaggccacttacttggttggcaagtgcaggaactcagttaaaatgcagttgaagaatgtcatctcccgaattgctgtcactttggcgagggagtggatatagggcatgtcacaaaagaacaaaataacccgacctttattgctgggagctggcttctgtccctttcttcccccccccacgagtcttgcccttgacttctgctctggattcactcttccctgtcggccgcgcatgtgctcatcccactctccgctaagcgggaggctgctgttagagcaggctgcttcctgcctaaagcaggcccttcggggctcgctgcacacacatctctggctctccaggcttcgtgttctgtcttttcatcagcatggcggggcggggggcggggggcgggggtgtgtatgggaatccctccccctcttactttttctcttgtggaacttggccacagtttctgaacaatgtgcctacattaccagctggcttcagtgattcctctgtgtccctttttggtttctggaaagattctttgtcaacattagtaactgatacatagaaccaaggagcactcaaatagggagccaggagccagggagctggtgacacttgtgtgctgtggggcagctgggatccaggtaagaccggattgaagctttgaaattagactaacaaagctccagacagcaagagcccaggtgcactgctcacacccccacctgcattttgaagtcatattattttttg

SEQ ID NO: 12783 - DNA, 1259 bp, Homo sapiens
gctggtggagagccactgtcttccctgcagtaactatctatacacctacctccagtgtgcacttagggggtgagcgcgggtgtcgaggtctgtgtgtctgcagactgctaacctatgacaattcagggacctcacctgtcggacctatagcttgctgagcaggaaccttgcacttcacacttcttgagtctcgtttcagaaggaaaatcatttgggattcctactgcccctccatctcaatcctcttctcttcaccagtttccaggactcatctgcaacatttgcaatctttttgcactaaaagtgggcaggagtcggcatgtgcccatcagagagacggctcctcagatgctcagctaagcctaagcgcttccaagcctgaaggccccttcagcttctcatgtgaattaccaacccctggattttccttgtgggggtacaagagcaggagtggggcaagagtttgaaaataaagccgcttccttgtgaactaactatattttagccataactgtttgtgatgtacacaatgttaagggatttatatgcagtgggcttttctgggagaaagttattcagctcttgagcaagtttaagtctggctgaatcctgaggccactgtgaatttgctgatgttcttccaactcagttgagtgattttaaggttttccaaatcttctatggctctctttttaatatatatatatatatatatatatatatatatatatatatatatatatatctatctggtagatcacatgtagatgtacagtgtgtatattaagctgaatttcaaccaactttattactaagaccagcctagcagggcattcatctttgatgttcttccttttcacatttcagaatcggcaatgcctggcccactcctgagagctctagttttctagttttccatttccagattgcgccagcattacagtaactaactctttctaaccaaccgtgatgccacgtaacttaccctatggacaaaagcaggaatgactaacacatcctaggagggaaagtccagtgtacctgtcatcacggacgcactgtggtcacagactggaatacgaaatactacagccctgctcccaggtgtgcatcttactggatgaggttgctgtgattgagatagttaaatacatgctaatttaaaaatgcagatgttttacatttgatttctaccaagagttgaaatgttgagagatgattaaaaataataataataaagtgtcttccattgttaaatg

SEQ ID NO: 12784 - DNA, 1879 bp, Homo sapiens
ctgtcttcccctactgttaaccttgtttgtcacacggtcgagttcgtattggttctcggctacttcctggagcttctgccgcctcctgtggaagataatctagcttctccacctcttgtttcacactcattcctcccatccagtgtttgtctctcgggtccttcaagccagccaggaccttttctgggtcatgaatagcacaatgaagcaagtgtctcctttccttgtccccaaggtgtgcagactttggcagccgtgcacctgaccagagctgaagctcccgctgggctgtggggttgccagaagctggggttgccatcccggggtacatgtcaccagtcctcttggggttttgtaccatctgatgctggaagttttgattagtgatattttctactactacatatttagagttcactggttcagtcttaaatgcctgcatggtgcctttttaggataaggtataaccatacatttttggtggaagtgtttctgggttagggaagttaaagtctgtttatccgtaagtggggaggagggtcagctaagagaagtgggagggccagagctttttggttctgatttacaaattaatgaagtagtttcaaacaacgcggtcatgtttacctctccatttgggagcctgcctacattcttgttctagaagcacaaaaaatcctcagatgaattagaagaaagaggtttggggactcagcggatactagttcttttaccttctgcttggtaacttagattaaactgagcattgtttttctgtcacaaatgttttccttatgacactggtttcgacatgtaaaatgtgtttgaaaacctgctttgtagatgcagagagaagctataggaaacccagtaccacccctggtctgttctgacgagacatcgttcataaggcacagcacatcgcaagatgaacagttgttaataaaagctgttgctggaaacttgctttaggaacagctcaagaaccttggagttcatatttcacaaatattaataaatataagtccaagagctgtcagcctaatctgtaggagcagaacctctgattgaccaaaaggcatatgggtttaggttggttttttgatgtcatatgtctctgatggggctgcaagtgctacctcgcgcttgtacactgctgctgtggggctccgcgcctgccggtgaagagctgcagatgccgagaagccagcaaacacagggcccactggaaaaaaatagttttttcattagtatttctcgggaggacccaaaagttaaggtcagcttgttcactgtaatttctggaagaagttcactcagaccttcctgaattcagatcatctcagaagtctggagggaaatctggcgaaaccttcgtttgagggactgatgtgagtgtatgtccacctcactggtggcaccgagaaacttacttccttgtattaagtgcacttcttgtatttctaataagatgactttccagaaagtgagatttgttatgttctggcttttaaaaggtaaaatataaataaatttcataacttaatctaagtggtaagctatggttcttgttttcattcaacacatttgccatagcatgggcttggggagtctccagaagatggttaccctttctagaagggaagttcttgcttgttgctgagtcctgtttggcgtcaaatctcagctgatgccaccagctgggcctcatggtgcctgtcctctggaaaaagaacacttgttacagttgggaggctctgggaggtgagaagtggcagcgctccatatagcaaggctttagacatgcggcttctgctacgtgcgggtaacagcagcagtgctgagggcttgtagtaaaggggctccgcagggtcaagtt

SEQ ID NO: 12785 - DNA, 1162 bp, Homo sapiens
atgggggttggaggcctgagtggccccaggcccattggtgggaggcccccacttccagttccttggccggtccctgtgtcctatcctgtactgactcactcctcattgggcccctccagcccagtgaaggtcagctctcttccaatgtccccttgactactctctcccattcaaactcccgctgccatttctactgcaggctggctcaactaccctctggagaagataggcttctggcgacgcctggaggacctcatccagggcctgacgggcgagaagcctcgggcagatgacatgaaatgggcccagaagatcaaataacttctccgagcctgctacctggttgccaaccttccctagcccccaaaccgaagccatctgccaaattccagcctctttgagctggcccctccagatggagaggacatctcctgggctgggcccaggtaccccagcccacccctcatgacacagaatacttgagccactgatttttcatttcttttttttttttttcctcggcccctcctcagccacctgagttgctctatctgcaagcctgactctgccagcctcccctggtagagaggaggtttacccactccctgcacgcctgccgtccctgccccgctgggcagcccttcagtgtggctggcgttggggccagtgagttgcctctttccctccttgtctggccccagtggtctggggagcccccaggcacacctaagcgtcgtggagcattgttctgccacagccctgcatactgaccccgggaggctgggcaggtggacagccccagccaccaccttcagcctagcctgtcccccaaggatggtgaagctcagcaggggtctgagggtagccggccagaagaggctggaacctcctgctcaagtctagacccctacttctctgctgcccccaccctgccagagctgatgtttccaataccaagatgtcttcacagggcacagcccctgcagagcatcttggtcatttggaagaggacacggtatcccctctggccagagtatgtcagagaaggaagagtagggcttttttgttttgtttttttttaaaggtgcttgcttgtttaatgtaaataatagaaagccttaatatcttttctgtaacacggagtaatattttaatgtcatgt

SEQ ID NO: 12786 - DNA, 1143 bp, Homo sapiens
tccacaagccattttttgaggagagtgaaagagagtaccatgctggcggcgcagagggaaggggcctacacccgtcttggggctcgccccacccagggctccctcctggagcatcccaggcgggcggcacgccaacagccccccccttgaatctgcagggagcaactctccactccatatttatttaaacaattttttccccaaaggcatccatagtgcactagcattttcttgaaccaataatgtattaaaattttttgatgtcagccttgcatcaagggctttatcaaaaagtacaataataaatcctcaggtagtactgggaatggaaggctttgccatgggcctgctgcgtcagaccagtactgggaaggaggacggttgtaagcagttgttatttagtgatattgtgggtaacgtgagaagatagaacaatgctataatatataatgaacacgtgggtatttaataagaaacatgatgtgagattactttgtcccgcttattctcctccctgttatctgctagatctagttctcaatcactgctcccccgtgtgtattagaatgcatgtaaggtcttcttgtgtcctgatgaaaaatatgtgcttgaaatgagaaactttgatctctgcttactaatgtgccccatgtccaagtccaacctgcctgtgcatgacctgatcattacatggctgtggttcctaagcctgttgctgaagtcattgtcgctcagcaatagggtgcagttttccaggaataggcatttgcctaattcctggcatgacactctagtgacttcctggtgaggcccagcctgtcctggtacagcagggtcttgctgtaactcagacattccaagggtatgggaagccatattcacacctcacgctctggacatgatttagggaagcagggacaccccccgccccccacctttgggatcagcctccgccattccaagtcaacactcttcttgagcagaccgtgatttggaagagaggcacctgctggaaaccacacttcttgaaacagcctgggtgacggtcctttaggcagcctgccgccgtctctgtcccggttcaccttgccgagagaggcgcgtctgccccaccctcaaaccctgtggggcctgatggtgctc

SEQ ID NO: 12787 - DNA, 1837 bp, Homo sapiens
tccatctgagagtgggcctggatcccaacaagtgtcagactttgaggacaatacctgcgaaatgaaaccaggaacctggtctgacgagtcttcccaaagcgaagatgcaaggagcagtaagccagctgccaaaaaaaaggctaccatgcaaggtgacagagagcagttgaaatggaagaatagttcctatggaaaagttgaagggttttggtctaaggaccagtcacagtggaagaatgcatctgagaatgatgagcgcttatctaacccccagattgagtggcagaatagcacaattgacagtgaggatggggaacagtttgacaacatgactgatggagtagctgagcccatgcatggcagcttagccggagttaaactgagcagccaacaggcctaagtgccaggttccctggcgttggtgacatgctgcagcctggaactctgatatccagtgtgactgcaaagctgtcttctcactggtactgccttgtgagtactggttggactgtggggcatgtggccgctgcagttccagtggttatttctaagtctatgacaggacaggctgttcttgcttcagaaccttctctgacagacacggtaactaaatgtgaaaaaccaataagctggtgactcatgaatacacacgaggaaaagcagaggtttattttatctgccttttcaacatttctttccctctgtgaaatgattggtcagatgtctttgagaagtgttaaactaattcacatggtagtgtagggccaacatacaagctaccagtctaatgtgtatagtagactttgggaaaagcgattttttttcatgtattcattctgaatagttgaaatgtatatttgtacagtcttttagacctattcaagtgatgctcatgatcctgttactgtgtgcccatcatagatttctttttttagtgttgcccttgctgtgtaataaacgctctatctagtttacctagcaaaagctcaaaactgcgctagtatggactttttggacagacttagtttttgcacataaccttgtacaatcttgcaacagaggccagccacgtaagatatatatctggactctcttgtattataggatttttcttgttctgaatatccttgacattacagctgtcaaaaacaaaaactggtatttcagatctgttttctgaaatcttttaagctaaaatcacatgcaagaattgactttgcagctactaattttgacaccttttagatctgtataaaagtgtgttgtgttgaagcagcaaaccaatgagtgctgcattttggatatttagttttatctttagttcaacaccatcatggtggattcatttataccatctaatatatgacacactgttgtagtatgtataattttgtgatctttattttccctttgtattcattttaagcatctaaataaattgctgtattgtgcttaatgtaaatatttgctttattacacatgacagtcctgtgtgtccattatatcttttgccatttaatgccataactctttcatcagagatggcagccacagtcacagaggaaacttgtggaaaacccaagatctgtcatctgcaaatagaatgctttctcttgaggcacctggtacaaaatctgtttttcttttttttttttttttttttttttttttttaactgaaaaacaaacacccttgagtttttcagttcaccttttgttaaggagcagagcctgcatatatatgtaaatgtctcaatgataaaaaaaaaaatgtaaacatggattggcattaatttgcaagcagaatcttaatagcctgatgggttttttgtttgttt

SEQ ID NO: 12788 - DNA, 1170 bp, Homo sapiens
aggactatcggacaaaacctttctgctgcagcgcttgtccattttcctcaaaattcttctctgcctacaaaagtcatttccgcaatgtccatagtgaagactttgaaaataggattctccttaattgcccctactgtaccttcaatgcagacaaaaagactttggaaacacacattaaaatatttcatgctccgaacgccagcgcaccaagtagcagcctcagcactttcaaagataaaaacaaaaatgatggccttaaacctaagcaggctgacagtgtagagcaagctgtttattactgtaagaagtgcacttaccgagatcctctttatgaaatagttaggaagcacatttacagggaacattttcagcatgtggcagcaccttacatagcaaaggcaggagaaaaatcactcaatggggcagtccccttaggctcgaatgcccgagaagagagtagtattcactgcaagcgatgccttttcatgccaaagtcctatgaagctttggtacagcatgtcatcgaagaccatgaacgtataggctatcaggtcactgccatgattgggcacacaaatgtagtggttccccgatccaaacccttgatgctaattgctcccaaacctcaagacaagaagagcatgggactcccaccaaggatcggttcccttgcttctggaaatgtccggtctttaccatcacagcagatggtgaatcgactctcaataccaaagcctaacttaaattctacaggagtcaacatgatgtccagtgttcatctgcagcagaacaactatggagtcaaatctgtaggccagggttacagtgttggtcagtcaatgagactgggtctaggtggcaacgcaccagtttccattcctcaacaatctcagtctgtaaagcagttacttccaagtggaaacggaaggtcttatgggcttgggtcagagcagaggtcccaggcaccagcaagatactccctgcagtctgctaatgcctcttctctctcatcgggccagttaaagtctccttccctctctcagtcacaggcatccagagtgttaggtcagtccagttccaaacctgctgcagctgccacaggccctcccccaggtaacacttcctcaactcaaaagtggaaaatatgtacaatctgtaatgagctttttc

SEQ ID NO: 12789 - DNA, 1033 bp, Homo sapiens
ttgttgctatgctgctttgcaaaaagttgaaaaaataaaaaaaaaatgcataccaaaacaaatacagactctttttttttgagatggagtctcgctctatcacccaggctggagtgcagtggcatgatctcggctcactgcaacctccccattctgggttcaagtgattctcctgccttagcctccagagtagctgggattacaggcaggtgccaccacgcccggctaattttgtattttgagtagagactgggtttcaccatgttggtcaggctggtctcgaactgctgacctcgtgatccacccgccttggcctcccaaagtgctgggattacaggcatgagctaccacgcctggcactttttttttttttttctaattttggaaagaagcgggtcttgcaaagtagctttgttacttgtaacagacgtatacatagaacctttgtacaacctagagtgactttttccaaagactgttacctatttcaaggtagaatcgttggaacttactgaacaacagtggaaaagacaactacacagcctcattgaggggagatgggtactgtatacttactggtaactggacacgggtaaaaggacaaggtctgtcatctctttagggacctgttttatatgccccaaccctgtccccatcttattgtttttttttgaatgtacttaaaaaaggaacaacaaaaaactagggttgtagaattataaaactgcttcaaccttagaaccttaagtaggaggccctcaaatggacttacgttagtccttagggagtcaatgtgtgtgttgctgcttatttaaatacagttcagttggagccccgagagtgccaatgttttccccacacctcttggatgccttcctcttcccaaatcccagaagaggtgggcacctgagcggggaatctcaggtgacttagtttgccagtgcctactctattgaagaactgggttttcatgctcgagaagaaactcgtggaagggcgtgtttcccatcacaggttcacatactgattgctt

SEQ ID NO: 12790 - DNA, 1194 bp, Homo sapiens
ggccagactggtcttgaattcccaacctcaggtgatctgcccacctcagcctcccaaagtgctaggattatagatgtgagcgacggtgcccggctccccccacatcttttacttgggcagagtccttagctttttctgtcttgttacaggtgctccagtgaaccacccagggaatgacgaggtggcgagtgaggatgaagccacagtaaagcggcttcgtcgggaggagacgcacgtctgtgagaaatgctgtgcggagttcttcagcatctctgagttcctggaacataagaaaaattgcactaaaaatccacctgtcctcatcatgaatgacagcgaggggcctgtgccttcagaagacttctccggagctgtactgagccaccagcccaccagtcccggcagtaaggactgtcacagggagaatggcggcagctcagaggacatgaaggagaagccggatgcggagtctgtggtgtacctaaagacagagacagccctgccacccaccccccaggacataagctatttagccaaaggcaaagtggccaacactaatgtgaccttgcaggcactacggggcaccaaggtggcggtgaatcagcggagcgcggatgcactccctgcccccgtgcctggtgccaacagcatcccgtgggtcctcgagcagatcttgtgtctgcagcagcagcagctacagcagatccagctcaccgagcagatccgcatccaggtgaacatgtgggcctcccacgccctccactcaagcggggcaggggccgacactctgaagaccttgggcagccacatgtctcagcaggtttctgcagctgtggctttgctcagccagaaagctggaagccaaggtctgtctctggatgccttgaaacaagccaagctacctcacgccaacatcccttctgccaccagctccctgtccccagggctggcacccttcactctgaagccggatgggacccgggtgctcccgaacgtcatgtcccgcctcccgagcgctttgcttcctcaggccccgggctcggtgctcttccagagccctttctccactgtggcgctagacacatccaagaaagggaaggggaagccaccgaacatctccgcggtggatgtcaaacccaaagacgaggcggccctctacaagcacaagtgtaagtactgtagcaaggtttttgg

SEQ ID NO: 12791 - DNA, 1181 bp, Homo sapiens
ttcgcggtcctctcagtctccctagcggggcaagggacccgcccagcgctttgctgatttgcccagcgctcacgcccaacctgggtttctccggagctcgccgcgccccgcgcacccaccccgcaacggcagccgcacgtgggtctccccgcaaaccacccaggcgtcccgggagcagcgctgctgcacggccgcgctgggggcccaacgcctggggttgcaggtgcaaaaggcgccccgagccggggaggccaatcgcgtccgcggagaacgcagagtgcgggcaggggcgcatccctcgccacccgcggtcgcccagcacgccgggacgcgcgtggccatccagctccccgggggcgttggggggctccgcgggcctgggcctcgggattcgcccgccgcttccccggggagccgctgctgcaaagccaggttggggcgccgggcccggccagcgccctctaggcagcggaagtgcagcttgctttacatccgtcctccccgcctcgcagagttgggagaaggcagggtggggggtgtggaaaaataaaaggaaaagtccttgcaccatgtagatcagcgtcccccactttggcatcccggccggccggggacctcccagtctgcggccatgaacgcgagcagcgagggcgagagcttcgcgggctcggtgcaaagtaagtgcttttccgggagcagtgcgcgctccggggcccagtgcgcgctccggggcccgggcccaagcacgtctgcgacgcagccagcaggcccggggccccgaaatcggggtgacggctcggagccgcgtctcggggaccgcggcgggcgcgctgtgcagggggcgccggagtgggcttggggtgggggcgcacccgacctggcgcaagaccgggggcgctctccagccttgcgagaccccttggaagggaacagtgggggagggcacgccgttcagacaatcgccaccccctaagggcattcccgccccatcaggcggagtttggggcgggcaggagaaagggaggaatctagggtaaacggggcaacactgatgggaaaacttctgcctcagtggctcaaaattagagcctggagattgggggaatcaccaggtctcacgaggtcctgccggctcattgcaaagccttttcctcattaagggtggagatctgaatggaaaa

SEQ ID NO: 12792 - DNA, 1109 bp, Homo sapiens
agggcaggggtcctatacatgggttgaacttagtggccagtttacccaaggcagtttgggtgagtgaaaggccccagctgtggtcagtgcctagcagagcttgttgtatgggaagcaatgcctagtgctaggttcaaatgttgaggccaggataaacgttaagtctggaagccagcaggaataagggaagactagaataagttatataaaataacaggagtaagcaattctgactggaggaaagctggcaaagcaatgggtttcatctcatggtaatccaaattgcttagtagtgtctgccaagagctctgtgttggagggcttctggattgtgccagggactggggaggcaggaagtcatgattgattggtaatgtctgccatgagtgtgggagctacgcaggacagtacacatgctacatatttgcaatccctgatttagaggcatggttatgctggagttcacacagagagagagagagaggcatggttgattggtaatgtctgccatggattttggagttatgcaggatggcacacatgctacacatttgcaatccctgatttagaatcatggttacagtgatggcttaagaaaattccctggttgtctttgacatacgcatattttgttttctcacctaatatttattttttcacttaataattgaccattagttgtctcgatctgtgttggggtttagtcatattcattgaactataataaaatgggtctccaaagaacacaagttagacagtggtaagtgccattgagtaagtggaggaactggggggttagcaatgggttcatgaaggatgtggcatttgaatggggtattggagactggaaggatcttgaacatgtggggacgagggacataacatcagtgtggagggaacagcacaggctaaggagtggtagctggaaagcatgagtggtttggaggcatagcaaggaggtggattttgcaggagcaaaatgtactagaaagcctagggagagagaagactgagattgaatgatacccactggggtatcctcccgtgggctgcaactgacaaaataaagaacttggacttaaccacctgaccatatggagcttagttgc

SEQ ID NO: 12793 - DNA, 1715 bp, Homo sapiens
aacaacaacaacaaatagaacccattgcatttctaggtcagtttggttctatgtattacgcttttttaaagaaagaattttctaaactgtattcagttttgatcttaatcatttaaaaaatgttgttttccttaggtcttggtggatgtcagtgcttactccccatgaaattaaattttacttcatcctttgagaagcgaatggtgaaagctactgaaataagctgtgattgtactgtacataaaacatatgaggaatctgcaaggaacactacagttgtgtaaagttgttctgttaacttttgtaccaaatagcaatacaaactagttggaacagttggaacttacatacatggggactggaaatctctattttgtccctgaataatatttttcttagaattgaccaaataagaagtggaatttttgcatacttgagcgctgctgaaaagaaatcatttgggttgggtggggcgggatgggggaaaagtatataatgcttgcacctcaggtaaaaatctgtaaatatctaagttgtaaacctgcttgttcaaatactgtgtgtattccttttctctaatgcagctcatcacttggagcagtttctgctattgtgctctttcatttaaaatgtatgtttttttttttttaaactgtcaatgattttgtattatgttgaatccacccaaatctattgttgtcttaaaattgttaatggaagtattgaccctctatgatatgtgctgcagatatcgaggtcagccattcggaagctggcagcattttatcgcaactttgagcatctcagatggggaaggcaccttcttcctcgcctctccagattgtcctggaacctccaggatccttgactgagggcgttgggatggcttgtaggatttttaagagagtgtgtctacagacaagcattttctctgtagagcagccacacgttgtataaacataaactgtatgtgcagttatttaaatttgtttctgtcaaattaatcatttttgttggacgattcagtggcgggggggttttgcctaaattagtatataaaaacaaaaatgctaaattatatctgtgaattgcaggtattggggaacagttttaagggaaattttggggggaacattttaggtttgtatttggtagtcttaatgtatctggcatttgggtgaactgtggacatactagagttgattatagacacattgattttgaataaggaactgctggccgagcccgctgggagtctagaaagagaaaatctgtttctagacctcagttattttcccatttttggttgttttgaagcagtaacatttttctcagtgcacatgcaatttgggttttagagaagatggccaccagctggcttcctagatattttaaacttttgttctttaatatgctgtccatggctgagtttattagtacatgggcttagtgaccacaaaatattttattaagaaactgtttcaaaaataaatttgcactgttcatttttctggcctcgctgttctccatagagcaagggtaatcctagaaaaaattttttttttttaaattatgcaacgtaagatgtcctccttgatagaagtcttagctcctgtgttacaagggagaactcatttgagatcagtctgttggcattgcaatgaagtgctttgtatcaggaaagtgtacactattgaccttttttcctgttcaca

SEQ ID NO: 12794 - DNA, 1281 bp, Homo sapiens
agggggctaattgctatgttctcatggataaactttgccagcaaaaatcaggcttttgaacaattttaattttttgcctcataaattttgtgaatgctattcattatagggcttgtatatataatctaaaatgtcagcaaggcatcggagatgggttaacatctcaaaacaaaatagcctacaaatgttccttgtgggagactttggcgagggtctgtgggtaaaagcaccagggggttaatcttggctcagtttcctaaaaagcattgattaatttaactggcttttaaatatccccttccgctgatatttgttgtcagctgcctacagtttaatatgcagcgttcacaaaacagctgccagtgctacaattaatgaagcaaaacttaatatgtaatcacaatctaaattagcatcaatactttgacattcattacattggtttgggggaagaaaagtagttctggtatgtttcattgatccccagataccttccaatctggacatgatggggctgattccagatggtttttctgaaatttcattaaggtaggtcagcgtcatttgtctctgtttaggtaaaatataaaaaccctgcccagtagcagtggcatcgcttggttcctgatgcccatgttccagaggaattcggataccacaaacagctaagacaatctcagcttttcttagacaatcttctatctcaaacttcagacattccagaattgtcatgatgtttacactgtctgagttaaaaatcctgttcaagaaaaaaaaagattttgtatcacttcttaaaaaggaatattcatagcacttgtcacaaatagaaggcaaccatgagataatacaagccagggagaggcttgtattacatgacaggtgtaattagtctgctgagccagctttacccaatgaagggcatatgtgttagagagattagctaagagtagaaattcgagcatagaggccaggtgcggtggctcacgcctgtaatcccagcactttgggaggttgaggcaggcgtgtcacttgaggccaggagttcgagaccagcctggccaacatgatgaaaccccgtctctactacaaatacaaaaattagccgggtgtggtggcacacgcctgtagtcccagctactggggaggctgaggcagcattgcttgaacccaggaggtggaggttgcagtgagccaagatcacaccactgcactccagcctgggcgacagagggagacactgtctccaaaagaaagaaatcccagcgtagatccaaactg

SEQ ID NO: 12795 - DNA, 1668 bp, Homo sapiens
tgagcctccctccgttttcaggaggaccactctctgtggcaccctggactacctgccccctgaaatgattgaaggtcggatgcatgatgagaaggtggatctctggagccttggagttctttgctatgaatttttagttgggaagcctccttttgaggcaaacacataccaagagacctacaaaagaatatcacgggtaagacgcaactgaaaaggacccagcacatctgctggaattctttccttatcagcctgaactgcaggccaagatccgaacatctatactatttgatctctctaacctgtgttttgtgatattttatcatttgttgtactccaggttgaattcacattccctgactttgtaacagagggagccagggacctcatttcaagactgttgaagcataatcccagccagaggccaatgctcagagaagtacttgaacacccctggatcacagcaaattcatcaaaaccatcaaattgccaaaacaaagaatcagctagcaaacagtcttaggaatcgtgcagggggagaaatccttgagccagggctgccatataacctgacaggaacatgctactgaagtttattttaccattgactgctgccctcaatctagaacgctacacaagaaatatttgttttactcagcaggtgtgccttaacctccctattcagaaagctccacatcaataaacatgacactctgaagtgaaagtagccacgagaattgtgctacttatactggttcataatctggaggcaaggttcgactgcagccgccccgtcagcctgtgctaggcatggtgtcttcacaggaggcaaatccagagcctggctgtggggaaagtgaccactctgccctgaccccgatcagttaaggagctgtgcaataaccttcctagtacctgagtgagtgtgtaacttattgggttggcgaagcctggtaaagctgttggaatgagtatgtgattctttttaagtatgaaaataaagatatatgtacagacttgtattttttctctggtggcattcctttaggaatgctgtgtgtctgtccggcaccccggtaggcctgattgggtttctagtcctccttaaccacttatctcccatatgagagtgtgaaaaataggaacacgtgctctacctccatttagggatttgcttgggatacagaagaggccatgtgtctcagagctgttaagggcttatttttttaaaacattggagtcatagcatgtgtgtaaactttaaatatgcaaataaataagtatctatgtctgtgtggagtgctgtgtaattctttccaccatctgttcattgttggcctggaaatgagcaggggctgagaggagcaggtctcgccctcatctagtcctgcctcttctggtctctcctgttgggtgtactcctaatacttcattatatatattgtttatatatttgtcatatctttgtcatctgtccatcgactaaagatacggtgaaagtgactgtgatgaaggaaaagtagaagtgttgaacttagagctagtagagaaatctgcttgcatggccaatgctcagtgcaagaaactggacagcaggtatgtcaggatatgtcataacaaagtggccaatatagagaaacttaaaaacatgactcagtaaaactgcag

SEQ ID NO: 12796 - DNA, 1215 bp, Homo sapiens
cctgccgcgctgccacctccagcagtccctgcgtcatgggcgggctccacgagatagctctgcaccgggcgtccggctccttcgccccgggctctggctccttcgccccgggctccggccacggacttttctggcccaagacccagggttcggacttggcgcctccaagcgcctcgggcttgggagcagcgcctagaccttcgccgccgggctttgagaactcgttcccccaggtctttcaccagactctcctccctccccgcactctttgcttacaacgaaatcctcggggcgcattgcccccgggtaccttccgaccctgggcaagccccgccgggcggggtgcggttggtcccccggggccctctgcgtagcccggcgatgccggccagttcgcagtagcggggtttcgcactaacggggtctcctgtttttttttttccctccaggatcgccacgacgggagcagcaatgggaatccgcgggtcccccacctctcctccgccgggcagcacctctacagccccgcgccacccctctcccacactggagtcgccgaatatcagccgccaccctactttccccctccctaccagcagctggcctactcccagtcggccgacccctactcgcatctgggggaagcgtacgccgccgccatcaaccccctgcaccagccggcgcccacaggcagccagcagcaggcctggcccggccgccagagccaggagggagcggggctgccctcgcaccacgggcgcccggccggcctactgccccacctctccgggctggaggcgggcgcggtgagcgcccgcagggatgcctaccgccgctccgacctgctgctgccccacgcacacgccctggatgccgcgggcctggccgagaacctggggctccacgacatgcctcaccagatggacgaggtgcaggtgagcggcgctgcggctcctgaccggacctgttcaccctacggccttctgcccccaccccgcactcctctaggctcccccgaacttaagggaattttgtcctctctcccccagaatgtcgacgaccagcacctgttgctgcacgatcagacagtcattcgcaaaggtaaatagcaaggtggcatcgtctaactctggtcacacgatctgggcttgtgaagttgactggcaaggttgggggtatttggtggccagcgtgggacatttgtggtagaaggga

SEQ ID NO: 12797 - DNA, 1302 bp, Homo sapiens
aaaggttctatctgcttagcaactagttaataagtggtatctgacacactctaaaccccgtgttcaaacgggggccttctggttttaggaaacttgtagaaacgaagcctgctgattgatttttttctcctttttttttttttttttttttaactttgaaagttaactcttcaaatgggagactctttgaaatgacatgttcctttaaggtactgaagctttatttgcatatttatttcagatgtttcgagtaaacttgaaaagggtaggcacgaagcaatttgttgctgcttgtcacccccaagtccccgtggaggttctgtattttaagaaacagtgcgttgagtgtacagattttatttatgcgtaatttaatggggtctgtaaatactggtgcacttcttacgacttttttgagacatgggatccaattttaatattaacttttaatggtgatggggtaatctataacacatcataaggttttattcatatatatacagggtattaagaattaagaggatgctgggctctgttcttggcttggaagattctatttaattgaaactctctgttcagaaagcaataactttgtctcgttcctgttgggctgaaccctaaggtgagtgtgcagtacagtgtgtgtgggtgaaatggagatttggaattgaactctctgcctgtaaatgttccccaaataattgttgtgtgtatgatacgtgtataataaaagtattcttgttagaatctgaaagtctggctataggtttttgtttttgcttttgttttaaagtcttttgggtgaatggaattagggcagagctgatttatggcttgactgtggcttggttaatgccctgagcaggcaagttttgtgtgctgttggggaggaacctgaagtttcaccttttctccctagcgacactgttcagctaccccaggccttatgctgtcatcagtgtctctcaactgcagagggatagaatcatcctccccaccctggaggtgttgggaaatgtctgagggacagtttattgacattaagaggggccaatgttttgggaacaatgtctcatggaaggttactgtattgaggacaggtacactggcatactgtactcagcatactgtatagtggtcaagaatggaagtgaaatgattatgggtgttctttgggcagatgtttctctcttttttttttttttctttttttaagatgaagtctcgctcttggccccaggctggagtgcaatggtgtaatctcggctcactgcaacctccacctcccgggttcaagcgatt

SEQ ID NO: 12798 - DNA, 1256 bp, Homo sapiens
tgcgccctgggacagcggagagacggcttctctttaatctaggtcccattgtgtcttgagggaggactttaagaatgactgagaactatttaaagacgcaatcccaggttccttgcacaccatggcagcctctccttgcaccttctcctgcctctccacactccaggttccctcaggcttgtgtccccactgctgcatcgtggcggggtgtcacagaccctctgcagcccctggctgccctggactgtgcagagatgcctgactccagggaaacctgaaagcaagaagttaatggactgtttattgtaacttgatcctcccgagctgtgagcgcagtctgaggtgtgaggacacggcctcctgttggagtcccattttctccatcagggcacgtgggcggcttcctcaagcccggaggagctcccaggcgcacaggggccgccggtaacaggggccgccggccaaaggcccctttccagtcatagcactgaagttgcaacttttttcttgtaattgttttgctactaagataatttcagaagttcagtctattttttcagcggatactgccgccaccaagaatccaaaacctatttttgacttggagagacttgcttttgttggttccgcccgtggagacgacgatagtgtttctgtataataaagtgtctgccggctcgcgggccaggatcctctcggtgggatgggcaccacagacaggaggcccctcaggcccgtgcgggccactgtctgctgccgcctgccggggtggcagagtgagttgtctcaggaccccgtcactgcgacgttgacactcctctcccttcccttcctccccaactccccaaacactgtggaaggggagaaggaagtgatccacagcattcaggccacttggggtctagaccatggtggtgccagcctggggggggcagtggccctcagctctgcccgctggagcggttgagtgcagaagggtgcgcctcttccctctacccccgcaccacctgctgtgtgccagcctgagacggttcctgcctgtcttgggggttggtggagggtggaggcagttctgccagccgtggcagggctgctatggggcatccagggctgtgggggtctggaggaggggacatgaggtgagaggtatcctggccgagggcggggggcagcggggggtctccctccggacctacctcagggagctgagcgtgcaggcgctccagggcaggcctgggacagagtcaaggctcaga

SEQ ID NO: 12799 - DNA, 1210 bp, Homo sapiens
agtgagaggaaggcggggggcgcagcaacgcatcgtgtggccctcccctcccacctccctgtgtataaatatttacatgtgatgtctggtctgaatgcacaagctaagagagcttgcaaaaaaaaaaagaaaaaagaaaaaaaaaaaccacgtttctttgttgagctgtgtcttgaaggcaaaagaaaaaaaatttctacagtagtctttcttgtttctagttgagctgcgtgcgtgaatgcttattttcttttgtttatgataatttcacttaactttaaagacatatttgcacaaaacctttgtttaaagatctgcaatattatatatataaatatatataagataagagaaactgtatgtgcgagggcaggagtatttttgtattagaagaggcctattaaaaaaaaaagttgttttctgaactagaagaggaaaaaaatggcaatttttgagtgccaagtcagaaagtgtgtattaccttgtaaagaaaaaaattacaaagcaggggtttagagttatttatataaatgttgagattttgcactattttttaatataaatatgtcagtgcttgcttgatggaaacttctcttgtgtctgttgagactttaagggagaaatgtcggaatttcagagtcgcctgacggcagagggtgagcccccgtggagtctgcagagaggccttggccaggagcggcgggctttcccgaggggccactgtccctgcagagtggatgcttctgcctagtgacaggttatcaccacgttatatattccctaccgaaggagacaccttttcccccctgacccagaacagcctttaaatcacaagcaaaataggaaagttaaccacggaggcaccgagttccaggtagtggttttgcctttcccaaaaatgaaaataaactgttaccgaaggaattagtttttcctcttcttttttccaactgtgaaggtccccgtggggtggagcatggtgcccctcacaagccgcagcggctggtgcccgggctaccagggacatgccagagggctcgatgacttgtctctgcagggcgctttggtggttgttcagctggctaaaggttcaccggtgaaggcaggtgcggtaactgccgcactggaccctaggaagccccaggtattcgcaatctgacctcctcctgtctgtttcccttcacggatcaattctcacttaagaggccaa

SEQ ID NO: 12800 - DNA, 1170 bp, Homo sapiens
ttctacccccaaaacagacagcccacaggcaggagtggtctgttgagcagctactcccattgtgccccgcatgggtttatgatggactttgtgcaggtggctggacagtgtgcttcggaggccgagaactccaagaactctgagagctgctgggctctagtccttccctcttggtggcagcctggaagcctgtaaatttccccgcggagtggggaagtggggtgactgtgcttgtaatatttcaagttatacagtcattcgggggttctttctgctctctcataattacagcatctttaagaagaaatatcaacatgaagtattttcaggggaagagacttttaaaagaaacacacacacacacacacacacacacacacgcacacaggccagaacaccaccaccgagttagtatagtaatgcaagttcgtaatgcatgcagggctgctcgctccaggaagctcccaagcaggaatgttcctgaaggatgggctattaaatattggatcctcaggctggcagatgcgtctgcgctgtaattgggtctttcctggagtaattaaaggaaaatgattatattaacccaagtcaccaggccagcatggcatagagaactgaatggcaacagtattgatgtttccctccaaaaactggcctctctcagcacatcaaaaacgcacccttggcttgagtttagggagctttcctttctttgcactttttataattgatcgcgtgtctcctggccttctttttctttttaaaaagcagtgggggatatccgtgccctctaacgtgagcagcctctacctgctcagggagatctgagcttaaggacaagtgtggcgtaaatgcccccggagactgcggcgtgagagatgacattgaaaaaggtctggcttttagagctcaaacctgggaggcttggactcttttttcttcttcttctccttttctgaagagttggagaagccggagtttcaagaccgtcttggtgtgctgccttatttaggaggcgagctgctgctcatttgtcaggcaaaacagatgtggtggggagacaacatctattttcataattcgaaacaaatctggcgagccgccttccttttcagcggggcctgctcatgcagaaagcccagctcccaggcagcatctagcagaaatatt

SEQ ID NO: 12801 - DNA, 1191 bp, Homo sapiens
gtggacctgtattcatttacactgtatacccattgagaggagagacttgttcagtctcagtacagctcgaaaagtcagaaatacctctgtgcaggtacctatgcaatgattttgctttctgattttgcagatggacgtgcacagagtctgaagtcagttctgataggaaagtggatagtttgtgggcatgtctgtggcaggggaaattttattagctccttagacacactcttacatcatctcccacatagaatgccctttctagttacgaacagccaagggtggcctccttttggagcctattaacgcagcccttagctaaactttaaggttcttgtctttgtacaggaaggaaaagcacaactactgctttggggtatttttcattttatgactcgtgctcccactgagcatctgatcagggatctggaccttgcaatccatatcccattatcatgatcttccttctctgcacagtgctatatttgtattcttccttgcattggagaaattggaaaaaaacatcacttgctgctgttgctgggcagagatttgtgaagctttcgggaagggaactatgaaaattcagttagccctgtgattattctttatccttaaatttatgaaggaaattaaatcaatgtttgctgaaggaatgggcacacgtaacatatcacttctaatagctagagacaaaggtctgtttttggaaaacacattactgagctgccttaatccccagtgtaagacctggactgggggctgggcagtgatgactgtggcccctgaggcccttgtgatatggttaaggggattgtgcaggcagccaccctgtggggcatggcgagggctcggaacggaggggatgcgatgtgtagaggaaatgtctgggagagaccttacatagcaggtgacatttggcctgggctttagagattggctgagaacccaccattcagagaagtcaggggatgagtttcagaaggttctttcagttccctgaaatcattatttgtaaaatcttgcatgtttgtgcatacttaatttctttgtaagacaaggcccatagctttcttcagagctcaaagggatctatgatccccgaagatctagaaataagtgatgcattttatttgtgaactggccacggcaggcaggagatgtcactcaggccattgggaagggcctggt

SEQ ID NO: 12802 - DNA, 1137 bp, Homo sapiens
agttagggaagccaaagtttaaaggactattgaacaaatgaatttgggaattataacattgagttcaattaaaaagcctttttagctgaaacaattgtttatagcgccatatttaattcctataaaactgtattctgaactatcttctgagagacatttcagtgttacattaaaagtttttgcctttggtaattactggttcatttgctttaaagcagcatgtcattttcttggcttaagagaaagattactttttgtgcagggataatgggcttataaatctagtataaaacatatttaaccagttttcccaattttgtttatttttccccctcctctgcagtttcgtgccttagcaccaatgtactatcgagggtcggctgcagctataatcgtttatgatatcacaaaagaagtaagactatatagttttctttagattgttttgaaaactcttttggttgcttagatctccagttgctctcttttttgtgtgttacaggagacattttcaacattaaagaattgggtgaaagagcttcgacagcatggcccacctaatattgtagttgccattgcaggaaataaatgtgatcttatcgatgtaaggtaagttattagaacgagagattacaatacctattatgtgttccttttcttaataagcaatatccagtttaagaatcttgcttttattttatctctgacattgaaaaattccttttggttgtgtggttggagtcctaaatttttaaactaaaattaagatttcaggcatttggagctaattatattatgtatacagacaggtgtgcaatttacggaaatactggttgcgttgcatccaacattatctgagatcagagcagcccccaggctcccatgacttagaatacttgaatgcagaaagcacatttattggcagtttccctgggccacttccatcattcccaaagcaagggctttttgaaaattttggctggggaagaaaaccctgccatccctaatcattccattagctacattactagtggtaccgagttttgtttcactttgtttgtttacccatggatgtggtgtaatcgagaagaccatgtctcagggcccatccagcagccatttagtccatcctttgtc

SEQ ID NO: 12803 - DNA, 2097 bp, Homo sapiens
ctccgtttgcaaaatgcggttggaccatatcatgtcatccaacactgggcataaacagcccatcccgttaagctgtacagttgactcccctttctggtgccttggcttgtctttgaaatgtgcgtttgctcccgtaggaagaagatggactgcggatgaggaagacagtgcagagcaacagccccatttcagcattagccccaactgggaaggaagaaggccttagcacccggctcttggctctggtggttttgttctttatcgttggtgtaattattgggaagattgccttgtagaggtagcatgcacaggatggtaaattggattggtggatccaccatatcatgggatttaaatttatcataaccatgtgtaaaaagaaattaatgtatgatgacatctcacaggtcttgcctttaaattacccctccctgcacacacatacacagatacacacacacaaatataatgtaacgatcttttagaaagttaaaaatgtatagtaactgattgagggggaaaagaatgatctttattaatgacaagggaaaccatgagtaatgccacaatggcatattgtaaatgtcattttaaacattggtaggccttggtacatgatgctggattacctctcttaaaatgacacccttcctcgcctgttggtgctggcccttggggagctggagcccagcatgctggggagtgcggtcagctccacacagtagtccccacgtggcccactcccggcccaggctgctttccgtgtcttcagttctgtccaagccatcagctccttgggactgatgaacagagtcagaagcccaaaggaattgcactgtggcagcatcagacgtactcgtcataagtgagaggcgtgtgttgactgattgacccagcgctttggaaataaatggcagtgctttgttcacttaaagggaccaagctaaatttgtattggttcatgtagtgaagtcaaactgttattcagagatgtttaatgcatatttaacttatttaatgtatttcatctcatgttttcttattgtcacaagagtacagttaatgctgcgtgctgctgaactctgttgggtgaactggtattgctgctggagggctgtgggctcctctgtctctggagagtctggtcatgtggaggtggggtttattgggatgctggagaagagctgccaggaagtgttttttctgggtcagtaaataacaactgtcatagggagggaaattctcagtagtgacagtcaactctaggttaccttttttaatgaagagtagtcagtcttctagattgttcttataccacctctcaaccattactcacacttccagcgcccaggtccaagtctgagcctgacctccccttggggacctagcctggagtcaggacaaatggatcgggctgcagagggttagaagcgagggcaccagcagttgtgggtggggagcaagggaagagagaaactcttcagcgaatccttctagtactagttgagagtttgactgtgaattaattttatgccataaaagaccaacccagttctgtttgactatgtagcatcttgaaaagaaaaattataataaagccccaaaattaagaattcttttgtcattttgtcacatttgctctatggggggaattattattttatcatttttattattttgccattggaaggttaactttaaaatgagccctatcactgagaaatacgtgtttcatgatttaactctgtgtgtgtgtgtgtgtgtgtgtgtgtgtgtgtgtgtattttttttttggttgtcttcagctgacagtatgaaaaatgaaactgctgaaaaagctgagcacctggtcacccttggccttccattgctttggccttcagtaaaaagcagcctcccttctaggtcagggaaccatgccattgagactagtaacgggcgttctgggcacagtcccactgtgcacaggtttgagaggacaagttcatcagaaggaaggcagtccttagaagtcacatacgttgagccacgttgctcctaagcctggctctgtcaagctgggtcaggggccttgaaactggagaagtggaagtctat

SEQ ID NO: 12804 - DNA, 1230 bp, Homo sapiens
gctccttctctaaaggaatggcccatttctcattgtagtttgagaaatacatgtatgaagagataggggtcttgggcttcccagtgtcactttgaacacctgaataacatttaactcctgagaccttctcggtgtagaggccactgcttccccctgctggagatggcatttcattgaagggcctctcgtggctttccctgcccccggctgtctggcctgaagaaggagaaagaaccaaactgaactatgaaaagttaccactctgaggagacctctcttaattaacacttggggccatgtttgctgttgttgagaaggagtgttctcaaagatgagctggaatggaattgtatttagaaaggcccctgcaaagtatatagatggatgactctagttcatgacatacaaatcccataaggccaacgaccactcttctggaacaccaagagcagctctgagatcatgctggccctacgcgaattgagtttctgtggcctaattggatttggagaacgccttccctggccccttttcctcagacagatctgctctgataggaaccttttcaagaaagttactgttgtttcaatgccactccttacctgtatagaacatttccaatacattcgctcattgaacttaatccttgcaactgtgactggggggtagatggctctgtttgcatacgaagaaataaaggctccaggaggttaaatcgggcaactttttagaactaaatcagtctctgtaaggcctacattgctaagataccatttcagctctgaaaatctgcttcagggaagtgagtggatgaggccttcctgcctcagctactctgcccgtctgtacatcttttgtgtctgcctccgtaccttattcagttattttcacactaaagtaagtagaattaagactgtagttcagatgctttttctttttctgttggaaactgaacacactacagacagtgaaaaaaggtacatattccattttctcattgcctgaagatctctgctgatgctcctggagaatgactttgggggctttagaaagaatattgccagtccgtctcggcaaggagatgatgggagcgctttatatggaggctttacatgacttgtaaattaaatgtgaatgagggcagttgattaaaattggtattacagaagggccctgctgaggtttgaaaacagctgagctgctgatgtctcaggcctttccctgaattag

SEQ ID NO: 12805 - DNA, 1243 bp, Homo sapiens
catggctcactgcgaccttcgcctcttgggttcaagggattctcctgcctcagcctcccgagtagctgggattacaggcataagccaccatgcccagttaatttttgtatttttagtagagaacggttttcaccattttggccaggctactctcgaactcctgacctcagatgatctgcccgccttggcctcccaaagttctgggattacaggcgtgagccaccgcgcccagccgatttccctcccattcttaaaagctttctaccgcagtgtgttatatagttaaaataaacaggaaccatcgataccatttcaaaataaggggaaatgttccctgtggacatttaactgaagaaaagaaatgacagtgtaagattgcattgagatcttaaggattgcttttgccaaatggtagataatttgctagcggttttaggcagttgtttcacacatcttaacacatggttaatgattgtgtgactgagataactggatcagccctatttccaaaataagctaagtgtatttaagtaaaccttgctactattgagcattttgtagttgtttcatttactgcctagttttttttttcacttgcaactgatcacaagaatcattgaggttcatgccgttctatcacagtactagtagtaagaggtctttattttaaggatcttttgttgactttttcattacatttctatagccagatcaagtcaaatttacgttctgaagtatgtccaaggaaattaagagctggtgcatgaaaagataggaaaacaatccaaatcctagcagttatcaaaagcaagtttataatacaggcaagtgcattcactcctttctatatattttcagggagcaacatttaagagagagtaaacattcactcctttctgtatcttttcagggagtaacatttaagagagagtaagagtatttgtatctaaattggattagaataatttttttcatgtccctttactttcctgtagcttgctgatgaccgtatggcactggtgtcaggcatcagcttagatccagaagcagcgattggtgtgacaaaacggccacctcctaagtgggtggatggagtggatgaagtaagttccatgttagtttcatagcatcttgtttttttaagtaattatgacaatgtattttaagatatctgtcatataaacgaatttggctacacttgaatgtatatttctagaaatactttagctttaggttaagttgt

SEQ ID NO: 12806 - DNA, 1243 bp, Homo sapiens; identical to SEQ ID NO: 12805

SEQ ID NO: 12807 - DNA, 1432 bp, Homo sapiens
aattgtaaatggaatattcctcatttaaaatttttgcactgcattttctactgtaaaccaaaagaggttactaagcaaaaccacctaaatttaagttggtgatttaaatgaatctcacattaaaagaaagcttgacagtgttatgaaagccaccagactcagccagtgtgtccccatgggtatccccagccatccttgctcaatccattacttatatactaactacataatgacctgttcaaaccagactctatttaatgaactgtgaatttacacagaggccattttaaatgggtcaccccatttaggattagtggatctcaaattattaaccaaacatcactccatttcaaagtaaaatattccaccagcgatttgatttattggctcttccattgccactgagcaatgcccaggaagcaggcacattgccaaggactgggggcatcttgactaggaagctcctcgtttgtgtgagcgtgggtcagaccgccaaagtaggacttcatcgtttacctacctattatcaatatggtgcttgaatatattcctataactgtagaacagtgtggaaagtgatggtaactttgaagttgttcatgttttattggctttgttttaattgacactagtagagttttaatggtctttgtgtaaattttaatggcttttccattgtttttgcttctcttaaaaagtttaagaagaatatgacctcattaaatgtgctgttttatttggaccagtcacacaaaatgtctctctagagttgactttaaagttgtttacagaaatttaaactcaattccagagattgaagttgtccaaacagctcatgggcttagtgtccaaacccctgcccagccttccctttccaagttggtgccacctccaggtagccattggtggttttcctattactgatgtggctgtggaatgataaggtcctagaggggccctggcatttcaggaagcggacctggtattccctgacaaacattgcttaggaaagagggccggagaataagaagccagcacctcatcagtcagccctgcaatgtgagacttccgtagctgttgagagtcactgcaggtgttctttcatcccatctgattttaacccatggttgagacgttccaagttagatctgctgctcttaggtgtggggctgtccacattagggaacttgcctcaaaaacagtccacagtggcaataccggacttctgttcaagctttttaaagtgctgagccttacaaacccctgaaggaaagtgaccctttaagagaggatcatctttttttatatttattttcaccaaatagggtgatgagggttggtttttgttccctcaacccatttgggtaaaataacggatctgattagaaactgttttaaggaggggctgggctcggtggctcacgcctgtaat

SEQ ID NO: 12808 - DNA, 1235 bp, Homo sapiens
tgcctacgcctggcctgccagccctgaacgtgtccagccagcagcatggaaggctctgggctccggctggtgctcaggatctccttcctgagaaggggactgtggggcacgtggaggggacccaggaggtgaggggtccccaggaacccctcctgtgctgcagccccacgcccagagtctgtgtcctgccctttgcttgcagggtgagcgagccacaggcttcggtgtggccctcctgctggcgctcttcggccgtgcctctgaggaccctctgctgaacctggtgtccccactgggctgtgaggtggatgtcgaggagggggacctggggagggactccaagagacgcaggcttgtgtgagcctcctgcctcggccctgacaaacggggatcttttacctcactttgcactgattaattttaagcaattgaaagattgcccttcatatgggttttggtttgtctttctggtcgtcagcgtggtggtggaaacagctgaagttttaggagacagcttagggtttggtgcgggccacggggaggggaccgggaagcgctggggcttgtttctgtttgttacttacaggactgagacatcttctgtaaactgctacccctggggccttctgcaccccggggtgaggcctcctgcctgcctggtgccctgtcccagccccaggtcctgtgcagggcacctgcgtggctgacagccaggctcttactccagccggggctgccagcgcatccagccagcccagccctgtgaaagatggagctgacttgctgcaggggacctgatttatagggcaagagaagtcacactccggcctctcagaattcacttgaggttcaattaaatacagtcacaccgccccctcacctggcctcgttcttctttctccccctccattttagaaacgggtcctggagcccatctagggaatgtagtgcagggctgcctcctgcttctcccagaccggctctggctttgagccccagctggtcaacccagtgttgatgacaggagcccaggacctggggaggacagggggccgctgggcctaggcctggccttcctgaccattttgattttctgggtgcacacagcacagactccaggtggaagtgctgtgggctcctgaactctctacagcccggcagcctgcacggaggccgttctgtctctcgagggtcctggagcctgcgctgtgtgaggtcgactgtgcttccgtgcc

SEQ ID NO: 12809 - DNA, 1235 bp, Homo sapiens; identical to SEQ ID NO: 12808

SEQ ID NO: 12810 - DNA, 1034 bp, Homo sapiens
ttgtctccagcgggacgcacggcgtgcgccccgccgtccaacaagcctttggccaccagggcgcccctggcatcctgggaagtttgggggagccctcgccgcctcaccctgacccccgatcccaggctgaccagctgagcctcctctcttcccactcgcccctgacctgcctttccttctcacctcctttccacctgcgctgctcccacaccgccctcaggctccccagtttagcggtgggcaactaacctgaatccatgaaaacaaggagaatctggacggcgtcctccattagtgacgccggatggggatgggtccctttttggaaggggactccggggacgcgtcacggcgggtgggcttctttggcttgcagcgacgccgctgcttctcctccttgggctccttcgactcttcggggtcccttggatctttgtcctcgggcttgagctcctccccttccctggggctctggggctcctgagtgctgggcggcgcgcgacttggggaggcgtcggggcttcgcaacttgagagcgtgcagacgctgggtgagggactggccgaaggtggagtgcttgggcaccaccgggccgcgatcgtcttcaggctcggtctcgggctcagtggtgggggcggtctcaggctcggtctcgaagtcggtctcggactcgatttcggactcggtctcgctctcggtctcgtagtcgaactcttcctcgtactctaggcactcggggagggacagctcaaggtctgcctcctcgtgctcgtggtcagattccgattcgggggactcagggaatacctgggcgccggagcggtggtgggcgttaaggaagctccggcgctgttgggcagccgcgcgctgctgggcacgggcgttggaggtggcaagggcgcggaggagcgcgatggagcaggagagccagaggagcgcggtggctgcccggcggcctatgggcgggcacaggtcgttgtaattatggcgagctcggcgccactgctgagcccgggacctccgatccatcctct

SEQ ID NO: 12811 - DNA, 1202 bp, Homo sapiens
gccgccgccgccgcggccgctcctcggccctcctcctcctcctcctccttccacccccctcgccgccgccgcctcctcctccccccgcctccccccgcccgccgcggcgcttttggctcggggcggcggcgggggcccggccgaggcaataagagcggcggcggcggcagcggcggcagcagctcccgcagctcctgctctggtccgcctcggcccggcggcggccatcagccccctcggcctcggctcgaggggcggggagctgcgcgcgcccctcggtccgaccgacaccctccccttcccgcccgtccgcgcgccccgcggcccgcggcccgcagtccgccccgcgcgctccttgccgaggagccgagcccgcgcccggcccgcccgcccggcgctgccccggccctcccggcccgcgtgaggccgcccgcgcccgccgccgccgcagcccggccgcgccccgccgccgccgccgccgccatgggctgcctcgggaacagtaagaccgaggaccagcgcaacgaggagaaggcgcagcgtgaggccaacaaaaagatcgagaagcagctgcagaaggacaagcaggtctaccgggccacgcaccgcctgctgctgctgggtaagggcgggcggggggcgccggccccggcccgggggccctcgaagggcgccccgcaggccgcgcgcgccgagcccgccccccgccccgggcgcgcgctcccgagccccccgcccgttcgcgggctctgtctgtggggggcgaggccggaagggggacccaggggcgcggattcggccgggcgggggctcaaaaacggggcggggggccgtggcgacgcgggcgcgggtccccctcccccggcctgcccgctcagtgtctctctcttgctctcgctctcgctctccccctctttctctctttctctctttttccgcgaggcctacacgacgccaggggtttgggtgcgtgttggggagggggagggggagcccatggggctccggagactgcgacaaaaagagggtttcggggacaggaaaccgggtggcgggtagagggagggggacccgcctccgtggggtgtgagatttgttgggagagggaaagaggggaagaaaggggcgaggagaggagggggtgacgctggggggcgccgtggtggcggagggggcctcgccaaagggaggctttggcgggg

SEQ ID NO: 12812 - DNA, 1250 bp, Homo sapiens
gtatcagaacaataactttttattagtcctactaacatctgaacttttatgttcctacctacaagtcccccatcatcattttttttggtaagattcacattttcccaggaggaaaatttagtcccagcacatcttacaaatgaagtttcttattttcacaacattgaaccatttattggcatattctaacacatttagtgtatattcttcctaaacaattctgtgaagaaactaaattactcagtagcttaccccattccccctacacacgagaaaagaaactacccaaaaccagtaattcacaataagacccagcagctaattgcgtgaacttttgaatatgtttaacgtgttgaattaaagttctttgtgagcattaattcattaattgggctcaaaattcaaaatcacaccaagtgtcggtcacatagggaactctggtctcagggtttgaatgacagtgttgttgattagttcaagctcttgcctttctctaaactttcttgtgttcactttcaggaattctatgagcatgccaaggctctgtgggaggatgaaggagtgcgtgcctgctacgaacgctccaacgagtaccagctgattgactgtgcccagtagtaagtaaccgccacccaacccatcagcacataaaacagacaaaaacaagaaaacatgaaaacctgtgatcctgctttgaaagttacttgttgatgattcctttcttagaagccaaccagttaccccactggcagaaagttctaatctgattcaattgtttatttataaagtccttaattgcattttttttcttttagtgcagcgacattattttacataaacatttaaagcctgttagagcaaaatgatgatgagtttcatagtattcctaattagtaggaagtaattaattgaattgaccctaagcatttagggaaatagggctgtgctcacattttgaataatgtaaaaatactatattttattgctgtaattttaaaacataacaaagaggaatggtgaagacatagctacgcctcctctctccttggtagttgttgattgatctatttctgctctcaggtaagcgactctagtagctgcctagtgttactagatcctagtgactctaggtagagtttgtttttgtgttgtcttgacttttgaactctatttcatatccttatttattccttctcaccgggtcttgattcaaggatggtaagtggtcaatggattttaaatcctaaact

SEQ ID NO: 12813 - DNA, 2851 bp, Homo sapiens
agcaatttgaaaattaaaatgtttttgtcaggcattaccaaatggcacagaatgtgataggccagcctggttttggggtcctttctctactggttgatatgcataaaaccttctaaaaatcaagaatattgccagagagcaacaggaataaagaagctaagtaaagaataaaaaagaaaaatagaaaaaataaaaataaacacgaagaacaaagccccaccaccgtgctgtgctgtttgtgtggccccactgcgtcgaggccacaggctagctgctagacgcatctagagttccctgattcctaaaattatttatcttaaatcctgtttgccctaaccttcttaaggcatcagctttgagttacaaatgtaaccaacacacaagcaaatgtgccattgacttagtgctgcataactgtgggacggtcacttccgttgagcctgaccttgtagagagacacaaatagttggcaaattgatgtgagcgctgtgaacaccccacgtgtctttctttttctcccagcttcctggacaagatcgacgtgatcaagcaggctgactatgtgccgagcgatcaggtgtgcaaaacccctccccaccagaggactctgagccctctttccaaactactccagacctttgctttagattggcaattattactgtttcggttggctttggtgagatccattgacctcaattttgtttcaggacctgcttcgctgccgtgtcctgacttctggaatctttgagaccaagttccaggtggacaaagtcaacttccagtaagccaactgttacctttttatataacagagatcatggtttcttgacattcaccccagtccctctggaataaccagctgtcctcctccccaccagcatgtttgacgtgggtggccagcgcgatgaacgccgcaagtggatccagtgcttcaacggtaggatgctgtgggcttggctgttcgtaaagaacgctttgcttctgtgttgttagggatcagggtcgctgctcacgctcttggctttgctctctttggttaagatgtgactgccatcatcttcgtggtggccagcagcagctacaacatggtcatccgggaggacaaccagaccaaccgcctgcaggaggctctgaacctcttcaagagcatctggaacaacaggtttgtggagtgaccgcccaccccctgcgcttgcccaggaggccctggtctgcactgtttatagagaagaaccccgtgcaagcattccagacccctggccgaaagcgcgcttctcccaagcattcacacggcctcccttcttgtagatggctgcgcaccatctctgtgatcctgttcctcaacaagcaagatctgctcgctgagaaagtccttgctgggaaatcgaagattgaggactactttccagaatttgctcgctacactactcctgaggatggtgtgtatggcttccactcttgctggctgttcattgcggtggttctttttcaaacggtcaggctgaaaacccccatccccctcccaccaccaaaccataaaggatctataagagaagcaagaaaaacgcactcccactaattctcatatggaaaaatcagggttttgaagacttcaggagctacagagatgctagcaccccagctctgcttgaattttaaattacattaatatgtattccctttttatatagctactcccgagcccggagaggacccacgcgtgacccgggccaagtacttcattcgagatgagtttctggtgagtcgagcctgtctttagtttcctctcttgttcctcctctttttctcatggatgtaaatttacttaattccaaattcaggggttcagctacccagttccatggttttagttcacgcacatccagtgtggatttgagctctttgcgcccctctttttgcttttgttttcatatgacatcagaggctggctgacagccgtccctggtaggtgtccccatcagggatagggtggttcctggcgagggtgtcactgacaagtccccttgtttgtgcccgcagaggatcagcactgccagtggagatgggcgtcactactgctaccctcatttcacctgcgctgtggacactgagaacatccgccgtgtgttcaacgactgccgtgacatcattcagcgcatgcaccttcgtcagtacgagctgctctaagaagggaacccccaaatttaattaaagccttaagcacaattaattaaaagtgaaacgtaattgtacaagcagttaatcacccaccatagggcatgattaacaaagcaacctttcccttcccccgagtgattttgcgaaacccccttttcccttcagcttgcttagatgttccaaatttagaaagcttaaggcggcctacagaaaaaggaaaaaaggccacaaaagttccctctcactttcagtaaaaataaataaaacagcagcagcaaacaaataaaatgaaataaaagaaacaaatgaaataaatattgtgttgtgcagcattaaaaaaaatcaaaataaaaattaaatgtgagcaaagaatgatgggactcccgtgagttatttgtggttctgagcaaattcccgtcattcatggttttgacttggtccttaggtcaaaagttgggaggccccaaggtgaagtgggtataaaatctcaccactgtatgttttctggtgaccctaatctgtaggtgtcttgaaacaatttgcagacaataggaaaagtccactcctgttcctcctaaatttcaccccatagtgaaccactatgccccagtcagtcacctctgcattttgatcattgccatcctatccaaagattctaccaacaactcac

SEQ ID NO: 12814 - DNA, 1187 bp, Homo sapiens
acaaaaaaaagtacaactagaagattctttttgtttgtttaattatagccagaccattttttgtcatatgtggtaagaattgcagttttattttctcacagcaatatgaatgctggcccatcttggaataaagtgcaacattcaaagaattcttcaggaaaaaggcagagtaaatcccaagtaccccacgcttcttcccagccgagaagcagcctcacagctgtcacccagcctactgaagaaaaacttaaagaaagcatttccccggaagcaagacgcaaaaggaatccactcggttccaggtgtcagggggcctcagggaataaactgtttcttgattttcagtcaatgaaaattattaaagagaatgctgatgaggacagtgcaagtgatctctctgattcggaaagaattcccattcctccttctcccctcacacctccagatctcaatcttcgagctgaagaaattgatccagtttactttgatcttcaccctggtcagggccatacaaaacctgaatactattatcctaatttccttccatcccctttcagctcctgggacctacgagatatggccctgcttctgaacgcagagaacaaaacggaagccgtgccccgagtgggaggacttcttgggaagtatatcgatagacttattcagcttgagtggctgcaagtccagactgtacagtgtgaaaaagcaaaggggggcaaagcaaggccccccactgcccctgggacctcaggggcactgaaaagccctgggagaagtaagctaattgctagtgctctgtccaagccactacctcaccaggaaggggcttcaaagtcaggcccttcccgaaagaaagcttttcaccatgaagaaatccacccatcacattatgcatttgagacttcccctagacccattgatgtgcttggtggtaccaggttttgttctcagaggcaaacccttgaaatgaggacagaagaaaagaaaaagaaatcaagtaagagtacgaagctgcagcgctgggatctgtccggcagtggaagcagctctaaggtggaaaccagcggtcacattcgagttcccaaacaggcagctgtgattctggactcagcagattcctgtaaggcctccaaaacacaagcacatgcacatcctaggaaaaagggaaaggcagagagctgtggtca

SEQ ID NO: 12815 - DNA, 1154 bp, Homo sapiens
tttctgcctcagattgactattttaaccaatattgtcacgactagatcatagctcctagtgaataacatgaggtgttttaaagttaggtctattacagaattaacataagcacaattttaattttatgatatctgatatgcctatctaatacatcttaatgcattaaatgctgcagataagaatcttgctatttttcaagtagacaacattagaaagttgaatcatgaactcattcaattcatcaagtcaaaagcactgagtgttttgctagtctagtgacatgggttattgtatttccgagaagtgcctctcatttctggggagttgtttacatataccctgcatttaaaccaattaaaacaatccaagtttctttaaaaaaaaaaagaaaaagaaaaagaaaaagaaaaatattttaggcttagaattatctaatggaaaaaatgtaaaaaagtacaaaaatgaactaaaagtatatcagtatttgcagtatttgctgtgattacttaggtttagactttctcaacttcttagatgactaaatgggctgaagacttgtaactaacttgaataggatagacttcataccctgtgacaaaaaggatggggaagagaatatcattggtcttgccatatacctcctagctaaaaggaaaatggtttgtagttgttcttgggcctactgtgttgcttttcagaaggacataagactttctactttatctgatatggatatcgtctacttcctcattcctttatgctcacttatggagtagttacatagaaatataactcttggtggtactgtattttaaggtaattcagaagcagtatgtattatttatgtacatgtacaggacaccattcaaaatggcttgaaaatattcagcatgtttgttatttgctgttatattgtatgtttagttttgtatgtgataaacagaattgatgtaagtttttgtggacttgaatttctccttccttgagatcaattaaacagcagaaaaatattgtctggatttttctggtattgttttgttttgcttttcatgcagttctcttctgaagcttgcctttattttctccctggttatttaaaggaattgcccaggatgaaatgctgttacaactcctgtcttaacactaagcgaca

SEQ ID NO: 12816 - DNA, 1210 bp, Homo sapiens
ctcaagtgccatttttccactgggaagctcctggccccaccctgcatccacgtggtcaggttgatctcagacccaggtagatctctgtcacctaccggcaaaagggtttggagcatccacttccatatcaaaatgtcaatctttagaaatctgccctgggcagaaatctgacaaatattttttaagcacttgctatgttctagggactgtaacaagcacagaggaactggcagtgagcctgccctctgccttcgtggagctcatcttggtggtcaggcaactttttaacatgctacggccaggctgtctgctcagattaagaggacattggagtgactgtcctctggtctagtcactcccctcccaaatatccaaatcccaaagagccagttctgcaggcgacatcactacttcccatctgagagtgggtccaccgcaggccatgtgggctgtcagagacagccctgtgtacttccctgtgtgccagttatccctgagtcgtcttccagcactgcccccagatctgtcccttctcccacagccaccgaaggaataaatcttgcttaaaacgcgtacatcccagcgctaagaccctggcaggcgatgcaccctacctactcccaagatttacatcctgagtgtgaaagtcaataaaaactaattaaatgtttacctcatttccttggtaatgacccttacatgccactaattgtcaaactgaatctatatgcaggcgttccctctattggggtcagggctaatttctgcatacacaaagaaacatcaccgcggttatttacacctgcggccggtatgttctgtgcagatgctcgtgagctcatttccataggaggaggagttggtgccgagatttcagcgcaatgagcagggaattaggtatgcaacaaccatgaacaataatgagagccatgcacctaattccccggcatcatcttaaaaatttgttgtattaaataatgctgtaatgttatgttaagtaatgcaatgttaagtaacattgacttcagcctcattaaataatctccttaactatcatactggaaaactagtatcattagacaaatgctatttgtcatcagccatgatgtaattgttgcagaagattccatgctaaggaaagaattaataaacaaagcaccacaaatagagtgccctcctcaaggagcacaaaaagaaaagtgagaggatc

SEQ ID NO: 12817 - DNA, 1150 bp, Homo sapiens
atctgcctgcccccttagggaggagctgagcttcagccacatggcccagccctcacctcccccacaccaccccttgccctctcccacacccccctgcccttcccctataaaccctcacagccccccaccctctcccacacctccaccttcccccacaccccttccccacaccccctccccttcccccacaccccctcccccacaccccctcccccctctcccacacccccccccccatctgcccttgggttgggaggagctgaactccagccacgggccctgcccaaccctccgcctcccctgcccacagactgctgctggatttgagtttgccccttcaacactcccacgctccatcttcacaaatgcccttttctactcggaaatgcccttcagttaaatgcagagagcccttattggacacctactttatgcaacgtcctacctccctacctcttcttctgggcctcgctttccgttccatctgatcccggggctgagacaacgcgtcctgcaccctaactctgtgtctgtgacccccagggactccgcgctgctgacaacgaccccacggcacccccctatgactccctgctggtcttcgactacgaggggagcggctccaccgcaggctccgtcagctccctgaactcatccagttccggggaccaagactacgattacctcaacgactgggggcccagattcaagaagctggcggacatgtatggaggtggtgaagaggattgactgacctcgcatcttcggaccgaagtgagagccgtgctcggacgccggaggagcaggactgagcagaggcggccggtcttcccgactccctgcggctgtgtccttagtgctgttaggaggccccccaatccccacgttgagctgtctagcatgagcacccacccccacagcgccctgcacccggccgctgcccagcaccgcgctggctggcactgaaggacagcaagaggcactctgtcttcacttgaatttcctagaacagaagcactgtttttaaaaaaaaaaaaaaaaaaagaagaaagaaagaaaaaaaaaaaaaaaagaaagtgccttttggtatgtatcagattccctcaaactcaggagtgtctaaagcagacagaccgtccccaccttccca

SEQ ID NO: 12818 - DNA, 1232 bp, Homo sapiens
tccatgcttcagtccttcggagtatgcgtggattgttcgaagtgtgactatggcccgggagccagggcagcatgaactcctttctctgaaatttcgaggcctccttgggttccctgaactccgggctgatgttcccaggacccagcaccaggagaccccagtcccgccagcagccgccgctacccaggagggctgggcgacattggccgcctcccactagctccccctcctcgcccacagcctcttgtcactgccaagcccccgttccttttgcccaaatcacgcaggcggaagctgcagtgccagctggagggatgttcatagggcttcctgtgcccatccctgctccaaacagctggacagcttcccctctacccccaccctggtgagcccctgggggccagagaaagatggggttcctgcaccttcccagctccacctctgaacttgagttagcgttagctaagcatacaatcagtgtcgaacgtctctcttccttaagcttgtagatacgactgcctataatcaggggactcccactggaggccgggaggccaatgctggccaggtgcgagggcatggtttggttcctttagggaatttttgttttgcaaacaggagaaacctgtgctgcaggttggagtggcaggaacgactggccttggtcagcaggcagcccccagcctagggccacagtcctcttcagggcctgggcagccccaatttctggcccagcaggtttctctttgtagtgtctttcagcacatccaaaatgctaggcctcctgccaccaacgtgtcagagcaatgtccaactgtcaggctctcagagatgcctcagtttccctagcatgagcaccagccgacacacacagtccactgagatgataattctgttctctccaaagcaaaaagctgggcgaggggtagtctcaatttctgtcagtgctcaaaggaataacaccaaaagaatcaacacagaatctcccagacacacgtgacccagctcgtggcgccgtgggtccgtaggagggacagtacctcacaacaggcccagcgggggaccacctctctgtacaattggaatgcgttttacttttcttttctctccttttttcattccgattttttttgcatgtttctttttgaaatgggcaaaatgtgtagcagcctgcatgagcacagttgttttggggaaagatactggagtatgatgtactcacacctgcaaat

SEQ ID NO: 12819 - DNA, 1368 bp, Homo sapiens
gtgcattttggtttagttctacctaacttactatgtaggtgtatgtctacagccgatgacctcatttcgtttattttatttttgtaatagtcagttggcaaagcaaactgattttttagactatttatcttccttcccttcccctcccaccccgctctcctctctgccccctgccctcccctcccctcccttcccctccactccgctgagaatcctggaggaatacacaattcatcgttgcacccccacctcagagtgtaatcgcatttctgcttggtagaggccgagcccagcaaaggtggctccttctgaatgtgtggtcagcatctgtacaaatgcattttatttgctatagtttgtaaagctgtaaagttaaaagagatgaaaaccttttcagcataaatatattttacttgcactgtgttttttagctaaaagtgaaaacctagattaaataaaatcaaagttgagaagaatcatcaaaagactgtttctcggtgtgaatcaagtgttgaaaaatggttggtgtattttgtcagtaattgtacataacttttggcacatgacatagaaatggctatgtaaactataattattttgctaagagactgtatgcaagccttgggccgactttacagacgtccagagcaaagccccttctttgtacctatttttttattacaaatatactaattggttctttctattttcagaggttattgtatgaaattgtctattgatagtacttttatgactgtaaatactctggctttctccgtgtgaattctcacattagactttaattcgagcgcgtgtgaactgaacgctgatcagtattttttatcaacacctgagaactgttacaccttttattttgtcttttaggaaatccctgtctttccattttttcatgtaaattttgcacagttacttgttcatatgtaaatattttactttcagaaatgaagtttttaattgctattgttttatataggattgaaagaaaattaactcctttattaaaaacaaatttatctgtatttgttttgcctatttttcctccgttttccagttttagattctactgccagattgcactccggctctgctgaggtgctggtttctgagccacctgttggaatctgtagctgagccccatcagagccgggagaaagaactttctctgtgaggacaggggccgagctactctctgcgtggagtctgggggctggcggctgcgcttaacaccttctgctgtcacaggtggagatgagctgggcacagctaggaggggcggcgggaggcccagtgctgggggagatgtacacagaaacgcacgtggcgagcccggctgaggtgcccagaggg

SEQ ID NO: 12820 - DNA, 1600 bp, Homo sapiens
gtctcaatggcatcctgcttctggaggggatgcccttgtctgtaggaaacacgtgcagaatgttccgggtggaggaaagtcaggttagcaactttcaggtgattcaggaaaaaattgtgcgtactcttcttccaacttctgagcctttaaaaagaatttaatgctgcctctggctttaaaaagctttgcatagatcagacccccacaagtccccgcgctgctcccggctttgctttctctggacttgagtcccctgcgcatctgtgtgtagatgttaacccggcgccaactcacagctctccttccgcagaacaatcgagctttccaggaaagcagcgaggcaccctctctgctgtggcagatgcagcaggtgcaggtgcggggaggacagaggcctggcctcctcacggccctgccttccacgtggggtttcctgcccttaccaccccagcccacctcccgatgaattccttgtacagttaaagtgatcttcccttctttcctcaagggacgatgatgacattaatgatgttgcatcgatggctggagtaaacttgtcagaagaaagtgcaagaatattagccacgaactctgaattggtgggcacgctaacgcggtcctgtaaagatgaaaccttcctcctccaagcgcctttgcagagaagaatattagaaataggtacgttggtgtttaatgactgagttcttattaaacagctgcgctgctggggcatgggagcttcaggtgagcacacctgacacctggtcatgtgttttgtctgagtttgtgatttccacatggttgctggtggtggttcttgggtaaaatatgggtaccactgccttccaccccaccagcctttctgggctccccttgggttgtataaaagcagtaactgctggatcagagattagccgtaaagaaagaactgtgcttaatgattttaaaatactgtttttcttgcctgacctttaggtaaaaaacatggtataacggaattacatccagatgtagtaagttatgtatcacatgccacgcaacaaaggctacagaatcttgtagagaaaatatcagaaacagctcagcagaagaacttttcttacaaggtaacaggctgtttgccgaggagagcgtctttatgttgttggcccccactctctgctggctgggagcctcctccccacaccgaggcagagggcggtgggtcccaagtgcctccatgttccttacgaacgtgttttggatttcttataggactagattttggaaagatttctttttgaggtagggtctcactctgttgcccaggctggagttcagtggcgcagtcttggctcactgcagcctccgcctcgtgggttcaagcgattcttgtgccttcgcctcccaagtagctgggattacaggcgcacaccaccgtgcccaactaatttttgtatttttaataaaagggacagggactcgcgatgtagcccaggctggtcctaaactccttgcctcaagtgatcctcctgacttggcctccttaaatgctgggattacaggcatgagcctctatgcctggcgggtttaccttttggaaggcacctgcctctctctc

SEQ ID NO: 12821 - DNA, 1125 bp, Homo sapiens
ggcagcctcacaaccggatcatgctcaccacgcctcagcagatccagctgaacccactgcagccaggtgagggcctcgcgggcccctggccgctcaacaccaagggctgctcccagagccagctgccattgggcttttatttaattgggtaaaatgtacatttacataaaattggccattttaagtatctagttcagtggcactgatttcatttactgtgttgtgtaaccatcaccactgtcagtatgatttttaattttatgtattttccatggttagcttctttatctgtaatcattcctgcactttaaaaaccttgatgaaatacaggaaaataaatgctcgagaggtacagcttacactttgtactgtaatttagagttattaatatgaagtttttggaaactttcttgtagctaattaggagagtggtagctgtgcccttgagcctgtaaagcaccaaagcacatagttgatctaataaaagccttgtgtggtttccactgtgtgtttgttttgtagtccctgtggtgaaacccgccgtgttacctggaaccaaagccctttctgctgtctcggcacaagcagctgctgcacagaaaaataaactcaaggagcctgggggaggttcgtttcggtaaggaatgggcctgtgtacgttggagaagcgtggccagagcggagaagagtccagagtccgtgctgctccattcccgcccacgggtctttcccacgtggccctggcggccggggctccaaggctcctgcttcacgctcactttgacctcacgttcacacaagtgtgttttcccatacagttggctcaaagaggttttgcttcatacacatagccagaaagcgaatcaactgattatttttatatgaactaataggaaattcattttttagtataacatcgtattttgagttcattgcattcctagtatagaatgcttcactttccatgtattcaacttcagaaccctcagaaatgctgtactgctccaggcgtagtggctcacgcttacagtgccagcactacaggaggctgaagtgggagaatcgcttgagcccgggagtttgagaccagcctgcacaacatagtaaaaccttactcaacaacaa

SEQ ID NO: 12822 - DNA, 1100 bp, Homo sapiens
ggggtctcaggagtcaggcagggccagcacagggtggcgtggggggcaggggtgggtgggtggagggcacggaaggggttttcccatggatcatgttgtataagtgaaccagaccaccctgatggcatccacagtgatgtcaaggttggggctggccaggggtgggtggactagaagcatttgggagtagtggccaggggccctggacgctagccacggagctgctgcacagagcctggtgtccacaagcttccaggttggggttggagcctgggatgagccccggcagcgccttggcccttctgtggtccctgccagcctctgacctgggccggtcagtcattgctggactctggccacacactggcgttctcatccacttggaaacaagccagtcttttctgcaaggtcagttgaccaagagcatatttcccctctgttgtacatcgttgttttgtgtttgtgttgtaacagtgggtggagggagggtggggtctacatttgttgcatgagtcgatgggtcagaactttagtatacgcatgcgtcctctgagtgacagggcattttgtcgaaaataagcaccttggtaactaaacccctctaatagctataaaggctttagttctgtattgattaagttactgtaaaagcttgggtttatttttgtaggacttaatggctaagaattagaacatagcaagggggctcctctgttggagtaatgtaaattgtaattataaataaacatgcaaacctttaaaattttcttttctgatgctctaagaatcctgttgactcttctgcccaagtcacctctgcatcatgtccaggtctggagcacacacttaggctggtggaatttggggagacttgggccccatcaggtgatggaacgaggtggctgacccaattggtcgggtgaagtgcggccagcagacccgggttctccctgtgggccacccttctgggatgaatggctctgctctcagaaactggatacaaagttcttttaaaaacccagctcacagataacacctgtatcataagcagtggcccctttgccaccttcctgctgcctccaagctccccagctcaggag

SEQ ID NO: 12823 - DNA, 1203 bp, Homo sapiens
tgccatgtcacttcaggtgaatcagaaaactgatttattctggggcgtgatcctaatcttgacttgcacaagtgtaacttgacctagctcaccaatttcagtaacattgttctgttctcagttcctggcatgggatattccaaattcctgtgtctggagggaaatgatagcttttgtcttgccatcctgagtgaccagtcacaaagcagttgaagggggctggaagccaccctatgaggacacgccattagtatgtaagcagaatgtgtgtctacctgtcaaagtaatttccagtaacctgagttcacaattctggtcctaggtgagtttttctaggagtgaaaatgcagaaaaggatgttgaaagctattggctaatgtatcatttgaactgctgataacctgagaaggggctcaggcatggtttaaaatgttcgtatcttcactaagtacggttctttcctcacatgcagtttcttaattggatggcactgacctgtttcttttcttgctagcgttatacgcagagcaatgggcgcaggccgtttggcatctctgccctcatcgtgggtttcgactttgatggcactcctaggctctatcagactgacccctcgggcacataccatgcctggaaggtgagttcgtgacaaaggggctttggacagtcttgccagaaaaaggctttgaggggtgggaggtcctgggcttcctgctgtaggccctgtatcagtgaatgagtcagtttaagttaacctagtcctatgagagcaagaaaatgattaaacattgctgtttggaagaaaatcaaagggcagcaaggtgtaagcgtagtccacataaattaaaattcttgggtgggcgtggtgactcacgcctgtaatcccagcactttgggaggccgaggcagttggatcacctgaggtcaggtgttcgagaccagcctggccaacatggcagaaccctgtctccactaaaaatacaaaaaaaatttgctgggcatggtggcacatgcctgtaatcccagctactcaggaggctgaggcaggaaaatcgcttgaacccgagaggcataggttgcagtgagccgagatcacaccactgcactccaggctgggcaacaagagcaaaactctacctcaaaaaaaaaaaaaaaaaaaaatctcccattgcctcttgatagcgcagtaaaacatacaatcgt

SEQ ID NO: 12824 - DNA, 1484 bp, Homo sapiens
gcacccagaacagggctgcgttttccttttgggctgagcatcttctgacccccctcccttgtatccggcaggtggttctacccaggcaataacccctacactgggacccccgactggttgtatgcaggggattactttgagcggaatttctccgactgcccagatatctactgagggcctggaggggcctggggcccgggaccggaggctgacgaggctggacttcctcgagtggccactgtgagcctcgtcacagcagaaaccaacttttctaacgactgagttcgcggagatagcatcatccctgatcaaggatgtaattctaattaactgttgattgccaaacatttcactctgctgtgccgtctcttcataaagcttcacttgggatcatcgtcttcattaaggtttcaacagggaaattcttcacggcgcccttttatgtggcagaaatcagctggggcttgtttagcttccagcacactctcagtcatagcatgtgtagctaaaggaagtaatgggaaggggttcatgttctctttataatgcagtggcaaaaggttctgaaagccttttaaactcgaaccagtgggggaaagatggatcttgaagctaatcctgcagagagttttatagaggccagggattgccttctaaattatgataaaacagaagtgaagagtttcagagcatcagattgagtgaaaagttgtcagattctgtattttttaacaatcttcaataatgtaaagattacttttaaaatatttaagttaaaactacttgaatagtattttgctgaagagcaagatatgcattaatcaccggttttatactgtccaaaatgaagcatccccgtgacaaaccagagtgggcagaagcatcgagagcgtgacaggaaatcccaagactgcttccgcctcagaggcgtcccggctgcgattcgctgccctgttgtcagtgaggcctggctgtcaccgcacaccgcgtccgtgtctccagggggttcctttcttctcacacgtcgcgtgtacccatagcactcttgtgtttctgtttttcccagtatgcatgtttaaaatagaagtgacaagaatcacatccggttgtgtcctgtgggagggtcagaggcagaatctacttacagtggtgtaattaaagttatttaaccaaaaataggtatgtgtccatctcagcattcacctttatcaagtgactgatttttttttcttttctttccttttttttttttttttgagacggagtttcactcttgttgcccaggctggagtgcaatggcatgatctcggctcaccgcaacctccgcctcccgggttcaagcgattctcctgcctcagcctcccaagtagctgggattacaggcacgcgccaccacacctggctgattttgtatttttagtagacacgggttttcaccatgttggtcaggctggtctcaaactcccgacctcaagtagtctgcc

SEQ ID NO: 12825 - DNA, 1496 bp, Homo sapiens
tgacactgatctgtgcacatgtgtgtgcacacgcgtgtgctcgattgtgagcgcctgccgtggccctgggccgcggtgtgctgagcgggccagttcgctgccttccactggttgaaggaaggagacgggtgtgtaaagaaccgcaccccagagggcaggagggtgagagggcttggtctggcagcagctaagtgccttcggagctctaggctccccatttgtgaaatgggcggagggggacagggcacacccgggattgcggcggatggggacagggcgcagagcatcgtgctcaggaggcgccactgccgtcccctcacctgctgggccgggtcctgtctcctcagcattgtgtggccaggcacacgcgcctctgcgtctcaggtccctcacctggaagccaggtcagaggatggctgtggtggccctgggtgagctggcgccagctcctgcccttacatgcccttcctcttgcaggaacccaagacagaccaggatgaggagcattgccggaaagtcaacgagtatctgaacaaccccccgatgcctggggcgctgggggccagcggaagcagcggccacgaactctctgcgctaggcggtaactgtcacatgtgtcacgtgagctcagggtttcctgggaggccagagtctactgtggatgactcgccccctcagcacaggttgtttggaagtggaaatagaagattctaaaagttagagaccctgtgagctccctgggtcactccccactcccaccttcacggggtaggacgggtctgcatcccaccgtcgcctcacttcaagtggtgccccctgtagggttcaggggcagccgagtgcggtgctcagcagaggcgcaggcagtgcggtggggcccgcgtggatctggctggggcaggcccgcctgagctgcagtgttttccaggtgagggtggcctgcagagcctgctgggaaacatgagccacagccagctcatgcagctcatcggaccagccggccttggaggactgggtaacgtgcgccacccgggctctcgggcagcttctgctgggaatgctttgaggcccggtctctgtttcctttaaacttctgctggctctgtctgcgtagtgtcggggagcctgtgtgtccgcaagctggttcccctttgggaatgcgcttgtttgcctgtggctagagctgggtaggcgagggcttctgggcccctggtgaggaccccagctgggtacttcagaggagggtggctggccgagcggtggggctggaggactggagggagctggggttcctgcgccctgggtcccctggccctacatggctgcctgcctgctgccagctcatggagtgcagacccgtgtgcttggcccttcagaaatgcttgtccctttgggtgggatctggactgaatcttctaatctaagcacatgaattgtgtaatgggatggaacagaaatgaccttgcttccagaacacagccgcaagtgtccacccg

SEQ ID NO: 12826 - DNA, 1053 bp, Homo sapiens
cgccacccctcatctctccgtgcccactcgccacccctcatctctccgtgcccactcgccacccctcgcctctgccctcaggactctccagtttggccacatgtccgtcacagtggagagacagatgatccaggaaaccaagggtgacacggtggcccctggggcagaggggctgctcaacctgcggccagacgacttcgtcttctacgtcggggggtaccccagtaccttcacggtgagcccgcccggcctggggcagcctgggaggggctccgcagccccgagtcgcttgtgtcctggagagccgcgggttcttttggtatcttgcctcagtccgtcctgctgtagtctgaagtccccttggtccatcctggaggggaggcgcctcaggccaggtgccctgacccagccctgtgcccacagccccctcccctgcttcgcttccccggctaccggggctgcatcgagatggacacgctgaatgaggaggtggtcagcctctacaacttcgagaggaccttccagctggacacggctgtggacaggccttgtgcccggtgcgtgtggcctgccctccccgtctccacccaccccaccccaccctccgctgaccccagaatctccgacctgcagctccaagtcgaccggggacccgtggctcacggacggctcctacctggacggcaccggcttcgcccgcatcagcttcgacagtcagatcagcaccaccaagcgcttcgagcaggagctgcggctcgtgtcctacagcggggtgctcttcttcctgaagcagcaggtgcgccaggcacacccgtcctgccatccccacttgcactgaccctgccccacactaaccctgccctgtttctgcagagccagttcctgtgcttggccgtgcaagaaggcagcctcgtgctgttgtatgactttggggctggcctgaaaaaggccgtcccactgcagcccccaccgcccctgacctcggccagcaaggcggtagggccagggtggggaccagggtggcagggagaggagatggaacgatgggggcgg

SEQ ID NO: 12827 - DNA, 1171 bp, Homo sapiens
cagtggtcagcgtggctggaaccaaggggctggcaagaccttgggcggtgaggaccagggctcccaccctgagaggcttggagcagaggacgatgtgcctcacccagtttctgagggacccctgtggctgcggactgttcccagcaagcccaggagagatggtgggggccaggtggtgggaggtgacatggggcacatgtccagggaccagctgtggcctgagaggctgggtgcctgtcctggcatggagggggcgtctggtggaggcatttaggatgggtttggattgcactgagcagcggggtgtgagggtctcacacgatccatagggggttggatgtccctgttgctggcccaacagaaagacttggggacatgaagccaggatggtccccgctggcccctgctgagcctgccctctgcccaccacagacgagacaagcaagaagatcgcacatgccaaggctgtggctgctgaagcccaggacaccgccacccgtgtgcagtcccagctgcaggccatgcaggagaatgtggagcggtggcagggccagtacgagggcctgcggggccaggacctgggccaggcagtgcttgacgcaggccactcaggtgcgcccatggccctcgcggtgcccctgatggaggcgggcacggtggggggcaaaggtctcaggtctccctctctgcagtgtccaccctggagaagacgctgccccagctgctggccaagctgagcatcctggagaaccgtggggtgcacaacgccagcctggccctgtccgccagcattggccgcgtgcgagagctcattgcccaggcccggggggctgccagtaaggtgggtgagagtcccaggggaaggtggacatcagggagggtggtggtggacgctgatggaccgtgccccgcaggtcaaggtgcccatgaagttcaacgggcgctcaggggtgcagctgcgcaccccacgggatcttgccgaccttgctgcctacactgccctcaagttctacctgcagggcccagagcctgagcctgggcagggtaccgaggatcgctttgtgatgtacatgggcagccgccaggtaccaggctggctgggtggatgcggcccgagctcaggctctgtttggaaatgagcggtgcctggtccctggtccccggtccccat

SEQ ID NO: 12828 - DNA, 1246 bp, Homo sapiens
gcctccccaggaaatgtgccggttagatgttcgcgctcacagatatcccgtagtgcacactgagacatgggactcaggagagatttggctccctgagcctgcctaacaggacctgccagcccagcctgggggtcggcagggggtgccatgtcagagagagctggccagggagcagggtgggccaggcggagaggggcaggacgagaaggctcagaagctggctgagcagactggtgtcagggtgttggaggcactgcaggaggtgagggccgggcaggtgaggcagctgtggcctttcgccaggtgctctaggggccacccaggtgcgctcaggttccgggcccctggcctgccaaggatggcagggctggggtcttgggcttggaagccagcaggcagaggtgcactagtacgggcggccccaggctctgacgaacccctgccccacagagctcatgtcccagacgggccacctggggctggccaatgcctcggctccatcaggtgagcagctgctccggacactggccgaggtggagcggctgctctgggagatgcgggcccgggacctgggggccccgcaggcagcagctgaggctgagttggctgcagcacagagatgtgagtggtgttgtccctggcaggcggggtggggagaggcagggacctgggagctccaagggggaggtcagcatggagtggcatcaggtgggcatcacggggcagatggatctggcgggcaccaagtggagaccaggggtcatgaaggggcctggcttccagagtgaccaccctcaccctggtctcggctagtgctggcccgggtgcaggagcagctgagcagcctctgggaggagaaccaggcactggccacacaaacccgcgaccggctggcccagcacgaggccggcctcatggacctgcgagaggctttgaaccgggcagtggacgccacacgggaggcccaggagctcaacagccgcaaccaggagcgcctggaggaagccctggtgaggaccccggacttgttcttcctcctgctcctcttcccgcctcctccctgcaatccctctcctctccggctcctcccctcccctcccctcgtcctcccctccctccgtcctcccctccctcgtcctccccccctcctcctcttcttccccccctcctcctcttcctcccctcccctcgtactcccctccccctcctcctcttcctcctccccctctccccttctcctctctcc

SEQ ID NO: 12829 - DNA, 1204 bp, Homo sapiens
gagggctgggcccagatctggcctctccctccggcctcatcagctgaaagtgtccttacgggcctttcggggcagctggggcttcctagaagcttttgggagagtcatccccattggcaggtgggtaccaggaacccggggtcaggcacctggcacctgccgaccactctcactgtcctctcatccctaggagaacgtgcagggccccaaatgtgaccagtgcagccttgggaccttctcactggatgctgccaaccccaaaggttgcacccgctgcttctgctttggggccacggagcgctgccggagctcgtcctacacccgccaggaggtgcgcctgcaggactgagggcattgccttctcggggaggtcttaggtgggactggatgcaagatggggccctgtgatgtgtgggcatccacccgtgtgcagccacacgtgtgtgcccacagttcgtggatatggagggatgggtgctgctgagcactgaccggcaggtggtgccccacgagcggcagccagggacggagatgctccgtgcagacctgcggcacgtgcctgaggctgtgcccgaggctttccccgagctgtactggcaggccccaccctcctacctgggggaccgggtaagcagggcatcaggtctgggggaggcactttgaggatggccaggacgcctgagagggttgggagccaggagcggggtctgtccagggagggggagctccatgggggtccgtgagggtgcccaggccctgtcccggtagggaatgagcgcaagtatccaggcccagcacagggctctgtgctgggggtgcccagaccactgctgacgggctctgagcctgtggccagagtctggccaggtcacctctgtctgtcctgcctccaggtgtcatcctacggtgggaccctccgttatgaactgcactcagagacccagcggggagatgtctttgtccccatggagagcaggccggatgtggtgctgcaggtgagggagctgagatgatgtggcagggtggttgggtgggcgtggcgcagtggcaccgtggtccaggcccgtgccaaccctcacctccccatgtgccttcccagggcaaccagatgagcatcacattcctggagccggcataccccacgcctggccacgttcaccgtgggcagctgcagctggtggaggtgaggggagctggcttgggc

SEQ ID NO: 12830 - DNA, 1151 bp, Homo sapiens
cagggctgggctgggctgggctgggctgctgctgccaggactctgagctgcctgcaggaccctggtcccagccagcctctgggggcctccccgctgcaggctctgggcccgcgggagagtgaccaggcctcaccccctaggattatgtactcgtggtccctgagaacgtctacagctttggctacctccgggaggagcccctggataaatcctatgacttcatcagccactgcgcagcccagggctaccacatcaggtgggcagggctctggcaggtcaggggtccggggtgggggtctgggccgggagctggcctcaccacgtgcccctccatgtagccccagcagctcatccctgttctgccgaaacgctgctgcttccctctccctcttctataacaacggagcccgtccatgtggctgccacgaagtaggtgctacaggccccacgtgtgagcccttcgggggccagtgtccctgccatgcccatgtcattggccgtgactgctcccgctgtgccaccggatactggggcttccccaactgcaggcgtgagtaccccagtccttgggcgcccagtggcagggagttggtgccagagcccaaggtggacgggtcgaccagaaagcagggtcaggagaatgttctagagcctggcagggcagcattgctgccccatctgcgggcctgggcccaggactccagcttgcgggccatgcagaaggtttcagggaccagcaggtggtccacagtctctgacgatgatgttgattctgagcagctgcctccatgtcaggagctgtccaaggctcagcacccggggcaggggtccctgttcttgtctcccccgcccccgtcacactgccacatcccctagggctgcattctgggcctctgagaggggcgggactgggaagaggggtcagtaaaccctgtacccgccccacagcctgtgactgcggtgcccgcctctgtgacgagctcacgggccagtgcatctgcccgccacgcaccatcccgcccgactgcctgctgtgccagccccagacctttggctgccaccccctggtcggctgtgaggagtgtaactgctcagggcccggcatccaggagctcacagaccctacctgtgacacagacagcggccagtgc

SEQ ID NO: 12831 - DNA, 1173 bp, Homo sapiens
gtgcctgccccaaaatagccgatttttaaaaataactcaggcagcttttgtttggcttttgctttaaaagacttttttttttctttctgcacagaaccatgtagcagcggaaaggtcagcactggcagctgagctgagcggggcgtggagggggaagggcggtcccgaagccaggggtctgcgctcgctccgggtcatggcgagggcggccggtgtggccctgggagccgcgaccaggtcagagacagatgggagtcctccagcgcgggcttcccttcctgtgaccatctgtgcagccaccaggccctcgaggacagctgtccagggcccctgtctgacagacagatggttgggatgggggacagacaggaggccaggatcttcctgtgcatcccaggggtggggagggcgaagtgtctgtgtccccctcatcctgctgatcagtgtcttcaagtcaatatttgtgcaagtgctctcagctgggaaaaatgtgactggcctgctgaaggggagggaggaggacagatcgggccgaggagagcgcagcctccatccaggcactcagggaacagcgggggcggctcccagggggctcagtcgggacctttagtctccttcggagcctttggtgggaggggctgtgttgccagctccccgagaacagcctgtgtccctgcccctgtccacctctagcgggtccttccctgtccaggcacaggggccactggcccccacctggggctctctggaatgcttgtggtcaggcccacagggggctgctgaggcccgggtgtggggctgggtatagggtctgtccctgaagaggctcatacccctccctgctgggcagggcatgtctccctgccccccacccacagggaggtagacgatgacctcagagcctggcagccggtgaataggcctgtgccccgccccaaccccggaaggctgcgcttggctcccacagtccccgcaacgccaagccctccgagaagggtgggatttggacctgggatgtctggagtcctggaaccttgccccctacctggagtctgggcagctggtgcccccaagggctgaagctatgaggggtctgtggtcttttcatgggggaccccacagcagtctcagtccggctcagtccagtggggtgactgtaggtcttgtgcagct

SEQ ID NO: 12832 - DNA, 1365 bp, Homo sapiens
cacaatggggggcacgcccgtatctctagcccggccggcagcgggcagcgaggctcagtcctcgccccttctcccagctgctattcggggctcccgaggcgctcagaggggtcgactgcgtccgtggggcacaacccaggggccaggctaagacgccacacacggcaacgaccctcaacgacaacgacccccacgacgccccgcgccccagggccagcaggctggggtccgagaacctccttgccggaagcggaagtgcgtcacggcgacggccggcaagcacgcaccgcgcagactcgctgtggtggcgtgacccggaagcgctcgccgaggcccctccttgcccgccgatatctctgccgggtgactagctgcttcctttctctctcgcgcgcggtgtggtggcagcaggtgtggcgcgcggcgcgggcttcgggctcagggctggggctggggcgggagtgggggcttggacgcgggggacggggtgcggggtgctgggtgcggctggggccgtgaccctaggggccggtttgcgccgggagccggggcacggttccggccgtactcacggcgccgcgcggtgactccccaggcgcagcccagcctcgaaatgcagaacgacgccggcgagttcgtggacctgtacgtgccgcggaaatggtaagcgccccccacatgcctctcttccgtccttacctaaccaccacgtcccctcgcctgcccttgttcccccacacccctcccgtccttacctcgtcacgtccctaacttgtcctgcccccgacgttactcttttccattcatatacccccaacctccctcgtcccctctttcattcttaccgcccaagtcccctctgctcactgcgccctttctccacagctccgctagcaatcgcatcatcggtgccaaggaccacgcatccatccagatgaacgtggccgaggtgagctgggagcccgggaggcgggaaggttgtgatatatgtgcgggaaaggcaggctgtcccattgtggaggagcccctggggtgaaggtacaggcagaggctggctttgaggattggtgtttcccaaacctgggggagtggtttgtgacccttcttctctttctaggttgacaaggtcacaggcaggtttaatggccagtttaaaacttatgctatctgcggggccattcgtaggatggtgagtgtttccctgggctttgctcatcacttcgggacatcgtggactttaccgtgcgcattggagtgtgtgatggtgcctgagtagatctgctggcagagtagtttgagccagctggactgggctggccgcctgccgcttcttgagggtggaagaggggtgctctgagaagacac

SEQ ID NO: 12833 - DNA, 1218 bp, Homo sapiens
ccccccaaacctgtcccctctccacctgtcccctcacctgtgccctcctcacttgtcagcccagaagctagatgccagctaatcgcaattttttactgttggtggccactcaggcttcgacaaatgtccttgtcacagcctgcagggactcggcagaggcccctgggggaggagggggtgtggctgccctggaggggggtcagtggaggagtcattggcttcccactggggcaggggccgctgaccttggagcactctgggctctcctcctccccccgccccgccccgcccccccgctcccccttccccttccccttccccttccccttcccctctgaggcatccccgctgtgggctctggacagaggtccctcctagggctctatcagcgcaacagctaagcactcaggtgtggtgttgagtgctgccatgcaggcaggaattgatccctctatgcctcagtttccccacctgtaaagtggacccggctgatccaccaccctctcccaccacggccccctgcctgagtccctggctgaatccctccctctccccagggtacctggtggtgccagcgggtggtggcggcaccttcctgggcggcttctttgtgaacaagctcaggctccggggctccgcggtcatcaagttctgcctgttctgcaccgttgtcagcctgctgggcatcctcgtcttctcactgcactgccccagtgtgcccatggcgggcgtcacagccagctacggcgggaggtgagggccagatggcacctgggtacgcgtcggggccccaagcacccgcggtccctgggcatggaggaggagtggtgcagcacttgggagaggtggttttgaaaagggctacgtcacaggacagcggcaagggcaacacccgctcagcagggcacccggcagcatccacgtgaaaaggcaccatgccagcccccagcagtgcctgcgcttgggtcccggctgtgcccccgggcagtcatatgcctctctgggcctcagcactctgctctgtagctgtgtcaaatggaacaacagccctagtgttcggggtccttgaggctggtctctcggtgacataaaaagtgtcccaggatgtgctcctggagttgccatgtgctgggagtgggagggacacctgctggtcaggtggcaattagggaatatccaaaatacacgtaggtagcctgcacctcggccctgccctgc

SEQ ID NO: 12834 - DNA, 1243 bp, Homo sapiens
cctgtggacacgtggcccctccgggggttatcctccaagggacattcttctgatggggacatcctctggggggatttctcttgggggacagaaatattcctggaagaggggattctctgcggggcaggcatcctccggggagagaatcctgctgggaggacatcgtcgggaagacatccttcctaggtacccggctcatcttccggggagaccgtcctctggggggcgggcaggctttggggacattttcgggagggaggatctcctagggcgggcatccttgcgagacggggtggggcgaatcctcccgggtgggcatcgtggggtgggggtgggcgttccgcgaggggcatcctcccgggcggacgttgggggattctcgggggagggaggggcgcggggcgggcgtcccggggagggaggggcgttgcgcgcggacgcgggcggggcctgggccgctccgtcccctccccccgcccgccccccgcgcttcctctgctttcggtttcgcttccgcctccagcgcgagccccgccgccgccgagcatggacgaccccgactgcgactccacctgggaggaggacgaggaggatgcggaggacgcggaggacgaggactgcgaggacggcgaggccgccggcgcgagggacgcggacgcaggggacgaggacgaggagtcggaggagccgcgggcggcgcggcccagctcgttccaggtgcggccccgcggcgcggaagaggcctggggtccccggcgccccccgcccggctgcgtggacgggagacccccccatcccgggcggagacacctggagcctcctggagctcccgcagccccggggacccccccccagaccggccgacccccagccccagggcccggcggggaagtgcgggggccgcgcgtgggtgacagcggagctgagcctcccgggccccatcgtgtgtgggcgccgttccccccgggggtgcctcgggcgcgtcccgcccccagccgccgtggccgcccctgatggaacccctcccgcctcgggcccgcgcctcggcctcctggcggcccctgcgcaggccccgcggcctggggctggggctggggctggggctggggctggggcccgggccgggtctggcctgggaggcttcgcgtctgcacctgcgggagcccggggcgggccgacggggcctccgcttgttacttttgttaccgccgggcgcctgtcatcgccggggttacttttgttg

SEQ ID NO: 12835 - DNA, 1328 bp, Homo sapiens
gagattgtcctgcctcagcctcccaagtagctggggtcacaagatgcttgccaccacgcccagctaatttttgtatttttagtagagatggggtttcaccatgttaatcaggctggtcctgaactcctgacgtcaggtgatccacccacctcggcctcccaaagtgctgggattataggcgtgagccgccacgcccggcctgaaacgttttaatatatacactctaccttctctcacacgctgggtttacaggtttattagctagggcccattagcggttgaaacgttcatgtcatgtatattttaccacaataaaatcaatacagtgtggccagacattctgagtattggaaaaacaaaagtacatgtacagtgtaactgctatttgaaaaaaaaaaagttaaaatctgtttattatataaatccccttgtgaggtaagacacaagtttgtgaatgacaccttaaaacagcgtattctaaagtcatttacttagctcttaatttgaaccttttgcactttggaagacagcagttttcatgtcagttaattcagtatgttaaccgtcacttcttcactgcaggaatttgagagcgtattttgcggtaaaactggccgaaggctaaagctgaccagaccggactccttggtgacctgtcctgcacaggggagtttacagagcagcccctcgatggagatcaagtgatcggactgaacaggaatcctcggggggtgaacagccattccttcgtgacctgtgcacgccttctgcaaccctggagctctgctcggctagtctgactcgaaaagggcgtgactcaagctgacgggactccagtagggactttgagagcacattttgtaaaaatatttatctagacgcaaatgcttatccatgaatgtcctcttagaccatttggggatgaagccatcttaataattagtaataattaattagtaataattagtaagcattttctcaatgctctgattccatcatgttttcttaacatgataacttaaaaaattgacatcctttgtactttctttaatcttaaaaagtacacggctttttacttatttaccttttaaatatgcccctttagcaattggaacaagttaaattgttaactaaaaacagtttggaaattttatttcattcgttatatcacacccccttgtcatgactctgagtcacgtgctgctgtattgcaacgtgcaggaccattttaaacctgtgtgctaaaaattttccagatacttgctttaaagctacttttgtccacaaatgaaatactgtcacagtagacgcttaaatgccacgttttc

SEQ ID NO: 12836 - DNA, 1812 bp, Homo sapiens
gccgggagcggagcaggaaccgagagcgcgagcgagaccggaggcgcgaccgggaccggtcccggagcagagagcgggaccgagacaaggccagggacagggagcggggccgcgaccgcaaggaccggagcaagagcaaagagagcgctcgggacccgaagcccgaggcctcgagggcctccgacgctggcaccgcctcgcaggcctagacgccccggccgggcagagaccctttttaaagccacgttcgtaagatgcgttgaacaaatagcttttgaaatagccacgatcttagattcaggatagaatattctggacttaaacattactgtaattttgtgtaaatggtttcttacaagatttcacatctttacaattctgatgcttttttaaaaaaactaaactttaatatttccatttaaaattaaaagaaatgggaaattgcctacggagcatattgcttttcagatcatagttatcttttccaataactttattgtaaattttaagggagtttcgttggaccctagagccataccttcactgacatctcatccgtttgtgtttccaaaagctgcttttacaggtcttagccgccgccccggaggccggtgtgggcgtgacctgcaggcgtccaccctgcggctacgggagaagtcttagtagcttgtatctggagtcttgagaaacacaaaccttacaaatgcatctttcttttgtcataaaattggaattacaattttcaactgggaaacagaaacacatttcttagcgtgctcagattttatatatcaccttatcaattttttccaaaacatgatttaaagcaacatctgtcctagtataattgttgcattttaaataacaatttattgaaaaatgttaagttttaccagcctaaaaaaagtaacaaaccaattaagtgtactttgggggcagggaggagtccttgatttgaataatcaggagttttgttggtccagtttcgccttctgagcagttcttctgtatcccgggaaaagtacgctcggccccaaactggtatttgtcagacgatacatgtaaaagtttgtccttgaacgtggaacaagacttgtgtaaagtctgagacgggaactagtgatcactagctcaagaactgcaaatgagacaggaagctgttcactgtgaaacagtctcttgcttgtcgtgtatttttcgagtacttctgaagtgtgaagtaaaaaaatctggctaatttatttgtacaaatacactttgataattttttatattttcataaacttttacagatgtaaaattaaagaacttcacttgttctttggagtctgttattccattgtacgtcactacagatttttcactttatagcacagattttttaagttaagaaaacattgagaatgtatcagtttgagatgtttggtgttgaaagccaagtgtccataggttaaattacattaaagtaggtgtcacgttccaacatctagtacgatgagaaggttttgtttgtttaacatataaagcaaatttttctaatttaaatacacaaatgtaaaaatcaagtgtgtttctttagtttacttgatagagattcctgtacattgtattttatattgcggaggcttatatcactgtacatgagaacatggaacgacctaggttttgttactcgcagtagaataaacagctacaggaagtttctgtctcgggtcttcatcagcctttttctaacgcggagaagtttggggtcgtgcacggacgccctggccacccagtttcttgttgctggtttgcctgggcgtgggcagg

SEQ ID NO: 12837 - DNA, 1199 bp, Homo sapiens
caaccgcacgtaagcttaaacacgcagaagggccagaatgatttcctgccctgcctttagagtattgctttcggctttgtgtgagaaacaccagtgtgccggctgggtttctcacagagcctttcctcgccttcttcaggccaggttccctccgcagaagatgagccagctccgaaaaaacaaaaattgtcagcttctgttaagaaagaagacttaaaatcaaagcatgacagctctgcacctgacccagctccggattcagctgatgaggtgatgccggaggctgtgcctgaagttgcctctgagccaggcctagaaagtgcttctcatccaaatgtggacagaacgtatttccctgggcctccaggagatggccatcccgagccctccccgctggaagacctgtccccctgcccagcctcctgtgggagcggggtggtcaccaccgtcacagtgtccggccgggaccccaggaccgctccaagcagttcatgcacagccgtggcctccgcagcatcccgcccagacagcacccacatggtggaagccagacaggatgtgccgaagcctgtcttgacttctgtgatggtgcccaagtccatactagctaagccatcctcatctcctgacccaagatacctgtcagttcctccgtcaccaaatatcaggtgcgtacttcaggtgtggtctgaacaagccaaactttttttttagattaacgaaaggaaagataactggtgattaaatagttgaacttggaaatgtaacctgaaatacagcttcactctttcatcttttaaaaagccccagttgtagggtgccttattgtccttttggaagtagagatcttagaaattgacatttaaatttgtgctcatccagttttgttgcctattcactttatttttctttaaccaaaatgtctgtatcattttaattaaagtaagtaattggcaaaagtaagctaccaaaaacgtaaaacttgcaagcgttcacttttgcttttacatataaagtctttgtactcttgaagccgggcacagtggctcacacctgtcatcccagcatgtgcttgagcccaggagtttgaaaccagcctgagcaacatggcaaaactccatctctacaaaaaagacaaaaattagctaggtgtggtaatgcacgcgtgtagtcccagctacttgaaaggctgaggtggg

SEQ ID NO: 12838 - DNA, 1233 bp, Homo sapiens
cgtccttactcacatccttaccctgctatactgtccaatatttcctatttgtccctactgtctggcttgtgaagccttgtcctgagcagttaaatgatgaaattgtacatttgatttgttagctgtatttttgtctaaacgttagttgtttaactatattaaaattatctttacaaatcatcttgaatcatctcacatagcacacattaggaaacactggtcagaaggacttgctttatgtagagctccactgtttgtagggaggtggcccctgctgcgcgtgtttggcggcaatgtcaccttttgttctgtggtcagttggtcactatgtgcttacactttaccgctaggtatggacgacaaaggcgacccgagcaatgaggaggcacctaaggccatcaaacccaccagcaaagagttcaggaaaacatggggttttcgaaggaccactatcgccaagcgagagggcgcaggggacgcggaggctgacccactggagccgccacccccacagcagcagctgggcctgtccctgcggcgcagtgggaggcagcccaagcgcactgagcgcgtggagcagttcctgaccattgcgcggcgccgcggcaggaggagcatgcctgtctccctggaggattctggtgagcccacgtcctgccccgccacagacgccgagacagcctccgagggcagcgtggaaagcgcttctgagaccagaagcggcccccagtctgcttccacagctgtgaaggaacgaccagcctcttctgaaaaggtgaaaggaggggatgaccacgatgacacctccgatagtgacagcgatggcctgaccttgaaagagcttcagaatcgccttcgcaggaagcgggaacaggagcccactgagaggcccctgaaagggatccagagtcgcctgcggaagaagcgccgggaggagggtcccgccgagactgtgggctccgaggccagtgacactgtggagggcgtcctgcccagtaagcaggagcccgagaacgatcagggggttgtgtcccaggctgggaaagatgacagagagagtaagttggagggaaaggcggctcaggacatcaaagatgaggagcctggagacttgggccgaccgaagcctgaatgtgagggttacgaccccaacgccctgtattgcatttgccgccagcctcacaacaacaggtgggtcatgtgtgggcacccacagaaatcccagggttgcaa

SEQ ID NO: 12839 - DNA, 1100 bp, Homo sapiens
ctttgtaggcagtggaaaacttgcaaggaaagctgccgtctctttggcagtctgatgcagagcctgcactctggcactcgctgaagaatctggaaggttgcggtttgctcttccagtgttcgggggcctctggctgctgaaggattcggtctaccacggagggctgtgctgttaggctgcatcccactcaaaatacaggaaaagcacgaatcatgattctgctttctgttagcttaggcagacattgggccttcacctacaagtttttccttacccctgtggtttttgtgtttttttttttttctttttccataggaaagaatatataaatttgtaaatcctaattcaaagatggctcatgtgtgagggcattgagtttgatttgttttccctttggtctgggttgtgtggcttttgggggatgcgtgtgagggggctatgtgttttttaattttttaaatatatattttggtgctgtgtgtggtaagagacttgttcctagtggatcaatgaaccatctcttctgggcagttttgttgaaaataaaggtttctctttgatttcaagaatgaccaaaatggcctctaaaagatgttaatcatctcaaatgaccttttgtctttggggcgttcttccccctgtgatagcggcagtggctttttctggtacctgcagctggaaaggccacttggccctgtgctgagtgagcggccttcattagagcgaggcagcccttggccggtggggacgcagagccccagcaggtggtgcacgactgttggcggaaggaacgcgtgttcatcctcagtgatctgccctccagcatctcggcagcatctcatcctccatcgtcagctggctctgccgatgtcctgcttctgttcactcacagaactgtcccctgctccgtggtgggcaggagggaagtggtgcagggctgcgtgcattgcctgcgagtcgggacagttgatgggcacatggccttgtagctctgggcacagatgtgtttggattcattgcagcggaccaccgggcactgttgaccccactgagcagtgctaagtgttggtttagtggatgttcgtggaattgctgaccca

SEQ ID NO: 12840 - DNA, 1778 bp, Homo sapiens
tgctggggaggtggtgcttccctaccccctagaaatgctgccttccaactaccactctcccagatgtgacccttgcgattatttcctctgaggtttgaggatgaagataagttggagggaaagagagtaactaataggggatgaaatatagcagaagctagaagaaagcggtgaggtgagagagatgcatctgcacgttttcttcaacagcaccaggtgattcagcatattcctaattacctttcactattcgtgtatataagatcgtttacttgcataatatatcatcaatttgacatattcttaaaactagagggtgtgagaagcacagcaataggaagtctctccacaaactaggggaacacaaatggggtcattcacgtgcctggactgtcactatgtggctgtcacgtgaagtgctggtgttgatttccatttcagccagtgggtagctgataagccagtgccagcatccagcatgagcagatgtcggggagactgggaagtctccagcgttactgctctccttcccttcatgataagccagtgccagcatccagcgtgagcagacgtcggggagactgggaagtctccgatgttactgcctgccttcctttcgtgtgaggggctgcacttgcttttcttgtgatctgttagtggacgaggtcttccaaggaagtgctttgcacactttctttgctcctttttacagtctttgtctttgcagcaagcaaatgaaattaagccactttgggataatgaacattcagtataattctactttgtctcattttggatctcactgttgtctttataaaaatggcacattttacaaagtagtttattcttattatactttctgctggagagtgccttgaaataaaatgtgagagtattctggtactctgtgttccagatgcatgaaattgggtgaggaataacccctagtctggaatctttgtgaagcatagggttattgcaaggcaaatgggaactaacacatcttgccatttgaatcagggtctccagtttctagaaaaggcagacactggttgggaccaaagtctccatggcacatgactgaagactggtggtcgtgtgtgtgcggagtccacggaagcctcggggaggtggagctgctccttccattccgtcaggacgtgatctgaaaacatgtagagaagatgagttgaggacagcttttctaaggcaatgtgatgtctttgctttcttatttctctttctctgcgttgttagttttgaagagtggaggagctaggggctccagaaagaatcttacacatgtgttgaagacattgatgtcatagggagcggggagctgcattcccttctgggctgttactgctaaatctcagtatgaacagaccaggcggaaagcttggtggccaagcagtctgtgtgcttccccgctgatggagaacgttgcgttgttcacaatagggcctcatgggtgtagccgcatggcagacccatggctggcgcagctgcctgttgccgtctgtcttcagtaactgctgctctgttaactgttctattctgatactacgcgtgttgttttttacaacaggtatgtttttgtttcagaaatatgtattgcttttctcatattttttgcaaattgtattgtcaacatgggtcatttaaagtcctgtatgaaccataacctgctgtggtacctttgtacatgtttgattctgtattctttattccagtgtggcatatgtgcccctctgtatcttttgagaagtgcggaatag

SEQ ID NO: 12841 - DNA, 1270 bp, Homo sapiens
agccagcacccactggcctctgcttctggaaggctgcgtgcctccctcttgttgggcctggcccacctaacttcttgtttatttcaagtgctgctatagggagacgatgctagagattttcctaaagcaaatccacacctcactacgtatggcgcccgttgctcagcctctgcatccacaccccccacagacgccccaggagaccccgcacagcttcttgtaaaccaagacaagccagccctgggcctggggctcctccctgcaccccacttagccctgcaaccttccagcccaactacaattctcaagatgaggagtccatgaaaaggagactgacagatgacactttcctctgccatgactgacaggcagcagcaagagggaagaccgcggtactggacatcacgtgcgggaactgcctcaaaggtgggggcacctttcgggctgagctaacccagtcaacagcagactggaaaaagacaaagaactgtgtgagatggtgctcaaaaccagaaagatgaactctgcaatgacgacaaatggattcggtgtgatgtgggcgtgatacagagaaacattcttgaaggttctggagcagttcatttttctcagagctggtaaactcattgttcgaatcttacaagcactagtgttcaacatttctaaaactgggagggcccagtgaggactggatgggcacacaaatctataaacgagcacagacgaaccctgggctgctgtgaccgccagcacctcttcccgttcttccatgaccctccatggcagagaattcttggtgacgggtcagcctgcttcactttcaaagccagctgggaaaattaccaaagctgtcagtcacacaccgtgatccacaagagggagaaaaccttgtttgtgtgaggaacgcctacagatgtgtctccaggaagcagaagtcacagccaggcggagaccttgcctgacacgggcagctcaaggcaacagcagctccaccgcttctccctggttcccaagctcatcaattccacctcaaatacacagagacccaaggacaggaggcgctgctgcacccagcactcttcatctccgaagtgagcctgcggggtgaccaactgccttgcatggacggacagctggcggaagagcctgcaacgtgacctgcatttacaaacatgaggaaacccactcaccttcagttgttactcctttcatgaattcttttggttatagctgtgcctatggctttacgggcttcacctgataaatggtc

SEQ ID NO: 12842 - DNA, 1132 bp, Homo sapiens
gtctaggcgcagacttgcagagagtgccgagaaggccgtatacctgcccctctgtccacagcacaccgtcatccactcactcatctggggcaggttcttgggagcacacacccggggtgcagccagctccccgcaggggcagacaggaccttttgggaagggtggggtgagactctccagtgtccgactcctctgccacccatctcctggtcaccctctcccctgttctctttgaggggaacaagcagggcccggcccaggcaccttttgtggggatgagtcgttgctgtgacctgcccgagtgctggccactcagttgctcccaggagccactgtgcctcatttctggctgcctgtgttctcccaggggtcagcagataggtgcgattaggtgtttgaatgcttgccaagttgccctccatcaaagctgtccccattcacagtccatgtcccccagccctgagggaggtctctgagtgatgaactcgaagcagcagggccgtggggcctccccagggcctgaccatctcctgtcccacaggcccgagtgccaggcatggacggggacgctgctgctgggcacatgccttctgtactgcgcccgctccagcatgcccatctgcaccgtctccatgagccaggacttcggctggaacaagaaggaggccggcatcgtgctcagcagcttcttctggggctactgcctgacacaggttgtgggcggccacctcggggatcggtaactgcccatcttccccatctcctggctggtgggggccgccccactggggcctccaggggcgagtgggctggctgtgctgctgcacgcagaggatgcgactcctggggaaggagcttggtggacacagaggatgcgactcctggggaaggagcttcgtggacacagaggatgcgactcctggggaaggagcttggtggataaatctgggcagaagacccccccagaggaagatgggagctgggaggggagaggccaggcttggcaaggccccagggccctgcaggcagaggaggcaggccgctcccctggagtacctggtctcctcacgaggcagctctggggtcatgagcaggccctgtagaggcagacaggccaggcccagctctgagc

SEQ ID NO: 12843 - DNA, 2209 bp, Homo sapiens
ctccttgagagcctggtgcgtgccagctcctccctctgagtgcagagaatttcacattgctaagtgtctttccatgtggaatgatagtggcacatgagggaaagacagctgtgggaagtgaggcttcccagcagacaggtggcccatgtgaccgttgtggttgatgcttttctcctggtagagggggtggggagaatgccatgcccagtgtggccagtcccccacagagcaggccccagtgcagctcagagttgtgtgctggtgtggcttgggtaccattcagggtcccgcctccagatttgcaggtgctgctaaggggcagcctcggatctcacttttgggagggattcattggtgtggttactctgcgttcaacttttgttttttctttttacaggaacggcagagtcgaaacaaacaatgagggcgaaccagtttcttacatgttctaacgtttgactttgaaaacagtttaaaacacgtgtgcttggtcagctccagtgtgtcgtcccgtgcgggggttgagtgttgcatctttgcctttcttgtcgttgatttttgcccagatggatctgcatttatttgtactttttctatgtattataatcctgtagaagtcactaataaaggagtattttttttgtcagcttatcaatcagactgatctaatgtgaaatgtaagtatccttaaaaacaaagcatctattttggcagaaattgtgttcttaaattcagtcatttgatattctgtgagacttcatatttctcatccctttattgctttttagcaaacataagaaaccatgagtcattttgtcatttagagtattctgataaaatctcttgaaaatactgaaatcaaaaggttaatgattttttgttcattctgatttgtcattttattatctgttatcggtctaaagtgctaatttacccatttgatttttctgctagacagataacttttaatttttcaaatttggcagacactttttttttttttttgaaaatctttccttccagatctgttgcccactgaacagccacccgtccctcactgtcctggtgtccgattgggctggatggtgttggggcatgatgtgtggaggaactggaaggtgctttaggtctggttcagggtcgggcattctttgttgtttgcacatctttttaaattttacaccttttcttaagaattctaatgccgtcttaagtttttataccaataatgctgagctttaagtgtaggatctggtagtacagacagtgtgatggatgatgctgctggttgtaaatttcatcgtgtgtgtctaattttttttcctgttgaatgggtaaaaacaaaacaaaactttttttagaagatgaatttgctgtcatgttttgtggaatgagggaccgttgagctcactaccacctggagtttgagttgaagcatgaaaatggtgcccatgcctgacgctccagcgcctggatctgcacgtgcccttgtagaggatccttaccgtcctagagagcagacgctttctgaaaactacttgctccaaaagaccctctgagttaacgtttcagctgtatcattagacttgtatttagagcgtgtcacttcctctgaactgttactgcctgaatggagtcctggacgacattgggtttttcctctaggagaatacaagccttaataaacaatactatttagcaaacttggtgtcacctcattcttcaccctacttgatgagtttatgtgttggagctttttaagctgcagagccattcggggagtcaccgtagaaagccctgtgtttctcaaggtgtgggattctcgttccctcgctttggaagagggagctgttaatttccttaagactataaactacatggcaccgtcacccacccctcatcacatgaatgtgcagacgcagcggtgcgtgcagcacctgggcaccgctaccccctttctggacttggctcctcaccgtctctctccattcatcctccaatgcctcttattatttatgcaataagagtttaatacctgtttagtttgttttccttttgaggtaaaatttataagcagtgaaatgcacattgtgtacatctgcagaagttgacaagtatgtgataaagttatgcaatattagcctcagcccagaaaatcctgagctcaggcaatccgcccgccttggcctcccaaagtactaggattaca

SEQ ID NO: 12844 - DNA, 1173 bp, Homo sapiens
ggaccagtgccaccttatggcaaagagctcccgcagtgtttgttagagtgcacatccctacgtgcccactggcacacacacgtgctcacatacatgtccgcatacaggcgtacacatgcacgcttgcacacatgcacacagaccacatagcacacatgtgcactgaccacacctgtatagaccatgcacagtacacatacgtgcatacacatgcctgcatacaggcatacacatgcacgcttacatgtacacgtgcacagatcacacacatgcacacacgtgtagctcacacacagtatacacatacacaagtgcacagaccacacacagcactaacacatgcacacacaaagtgcataggccacacagcacatgcacacaggtgcacagaccacacagcacacacaagtgcacagagcacactgcacacatgcacacacacacgcgtgcatgcacactcctcgcacttccagccttggagcccttctgtctctggtctttctctttgaccctgctgagtgtaagctgcctggggaggggctacaaggagtaattgtggctttaggggtcgtggtgatgctggaatgtcaagcgccgtcgtggggtatccgactgtccgggctcctggtccgcagtggcagagcgccaggcagagcccaatcagggtctcgtgctgcccttccctcccacagcctggcagccatccagaggaggggctctaccagatgccaaggtgccccggtgtctgtatgggtgtccggttgggtcctgtgtttggtctgccctggaggtgctgggccctcctgggatgggtggctcagcctcgaatcccaggccccagcccaggcaggtgctgctgcctgttgtggtttcctggcccagcttctccttctccctctgcataaaatcacagtccgtgagtcttccagctgccaccacggctgggacacgctgggggagggctcctcccatgcctcctgcacacagccgtctgagcagggcaggtgcccaacaccccccaccggaggacacgctgcccctcagcgatgcccctaccttttggggggcctcgtctcaagcccccccttggaggctgaaatcaccccaggcactgtgagggcttctccagggggcaccctttgagctgtgggtctgatcaccccaagtcccgcc

SEQ ID NO: 12845 - DNA, 1222 bp, Homo sapiens
ctttgcccctaggggtctgggaaggaggaagagctgctcctgggcctcctcttcccgctcctccagcttccagggagcagggatcccccctccctgtacctctccagggagcaacccaggtccccccacctcctgggaccagcccaagtcgaccgacttcctgggagtggtccaggtccccccatctcctaggaccagcctgggtcccccccatttcctgggactagcctgggtcccccatttcctgggactagcctgggtctctcctgtttcctggaaccagcctgggcccccccatttcctgggagcagcccgggtccccacatctcctgggactagcctgggtcccccgtttcctgggactagcctgggtctctcctgtttcctggaaccagcctgggcccccccatttcctgggagcagcctgggtccccacatctcctgggacgggccctcgcaccccagcccagcagccccttttgcaggtcttgtccatggagaagaagctggacttcctggtgaatatctacatgcagcggatgggcatccccccgacagagaccgaggcctactttggggccaaagagccggagccggcgccgccgtaccacagcccggaagacagccgggagcatgtcgacaggcacggctgcattgtcaagatcgtgcgctccagcagctccacgggccagaagaacttctcggcgcccccggccgcgccccctgtccagtgtccgccctccacctcctggcagccacagagccacccgcgccagggccacggcacctcccccgtgggggaccacggctccctggtgcgcatcccgccgccgcctgcccacgagcggtcgctgtccgcctacggcgggggcaaccgcgccagcatggagttcctgcggcaggaggacaccccgggctgcaggccccccgaggggaacctgcgggacagcgacacgtccatctccatcccgtccgtggaccacgaggagctggagcgttccttcagcggcttcagcatctcccagtccaaggagaacctggatgctctcaacagctgctacgcggccgtggcgccttgtgccaaagtcaggccctacattgcggagggagagtcagacaccgactccgacctctgtaccccgtgcgggcccccgccacgctcggccaccggcgagggtccctttggtgacgtgggctgggccgggcccaggaagtgaggcgg

SEQ ID NO: 12846 - DNA, 1180 bp, Homo sapiens
ctcagcagtttgggccgtacgaagccttcctggtaaagatgaggatgagcggcagccatggccgttggtgctgtcctgcgccctcatcactcttcttggctgtctctgtgcctttagaaggaggaaggttctcctggaagtgatttcccaccttcctctgcttcagaatgagtcacgcatgatgcaggtggactgggcccacctttgttagctgtgggtcactcccttggggctggggtagtgggacatcccagaaaggcccagccccacagactctgacgggcacctccaggacacccactggccagcgcttgcccccttcctggggacagtgccgtagcgtgggcctgggccggctgcttcttcagcagcagggtcctgcacgccgagctcgcgctaagagggaagtagagcccaccctgccctgtggagctgccagcgcctctgctaggcctgccccacgcaggtggatggcccaggtcagggtgggcgggccaggtgccttcggctctggggccgacctggacgctccatgccactgtctgtcacaggaagatcatggactccggggaactggacttctaccagcatgacaaggtctgctccaacacctgccgcagcacaaagattgacctctcaggagcccgtgtgtccctgagcagccccacgtcggccgagtacattcccctcacgcccgccgcagccgacggtaggtgcacagggctgctcgtcctgacccagccccaccctggccatggccacagagggtgacatgcccctgggtggcctccttggccccaggcgtttgctcacgccaggactgccggtctcctgcctgggaccctgagttgtctgggatcagcctcctcctgcctcacagaggagatctggcagaattgctgctttcattgacaaggaagattgaagcacttttctttttaagccattttggttgtaatataataactcacgtgtggggaagggtatagcgagtaacagagagtgcctgggcgcccacccggccccctccctcccacccccacggcccagccccaaatctggacccgcttccctcctgacctggcggtttacggaactgcgcgcctgtgctcccgccttccgtgctgggtgccttgctgcaggtattcctgccacttgggtttttgggtgacgctttaga

SEQ ID NO: 12847 - DNA, 1162 bp, Homo sapiens
aaaaacccaaaaacccaaaaaaacccagggcgtttccctcctctctttctgtcttgaatgggtttcccttcccgttccacagaccagcgaggacttcttggagtgctttctgcacctgaaactcagttcagggattggggctggctttgagttcaggccaggagagacggaagaactggcaagccgggagcctgcgtccagggaagttgcttggaattccaggcccctcctgtcctcctgctctgagccccacgtggagggagtggctctgtgctttctacccaagggtttcggcttatccagtgggaaaaacgggtggagtgcgcttacaccgccctcggaaccagagcctggagtagcccttctgttgccgctcgtttttgtcaggaggtagcagtctgggactcaagggtgggtctttggagctgattagagatgcctttgtgagtgctatgttgtgtggatgtggagatgactccatccctgtgccctgccttgcttcctccaggacttgggaccctggaggactgacgctgctggcctgggcgtccccttccgctgagccatggcgactcccgacgtgagtgtgcacatggaggaggtggtggttgtgacaactccggacactgcagtggacggcagtggtgtggagggggtgaagaccgtgttggtgacgaccaacttggcccctcacgggtaagctcgggcctcggtgccattggggctgatgggggcttgggttgggctgtccttggcacagctggcattaacgtagtaagggacaagtgtcaggatttttctagttccagttcttctgagactggactcaaatgtgtgtgtaagtagagagcgaagaaaagcagaaatggcacggggaccagaagacccagctgcagctgcggggaggcctcccgtacctgcatggccacgtggctccacgtcctgaaaggccgtgatttctcatgtgagagggagtggtagggatgtcagagagctggcctttcataaatgaagtgaagagtcagtgattttcttgacagtcttcatgaaactgtgagtgttttcttcctcatctctgtaccagatgtccgattcaaatgttagttggcaaaaacgctaacatttgcccaaactgccagctttgttttgctgcccgtaggtg

SEQ ID NO: 12848 - DNA, 1158 bp, Homo sapiens
gccctggccttgctggggcccctcctgcctccacgcccacccagcgtcgacccttgacccacgaagtgcgtagcatgcagtatttaaagcagtgtagctacggtcttctgtttttttcccttttttaatagcatgtatggggttctgttccatgtctgtgttgtggacattccgcggcatgaccgcgtgaactgcacggtggagctgcctcagggctgtcggtcaggttggtccagtgaggggtgactgcagccggtcaggtgggcgaggagaaggggggctgcccctttcctacctgtgcttgaggggccggaggcaggtgctgcctggcagagctgtgttaccgtcttggcctcggggtctggtccacactctgtgctcccagccttgaggctgcagtaggactctgatctcacctgccagaagagaggcggggccgcgtcctcctggcgtcaccggcgtcactgtcattccttggtgtctgtgctgggcatggttggcttgggggtctgtggtttcctgggccttgtggcagggtttctcccgtgggagaatttggtgtggaaagcataggaggccccttccgaggttgacaccgtgtcctccgcggtgtttctcgcctggtcgtctcgtcgtgtggacgctgccgttctggttctcggaggtgtgtccttcgccgtgttggggttatttgtctgtgttcctgcacttttcccgggctctgagctggattgatggggccagtctcccccctcccatcttgaggtcgttctccacattccttccagcacacctgtcctttccatagccctttttggacctttagaaccacagatgataggaccagcccaatgagccacagtcagagagtagattgtgcatgtgtgagcacccagctactggggacgggggctctcccacgacccctcctcctgtgtttgccagagctcccatctgccccactcgcctttgccccgtcatcgatgattcaggcagagccagattcgttaggtccctggaggaaggactgactggaccagagggaccctctggctcaggagggttgggtccctgggaggccggcagccaggccacagaatccacacgtggaccattgtgggtccctgggaggccggcagccaggccacggaatccaca

SEQ ID NO: 12849 - DNA, 1214 bp, Homo sapiens
gcagaatgtccatggtggccgctgcagagttgcagaggtccctgtagagataaagctgaggaggaggctgtgtgtgatggctctggctcggaccaaccagatgagcctcctgaagcccccttccctgcctgcctgctgacccgtggccccagctcactcattgccctcagcagccacccgaggctgtgcagaagggtaggttcaggttgaccaggaagctgccaaaagggacatggatatgaggatacatctggacgtgcttaggaacagggtgctggttgagggcccccagctgacccctactgcagatccgcatgtggaccatgagccggctgccagcactaggtcctgggcagctttgtttgtcccacttttctttgtttcttctcactaaaatgatcacgaagacctttgacaagaggagagatatgcactgtgatattaaattagaaataatttatcaaaatcagacctctcctaaaagaataagaaattcattgtttggcccatcctgaaaggtgaggtggcgagacagtggggtgcctccgtgccgcttcgtgcagcagcaagttcagcctgagatgctggctgtactcagcctttgcaatttttgtagatgtagcttaggacgtgagttatttttccgcagactggccaagagccaggttctaagcttggacctaaggtagaaagctgcccatcgggggccctagctcagccccaccaggccctctgttgggcctgcacacagctctgtggctagaacactccaaggcccttcggtacccatcagagtgggccccttgccaggtggcttttcagttacagagtccagtggaccattttgtagaaccatgcagctccctgcggaaggtggggtagggtgggaaagaggagcaggtctggaggtttgtggaacccagtcccctgcagaatctgtaaaacctaataaatcatggttgtggccattctcacggtggtgattgtgattagacgacccccgggaagcccagacactcggggcctggagttcctccccctgcctgacctagaagcagaaccgttttcagcgctctgccctgttggctttaaggctttgtcttaatttaaggaaaaagatcctcccgggttttatttctctctttcttgagtggactgtttccctataattaaaagaggtggtgagtcctggggcagcttccgcgcctccctgt

SEQ ID NO: 12850 - DNA, 1184 bp, Homo sapiens
ctgtgagcaagtgtggccatgggcacagaatgtccctttggacgccgctgctgggggctgccaggggccctctggggtcgtgctttgaggcccgtccggttcacgagggggtccgggcagcactgactgcttccgacctgcaggaggcgtaggagcggccctgcgggccctttcacggcagctgctgctgtatagatttgtctccactcagtgacgtgggatttttttgtcttccttttggctttatttttaaactgctttagatattactgctcagtgtttgtgaactttcctagttctctatgttgttagtgcagccagcacccagtggggacctactagaaaaaggaactggcatgcacacgtgcccagcaggaaaagcttcgtcttcacgtcggctgctgccatccagaagaggccctggagcctcacgccgtcgaggctgctctcaggcgttctgttccgggcgaggcttgtgctgcaaggaagggcaccagcatgcaggctgccactggagggtccgggtgctgcgggcagagttcagcgcttgtccaccctcccttagctctgactcagtgcatcctactgtggggacatctcgtgaggggacacgaaatgactgatctcaccctttcccagtattcagagctgtgaacccctgtggcgcaggactggcctgtgtctgttattttggttgtaaatcattctcctgtggaattggcaaaagctacatttttactgtccttaccagcaacagtttgcgtcgtcacatgctgtgagtgtgggctgtggtgtgtccgtgtgtgtacatatgtgtatatgtatatatcacgcagcaggagtgtcattcatgctgctgtcccctggtgaagtgacaagtacaattaaaggtggctctgaaatggcctctggtttcttgggagtcgggcagggacctgcaggaggctttcccagcaggtgcacagaaggaagcgctgagcccactgtgtgcagagggtgtgtgcccagggcactgccacggcccccaccagcattggcctctgctctgcagggtggggtgcccatcctgggggctgtgtgtcatgctcacctgacccaggtgtgtgtcccggtgtgaaatcgaggaggggactggaagcccttccctgccttgaaacatgaaagctgattttctgagcagcaga

SEQ ID NO: 12851 - DNA, 2357 bp, Homo sapiens
gtcctaaaggctgtgtccagccctgctgcaggtgcttgcctggtcctgaaggctgacaggtcttcagctctcaggctatgcctggctcaggtgctcagcatccagtcccaggtcttcatcagcgcttttctctccccagaactggttccgaacatcagcagacccacctcccaaacacaggagccaggactcattggtgcccaagaaggaaaagaagaaaaatctggcaggtggaaagaagcggggccgaaagcccaaggagcggaccccagaggagcctgtggccaagctgcccccgcgccgggacgactggcctccaggatgcagagacaagggggcccggggctccaccggccggaaggtgggagtcagcaaggcgcctgaaaagtgagcatggtgcgtggggcctggcccccatgcagccgccacaccgccctctgttcaaggcagggccagctccgggacctctgtcctccagttctccatcccccacccccgcctcttcatccgtccagtggggcagccagccactctcccttccctgaaggtggcccttcccctgttaaggctgccacagggcacacctgggttggggctccccaaggtgtgcccagcagaagtgcaatagccaggagggttgcccctcctcatgggaatgtgtctggggtcttggtgccacaggggctgcagcgcagagtaggcagatggcctttggccccccggctccgcttcctcaggccctgccgggtcccttccctggctaccccaaggctcaggcatccctggtgacctgtggttctgggctggtgagggcacctgagcaacctggcacgggcagccaccatcctggcctcacctccacccaacactggaactccagcacccccagctacctcccaggacagacccctgtctgaccactgccatgctgacctgacaggctccggcctgcccttggccacccacttggtccccttgcttctgttttctacctctccaggcctgcccactacccccacccctgctcctcctttgtcagtgcgatccctgctgtgctcaggccctgccccccaggcctgtctgtaattctcccagcttggggcaagggaggggttttgcttcttgtacctacagggcagcagaagcttgatgcccttcaacacagctgccagccctgggggtgtggggcccctggagtgtgctctcctccagtgttcagccttctggcactgcaggcctaggttggagcagcctcgtggagtagggacggactagttcgggccctggggtcttgctggggcccataggcatgtggggcaggaagctgggcagagctggcctggctctgagtggccactgggggaaaggcagccttctgtctgccaatctgggtaggcccagtggccaagctctcatgggagccccctccccacttttttttttaacctgcccccattgtttctggttgtgtggtcatttgatatgggaactgaaggccagccaggggaggggcttggccaaagtcacagcaggttgatggcagctccagagctgtctttgcccctttgtggccctgaggacggctgggtctataggtagggcaggggtcaggcagggagtccagggtgcctggaagaggtggccacagcctgtggctccctccctggggtcctgccttccaaccacggcattgcagggaggatgaggctcagagggggtaggtttggagggaggccattttccagggtgggtgggagtgggctgagggctcggccccactgaccctggacgatgagaattttgatgtttgcccgtgtgcgtgtgtctcctgggtgtagtggatgccagtcttgttgctgtgacaagtaacaaccttttttttaaattgttttttatacaaacactcgcaatccgacatttggtgctaagggtttcctggtgcagacggtgggcctgggggctgggctggaccagggcgtgggtctctggggttggggtcccttgctgctcagggaggcagtactgactgggcactgcctctgcccccagcacccaccctcccccattccccagggagaaggggccccactgggcttggcctgcagtagtagggagacaagttccaggagcactttggggactggggttgcagaacacttcctgtctctggcttcatccttgggccagaaggctccaaccctcagcagcccttgccagatgtgccagggagtgggtgtggagacccggactccccccacccacgcacacctcggcctgatgagaggatggaggctggggcagagatgggcgtgacccagcgtcagagggtcgggggaggcattccttcctgtgtccca

SEQ ID NO: 12852 - DNA, 1215 bp, Homo sapiens
gtgaggacttccagagaactttgtccccggacactggcctcccccttggcaatgggcagtgactgtcctgacctctgacctcagctctctggccctcctggacacagcagccccttcccatcccctcggatccaagttaattagaagctatcaggagggggccacctgcccactcaaccctcaccctgcttcctgtcccacccccttccgtggcttttccacagggctgggcccagagtctcctctgctccccagctctcaggatggggttcccagcagcacaggccctcgggggccccagccttgggcagcagggcgttctctctggccagcatcctgggccttcactgctggtgcttccacgacttgtttggctgaagtggtagtggtgggtctgtaggcagaggactgagaggatccagagagaggtggggggcgggtcagcctgccaagcctggagacaagtctgcgaagagcatcaggtaggatagttcagccggcacagggacgggagcttggtgcagtgccagattgggccaggggtcctcagtgcccaccttggctgttttccatctgtgtctggagagaagattccaagggtacctgcctgggtaggctggcattgcatcaagtcagcatgggaaggtatgagggccccagtgagaagctgtgcccccactgctgggcctgggcagcttgtgagccagcagccatcatcagagacataattggcccctggaggaatgttgccagcctccttcctcctgcgcaaggcacctctcccaggggcacaccccctcccagcactgggtaggagtgcatcaccttcggcatcatcttcgcagctgtggggctacgcacactgtggagctgcgtacactgtagagctgcgtgttgggaagggggtctggaagttggtgagggtctcaggacaggactagatcctatcaaactgatgatgactcctgggttatctggggagaccttggctggcagcccctcccctaagtcagaagcccccatcacttgcttttcccacgtgaacaaaaccacaggaaggcaggcccctcttccctgaccagagaggacctgccaagggcagggctccagggcagcctcaccacgtgttccaagtggggcccgtcaggcttcacagattgtctacttgctctgcagagatgacggatcctttctgcgttggaggccgtcggctcc

SEQ ID NO: 12853 - DNA, 1848 bp, Homo sapiens
ggcactaaagttagtaaagaaaagtttaccatctgaaaaagctggattttctttaagaggttgattataaagttttctaaatttatcagtacctaagtaagatgtagcgctttgaatatgaaatcataggtgaagacatgggtgaacttacttgcataccaagttgatacttgaataaccatctgaaagtggtacttgatcatttttaccattatttttaggatgtgtatttcatttatttatggcccaccagtctcccccaaattagtacagaaatatccatgacaaaattacttacgtatgtttgtacttggttttacagctcctttgaaaactctgtgtttggaatatctctaaaaacatagaaaacactacagtggtttagaaattactaattttacttctaagtcattcataaaccttgtctatgaaatgacttcttaaatatttagttgatagactgctacaggtaatagggacttagcaagctcttttatatgctaaaggagcatctatcagattaagttagaacatttgctgtcagccacatattgagatgacactaggtgcaatagcagggatagattttgttggtgagtagtctcatgccttgagatctgtggtggtcttcaaaatggtggccagccagatcaaggatgtagtatctcatagttcccaggtgatatttttcttattagaaaaatattataactcatttgttgtttgacacttatagattgaaatttcctaatttattctaaattttaagtggttctttggttccagtgctttatgttgttgttgtttttggatggtgttacatattatatgttctagaaacatgtaatcctaaatttaccctcttgaatataatccctggatgatattttttatcataaatgcagaataatcaaatacattttaagcaagttaagtgtcctccatcaattctgtattccagacttgggaggatgtacagttgctgttgtgtgatcaaacatgtctctgtgtagttccagcaaatcaagctgagctttgaaaaagtttgtcttagttttgtgaaggtgatttattcttaaaaaaaaaaaagaaagaaaaagaaaaaaagataagaaggaggagtaaagggactactcctccttgccaaatgtgctaaatatcattttaggagaagaaagtgggtttattgtatttcccttaagattgtgagggagtgtggatacagtagaatgagccaacagtttctttataataaatacggtctgcaataaattatttcactagctctaaaacctttccctagattttagtagggagttggtttctgttaatatctttgggtgctgtggtggtaaatgctatattatgaacggtggcatgtatttacagttagagtattgtgtgtacactttttaatggtaaacttaagctgaatgtgtaatggatttgtgtatagttttacatatttggaagcattttaaaaacaggttttaaccttatgtaaaattacttttatactcgtgttaacattttcatctgtgccttttggtaatttaatttctattatgaatttctggtgcctatgagctagctatcacctacctgaaaggtgcttagaggtgaaggtactgtttctaaaaacacatcactgtgatacctttctatcctcacattttcaagcttgcctcttttctgttctttgtggatataacttaagcaattgtgttattcataaaggtttagaaatttcaatattcccaacactctatgtttctgattttataacagtagccatttttgaaagtcagatgtttggcctgttttatatgaataaagtttatttataaa

SEQ ID NO: 12854 - DNA, 1416 bp, Homo sapiens
caccattagatgaacttccaactctgacactgaaaaaaaagcaaagaacaagaacgcgagacaaatgcacctcaaatctccaaggagcaaaaagcttaaactgagaagggaccaaggctgtactaaaatctgagacctgacttccagcacgagtcttgattgcttttttttttctcgagttcgaggcggagcccgcgaaccccatctcctcagagcgccaccccctcagcttcgcccgttgggcagaattttccaaatatctccacccctaggctgaaaagccagaaagaagttttgagccaacgaggggaagaaaggagttggggcaaaacaggaggcgtttccctacccgcatacatccccgtccccgagacacccaatccccccacccccagcctgcccgcgcctcccgcccccagctcctcgccctggggacagctggcagccccgcgcggaccagacacaaagccgatcaatcccggaggcgtgggggcggagggacgacccgccggggctttcccgggcgctgctctcctcctgctgccccctcgctaggacccggcggacgcctcgtctggttttcacgccctctagcccctacccccacacccccaaaacagaacagacccccatccctgggctggaggacccgcctcttggcagccagctgagaaggcgccccggggagggggaaactgacatcccatctagagccgtccctcctcttcctcccctcccgactctctgctcctttcccgccccagaagttcaagggcccccggcctcctgcgctcctgccgccgggaccctcgacctcctcagagcagccggctgccgccccgggaagatggcgaggaggagccgccaccgcctcctcctgctgctgctgcgctacctggtggtcgccctgggctgtaagttgctcgggttcctctacccttcctgcctggaccagcctgcccccaccctccagccccccacggggcgctggctgacagtgtctgggcggctctgggccgaggtcgccgcggggcgtctgaccttgcgcccaggcgagcgggaaacccagggtgcccgcgagcggacgctgggagcaagggagcgcgaggtcgtgggtttcttgtgaattgcgtctgattttgtcagttctagatacagaaaattaagggttcccactagcaggttctcatctgtttgcaaagttggggtaagttttcagacagagggacgtgattcgaatgcaaaactcactacccactggtaagatgctaagaccccaagaaagatggcatcactgggaggcgggcgccggccacactttgagtccccggggagggggcagcgtccgcgtggtctgggctctgtagcgtcccagctgagccggcgatatgcagcgcacttgtggggcggaggtgg

SEQ ID NO: 12855 - DNA, 1146 bp, Homo sapiens
tgagtttctctctgtcgcccaggttggagtgcagtgacacaatctcggctcactgcagcctccgcctcctgggttcaagcaattctcctgcctcagactccccagtagctgggattacaggcgcccgccaccacacccagctaattttttgtatttttagtagagacagggtttcaccatgttggccaggctggtcttgaactcctgacttagtgatctaccggcctcggcctcccaaagtgctgggattacaggcgtgagccatcatgcctggccttttgaacattttaaaaactgtcctttccaaaagaaaaattttaaataacagcatctatatacaacttttaggctttaaacttgagtttattaaaagggaaataaatgctttggttactaaatgaactgattagaggaaggtattacacagaaagctacttggattattactaacatcaatgtcttctttttctaaaaggtgattttaaaaatcgagctgagatgatagatttcaatatccggatcaaaaatgtgacaagaagtgatgcggggaaatatcgttgtgaagttagtgccccatctgagcaaggccaaaacctggaagaggatacagtcactctggaagtattaggtgatgtgcatgtatgtgtgtgactacgtctcccactccttctccaccacccagccctgggggcaagcaagcactggtccataaacatgccagcatcaactgggagcctcaaccagtcaagttacagagaccataagcatcaccttcctggcaatctcctggccatttctccccctctcctcattggctgctgaaattttagtaatgcgttatcacaaagtatctctttgttaaaggtggaggcaattcctaatgatcctacaatatacataggagtatctttcctgagagtttatttttcaatagttttcagcatatacacagtttctccaaccatttaaagtagtatcacatgagatggtggagaagcaataacacacaaaaaagtagactgaaggtaggattagaagtcatttggtaaataaaggaaattgacattgattatatacctgatatgttagcccttttcacataagtaattttacttcatcttcattaatatgatttttatagatgac

SEQ ID NO: 12856 - DNA, 1549 bp, Homo sapiens
ttggctcactgcaacctccgcctcccctccgcctcccagattcaagcacttctcctgcctcagcctcccaagtagctgagattataggcgtgtaccaccacacctggctaatttttgtattttagtagagaagggtttcaccatgttggccaggctggtctcaaacctctgacctcaaatgatccacccccatcagcctcccaaagtgctgggattataggcatgagccactgcactgggcaggttaatcttctttcaaaagagtctgctctttctacccaattggcgaagcaaatccccaggattcaccgaacaaatggattaagcacccactgagtgcctagcatgtgcctggacaccaggccaccgggaagatgctccccctttgacttgtctatgacatgctatgtctctcaccagatcccttcctggaggtcgggcttctgtaacatggctctgcccccaaaataaaattttcaccacgagtcagggatcggcaaacattttctgtaaagagccagaaagtagatattttaagtcataaggtccctgttaacaactacttgactctgccattgtagcacaaaggcagccacagacaaaacaagcaagtagtcatgtctgtgttccaataagactttatttacaaaaacagcaggcacagacaagatttggcccacaggcatagattcccaactcatggtggtgaagtacagaaaaaaacacctgtctacaagcttttgtaagaaatcaggctaaatgttacctatgttttggttggaagatttctttggtttgaggaatgctttcctcttgcattggcatgccaagaggatagatgactctgaaagacgcctcttcagacatacctgtcatcacacaagatcaacttcttcagtttaaatgacacaaatccatattgtggaaggaaaatatgtagtgccttagcttcactaatagttgtaaaacttctttttaagacatcaaaggctagaggattcattttatgcagtgcgaacatctaataacactctctgtgtcaaatatatattgtacattaccttaaactattgtaatagctaggtaaaaatccttgtataaaagaatgttttcccccacacaaagggcagagtattgagcactaatttcctattaaaagtatatatatgtatctgtgggtcactggtgtccagacttgtatttgcatttgtgtttacttgaggaacttgaacactaacaactggtaaaatcccattgtaattcttacagcattttgactttattttcctgcagtgaattgtgttgtgtaaagattagggctttaaaatcttattagcaagctttgttttgttttaattattgttgctgttgtaactagatttaatttatttttagttggaggtttgacctaagtctggaccaattgattgcttttcaatacaactttgcaaagaacttcctttttccacaggtggctttgttcgattaaagtctacactaataaaaatagctgaacttgttaaactttttagccccatataacagtgca

SEQ ID NO: 12857 - DNA, 1157 bp, Homo sapiens
aatgaagttgtcatgtcaggttaataaacaccagttttttaaaaaattagtttataaatgtcatttgtggattttctttattttatttttcaaacagggtctcttgtcgcccatactggagtgcagtggtgcgatcatggctcactgcagcctcagcctcctgggctcaggtgatcctcccacctcagcctccgaagtattaatagctgggactacaggcgcgtgccaccacgccctgctcatttttgtatttttagtagagacaggatttcgccaagttacccaggctgatttcaaactcctgggctcaagcaatctgcctgccttggcctcccaaagtcctgggattagagacatgagccaccacacccagctgattttcttctatatgtaaagactacttccccctcttctgcttggcgtttgctttttatttggattgggtctctacttcttgtgtgtcatttcgtttatgtggatagttttaaaatatcttaaaaagtcactcttgcaggactgatcctttgaaatactccagccatgactaaaagagaagcagaggagctgatagaaattgagattgatggaacagagaaagcagagtgcacagaagaaaggttggtgtttctgaatttatcattttttttcaaaatatcaatatacctaattaaaaccaggaaacaagtcatagttcttttggactgtctttttttaactgttctcagtattttagggaataatgtattgttttatttcctctgacttaatgtggttgtagctgagagggaaagacagttttaaactaatggtagtaaaagggtaaatgaaatcaaaagcaattgctttcaatagttttctcctttggggcatttgattctttattcttttcctcagcactggttgctttaatttcagaaatagtttaattcaacctgaactcatttaacaaatatttatgagtaactgttgtaaacaactaattgacaagaatatgtgaataaataagatactaatctgcccttataaaggccacgttgtatttgaggagacatacaggtatatgagtacttacgggaccagtactaagcataaaatgtagtgaaaagtgttaattcttggaataatagtggaatcatacttatttgaaaggaggacag

SEQ ID NO: 12858 - DNA, 1212 bp, Homo sapiens
ctgaacttttttgttattttgtttgaaattgtggattgaggctttctgtagtgaagtactttcttgggggtaattcatagggcattagttaaagtgataatgtctttcagtaattttttttttttcctgcttgtattggaagaaaaaaaatttctccttgtctgtctttgcagctgtgcaaattattccagcatcagtgcaatctgctacacctactaccattaaagttataaatagtagtgcgaaagcagccaaagtacaaagagcgccgaggatttcaggagaagatagaagctcacctgggaacagaacaggtatttttgtattttcttgtatttataaaatatatctatctaattaggtatattttgttgtattttactgtatgaaaaatgtgaatttggactatccctctggcagtttttagacagcatttctagaaaaacaaaaattgtttttgccatggctgagatttaaaccacgggaccagtttgttgtctttgccttgggctaatctataacactatagctaatgctttgttcctcttaccaatttaggaaacaatggccaaatccaactatggcagtttttgctagaacttcttactgataaggacgctcgagactgcatttcttgggttggtgatgaaggtgaatttaagctaaatcagcctgaactggttgcacagaaatggggacagcgtaaaaataagcctacgatgaactatgagaaactcagtcgtgcattaaggtaagcctttattacttttttttctgttatcaaaaatagaaactttctaaaaaatagtttcttattctagatgtaataagcattgttatgtaatgatattaaaaacttgtttatgtttttttctttacatattaaaaaacctttttaaaaagatcttaataatttcgaggtacagttttttttttacaaaattactctaagattgtttgtttttatctgatttgaaagctataatactctgtcccaaaaaaaaatgtttaatttttgaggtttttattatttgcatagatgaattgagtgttagtttttaatgagtaagcagaaactgtcctctgtttttacaattacaagcagaatattgacccattttctacacaatctgcctaaatctggatatccaatctttacattgatacaaactctccgtaagtagtataaggttttttgacagaaattactat

SEQ ID NO: 12859 - DNA, 1067 bp, Homo sapiens
gagctaaaatgttcataccgaataaatttatattaataaattactaaactaagagtatcaggttatttatatatttgcaagcaaaggacagtaagaagttgactggcaaaagagcagtgctgaaggaggagatccaggtttaaatctggcttattaactcaagccaattttaaggattttctgtatagattactcatgtcagaccaagaatttaaattattttgagagaggcatttaattctaataaaccagctgttataaaaattataaaatgatctctgtttttcctgtcagagatttaaaaaactgaaaaggtatacctcaacccaaaaataaaggtttgttttggtttgttatggcttccttttttaaaaaattaccctgtagtgccagtttattatgcaaagcagcttatattcctttgtttctgataaaatgaagactttaaatcagtcagtagtactttacctttcaaggcattagtaaattacttgcaaatagttttaaaaggaaaatacgacctttgttataggcagtcttctctttaagacaatacttttccacttgttttccttttccatattatatatgtgtattcatatagctgtatacatattcagttgatcattttataaacatatgaaggcataaagatatacagaagaaaaattattaaacaactcattttaagattcaaattaactaattcctgcatatatgacattccttacataagcgaacactaaacaaaaatggctagaaatgtctttttctttcttttctctctttgttgtttaaggtattaagcacgaattattacatgagactggcagatagctattaatcctcttacagatttgagaaagttgattctcaaatatttatgcaccttctccttcattgttttctttaaatctgtcctcttaaaaagcttcttaagagctcagttaatgcttttgacttaactaggagaaaaaggcatgataatacaggcaagatggcattgttagcaattctggtagtggtttggaatgaatcctaagaggcagggatcttaaggacaagga

SEQ ID NO: 12860 - DNA, 1182 bp, Homo sapiens
aatagtaatttgattatttcattcatgaagcggagtggtagttatccttctattgagagggaagaaataaatgagtattactgaaacttaaagatcagtggaaaaaaaaaacatttaaaaatgttgtaggagactttcaattttggaagcaaactgagctattcttaccagccaaagttatactaaataagagacttgggggagcaaatgtttttcagccttcagaaatgaaagttaaggattttagcactaggtaaaattcagtataataggctgaagtggagtaagtgaaaacctgccttttgccactcttaaaaattgtgcccaaaatataaaagtgtggaactttagaacttggaataattttattgcagtcttccattacatggaaatagcatatctaatatctaggttacttgagagaccagctaatcatctctgttgcacatgtttaattggcaaaaagcaattcatgataaataaaattactgctttccatctactgggtaaaatgactattgaaatagtatgaatgtggtcagaggattatagttgagagtgaagtactatgtgtgagttatagatctctcgaattatatttatagatgcagtgtcctgcccagttttgtttgcctcctacattttactgtaaaatatttattgtcttctagccttgagcctctgagggtcagtaagtgaagtacagatagcaaaattttactacctcgttaacccttttcttaaaatattctctatctttctatgtctctttctgacatagtaatcccaaaggattgtgttactccccgtgaaagttattacttttcctttaaaaatggttttataataagactgtttaaaacctttccagtattggtacatcttggcttctggcccaaaccccaagcagaaaagaaaatggaataatggagcattgtttttccacattagtattagggcatcagattcttggtgaaacactataattaagtagttataattaaataactgttcttcatacttaggactcttaatacatttctttaagacttgtaagtataattgtaaagcttgttaactgtttatatactaaagaaaaagctttacaagataagactgaaattcagaataccacatctgtacagcgttgacaactctaactaaaaggattacagcccttaa

SEQ ID NO: 12861 - DNA, 1237 bp, Homo sapiens
ttcaagcaattcttgtgcctcagcctctcaaatagcaggattacagatgcccaccagcatgcacgactaatttttatatttttggtagagatgcggtttcaccattttggccaggctggtctcaaactcctgccctcatgtgatccacttgcctcagcctcccaaagtgttgggattacaggcatgagccactgtgcctggccgattttcttattttaaaataataacttacaacttgtagggctactgagaagattataaatgtgtatttaatgtgtctgacttagtgtttccttccatgggttagaaattaaaaagggtacttgagaataaattgtttattaatgattctattcatggtatttaattttgaagaaaaaagttattttgatgtaaaattttatgtttctcctgagattacacacctcaactgcttttcgttttaaaattcaaagaaatgaaagtggggcttttctttatattggctttatttgtagtgttctggtagaagtctgtttacctatttcatttttattgttttttcagacaacaagtgagaatcaggcattgtattctattccacttgtgcaactgtttgcctgtgtcagctgtgatttggcctgtgacctcagtgctttctttgattccacaactctggataccattggcaatcttcctgtaaatctaatcagtgaatggaaagaatttttttcccaaggcatccacagtttgcttttacctattttggtgactgttacaggcaagtgaaaaagggaataatagtgagattgattcattggaaatgacttactgaaaaattcaaaagcaaaaattttgatgtttaaatcaaataatactaaatagtaaaagaaaaagccagaagagaaagcttggcttctcagaagcatcatctatgctttactttacagacagaaattgaaaaatggcaaggtatccaatgactgttgcaaattaaaataataatacttcagataacatgaatggatgatgtgaatagaaccttgctattgaacatttgctggatcagataaaagtcattaaaacagttgagattaactggaatatatattcagttcatgtttctagttaagactgctttattgtttatgtctagtttttatttcattttcttaaatgacatttgattgtttgtgaatcatttaagctatactaactttcttttgagacgtgcatgtttctttcctttttgtcatta

SEQ ID NO: 12862 - DNA, 2404 bp, Homo sapiens
gaaaaaacagctcacaacttggagaacgtactgatacatttctgggaaagactgtcagagatctgtgttgcgaaaatcagtgagccagaagctgatgttgagtccgttttgggtgtatctaacctattacaggtgcttcagaagccgaagagctcattgaagtcaagtaaaaaaaaaaatggtaaggttagatttgctgatgagatacttgaaagcaataaagagaatgaaaaatgtgtatcttcagaaggagagaagattgaaggctgggaattaacaactgaaccttctctcactcataattcttcaggccttttgtctcctctaaggaaaaaacctttggaagacttagtctgtaaactcgcagatataagtattaattatgtcaatgaacgaaagtcagagcaacatctaaggtttctttctactctgcttgactccttttcttcaagccgagtatttaaaatgctacttggtgatgaaaaacagagtattgtccaagccaaacctcttgaaatagccaagcttgtacaaaaaaatcctgcggtgcagtttttataccagaaactgataggttggctaaatgaagatcaaaggaaggattttggtttcctggtggacattttgtacagtgctctccggtgctgtgacaatgatatggaaagaaaaaaagtcttggatgatctaaccaaggtattcctgttgtatatcttttcaaactatttgaataatagatgagtagaatgagcctgcttattgttttctggttgtttcttcactgtgagtgtcaattttaggacaagcaatatattcttgatcatgatttgggaagtatctagggctgctgggtagatgttcagcagtaccagggtgacaaatacttgtaattaaaaggtgaattcttttaatctatacatttaaaaagttggataagaacattttagttttgtattggttacatgggtacttcatttactttttaaaagttttagctgggcatgttggcgcatgcatgtagtcccagctactcaggaggctgaggtgagacattggcttgagcccatgagttctagactagcctgggcaacatacaaaaccccatctcaaacaaaaagttgttctagcagattgtttctaactctttttcttttttcaggtggacttgaaatggaattctcttcttaagattattgaaaaggtatcttagggatttttttttctttttttttttgtatttatgggaatagaaatattataaccgtagtcctatttacacaataaatatggtcagatagtcaggttctgtgttagagaacttcctcattattgtaactttcttcctataatgtgggaagatatttgttcttttcctttcctgtagtagtatttttctggttagtaatattagggaaaaatgaacaggctctggaaaatccagtgtttctttcctagaaggtaacaaaggcagatttaaacattttattatcttttaattaaagctacaactttctgctgttattctagttactttttctactgcagaaatggattggaggttctagctttgggtagaacacatgagaaaattaagttttctctactctggaacactatgtaggtaaataaaaatcttccagtctttgtgtgattgccactgactaagaaaattagtggtaagaataatgaaaagaaatgaaagaacataaacaatttacaaattttcaaaacggcttaagtattctttcctaatgaggatgtaaatgttataactaacacttttccaactgtagagatgttatgactagctacctgaaattcttactcctttttaaagcattttcaaattatttttctgttttcatagctaactcttgaatttgcaagtttttttctattttttaaattgtagtaaaaaaaacacatagcatgaaatttaccatcttaaccatttctaaatgtacagttcagtagcatcaagtatatttacatcgttgtgcagtttccataacttaattcatcttgcaaaactgaaaccctgtatccattaaacagtaactccccattttccccatagttttatttttacaaaataaatacagaatatttattatttttcaatgaggaatatgacttatcaggcacactatttgccttagtttatctagtgccttctctccctgtagccaagttacatgaagagctaaattatcagaaagctccttgataagccttgattcagagcagggggtgcaaataatttgataagagtagactaatgtatccatttccaacttaggaatgtacctgccgtgaagtgcaaatactcacatctgtgtggaagaaaatcctcttcctgagcagtgattggaagttcctagccagtgtttgctgcctgcgcttccat

SEQ ID NO: 12863 - DNA, 1236 bp, Homo sapiens
gagctgaattctgcataagacagtctgtgaccaaacagtttctatctcttttgatgtacattttaaacttttaaatggggcagttctgtcaggaacattggtagtatatgttaactaattagattttagtaaagtcagtgattccagaatttgactgaagaaagtaatttcttttcccatattcaggaaccattagaaataaaccttgagcctccaggccctcttactttagccatgagccagtttcttaatgagatgcaagagaccaaaaagggggttgtgacaccgaaagaactcttttctcaggtctgtaaaaagtgagtatccacttcgattgtgctttcagtgcctcagtgagatgctgagaaataatattaatattaaatagtaaaatataaaaatattaatagcattacatttagtcaaccctctatatacaaaaggcatagttttttttcatttggattttaaaatatattttatgtgatagttaaatctcccaagggtgttaatggactaaacggaaatttgtagaaaccagaactctctgagatttgggatatgatcctaagattttctaaaaatagcttcagagcttagtagactgaagattgcttttctgtctttttgtttttctctagagcagtgcggtttaaaggctatcagcagcaagacagccaggagctgcttcgctacttattggatgggatgagagcagaagaacaccaagttagcatgttatgaccattgtattttatgatcttatcttcataagctttctgtctcatttgatatcttacgagttaaaacaatgaaagctagttattaaggccatcatactttaaaattttttcttacaccagctttttcaactagtatgttttcaccattagaatgaatccagagaattagcagtaattctctttctcatgatggcttaagtttagttgatgtttacagcattaatgttctttaaagattctgttgtactaacctatacgaagagagctgccaaatattggaaattgtttctcccaaacccaggtgcagcacacccttacttttaattctgagtctgatttaatactgttttttgaacctaggaagtattttcattttgtaagagtcagggaacattggttgcattttaaaatttttgttacttgccaggatataaaaaaatgtatttggggtatgaattaatgagtactaataatagtgataataactaatatt

SEQ ID NO: 12864 - DNA, 1214 bp, Homo sapiens
aatttcagtgttaaactttgtatatacttatgtatcaactactttagattataatggcaaagctggcaggtgggcctaaagctcctaaaccacaaggaaattgggacagagatggttggcaagacacatctcatatataaatagcaaatcaggtgccaaactgaccgacttacaccagtgatgcatgcacatattttcactttcagctttttgagttattgaagtgcatgtcttggaatgttcactaatctctgtggattttattgcggttatccataaaagcagtaaactttctcatgcgctgaaagtttacaattgaatttctaacaagggagctagcaaactctgtgctgtagtgttttatatgcagtacataattataccaagaagactgcttaatcttaaatcatgctaatagaagcattcttttcattctaaaggttaagttgataagcatactcttgtgtgattcttttttatgcagatcatcatggcaaaaccagctggtgggcccaagcctccaagtgggaagaaagactgggatgatgaccaaaatgattgaaattggcttaatttttactgtaggtgaaggctgtatttgtagtagtactcaagaatcacctgatgttttcttattctccttaaattaagagttattttgtgtttgtattcttggctggatgttataataaacatattgttactgtcaaagccttattgtctaatgaccacggttattggctctaaatgacttgtgttcctctcaaccttgttaatcacattagctgtgggacttaaggcaagtcacttatgtaagtagaggcctattacccatgtatatctggcctactgcctgtttgtgtaaataagttattggaacacagccatgctcataccattacatattgtctgcagttgctttctaacaagggagtggcagagttaagtatctttatttttgacagagaccaaatgggcctacaaagcctaaaatatttactatctggccctctacaggaaagtgctgccaacacctggactagatttccagtgtttttgtcacagctctggaattcctgactcaaggtgacttgtttcaatagcaattaataatttgttgaagacactcgacttagcaaagtacaaaaaaaatgcttagaaaatagataaactgacatacaaaattaagtcagttttcataaagcagattctat

SEQ ID NO: 12865 - DNA, 1161 bp, Homo sapiens
aggcaagtgttcatttataatttactcctactaaatttttgcttacatatacacctgcttaaaacataaactaaaatcattattatagtagtagctaacatgcactgagcagtttgctctgtaccagccattatagtacatatgcttcacatgctgtatcattttagtctcacaaaaaccctattagtgaggccttataatcccattttatctattttttttcccactttattttagatgagaaaagagactaaaattagaaaaatcttgcccaagatctcatagctagtgagttaggtagagttaagattcaaatttgggctgtcatctaagcctccattcataactagtagagtctactatatgttttattccgaagtatattctttgtcattttgtatcaaaaataaacatccatatgcattgggttaccaaaataagctactttaagtcatgtcagaataggaaatgttgtttatgttttaggtcatagaaggttatgaaatagcctgcagaaaagctcatgagattcttcctaatttggtatgttgttctgcaaaaaaccttcgagatattgatgaagtctcatctctacttcgtacctccataatgagtaaacaatatggtaatgaagtatttctggccaagcttattgctcaggcatgcggtaagtaaatatcagtaaatgaaaagatccaaaataaaaatacctttaacatgactagatactttctctgttgtcccaaaataatcttttgatatgtctcattttcttaacagtatctatttttcctgattccggccatttcaatgttgataacatcagagtttgtaaaattctggtaagtagaaaatgcattaatgctacatatctaggtcagtttttttgtgtgctttttttgtttttttgtgcaaaaaaaaaaaaatgtgttcatctaaacctaaatgttacttcatgatttgaacacttaggactttttttgaggcattatttttatttatgtacttatttatttttgagacggagtctcgctcttgttgcccaggttggagtgcaatgacatgacctcggctcaccgcaacctccgcctcccggttcaagtgattctccagtcccagcctcccgagtagctgggattacaggcatgcgccaccacaccc

SEQ ID NO: 12866 - DNA, 1133 bp, Homo sapiens
tcccccacaattcttccatagaccctcatggactttattctttgtctcttttacacacatatgaccaatatggtgacttgaattttgctggtatgcaaaacacaacagtgttaacagaaaagcctttgtcaggtacagacgtccaagaaaaaacatttggtgaaagtcaggatttacctttgaaatccgacttgggcaccagggaagatagtagtgttgcatctagtgataggagtagtgtggagcgagaagtggcagaacacctagcaaaaggcttctggagtgacatttgcagcacggacactccttgccaaatgcagttatcacctgctgtggccaaagatggctcagaacagatctcacagaaacggtctgagtgtccgtggttaggtatcaggattagtgagagcccagaaccaggtcaaaggactttcacaacattaagttctgtcaactgcccttttataagtactctgagtactgaaggctgttcaagcaatttggaaattggaaacgatgattatgtttcagaaccccagcaagaaccttgcccatatgcttgtgtcattagcttgggagacgactctgagacggacaccgaaggagacagtgaatcctgttcagccagagaacaagaatgtgaggtgagcaggaatatgttcttaattcattgttttaataaccattaattgggatttactgtggatcagctccctttgcatcattagggatataatcaggttcagggagtggggaggaaactcatacaaaattaattgtaagactgtgtgatagggctgggcgcagtggcccacaactgttaattccagcactttgagaagccgaggtgtgggtggatcacctgaagtcagaagtttgagatcagcctggccaacatggcgaatctccgtctctacaaaaattagctgggtgtggtggtgggtgcctgtaatcccagctactcgagaggctgaggcaggagaagcgcttgaatgtgggaggcggaggttgcagtgagccaggtttgcaccactgcactccagcctaggagacagagcaagactgtctcaaaaaattttttaaaaacactgtgtgataaataccaaaagagagagatgaagtttgaaggactt

SEQ ID NO: 12867 - DNA, 1189 bp, Homo sapiens
aggagtttgagatcagcttgggcaacatggtaaaaccccatctctacaaaaaatacaaaaattagccaggcatggtggcatgtgccagtagtcccagctacttaggaagctgaggtgagaggatcgcttgagcctaggaggttgaggctgcagtaagccatgattgtgccaccgtactcctgcatgacagagaccctgtctccaaaaaaatatgtgtagatcagtgcagatatccttttgagattgtatagaaattgggatagaggcctatgttttctttaatgtaaaataagttctctgaaaaacttagatgtataccttcatcttcctaggtttgactataattataaaatacagcaataattagtaatatttatttcatattctaggtaaaactgccattcaatgcacaacggataatttcactgtctcgaaatgattttcagtccttgttgaaaatgcacaagcttactccagaacagctggattgtatccatgatattcgaagaagaagtaaaaacagaattgctgcacagcgctgtcgcaagagaaaacttgactgtatacagaatcttgaatcagaaattgagaagctggtaagtgtaaaagtttcttgttactatttaaattccaccactttcttttttgtcaaggaaatagtttttaaatttctaggtcagatataatgctcaattacttattttaatatgtatcaattaccattttatcatttttaccatgatatgctgtgatatgtaagtgctttttaaaaagaaggttttcaaattaagaatgactttactgtctacctaatcattagtggttgtgaatagattcaagaaattataaagcactttaggttctctgttttgtgtctatagaagttaatattccaggtgttcatttaaatgaactgtggacctgaataacttgttttggttgataccaaaaccagaccaaccaggatctttcatctaaggaaaaaaattctgatagatatggtgatatgaattgaaaatattaatatctaatgggatcctaagtgagaacaatgcttgcttttgaatcttttctttttcttttttgagatggagtcttgctttgtcgcccaggctggagtgcagtggtgcgatctcggctcactgcaagctctgcctgctgggttcatgccattctcctgcctcagcct

SEQ ID NO: 12868 - DNA, 1249 bp, Homo sapiens
ctccctgtgccagaggaaacagtgagcctggctacgcgcgagggcaggagtcccagcagatgtccacagccacctctgagcaagctgggcctgcggaacagtgtcgtcagagtggtgggatctcagatttctgtcagcagatgactgataaatgtactactgatgagtaaacttgcattcacttccttcaaaccatctaattttctcctgaagttttggcagcgtcttgaaagcctaatatgaccatctgttgctcaacaatactgtttttttcctttagtagtttaccataagggaatttcctttaagtcaaccatgatttctccttgatttctacaagagacaaagaaatgattttgcctcctggatatcagaaaaatccatgtgaaaatgtagtaaacctttaaaactcatgttttaaagaataataactctagtaataactcttcctgctattcagaataagtaggagaatgaaaactgcagcatatcagacagcaatttaacagcttgaaacatctacagatagttcctactaaaagaagtggcctgcagaagtttaataatttgacttttttctaatattttagtttgaaagaaaatttcttcccaagcaatgctaatagagttctattcttagaagcagggtgtcagctactgggaatatttttgtagagctgcattgtgaaaaaaagatggtcttacctgaatcttagggctttgttcttcggctcctaaaatcaggctttaagctacattgggaagatttagtaaataggcaagtggttggcctaagacgggggctgcttctcctcttcagtatggactctagaaagtctggctacatgaatagatttaagtgtcactttccctccctgccccccgcttcagtctctaccatatctggtcccatcatggacttcctatttcctggcatttttgtccctttggaagaagaaataggactcagaatacagtggcatgagtgattacactggcagcattatctcaggctccctagaatctggagagcttaccaacatgtaaagctgttcatttttccaccgtgggtcaccaatgccagaaaaccagacatcacggggaaagaatgttgcttactttttaccaggagtgcagttcatttttttcaccctgtttttgaagtcgtattattcacttgtaaaaatgattgtaacagataaaaaatgtatctgcagcaactctgcaggtttgtgaaataggatgaaac

SEQ ID NO: 12869 - DNA, 1099 bp, Homo sapiens
cagtaggtactttaaagacctgaattttatagtagctttaggagttatattttataaaaatcagttatgactttatatttccagacaatagagagttcagtacatcatgctcttgtgcctctgcctgcttttcctgcgttcccaccctgtattccccccgcctttcgggtttccagggcttcgagcttgatcttttgaaagttttattctattaaatttttgctatatcttctggttttctgaaaaagctttagaatggtttctataccctttgtatcactgcatttttccatatcatctccggttcgatcgcgtccagatggaaaacggaagcagaggcttctaatcgtcgcatttactggctccagtgcaacacatccatctgaaaacactcggaagtctggtgcttggagagggtgccattgtctcttgtacataaggtcatgacgtgtctatgtcaaaagttcttatatatttcttttataagctgaaagaaggtctatttttatgtttttaggtctatgaatggaacgttgtaaatgcttgtcaaacaataaaaataacgaaaagtgtctgggcggttctatgcctttttggatgggaggatgagtatgaattgttggcgggagagcggccgtgggagaagattcctgggaatgccatttattgaaataactcgtgatcatcaggagaacgctgttgtagcgcttgaagttttaacaacaacaaaaggtgcattacagttgcatggcatcttgacctaacgttgcccctactgggcactgtttcttttccagtctcctgcctatcccgatgggagcaggctgggggggttcctgtgaaaatattggggtgaagtgcagagctctgactggcctgactgagctcttgaatcactccacattttatcaccgggggcctgctgcctgagtctttcacagaatcaccaaacaaggtaaatacagtcttgggctgcctttctcttcctgtcagagtccccagatctgagcctctcgagtcccttacaaaccttacccatcaatgttaccccatccatccctgccctcagtgaaaagattgtctcctgtcactagaagag

SEQ ID NO: 12870 - DNA, 1143 bp, Homo sapiens
tgggttaggcgtgaagactttgccccctccaggaaactgaacactgagatctgactgcgtcacctgccccgtagagaatgtgtgtagatacttcctgccctaactctgcccaccctcctgtaccgtcgacaagaatgtccccttaggtcgcgctcttgcacacacggttttggcagctgacttggttctgaagccatgtagccacccaactttgtcattttcaacaacatcagaaagaattgatcagaatcccaaataagcttgagtcctatcttctgtatattactaagggcttttatttattctcaataaatcagggcctgaacaattaaaagaaaaaagattctatagcactggaaagcaaatcaccccaggagttaacggatgtacaacagattaatttaagggatagtagcacacacacgatccttctatctgaaatcagtctcctagctggggaaacctctttcacacacaaaatgaaatgtgtacagcttgccgtgttctgactgtacccttccctcttccatgtctgagaatctccgtgtattttaagaatgtgtgaggagagggtggcgattcatgtttcaatgagcctctttttttttttccttcctgttttggtctatggctggtcttactctgtgtccatgttcggaagctctagttttgcatagaattatagagatgccaaactctttgaaaagagatccaaatttatcgcttgagagaaagaaaagaaacactattttttgtattttacctgagatacaggggcacaaatagatgagaattttacagtgttagtgtatgtatccctgagcctaaaaaatgaggatataaccttttacagagagagtgaggcgtggtggttttatatttatatatgaaaggccagcaagctcatgcgaaggatatacttttcttccaaaaagcggattttttttttttaatgtttgaatctatatttgagatgggagtttggttggattaaacatgacaccccggtgggcggtgtgtgtgtctgttgcacatggcagggaggggagcctccttctcatggggttgccatggtgatcattggtttttccatcaaaattgcatcttcatccatagattaccttccccttccctgacagtcca

SEQ ID NO: 12871 - DNA, 1209 bp, Homo sapiens
ctgactaagatggaatagagaatggatattgggggccaatgatcactcgtctgattttaaaacgtgattttatatatcctaagaaaacaaaatagtagagattggtaattttagatttaacctggaaacccaggaaccaaaatctgttgtttttccactattgttgctgacgctttagcaccatttttcaatagaatgcagaaacagctctgtagcatttggagagaaagcctggctcatttcccttgctgtagttcaagcctgtgaccagaaggacatgtcatttttggaaacagaacatatattttattcctatattatgtatttttgctgatgatttcaaacaaggattgaatttgccagcttttcatttccattctgaatccatgaagggctctcaaagtcccaatatgtctgggtcatggattgaatactttaggcattggggtcagggttggctggcatgatggaggagggttttttgaagggtgggacttacggggacctcaaggcacaagtgggtggtcctgatgcatctcccttgtggctgcttgtccttgccatcctcaggtggcagcacgcactggtgaaactggagtgagaagacgtactcaggccatgtccagatccgcgagcaagcgaaggagcaggttttcttctctgtggggtctggatactacctccaaaaagaagcagggacggccaagcatcaatcaggtaggttccagagcagatgaaaagtgagcccgcacaaatcacttctgtggccacctcaatttggggtgtgtgtgtttcttcagtgaggccgagtgttatttaaaatcaactagttggcacaaagaaactagctgtgctagacacttttaatagataatgcatacccataacattgaactctgctattagtctatcaccaagctgcagtttcccacctgcatcctttccaaaccctcattaattacagacctactcaaagcgcacaattcaccctgagtcttcaggaaaaagcagggctctgcaatgaagccaagtgggtacctgagtgcagtctttttttttttttggagacagagtctcgctctgtcaccaggctggagtgcagtggcacaatcttggctgactgcaacctccacctccctgattcaagtgattcttctgcctcagcctcccgagtagctgggactacaggtgcccaccaccatgcctggc

SEQ ID NO: 12872 - DNA, 1442 bp, Homo sapiens
agcccttggaaacaaagcaatgtgaagaaaagggtgtagaagctgagaatggtaaaaccagaagaggccacaacaatcctaccatttcttcatatagtggagaagtaaaggagagaaaaattgtggcgacagagaaaagcaagctgggtgaaggtagtgtgttgtattttagttggaatgaggacattgggtcctagcatcagtaactgatcacccatatccctgattgctgggttagaaatgggaggggaagaaggggcagacactgcaagtgtttgcacatgggggatactggactttgaaagaatattttgaatagctatgatttccagaaagtggttcattagcgaactcaatgggtttgcttagacggtaactgagtttttaatctctggagggaacacctgcttcattggcagctatgaatattattgttgttgttaataagataaccaataacattataaatttaggttaaatttactgaggattcctgaccttgtgctaagcactttgtagagacatcttatatgggatagtgggattttctcttacgctttggggccgttgggtaagaagacattctatagctgaggctctcccatttgttttacgtggactgctgattttgccctagctttagttttataggtgtaaggagacactcagtgttggaagagtcacagaacattccccatccctcaggggtacaccctttctgtgacttcctgcctcctagggccatctaaccacctgaccacacaaactttcccaggggccatttgtgagaatgttccttggagtgcgtgatgatttcaaatcagtggtggctttctcctattgtgggcggtgtgtgtccgcccatgccttttgggactctcttcgtttggttgacatatttgtttggacgtgacctttttccagttcctcttccctgggtttttgcccgctgaggaaatgattctcagatctcatccatctgcaccagtggcaacagaagagagaatttcttttttctatggttcgggtccaactgcccagacacctgtccttcagaggctcatattgttctggttgatgtcacttcctgacgtagacactctttaatattttagttctggaagtcatcaagttggacaagagacaggaggaaatggtggagggtcctcagctgacctgggatgcttttttgattgttcactggacacatagaaaggggccgttgctcccacctccatctgccactggcccctggaattagccctgttagtaagcttttcccagtggtggctgattcattctgagagcttttcatatcctttgggattcttcactgttagattcgagaagaaaaaggacagcttcgcttttgagtctgatgaaaaccacctgcagaagacatgtgtacataagctgtatatttatgcttttcttacggacac

SEQ ID NO: 12873 - DNA, 1186 bp, Homo sapiens
gatttggttttgtagcatttattgaatatagaactaatacaagtgccaaaggggaactaatacaggaaatgtcatgaacagtactgtcaaccactagcaaaatcaatcatcattgtgaaacataggaagcttctgtagataaaaaaaaaaattgatactgaaaactagtcgagactccatttatatgtgtatgttttctgaaagcctttcagaaaaatattaaatttaaggacaagatttttatatcagaggccttgggacatagctttgttagctatgccagtaattaacaggcataactcagtaactgagagtttaccctttggtacttctgaaatcaggtgcagccccatctttcttcccagagcattagtgtgtagacgtgaagccttgtttgaagagctgtatttagaatgcctagctacttgtttgcaaatttgtgtctactcagtcaagttttaatttagctcatgaactaccttgatgtttagtggcatcagccctaatccatctgatgctttttcattattaggcatgttggagacttgggcaatgtgactgctgacaaagatggtgtggccgatgtgtctattgaagattctgtgatctcactctcaggagaccattgcatcattggccgcacactggtggtaagttttcataaaaggatatgcataaaacttcttctaacatacagtcatgtatcttttcactttgattgttagtcgcggtttctaaagatccagataaactgtacttgcagttcaaattaggaaaagcaattttattggacaattacggtgaaaatgaattattttatctaggtcagttaagaacactgttctgctaagatgcagtaaaaagcaggttacatttgaccatattagatctgagtttggaaaacagaagtagtctttagttttaaaatggccagattttcttgccaggattgggtttctcacttgttaaacagaacattttgttaagtttaaaacctgggatggacttaagtattcatgttcattcatgttcattcaggactgcaggttatcatgacttgtttaacttgtgggaagctgttgtcccaagttatcctggggaactgcatctggttcttgcaaaacaccaagtagacaggctctcttttacctccccttgagggcattaacattcagtagtcacttcc

SEQ ID NO: 12874 - DNA, 1253 bp, Homo sapiens
ttgtaaagcagaaaaatcatttataaaggtttgttgaacaaaattcaaaatactgttgcttaaagtattaagattttttaggattataccttacttataggcccgtcattcatttggcatgaaattttgagttttattcactttcactttcctttttttccaaagcaattaaaaaaactgccaaagtaagagtgactgcggaactaaggttactgtaacttaccatggaggattaagggtagcgtgtggtggtctacaacatagttatttgggttttagtatttcatttagacagcaacacttacctaatgtttaaaggtaatgtctttgcaacaccaagaaaaagctttgagtagtagtttctacttttaaactactaaatattagtatatctctctactaggattaatgttatttttctaatattatgaggttcttaaacatcttttgggtattgttgggaggaggtagtgattacttgacagcccaaagttatcttcttaaaattttttacaggtccatgaaaaagcagatgacttgggcaaaggtggaaatgaagaaagtacaaagacaggaaacgctggaagtcgtttggcttgtggtgtaattgggatcgcccaataaacattcccttggatgtagtctgaggccccttaactcatctgttatcctgctagctgtagaaatgtatcctgataaacattaaacactgtaatcttaaaagtgtaattgtgtgactttttcagagttgctttaaagtacctgtagtgagaaactgatttatgatcacttggaagatttgtatagttttataaaactcagttaaaatgtctgtttcaatgacctgtattttgccagacttaaatcacagatgggtattaaacttgtcagaatttctttgtcattcaagcctgtgaataaaaaccctgtatggcacttattatgaggctattaaaagaatccaaattcaaactaaattagctctgatacttatttatataaacagcttcagtggaacagatttagtaatactaacagtgatagcattttattttgaaagtgttttgagaccatcaaaatgcatactttaaaacagcaggtcttttagctaaaactaacacaactctgcttagacaaataggctgtcctttgaaagctttagggaaatgttcctgcttagtcattttagcattttgattcataaagtacctcctcattttaaaaagacattatgatgtaagagagccatttga

SEQ ID NO: 12875 - DNA, 1190 bp, Homo sapiens
atatatataggtgtctgtttctctgcttttctctgctgttgtcagttcggttagccaaaaactacttcttgtttttaatttttatttggtactgtaatagaattaaaattgatatgttaaaaaatgttttgttaattttgaaagataaaaattacctttttgagcagggtgaattgtagagactatcataataagtgaatttatatggaactggcttaaggattggtaaagtaatgtcgattttgggacattgggtgtagggaagtagagaaatcaaagaagagtaaaatcttgggggtcagtagtatcaagagaatggtagttccattatagacatgggaaatttgacaagttagccatttagagagctgaaacattcaagtagtttttaaacaaaagcaatcattggatggatatataaaagtttcataaatgtgaaaataatgggtgtcagattgtgactttgctttttctgtactgatcttacatctttatccttgcagtgtaaaccagaatacaaggttccgggattatatgtaattgactcaattgtgcgacagtctcgtcatcagtttggaactgataaagatgtttttgggccaagattctctaaaaacataactgccacattccaatatttatatctttgtccatctgaagataaggtataattaatttttaaactaaaacttgtattctttaaaaaatattattttaaatgtatgttagatatttggagcctactatattaccagataagattttcatgtagcgatgtctgtgagcttgaaacaaaacagtttttttcttcagtggtcatttcgtgtttattttcttatgagttcttcaggattatcagtcatactgttgaaatatgacaggaacaaaatttatagaatcaaagagtttaatagtggttgccagggactaggggtaagggaaacattaggagctgctaatcaataggtatgacatttcagttaagcaagatgaataggttgtagagatctgctgaacaaccttgtacctatagttaacaattctgtattgtacacttaaaaattggctaagtgagtagatctcatgttaagtgttcttatcacagtaaagtaaaatttttaaaaaataatatgaaaggcgcatcatctttaaagaagatatcgttggaaagatgtgcttgtgtagttgag

SEQ ID NO: 12876 - DNA, 1188 bp, Homo sapiens
tgtggcacggttcatttgggcacttggcaaagccgttgcattgtgggcaggatgacctgttttcgagctgagcaggtgtgcatcctaatggcctatcccctgctcttgttcagcctccgcagcattcctagtgtctctctacataaaggacatctggctgggggctcagcggccggacaccctcttaacccacgtccggatggtgtgtgaggccgcagatgatgccccgagcagtgaagaggaggccatcgtggtgctctgcaaggacgccgccagcgcagcctcagatgcttgactcctgccggccagcaccttgcaccctgatgaccagagcctcgagcacagcaccagcttctagaagtttggttgagtcaagggtttccagagaaggcatgggaaacaacaggttcagtacattggctcagttctttgacaagaaaagttgagaggactttattgaactgcccagtaaatgataaactcgggcctgtaggtgcccagcatcagagttgcaaggaatgtggggacttctaggccatgaggcccatccagtgcctcgtcaggccgccccttcctctctaggggcttggagctcatcacaggaaatagctcgagtttgaggcagcacttctgaatgcagaagagattcatctgtgttaaagctgaaatgtcaaaaggtatcagattttttttatgaaaacgaagagagatgtttaaagtttatttttcagcaggtgaggtggctcacgcctataatcccagcactttgggaggccaaggcgggtgaatcacctgaggtcaggagttcgaaaccagccttcccaacatggtgaaaccccatctctactaaaaatacaaaaattagccaggcatggtagcgcacacctgtaattccagctactcgggaggctaaggcaggggaatcgcttgaacctgggaggtggaggctacagtgagctgagatcgtgccattgcgctccagcctaggtgacagagcaagactccatctcaaaaaaataaaaaaataaagtttgtttttctataaaaagtcataacaaagtattagtatgactttttgaataagttaatttctgccagtgtttaattattttattaaagaaaaggatgttacactgaatccttaaagaataaaagtgatttgacctctgctttgagaagacagcctgt

SEQ ID NO: 12877 - DNA, 1109 bp, Homo sapiens
cttggaattcagggagatctttttcctcctggtggtcatcaggttttggccgtgggtggtgacactgtcccagggcctccctgggtttttctcactttactggtggtctgtgaggcaagggaaactggcaggcctggagtggagccctcgcaggctcttggtaccctggctgtcaagctgtgtgtttggctgccctgtttagccagggtttcaggaggtttctgtgcctgtggggtgcaggtcagactccaggtcccctttgtgccttcctggagtggctcacttttttcttttctgcgtcctgggggcccatgctagatgtctgctgtgcaggaaaacctggttcctggagggactgtgtgcacctctgggtgtgtgatgtcgtcagggtgccgcagtgctgactgccaggcaggggcagcagcctttgctcagtctgtaacattgactcccaaacaggcccaccttggcccccgtccagctgaccaacttcttcgggacacttgactccgtgctgaggtaccgggccactgtcatacaggcctttagggacatgaacagattcaccgtaaatgagacagtgctttccaccaaggacgtccttgtcctcttgcacaagtggagcctcattgaaagagacctcaagctccaggaagacctgagagcagccattgagaaggcccaagcccgggagctcatgagtgagtgtcagaacccaggactggcccagagtagccaacatgtctctctcaccctgtccgtccctccctctctctctgtctctcagccacatttccaaagctaatgaggctcagagatgggacacatccatcttggagccctggatggggagctgggcagcctttgagtttcagcccagctgcttactagctccctgtctttggagaagtcacttcacctaccttagtatcatggtgctcacctgtaaagaggctgggggtagctatgagctacttgccccaacctcctcctgtagtgcagggttaaggaaaagactggaacctggcctcctggactgaagctctgatgctgtcctgattccctgtgtttaaagaggacagtaatggcttctacctcatggtgtgagg

SEQ ID NO: 12878 - DNA, 1339 bp, Homo sapiens
actgctattaataagtcgaagacagccattagccacatcactggtatgggtagtagaaaaactaaaagggctccaccattcaattcaggcaagagtagacagagtagaggctttggtagcacagtcatggggaaaacatgcctggattgaaaatctgtattggcttaacatttgggagggggaatgcgcagggactgaattcagccttgtcaaaggcctaggaagaaaggtgactgtggagatgtcttaattgaaaaacacgtggggggctgggcgcggtggctcatgcctctgatcccagcactttgggatgccaaggaggattgcttgagctaaggagttcagcctgggcaacatagcacgacctcatctcaaaaaaaaaaagaaaaaaagaaaagaaaataataataacaaaaaaataagcggggaagggattagatggcagtccaaacaccagtattattcagaggaggagatttccagcatttcaatgttgcctggaaggctctctcctcttctggtattcagtgtgtctgccccaccatgccatgtgtttcagggttgttttcttgcagaagcgctggtggacctgatgctgacggtggtggagatgtgcccctctgtctgtgagagcagccactttgcagtgcttctcggggcctatggcgccactctcagcgtcctaggtgagggtgtgagggctgggtagtgtgagcagggggagggagtgagggccgggggtgtgagcagagatagggaatgagagctggagggatgtgagcaggaggagacagtgagaccaggcggtgcaagcagggtgaagatatgaggaccgggccatttgagcagggagggtatgagggcaggtggtgggagcagcaggagggtgtcaggggttcatcttcctaaaccgatcctgctttgacttgtagatcagaagattttacttctgcttcgagcgtatgagcagaacaagctcagcctcatcaacttcaggtgagtgttgggctagaggtagactaggccttgaggtcacagcctgctctccacacagtgagctccagactcgagattttctctcattccattttggttctcagggaaagagtgaggcaggcagcactcccctgactcacactggcttctgcatagggtgctctggggaagcttggccttatgccataaggcatctgggcagggccactgcagctgactgatgggtgcctgtctgtctggaattgcccctgttgtgcactgtcagctggactggggtgtctcatttggttgatttttctgaaaacttttctgctcatgcctttaggtagattgacttatgcca

SEQ ID NO: 12879 - DNA, 1113 bp, Homo sapiens
aggagtagcagggtgctgtactcagggtgtttgggtctccagcccttcttctccctcccaggatgggagatctggactgcccctggaacgtgactgccgggacgatttaggaggagagtgcaggtggcggtcaccctgtatgtggtcagcctggtctgtgtggggcgctctattgctgctgtggtggagcagcatgagagtggagatgtggtctctgcataatgcagcggacagatttttttttttcctacttgttaccaggcactaggttcaggatatcttgctgctgccagggccagtagtttcttcaaattcccgtgggccatttcagctgtctggccttttattcagtgacagttggtaccatttacactgttgaagggggctggaacatactacagtttaatgtttctgctgggaagtttggctgtacacatcaaaacttttaaggtgcttatgcatgggtttggatttatgatgggcccgtccccctggacctctcatagtaccccatgccagagcaaactgtagccctgaaccattgcctggcctctgttcccgtaggctgctggcactgaagtgggttgcacaatagataaagaaaaaagataaaaaaacttttaagatacttgatcctgcaattccatgtctagtcatttatcccagtgaaataattaaagatgtgagtagaggttttgttagggaataatatttatattagctggaaatgggtcttctaactatccaccagtaagggattggctgagcaaattggggactggtcataagatggaatgcagcgattaaaaatactctggaggctggccgtcgtggctcacacctgtaatcccagcattttgggagttggaggctggaggattgcttgagcccgggagttcttgagaccatcctggacaacatagtgagattctgtctctaccaaaacaaacaaacaaacaaacaaacaaaacaaaagttagctgggtgtgttggcgtgtacctgttgtctcagctacttgggaagctgaggtgggagaattgcttgagcctgggatgtcaaggctgcagtaagtggagattgcgccactgcactctagcctggaggacagaggg

SEQ ID NO: 12880 - DNA, 1225 bp, Homo sapiens
ctgtgagcctaagtgcagccgtgctagctgcgcaccgtggctaaggatgacgtctgtgttcctgtccatcactgatgctgctggctactgcatgtgccacacctgtctgttcgccattcctaacattctgtttcattcttcctcgggagatatttcaaacatttggtcttttcttttaacactgagggtaggcccttaggaaatttatttaggaaagtctgaacacgttatcacttggttttctggaaagtagcttaccctagaaaacagctgcaaatgccagaaagatgatccctaaaaatgttgagggacttctgttcattcatcccgagaacattggcttccacatcacagtatctacccttacatggtttaggattaaagccaggcaatcttttactatgcattaagacctctgattcaaaacttattagaacagtagcttctgctggaatttgcaatcactgaagtcatagaaaataggtaactatctaattagagaaataattgttgtattttaagatctgagagtgtgtacaagttttagtatacatgccatgccagaagatagtgtatgcaagaagtcttgggaccagaaaatggcaatgataggagactgacatagaagaagaatgcttccctaggaaaaaggtcgctggctttggtgcaagaggaagaagaatgttccactggaagcctgagcacctaatcagctctcagtgatcaacccactcttgttatgggtggtctctgtcactttgaatgccaggctggcttctcgtctagcagtattcagataccccttctgctcagcctgcttggcgttaaaatacaaatcattgaactgagggggaaaaatgtaactaggaagaaaaacccaatttaagaaattacataatgctttccaaaggcacctacaacttagttttaaattacttgctactggggattacccatggatatccttaataggcaggaagtctgggaattctggtggcctctagggcagtgttctcacagcaccgttccgacagggaccagtgaaagaaaagagacaaagttagaacgtgctggggagcggccatttctaaggccagtctggtttaagtagtcatttctgctgaaaaaacagatgatcctggtggaagaaaaggttgaaggcagctgccctcgggagggctgtgatgctcggcacatcctgcctggcacatacacgtgtctgcag

SEQ ID NO: 12881 - DNA, 1139 bp, Homo sapiens
catgatgtcagcttatgaacgctccatgatgtccccaatggctgatcgatctatgatgtccatgggtgctgaccggtctatgatgtcgtcatactctgctgctgaccggtctatgatgtcatcgtactctgcagctgaccgatctatgatgtcatcttatactgctgatcgttcaatgatgtctatggctgctgattcttacaccgattcttacactgacacatatacagaggcatatatggtgccacctttgcctcctgaagagcccccaacaatgccaccgttgccacctgaggagccaccaatgacaccaccattgcctcctgaggaaccaccagagggtccagcattgcccactgagcagtcagcattaacagctgaaaatacttggcctacagaggtgccatcatcaccatctgaagagtctgtatcgcagcctgagcctcctgtgagtcaaagtgagatttcggagccttcagcagtgcctactgattattcagtgtcagcatcagatccctcagttttagtatcagaggctgctgtgactgttccagaaccaccaccagagccagaatcttcaattacgttaacacctgtagagtctgcagtagtagcagaagaacatgaagttgttccagagagaccagtgacttgtatggtatctgaaactcccgccatgtcagctgaaccaactgtgttagcatcagagcctcctgttatgtcagagacagcagaaacatttgattccatgagagcctcaggacatgttgcctcagaagtatctacatccttgttggttccagcagtaactactccagtgctggcagagagcattctggagccgccagccatggctgccccagagtcttcagctatggctgtcctggagtcttcggctgtgaccgtcctggagtcttcgactgtgactgtcctggagtcttcgactgtaactgtcctggagccttcggttgtgactgtcccggagcctcctgttgtggctgagccagactatgttaccattcctgtgccagttgtttctgcgctggagccttctgtgcctgttctggaaccagcggtgtcagtccttcaaccttctatgattgtttcagaaccatctgtttctgtccaggaatcgactg

SEQ ID NO: 12882 - DNA, 1127 bp, Homo sapiens
gctccagagattggcatgcaggagattgcattgcattcaggtgaagaaccacatgctgaggaacacctgaaaggtgacttttacgaaagtgaacatggtataaatatagaccttaatataaataatcatttaattgctaaagagatggaacataatacagtgtgtgctgctggtactagtcctgttggggaaattggtgaagagaaaattttgcccaccagtgagactaaacagcgcacagtattggatacctaccctggtgttagtgaagctgatgcaggagaaactctatcttctactggtccttttgctctggaacctgatgcaacaggaactagtaagggtattgaatttaccacagcatctactctcagtttagttaataaatatgatgttgatttatctttaactactcaagatactgaacatgacatggtaatttccaccagtcctagtggtggtagtgaagctgacattgaagggcctttgcctgctaaagatattcatcttgatttaccatctaataataaccttgttagtaaggatacagaagaaccattacctgtaaaagagagtgaccagacattagcagctctgctcagccctaaagaaagtagtggaggagaaaaagaagtacctccccctcctaaagagacactgcctgattcaggattttctgccaatattgaggatattaatgaagcagatttagtgagaccgttacttcctaaggacatggaacgtcttacaagccttagagctggcattgaaggacctttacttgcaagtgatgttggacgtgacagatctgctgccagcccggttgtaagtagtatgccagaaagagcttcagagtcttcttcagaggaaaaagatgattatgaaatttttgtaaaagttaaggacactcacgaaaaaagcaagaaaaataagaaccgtgataagggggagaaagagaagaaaagagactcttcattaagatctcgaagtaagcgttccaaatcttctgaacacaaatcacgcaagcgtaccagtgaatctcgttctagggcaagaaagagatcatctaagtccaagtctcatcgctctcagacacgttcacggtcacgttcaagacgcaggaggag

SEQ ID NO: 12883 - DNA, 1189 bp, Homo sapiens
ggctggcaccgagtggccaaaacccgaaatacagatgtggcagcggcagaagctctgtttagcaggccattatccgggatggctaagctccgctagctaaaagttacttcccattacttttgctttccagttttagaagccaaactgactgaggagtgggacggttcgtttgaatggaggaggtgttgagtgagcaacacgcagaagctcgcctacagtttcgtttccattcacgacgcgttcactgatcgccacgagtatactgcatatacgcaaagacacagacaatcttcagaaatgatcttttgccaccggagcttggaaattaataagaatagctggccattgcctgaaaggaacttctttcgcatcaacatttcgggttttggctgtttggtaccagccattggcgataatggccggccattatcagttcttcctgcggttcgggttttggcagtaacatatatattttaaacacacttatttttgtttttaaaagtttgatcttttcaattgaggcttttttggggctttgttttattactatttttttggtgtgggtggatggggggagatgctaaaatattgctgctaggatccagaaataccacactgtttcatatattggaacttgttattggctagccttatgccagcctgccactgtcaatatattctgttccccttggttacaagcttaatatactcttgtgtttttggcgaaatgagctttttatcctattgtaatattttcaattgataatagatgtcattaaatctactgcttgtatagagacaggtgtacccaaatttactcttgacctttttataaagccaggtaatggagtctgttcctttgcatctcaggaaggaattgactttgctttatgtatcagacctcatcaattgcaccctctccatcatgccttattttcctaagttctccttaaagaaactcaacccacaaaacatttatggagagacatgttgctatctaatcctgttgcaaatatttcagatcttttgttttgccatacatctgggaaaatgtaaagcttctgaatctgtttcctcacttagatttattacaatatgaattacaactttttttaaaaaattaaggaccttgtaaacgcttctattgcttatttacctaatccaagctccttatccaaaatgctaagga

SEQ ID NO: 12884 - DNA, 1674 bp, Homo sapiens
tatgtttttcttgaataggtattgagaaatggagcccttaccagacccaattgtatgtttttcttgaataggtattgataaatggaagcgcttaccagcccagctttgccagccctaataagaagcatgctaaagccacagcagctactgtggttcttcaagcaatgggccttgtaccaaaggacctcatggctaatgccacttgcttcaggagtgcctcacgtagatagattgaggttttataataatcatttcagaattttactctgcatcacaatgtatttcctctttaatgttgtaaatatttggcaatttaagacattgtgtaaaaagcaatctgtaaaaacatctccaggctttgatttttgtaccatggaaattgtatttaaccatacagggttttggtatgtttatattgtttaccttagtgatgtatttgtttaagtggctaacatccaaacgactgtttgaaggcatcagagtaatcttcagtgtggaatgttaaataacgcttttatactgtattttgtactatgatgtaactccccttccttatggctaggctactgtaacacttgcctgtaatcagtgaagggctgtgcaccttgtactatttcacaatgggttctgctggacagataatgggccagtgttattgaggtgatcaagatctgttccacagggctaatgccaccatctcccctcaaaattttgtagaggttctaaaaagaaagtggtatgttgtgtgatgatcagcactaagtcctgcattcctgttaaagccacttgggtcataagaagggagtaaaaaatgaagtctgactagaattctattgcagaggccagtacatttagtatggcattgagttgtgatatagttttactttgatgtgcattttgaatttcagctacacctagatagacgtaaaatgataattaaaatgctgtaaccaacttatctaataaaattggcaaccagccactattttgttgactatgagaaagttaaaagtttatgttaatttttagggtctgatagaatatttcatgtgtattacagtggtattcatatgctatgtctctaaactttattttcaaaagcttaaggcccaaatacaaacttctctggaataaacgtggtgttttattttctgggttataaagtgaacaaatacttagatactattatttctttacccaatgcttttgatttttaagcacttttattttaaaaatgtgaattatacagtccccccctacacacacacacacacacacacacacacacacacacacacacacacacacacacacacacacacacacacacacacacacacacacacacacacacacccctataagcacattaaatactactttgccgtgacagctcagtgtacttcacaattcttaacactattctatgtggaatacaaaatgcctttttatctgaattaacatgcatttaaaaagttttagtatatgtgaaaataaaggaattataaatcagtaggaaagatattaaggtagaagcatcaccaatcaactagctcagtagatgttgtctgtatttattttctacctttatgaaacaagaacctgctaacaggtaaatcgtaaagtaacatatttttgccctgatgccattagtcacaatgccatggggtaact

SEQ ID NO: 12885 - DNA, 1350 bp, Homo sapiens
cttataaccattaatattttgggattttgtcactacaaaaattcttagcatcaacttctattaataggatgaatcacattaatcagccatttatttgtcagtctccatagtaattatttaactcttctgtgtttaaagactaatgtgctttttactgacttgtacacacatttccacaggaggttgttcataaggagcttactaactgtggtttgcaccctaacactctggagcaacttagtcaaataccgttacttgggaaatcatctttacggaatgtggtgctgagagactacatttataattggagatcctgaacaccaaagtaagcctaaaaggaatctttgaggaaaaaagccttctagcaaggaaattcaagattcttgaagttgaaggaatatactgaaatgtttataaacataacttttactacagtagcatctaaggttttaaatgtgttttactattttcagattagatttttagatataaagatgaaaaactcagataactcaaatgagatatctatatccctacaacctaattgtatattgagcagaaactgaattaatatgcttccttgcaaatgggaaatcacatagcagttaccccatggcattgtgactaatggcatcagggcaaaaatatgttactttacgatttacctgttagcaggttcttgtttcataaaggtagaaaataaatacagacaacatctactgagctagttgattggtgatgcttctaccttaatatctttcctactgatttataattcctttattttcacatatactaaaactttttaaatgcatgttaattcagataaaaaggcattttgtattccacatagaatagtgttaagaattgtgaagtacactgagctgtcacggcaaagtagtatttaatgtgcttataggggtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtagggggggactgtataattcacatttttaaaataaaagtgcttaaaaatcaaaagcattgggtaaagaaataatagtatctaagtatttgttcactttataacccagaaaataaaacaccacgtttattccagagaagtttgtatttgggccttaagcttttgaaaataaagtttagagacatagcatatgaataccactgtaatacacatgaaatattctatcagaccctaaaaattaacataaacttttaactttctcatagtcaacaaaatagtggctggttgccaattttattagataagttggttacagcattttaattatcattt

SEQ ID NO: 12886 - DNA, 1254 bp, Homo sapiens
aacttttaaagctacctcataatagctcttaaaaacacatttaaaacacttagaggtgatcctttttcctagccatcagtgggacaaattaattcctttttgagtaaaaaaaaaaaaaaaaaaaaaattctctttttttagtactcaagatcagcaagtattggttgactcattctttgttgttaaacctcttggtttctcaggccagtgtgtctttttgtatactttgaccttgcactttaaactgaattccttttgtcctttgagggaggcataaagctgtcagttcctgttggtgagtgtgggaaattgagttttcactcttctctataatttctgcatttcaagtggttttaataataatcataactatttctcaattttacttcttaaaaaagtagattcatcagactgaattgaatatttgttttccttctaaagctgaagccaattttgccatacttgtttgtgcattcttaagagtttagtacttaagcatagaaaactgtggggttcacatttatattttgctttattacaacttagaaggtaattgatgacttggctctgtggtatgctcaaagtgctggactgagctagttcaagaatgtcattagcagtgaatgggaaatatgtgtctacttttcttcagtagctaaacagaagtaattatatatttacattctacctatttcatagggatgttgttagaattactgtgattagatttttttttttaatttccaaatgtatttaagcttctttacagataggtgccatatcaaagcaaggtgttaatgtcatttttctcaatttgtgtttttgtcactagaaatatatatatattgctttttctcttttcctggtatatttttctgataaatgttttgaaatttgttatcttaagtttttcatagctggaatgctagaaaagcatttatgtcctatttttagtgcaagtgatgagtctggctgggtgggtaagttaatggcaaggtaattgaactgtgctgagtgctcgccgatgtatccttctggcctctccattttcagggtagagttactgtttacagtgacatgtttcacagtctgtgtgaccagccagtgtgaatcagttcgtctattgcctggctttcttgagctcaatttttgtctcatttcccctttccattttatatatcacatttcaagatggatgatctacttgtctaaccactccagggaagattggtgccatctaataaagtcaaaatg

SEQ ID NO: 12887 - DNA, 1233 bp, Homo sapiens
tgttccagaacccctgcgagcagccgttggccgcacagcccccgggccggccgcgaccccgccttgcgccgcgaaggtccctagctccggggagtcgcgggcgaggggcacgcgcacggacgagaccgcaccgcagcgcacgcgcactggcgggcactcactcgcccgccgcccgggaggagaaggaaggcatggaaagttccagccggttcgagagctaggtagcaggcatggcaggaggcggggtaggggcaggcagggtcgcgagggggcgtgcggccgccgcgagccgctctgggccgcgtctgcagcaccgcccctagccgcggccggcgggctgggctggggtcggggcgggggcggtgcggcgggtgcggggctgcggagggggcgtggcggccgcccgcgggcggagagggggcggggcggcggcaaggcgcgcgggcggggcggggcgcgccgagggggcgtggcgcggcgtctgcgcagctgccagcgcctttaagcccgggctcgcgctctcggaccgtgctttcgccgcctgggagccgtccggcgcagcagtttctaggtccccactgtccccgccgtcccgccccttcgcgtcccgggaaccggctggcttccgagccgcactcgccgatcctccaggcatgccccgctacgagctggctttaatcctgaaagccatgcagcgggtaagtgaccttccctcagagccggtcttcccgcgcgggcgcccccgctgccgctaggccgccgtcccccgcgcgccctggccgcgggaccccgggccttcctgcactcctcggaggaggccggggcggcgggcgggcggcgggcgtccgcgggaagggggcgcgcgtgggccggccgggcccggccgcgtgcgcgcgggaggcgggggtgtgcctgcgcgtgtgcgcggtccgggagggtgtgcctcgcaagcggcccgccgggcggggggcggggcggaccgagcgggccccgaccccgatcccggcgccggcccgcgggagtccagtggaaggtccgcgggaggacacgcgcgggcgcccagcccgactccggcccgtccccgccagtcgtgaagctgcctcgtcgccggccccgccgccgccgcctggtccgtcccgctccgccgcccgccggctgccgccgaccgcctccgctctagcgcccgccggccgcccggaacgtccgcgcccaataaagcgttcctccaaagct

SEQ ID NO: 12888 - DNA, 1233 bp, Homo sapiens; identical to SEQ ID NO: 12887

SEQ ID NO: 12889 - DNA, 1067 bp, Homo sapiens
cacaaatgatgatatgcagatcagtgacatttccctgcaggattccattgcagtgaaggagaagtatgccaagtacctgcctcacaatgcagggccttatgctgccaaacgcttctgcaaagctcagtgccccattgtggagtccctcactaactccatgataatgcatggccacaacaacagcaagaagctcatgactgtgcgcatcatcaagtatgccttccatttcatccacctgctcacaggcgagaaccctcacctccaggtcctggtgaacaccatcatcaatggtggtccccaggaggactccacaggctttgggtgagcagggactgtgagatgacaggctgtggacgtgtccccactgcaccatgtgaatcagaccacctggttgctgtgcacaggcactcttgagggtgccctccgggagatcatgaccattgctgagtgcctggcagatgagctcatcactgccaccaagggctcctccaactcctttgccatcaagaagaaggatgagctggcatgtgtggccaagtccaaccgctgattttcccagctgatgcccaataaaccagtctgccctttggggtaaccccacgccaccacaaaaaaaaaaaaaaaaaaaaaaaaaaccggctctcatatacattgctggtatagtttggcactttcctaaacatacacctacagttatgatctagccattccactgctaggtatttaccccaaagaaattaaagcatgtgtccacacaacaacttgtacacaaatgttcacagcagctgtacctataacaaccccaaactggaaaaaaacaaatattcactacatacaatgccatactactcagcaatgaaaaggagtgaactattgatacacactattgatctcaaaataattatgctgagtgaaagaaactagagtaaaaggggtccaataccatccaattctatgtaagtctaaaaaaaaagatgttcctcaacttacaatatacgcatttcgataaacccgtaaattgaaaatattttatgttgaaaacgcatttaatacaccacctaacctaa

SEQ ID NO: 12890 - DNA, 1163 bp, Homo sapiens
catgcctttcttaatcttttcccatgtttgtgggctcatggttctcttaggtgtgttagttcacagggaaaatcctttgaaaagttagaagagtatctaatagatgttttcacacacacacacaacattaatgaatagtttggaaaattcagtctcgtcaatggattagaagttttcccccatgctttctagtacttcacaccatctgtaatgtcacagtgtgtttttgctgccataaagctggtttggattcatattttcacaagagtgtaatgggaaagaccatagaaaaagggagattgggcttaacactgcaattctgtttagctggtcagctggtagtttctattttgacaaggttatgtgtgtgtatgtgtgtgtttgtgtgtagttgatgtctgtctaggaagagtaaaatggaaacactgaccaaaatagtagaattattacaattcaaatgcagacactcacaagtttttattttattgcaggtatttcttggtggatttttatgcacccaccgcagctgttgaaagcatggtggagcacttgtctcgagatatagatgtgattagagggaatattgtcaaacaccctctgacccaggaactaaaagaatgtgaagggattgtcccagtcccactcgcagaaaaattatattccacaaagaagaggaagaagtgagaagattcgccagattttagccttatatgtaattccttcacatttgggcagcatggacgagaaggaagaatttgcaagtttggcctttatataagcatgtgttgcaggtgctgtttgatttttctaaggtatttttagcccttgatcccctttgcttgcgagaggtggggaactgctcactgacagcttctctgtaacctgcagtaccagtggatcgttcttgattttgttttcattagtgtcatttctttgtcattgaggacttttccccttacaacagtaacaccattttttgaagagcaaaacttataatacctcctgggattgtgagctagtcattcagcctgtgtaaccatgtggaaataaaaattgacgaccaatgtattatatggacaacttttgctttgagtaataaacttgattgtaggaatgtgggaggtgttttgtccctttacttacccagtgcagtgcacttccag

SEQ ID NO: 12891 - DNA, 1456 bp, Homo sapiens
tatgtctggctgtgtctctcagcccaatcgaatggtcacgagcagctggcccagcagagccctgaatgctcttttatgtttgccttttgactcccaaggacttgtctgagtgaccctgcgattattttccctccttaggggaaaagtatgaattgcacgcagcgactgacaccactcccagcgtggtggtccatgtatgtgagagtgatcaagagaaggaggaagaagaggaaatggaaagaatgaggagacctaagccaaaaattatccagaccaggaggccggagtacacgccgatccacctcagctgaactggcacgcgacgaggacgcattccaaatcatactcacgggaggaatcttttactgtggaggtggctggtcacgacttcttcggaggtggcagccgagatcggggtggcagaaatcccagttcatgttgctcagaagagaatcaaggccgtgtccccttgttctaatgctgcacaccagttactgttcatggcacccgggaatgacttgggccaatcactgagtttgtggtgatcgcacaaggacatttgggactgtcttgagaaaacagataatgatagtgttttgtacttgttcttttctggtaggttctgtctgtgccaagggcaggttgatcagtgagctcaggagagagcttcctgtttctaagtggcctgcaggggccactctctactggtaggaagaggtaccacaggaagccgcctagtgcagagaggttgtgaaaacagcagcaatgcaatgtggaaattgtagcgtttcctttcttccctcatgttctcatgtttgtgcatgtatattactgatttacaagactaacctttgttcgtatataaagttacaccgttgttgttttacatcttttgggaagccaggaaagcgtttggaaaacgtatcacctttcccagattctcggattctcgactctttgcaacagcacttgcttgcggaactcttcctggaatgcattcactcagcatccccaaccgtgcaacgtgtaacttgtgcttttgcaaaagaagttgatctgaaattcctctgtagaatttagcttatacaattcagagaatagcagtttcactgccaacttttagtgggtgagaaattttagtttaggtgtttgggatcggacctcagtttctgttgtttcttttatgtggtggtttctatacatgaatcatagccaaaaacttttttggaaactgttggttgagatagttggttcttttaccccacgaagacatcaagatacacttgtaaataaagctgatagcatatattcatacctgttgtacacttgggtgaaaagtatggcagtgggagactaagatgtattaacctacctgtgaatcatatgttgtaggaaaagctgttcccatgtctaacaggacttgaattcaaagcatgtcaagtggatagtagatctg

SEQ ID NO: 12892 - DNA, 1205 bp, Homo sapiens
aagaaatatcaaatgtatcagaaagtaatgatgctataggaaaaaataagacttggagggcaggaggagggagtggagatctgggagtggaggggagattgctattttccataagatgatcagggaaggtcttactgatatggtgatattttgagcagagacaatgtagcattggttcattcaggctttgctgtctattgagtgcttactgtgttccagccactggtttaggcccagaggataaagcagggaacatttcaagctccttgctttcatggagcttaggatccagtggttgagggggagatagacaataggaaaaaggcaagtgaacaagatcatttcggatagtgataaatgcgatgaagagactgaaacagggatagagagcaaggggagggggcttggtcagagtggtcaggtcctaacactgtgggggttttgttgaagagctggtgaattggggcagtcctgagggaactaacaagggatgtccaggcctgcagccatgagcaacagctggaagctggagctgggggaggaagtcacgtggctggaaacctaggggaggagctgcctgccaggagctgtagacttgaaggtgtggagttgagatgctaaggcagggtacaggcagggaagaaattctcaggcttctgatttcattggcagaactcaaaggacagctaggaggcaagggagcccctgcagtggagtccataggttgggtcatcctttcagggcccacagaagggtagataatggctctggggacagtgtggataaaggggacttacacagaggagttagtagggagccactttagatggagtggcccagggaggcctctgcacagcctggaccaggttgacaggaagaagctccctggggaggtgtttgtgtggccggcatcccggcagagggactagcaggtgcagaagctccagtgcagggtgaactccatttttaaaggacttgaagggttgcatgagagacagagaggcgattggtagctgaggttggataagcaaccagaaaacatccccctggggccatggtaaggattcaggtgtgattctaattgcacatcttggtggagaatggctttcaggagggaaactgggtaggctagagaggaagcaaggagacctggtaggaggctgttgccatcatccaggggagataggaagggagtgggactagga

SEQ ID NO: 12893 - DNA, 1118 bp, Homo sapiens
aaatcaagagtcaggaaaagtaggagaagcttttaagttttagttttgtgttgaatcttttttttttgaggtgggggggtctccctctgtcccccacactggagtgcagtggtgtgatctcggctcactgcagcctccgcctccatacttgacagaaaaatcagaaaatgtacctttttgtacatatatacattttttaaaattaaaatgtgatcataccatacgtgctgttttgtaatctttttcacttagtaataaatatatcagcatctatatagatcagttgattgtattctgcaagtcatttttactggctgcggtatattgagcttatttttaatgaaaaataaccaaatcagaataacatacagctttatagcctattttattgaagagttaattgatcttttatcaagttaataggagagcttctgtgtaaatccatgtctaagtaatggtgagcaaacctgtagatactaacttcttgttatgttattttccaggcttattgcagtatattatatctaaagccaagaatgcagatcatcctacgtggacagaaagtgaagacacagctggtttcgaagagtcttgcctacatcgaacgtgatgtttatcgaccaaaatttttagtatcctttttctgattccttatagagatatgttagtcaggtgtattctcttttgcccctttccccttatatgctgatagggattctagtctgctctagctttgccctcctttgtgtgcttttggacttaccaaataatgaaatagaaaggatgatttgaactgagtgaggtgttgtgttcaaaatttaccttaatattttaagtctaaaacagtgagaattacctttggattcaactgcagaaataaagatcattatgggataatgatgtatcacagaaatagactcatcaaagcttatgaaaaagttggatgtcagttaagggtaagctttattttttatttgaaaagaaaatgtctattttccacaaaagttaggataatatatgctcttgagtcaaatgttaaataattttattgtaccttttgcctatagctttttaatgtaaatttgtaaaaaataacactgtggtatttgaacttttat

SEQ ID NO: 12894 - DNA, 1415 bp, Homo sapiens
tgtgggcctgtgcttccagctactcaggaggctgaggtgggagaattgcgtgaaccctggagagcagtggtgccatcgcagctcactgcagccttgacctcctgggctcaggtgatcccccacctcaccctcttgagaagctgagactacaggtgtcgtcaccaagcccggctaatattttgtgtttttagtagagtcagggtttcaccatgttggccaggctggtctcgaactcctgggctccagcgatctccctcctcggcttcacaaatgctgggaatacaggcatgggcaagtgcacctgactcataaaagtgaattattaaagtaaattgagttctctaggggaggttttgcttttccttttgtttaattgtatattattctacggagatttgattttgatattttactttttaaggtctacatgaatcttaacttgtaatgctcatctaataagttacatatttgtatttgcagcctcaaactccgatctcttcgagttaacgtaggacaactgctggctatgattgtgcctgatcttgatcttcagcaagtgaattacgatgttgatgtagttgatgagattttaggacaagttgttgaacaaatgagtgaaatcagtagtacttaaagtatatgttatgtaagataaaatatttgctcaattcttttggttgtacagctttcaaaatataattaattttgttttatagatatgataggcaacagactgaaaaccataatctttactgtattctatgcattcaaatgtggtcacaaatattgtggacacattatcttatgttttgaaatacctgtgaattgttggcattgagcagctgaagctaactcatgactctgttttgaatgtaaatatttgtaattaagcctgcacatatttttttattgccctagagtactcaagtgtttttcaccaagagcttttcaggttgcccctaagctttgtgcaattttttctggttccccaaagtgtatttttctctaagtcgagggctatgccataatacaaatggaaatgttacctttgattttcttataaaggagtttaaataggatttttaaataatgtagtaacactcctgatacaactctggttataagtgaattgagcattaatgtttcttttgtataaattcctgtcctgaaatattttattcatgaaaataaggtaagcaaaaaccaactccattttgccaggattttgttgtgctgagattgccaatcacggttaaacacaaagtgtttttatagaatgaagaaacagtctttaacagaaaaaaggtattgaaatattaaatggccaccaagtttactttgaagcccatttttggctgtttagtcagcatgaagtgggcatgataattttttaatatttctttttgtgaaatttc

SEQ ID NO: 12895 - DNA, 1268 bp, Homo sapiens
cactacaacctccgcctcctgggttcaagcaattctcctgcctcagcctcccgaatagctgggattacaggcgcccaccaccatggctggctaatttttttgtatttgtagtagagacagggtttcaccatgttggccaggctggtcttgaactcctgacctcaaatgatacacctgccttggcctcccaaagtgctgggattacaggcgtgagccaccgcacccggcctattcaagtgaaaattgctagtagcacagataggttgcagcgacttagcaaatcgcgatgaaactgcatgagtgagtcgctatcacacactcttttccagttgtatcttttccctggtttttgccttcaaacaagcttgtgattttgctcgaacttccctcttctaagtagatgtgagagtgttggtaaggtctgtaacttttccctgttttggggacgaaggtccagcgatggtgccttcctggccatttcttccacggacggttactgctcatttgtgacatttgagaaagatgaacttggaattcctttgaaagagaagccagttttgaacatgagaactcctgatacagcaaagaaaaccaagagtcagacacatcgagggtcttcgccaggacccagaccggtagagggaacccctgccagcagaacccaagaccccagcagccccggcacgactccccctcaggccagacaggccccagccccaacagtcatcagggaccctccctccatcactcctgctgtcaaaagccccttgccggggccttcggaggagaagaccctgcagcccagtagtcaaaacacaaaagcccacccatcccggagggtcactctgaacacactgcaagcctggagcaagacaacaccccggtaagaacttgttggaacaagatgtcattgcaaaatgaaacacaaaatgcagacagaacgctcccaccctgctgcaggtgaaatttcaggcggtgaatgcttcatgccagtaggttgccagagagattcttaacttcaaatccgagagtgtcatttcttgcatataggcctctgtttgttcctccagtttctgcctgtcagataaagcccaggctcctatgcacacacacagactgtgatttggctgcagcctgtcatccaggactgtggccactctctctcctgagtctgtggccttcatctccggcctagtcctgaatgtcatcttcccagagcactctctgccctttgaggcctctgtccttcccttctctggggaagccct

SEQ ID NO: 12896 - DNA, 1288 bp, Homo sapiens
caagacagaaacacactgagatggataggagaatatgagcagttgataggaaagttctcagtggagtcaggatttaggttaggccaggagattgagaatataacagtttgtgtatgatgaaatggcatatttcacagaatgcagtaaaagcaggtagggtacaagtgcagcaacaggaagatgtcttttcttcattcagcaaacacttatttgagagcttaccatgtgctaggcacatacaaagataaataagatgcccttgatgatcctctatttaaaggagacatgtaaacaggttaacttagagtagagatggtgaatatgtgaacctgaggaaaggaagaaatagattaaattatctggagagagaggaaaagtcagcagaatggggacgagaatctttcggagctcagtgttctgataggagttatttccttgggcataggttccaagtatttttctaatataccatagaagccaggaaaactttcttctgttatctcaaatgatttaattactgacttgagtttgtgttgtctccttagacttgtgcaccatggacaattttgctgagggagatttcactgtggcggattatgccttgttagaagattgccctcacgtggatgattgtgtctttgctgctgaatttatgagcaatgattatgttcgtgtgactcagctttactgtgatggggtggtaagtaggtttgctaatttttcatttttgacattgtgtattgaaggttttctggtttagggctatctgagtaaagatgtttttgtggtacgtgcgttttgacagggaggtacacatgctgttgaaaagttgatttgagaagggaaagtaagcactggctcaaaaataagattgtggagtgccagagaatgagtggtggcaaaaggtggttttctgacagggcataagaaaagctcttggggagagccatagaagcaaactcaggtaatactgtaaaacgggtctcaaattaagactctttggctgaagatgtgtttgaagcatataaataaatgcccactgaaagttctttggttagttctgataatccttagattaaaaatcaagaacattttactagacacaaatcaaaataattttcttctttttagggtgtgcaatataaagattatatccaaagtgagaggaatttgggtgagtacgttggtatttttaatgttaatttatggaaagactacaaagggaggtccatccatcctgtcatagcaatacaacagatttatatgccttttaaaaatgtattcttac

SEQ ID NO: 12897 - DNA, 1181 bp, Homo sapiens
atcactgcactgagtgcccatttgcccagccacatcttcctcttgttctttatctccttattcttctgtttgccacagaccacgtaaaatatgtagttcctttggagaactttaatctataaatttaaccttggggtaaggatggaagtctttgtgtagatgagatctgagaaccctcatccaccttgttatattgcacttgcctgctaccccaggcagtctggccaggttgtagacctcaaattgcaggtctgtagtaattgcagaagcatcttgagctctgagggtggcctgaagtcacctgaagaggtaacatatatgagtccatagtatctgttaatttatatgtcagagtctgtctactctaagttacatgccagagtagcaaaaaataagtggttgtaccagttttgtagtaaggatctgaaatacttgcataagatgaatttataatgccacatgcaaatttagaattaataaccaaagccccattcttcatttctcttttgaaacagaaaatcttggcaatggaagaagctctgaattggataaaatatgcaggcgatgtaacaattctaactaaattaggatcaattgacaattgttggcctatgttaagtattttctttactgaatgtaagtataaatgctttaaattgttacttgactcagtttttaaaggtgtttgggaaaatgagatatgtagttaagtgatttctgatttatcttagaatttaaaaaaagtttttattttgttatatatggctgaaaaagagaatttcttttttttattatttatttatttatttatttatttattttgaggcagattcttgctctgttgcccaggctggagtgcagtggtgcagtctctgctcactgcaagctccgcctcccgggttcacaccattctcctgcctcagcctcccgagtagttgagactatgggcgcctgctaccacgcctggctaatttattgtatttttagtagagacagggtttcaccgtgttcaccaggttgatctcgatctcctgacctcgtggtctgcctgccttggcctcccaaagtgctgggattacaggcgtgggccaccgtgcctggccgaaaaagagaatttcaaactggtagttttattctatattttctgtcttaattatttttatgacattgtactttaaaaa

SEQ ID NO: 12898 - DNA, 1166 bp, Homo sapiens
ctaaaacttctgaaataattaatttatcctgaaagattagaaaatataagttgaaactttaaatgaaaaagagattcaatttaaaaaagaactttggcaagattgatatctaaaagggtaaaaataataatactgtatcttacaacatggttatcactgttctgagcatttaatgtgtattaactcgtaaaaccatcacaactacgtgaggtaggtgctactgcctttttacagatgatgaaacaggtatagggaggccaagcaaagtgtctgaggacactaggtggatgtgatggagccagaatttgaacccaggcagcctggatgtagagtctctactattaatcactatgggaaggtggtgatagaataaaagggaatgtgaaagtcgaaaaaattaaaaaataaatggtctaaatagtcaataaacgtttatgaggaaatgattatccttccaggacatgtagattaaaaactacgagtttctcatttatacccatcagatggacaaaagcttaaaaatctcataataccaagtgtttgagaggatgtggaacaaaggagactctcatattcagctggagaaagtgtaaattggtacaatcactttggagagcaatttgacaaggtgaagatgtgcatactctgcaacccacttctaggctcatatcctctgaactctcaaatgtgtacccaagaagatatgtacatgccttcatgatagcattgtttgtaagagtaaagaaatgaaaacgacctaaatggccatcaataggggaatggataaatatggtatattcatacaatggaattctatatggcagttaaaatgaacgcaatgttgagtgaaaaagcaagtcacagaatgatttgtacactgtgatgccatttattaatgtttaaaaacatgcaaaacaatatgcatatatacagactgtgtattaacaatgtttaaaaatgcatgggcatgttaaacacccggggagtggctggggagagaaggagggaaaagggattggagttgggaggggtggtacacggtgggtgtcaactgtaacaaactactacaaaaagagctgaagtatatggcaacatgttaatttcttgctaaggtggtatgccattggtacatgggtgttcattttgttaatgttctctgtactttt

SEQ ID NO: 12899 - DNA, 1152 bp, Homo sapiens
cccactttgccttagttgtaggatgtggtcatatgccagtaaatgtgaaattttattagtattaatattaattgcattcatatactaattgtgatatttataatatatgctattataacgctgtttgtagtgctatatattataagtaatgttcagcattgattcaacaaatattggggttctgttgatggataatgtcagaaatgagcaaaaacagcctctgtgtttcagacagtgggctggcattgtgagggccttgtagtgggaaggaatttgttgcatttgtggaactgatagttgctagatggcctgaatacagaggagagggtagtatgttcataggctaagccaaggagggccttgtaggctgtgttaaggcttttggcctttaagagcaataagaaagtaaaggattttaaactgaggagagagagcatgattagcacttaaaaaaaaaatttgagcatagtgaaaatggatctgaaggggatgtagtgtggatgtaggttaggaggctgttgcagtagcccaggccagagatgatggcttccagcagaatattgacagtgggaatggaaaagtagaaggattcaagagtttagaggtgaagctgacagaagttgctcgtggttggtgttggaacttgagagtgaaggtggttggaactgttctgacgtttctgccttaagcagcatcatggattatgggcctactcactcacattgggattgctggaagaggaataaatttgtaggaggtagaactggacttcactctcggacactgaatcgaagtgcctttgaaggccaggcatggtgactcacgcctgtaatcccagcactttgggaggccgaggtgggaggatcaccagaggtcaggagttcgagaccagcctggccaacatggtgaaaccctttctctactacaactacaaaaattagctgggcgtggtggtaggtgcttctaatctcagttactcgggaggctgaggcaggagaattgcttgaacgtgggaggcggaggttgcagtgagccaaagtagcgccattgcgctccagcctcggcgacgagcaaaactccgtctcaaaaaaaaaaaaaaaaaaaaagaaagaagtgcctttgaagcatccaaattccaatgttgtgtaggta

SEQ ID NO: 12900 - DNA, 1169 bp, Homo sapiens
tgattaaattagacctaacctgggtcttatggtctagcttccatgctctattcagtgtagcttaactgatgttgtgtgaaagacctggtagtgatacatttggaaagtcttactgacatgcagaaatagtacagaaaaacatacaaataggaatgttattggctgggcatggtggctcacacctgtaatcccagcactttgggaggccaaggcgggtggatcacaaggtcaggagatcgagaccatcgtggctaacatggtgaaaccctgtgcctactaaaaattcaaaaaattagccgggtgtactggcatgtgcctgtaatcctagctacttgggaggctgaggcaggagaatcacttgaacccgggaggcaaaggttgcagtgagccaagatcacgccactgcactccagcctgggcgacagagcgagactctgtctcaaaaaaaacaaaagaatgctatgcataggtacaatgtcgaaatgtgcaagaaatacttcagaaatattaaaagtagttattcctgggtagttgtgattgtgactctgggtgactttttccctttgttttatttttctgtattttccaaatttcctataatggacatatattatatggattttttttaattaaaattatcttttgactagataatatacatggaaaattcacaaagtacacatatgcaagatataatacttttactataaaagagtgaaaatttttaaatacttgtttttccttttagaaatgcactcggtgatggaaagagagccactattctgaagaacacttggccaaaggtaggtttcttctgtattttatattgagcaaataatgccatacaacattgtgaaaaatctgtttatagggtgtgtttgttcataaaaatgctatatgaaattacgtagagctccagaatgtgaaaggggagtcatcagatccatgatcagcgtggggacccagccacagcactgacaggctgtgcgtgaggacaggtggcctgtgggcatcttgagtcttcagggtgccttagtgattgagaggtcatctctgcgtattctgggtgggtgtgcctgaatgtgaaaaatgacttaaaactggggaggaagtataggaggctgtctttataggaggcaggaaaagatttcttaacacacagtgcacaa

SEQ ID NO: 12901 - DNA, 1726 bp, Homo sapiens
aaattttctttatagtatcattgattgcagttaaccttatgtttgttatatttgttgttgaggaaaggttgagatcagtgaaaagtgaaacagtgttttcctttgggagaataaaagtttttttcaaatagacatattcaagtacttccttatagtaactcatgtaaatgtaaattttttccaagttacttctctcagtttttggaggaacatggtcccttggacatgagtaacaagatgttctctgcagaatatgagtttttcccagaagaaactcgacagatactagaaaaagcaggaggtttaaaaccttttctcttgggatgccctcgttttgttgtgattgacaactgtattgcactgaagaaggttgcatcacggctcaagaaaaaaaggaagaagaaaaacattaaaacaaaagtagaagaaatttcaaaagcaggggagtatgtacgagttaaactacaactgaatccagctgctagggaatttaaaccagatgtaaagtctaaaccagtgtcagattcatcttcagcaccagcttttgaaaatgtgaaacccaaacctgtgtctgcaaattctcccaagccagcttgtgaagatgtgaaggccaaaccagtatccgacaattcttctagacaagtttctgaggatgggcaacccaaaggggtctcttctaattctcctaaaccaggctctgaggatgcaaattacaagcgagtctcctgtaattcccccaaaccggttcttgaggatgtgaaaccaacttattgggctcaatcccatttggtcacaggatactgtacgtatcttcctttccagagatttgatatcacccagacaccgccagcatacataaacgtgttaccaggtttgccccagtacaccagcatatatacacccttggccagcctttctcctgaatatcagctaccaagatcagtaccagtggtgccgtcttttgtagccaatgacagagcagataaaaatgctgctgcctattttgagggtcatcatttgaatgctgagaatgttgctggtcaccagattgcctctgaaacacagatccttgagggctctttgggaatatctgtaaagtcacactgcagcacaggtgatgctcatacagtcctgagtgagtctaacagaaatgatgagcactgtggaaattctaacaacaaatgtgaagtaattccagaaagcaccagtgcagtaacaaacattccacacgtgcagatggttgccatacaggtaagagttaaatagaaaagtcttcttaatactgaagttaaattttccttttcatttttcattgccgttatatttgcaagaatccttaaagttgattgactttataatgattactgaagcttttgcctgaaaatacttttaaaatatgaactcttttgtgaggcatgacaggtaatcttctcagaaagaagcttgggtccaataaacaatacccatctttgctactgaaattctacacagattgagaaataagacagcaggtggagccaaaacgtcatcctaagaattaataaaggtgctggaggagaaggtggctgtttgtaggaaagttcaagtgctagctggaagtgtagcctgcatcacagtgccttacctgccagttacaggagggcccacctggaggccttccagcgtggggtgcctgccccataggacttagcgcatgaaggaggaagggaaaatgtgctggcagctc

SEQ ID NO: 12902 - DNA, 1485 bp, Homo sapiens
atgttaaaatattggctgatttagaccaaaagattcaaatctcctctttgtgaaatcccatctgcatttgattttttattattttatgttcccccgttagattgttttaagtgtttgcttttcatcttttatagatgtaatctgattttcaaaaatcattaacactttttaattagtatcgactaagactttttccccctggaatcgaggctgtgtgtccgtcatcccagcccccggttggagcctgctctttgaactccgctgccttccttagcagcttctgtcctcttctgtgagtcagtcagcgagtgcttgggatccgcatccagccgtgctgagcacacaacaggctgtgtgtggaaatggccaccaccattctccttccccaccccaccacaaaaagagaagctgtgtctttagacaaccctgaggtatctgtgttacaatcgttctgtgtttgatatttgtgtaaagtatgcatgcagtcttgtactgtgacctaagaacaaaactgtaactgcattagaaaccatgaaaaaattagatattgttttgtgacttttagacagtggtaaatatagaaccatgaattctggtcacattccatttctctccaacatgaaggatcaaaaaatgtttttcaatgtgttctttgttccactggaaacttagagtcatgagtttatgagctgatttggtcaccttcctctgcctttgttcactgtgagttctgatgtcttagtgacttagttcttagaagctcacgccttagtttgaaacagattctccacggtggtccccaaaacactgtctgcatatccataagaattgagcgctatgggtgttaacgtgcatgaggatcagtttgcagcagcaagtacaaaaggagaagaggaacatccgttgaatgagtgtgttttgtacataacttcagatacttgtgaacatgccttatatttgtccaacaactgtcagaataaagaacattctaaaatgagaagttcactgtcactcttgtccattctttcttagagaagtttaaaaatgcattcttctggaaaacttaggacatgtatgtcatgctaacattttaagagtgctttcgtcaggaaagaacagccacgccatgctgtgtctgaggagtctgaccagggatctcagggcgttttagggcctgggtcagaattttcctttgtgcctgcgtaagatcgactataggagttcacacagagatgatagagtttacttcttaaggctaaattaagagatttttcatgtgaatacatataaggatgttgaagataaattgcattccttggtatattttttgaggcatttgtggatttatgggccactgaggctgtcgatggggtttcctctatagaggggcttctgggtatgctgagcactcacagagtgaaagctcatttgaagaaagctcattttcaaaatctgtcttctgttttttcaagtgtattcaaagta

SEQ ID NO: 12903 - DNA, 1169 bp, Homo sapiens
agcctgatcactcatgttccaagatgagaggacaaaaattcacttagagaaagttgacagaggtagtcagacatcagcatagtcatctccactgaaagtttggctgaaaggtcagggtggcgctgaggggacagcaatgaaacccacccgcaccgggtgctccttcgccgttagagcttcctgcgactgcagtggtggcggcgtgtggtttcgctgcttggtaacagtgagcacaaacccaccctctcttctcttctcagaatttgaggttaacatcgtggtgctgcttcaccctgaccacctcatcacggagaacttcccgctgaagctctgcaggatatagcccggaggagggaagcatagagaacgggagtggccatctggaaatccagctggttatccaaatcctaaggggagctacagccagcggcatatacttgtttttgtgattattctgtatcagaaatgaaacagaccctcaaattaactttccttcctcatttcttgaggcttctgcttccaacaggcacctctaatcagaccttttctttgaaattcaacaagatttcttaatgctatttgccaagaccatttcacagaaaacattgactgtggctcttgccttatctgttcctttttaggtacagtaaaacaattgtgacagcagtttgagcttgctggagagtggcatcatggggacaaaaggaaacctctgacttgctaatggatgtagccagggactccccatagcaaagggtctgtggccagttgacatccaggatggctgcaagcgcacttgatggtcaggaagtttgcagatactcgccaaggcagagcgcaaagtgctagccactggaaatgcatgacttccctccacccctactctattctgtagttttttggttttgtttctgagacggagtctcagtctgtcacccaggctggagtgatctcagctcactgcaacctccacctcccaggttcaagcgactctcctgcctcagcctcccgagtagttgggattacaggtgactgccaccgtgcccggctaatgtttgtatttttagtagagacggggcttcaccatcttggccaggctggtcttgaactcctgacctcgtgacccacccgccttggcctcccaaagtgctgggattacaggtgtgagc

SEQ ID NO: 12904 - DNA, 1193 bp, Homo sapiens
atcagtggaagcaataagtaggaagtactgtaaaagaattacaataaaataagagaaaccacttggagagcaagagggcttgtggacttgggggagcggttgtgagaaatgtctcagaacttaatttacaaataacattggtagattgacatgttgtctttcctataaagtaactttacctctgtcttaatagtaaactactatgaaagtgaattcgtgttcctcttgatttgtgaactgatgaaaattacaaaatgtggagttttttccccagataaagtaaatggtggaatattcaggtttatttgatacctagaaaatacctgaaattttccgtggtaataggcacattttgaaactgttttttttttctctgacaattgaatatattttatatatagttgattttgattattgaagactaaggaaaatttaagtttgaatgttagaaaatgaattttgcaaatttgaagtaattttattctttatgttttgggattgtagttatgttagatattcctcagttggggtaattgtcttgcatcattatctcttatcataatctgtttttcttcacacagtgttatagttttgccgctggactcttccctcccttcccccaccccatcaggatgatatgagacttgaaagaagacgatgcatacaggtgactcaagttttgaaatacagtaaaactctggctaagagaatgtgggaatcgatggtctattttgaatgggggaggtttctgataaatagcagttagtggggggaattgtagatcagtaaatgcaaaggtagttgggctatttgttaaacttacttttgaactcagattgataatcagtgatttatagtggtgttattacaaatacagcatagtaaatgctagcacttaggcttttcaagagctaatattttggtgggaattggaataattctgttaatgtaaataacacagtcacctttatggttgaatgcatgtctcccccagaactctattagaatatggcagatcttttatgggagtagatgttagtaggatatcatcaaaaagactgacaagttaaggatattatacccatacatacggtttcttaaaaagatatgctctgggattttgtttattttttccttgttcccaatatccctgcctcccatttcctttcttcccaccctccccctcttatcct

SEQ ID NO: 12905 - DNA, 2822 bp, Homo sapiens
agttaatattcagatgttggtcttggtcatttgccaactaattttaaagtaaaaggcactgcacataatttgcataaagggccccatgagggtgttttttttttttctttttgtcccccccatccccctttttttttgttttgttctgttttgttttgggtgggagggtgggaaatttgggtttttaagtcctctaaacacacttgggcacggaaatgcagtactgtaaggaagagggacctccagcttccacaaacaccatcttcagctgtatgaaagggacggttgtggtgaagtttgtcaggcacagtaagcatgctgagtggcggggatcagaactctcctatctgaacctactgaggagcaaagcagcaattacatgggatcctgtggctctcccgttgcagaggccacaggaagataggatggaacgtgactggtctcctaaccaaggtgcactgagaagcaatcaacgggtcggtcgtggccagtcctggggaggtctgagtggtggtctttgggataacctttggccttatggatttggactcgaaattagaagagcctaccatttcagatgcaatcacttttggacatgcttttgcagacagtccttaatgctgaaaacacagagaatgggtaattcaagaggcctttcttttaaaatagacttttgtgacccactaattgtaaggtattgcaaggtcactttgcgtgtgtcataaagttgacttccttattggttgaaggtcacagaagtagtggtttgctttgatggaaatagctacagctgtgtcccttcctgctttttactttttcttttgctttttctcggcacgtggtatctccaccatttcttctgcacaaagatgtcttctgttcatcctgaacatttttaaaaaatgcagaattttatgtgactgcttttttgcctcacaattatgctgtgaattttacaaaaatttattttcttttttgataatttattgtaccaaagctgtttttatagcacatagatgtctgtaaccaataatgtagcagttctgcactttgacacaaggtgtaactagaccatttttaaatgtcagttgaaaattatggctgtactattgcttaaacaaaactggaactgttgttgaatccatagccaatacatttacagcaatctgtgtactgaacatagtagattgacatctaattcaagattacaacatctgttacattctaagtgtgttcaggcttctgaaggtaaagggacactggatccagaagctatggaaccagcagttgattcttgtattcctgattaacctacttgtaaacttgaaagcaagaccttgattgcaccaacaggtccagagtatgagtgcaagcaaagcagaactctcatgcgtgacctgagcagacaggctggtatttaacaggtgcctcgtgttgagattacgctgccttaatgtaacacagtctggcagttgctaaatttgtgttcccattttaaattgaccaattttggggtgtgacacttttgagcggttgaattgggagaatgaagataagtaatttacctgtccaggatcaaaagaagcctagaaaagaagcagtaatctacctctgccgataacctgtttaagatgactcagcagaacaccgcgtttcattctattggtcaattccatgtggctgactaggtcaattttttttctgaacaaaagcaggtttttatatgtaaacagtgagaaaagaaaggctaaacactatgtaaatgtgaatggaaacttggaaatactcgtttttataaactacaaaaactttttgttgtttatcaggaaatccatatttattttgtaattaactgtcaagcctgtggatgatttttttgaacttggtagttcataaaggtttacagtgaataaaaggatatcatcttgagtatagcaatatcaaaaggaattcagtagttactgctgtttaggaatataaggttaagatatcatatgggtcaggtcattttttttttctgtgctggttgccacatcttagcaagcaccaaaaaactaaagcagtttttaaaccgatatttacgtaaagaaaatcataaaatccaatgcttctgcatactgtgttatgttacagtccagttttgtgtgctttactacacagtttggttacaggacttctgtgcattgtaaacataaacagcatggaaaaggttaaatacctgtgttcagattgtaagatctagtccggacttgctgtgtatattgtaacgttaaatgaaaaaagaacccccctttgtattatagtcatgcggtcttatgtatgataaacagttgaataatttgtcctcagactctttactatgcttttttaaaaattaatttaagaaaaatgtaaacatagtaaaaatcttcctatgcaattaaactggtccaggtctggtaggtatagtatcaaagttgagttaaatgtgtaaaaaggaaactatttgagatacattgacataggcatcagcaatctctgaaagtaaaaattggaggtttaacagatcattttgatttttcacattgatttttttatttgaatgtttacataattttgtgattcaaaatgctcatattttagttggtagcatttcgactggatgtgagggtctgatggttttctctgatatgctttgacgtgcttggatgaaggaaggaatacgaatactcattcttccttccctaactcctcgtacggggccatatcagaattctagaattcttgccactgtgattcaattgctaacctaaagtcttctctttttacaaattcacctgctt

SEQ ID NO: 12906 - DNA, 1087 bp, Homo sapiens
cttttttcgtgtcctccttatttaaaaaggtatacttacaatgtgaagtaacttatgaataaaaggaaaagtttatcccatattcaaataattcctaaggtcagcctccctttttgtaagtggcaaatatctgattaaatcatttctcagtttattaatccttggaaacaatgatatagcagttactcacagcttgtaaattacaacagaaaggttcctttcaaatagtagagctgcacctaaagaggaaattgggtttataagaaaatggaggcaaagaacttaagttttaagaaaaagcacttcaaaacagaagggcaaatggaaaaggggaatataaaacaaaccaataaaaataccatctgagggtgttactgtccaaaagtaaagaataagatgcatcactaagccctttgcactcgttatgacctcgtaagtaaaaattatcacttagaataaggggtgcacactacattccctctgtcttctagacttttttttttgtagaagaatcagaaaacaatttactaacctccctgtttgatattaaaaataggaagaattttaatattttctgttagtacaagttgaacttgattgtgccaactgaaaccccagaggtttgtatatcagtagaatgcaagaacattgttaaaggtgcttacgatcttttttgttttcctttccactccattgtatcaattttttgagtaacttttaaatggctagaaaatggtctttttgctttgcccttttaaagctgaaataaccagctccattcttttcatgaatagtaagttgatatatttatttatcaggtatcttgcagttgtcaccaaatactgtagttttcttatgttgtatggaaattatagttcaattattttaatgtgatagagtgcaacaagtcattgtagaacttttcacctgttaatgttgaagttatacctctgaatttctgctgtggatatcaaggaaataataaagcagaaaccccaagaaatttgcaacttaacagtttgagactgtctcttatcctagtatttgggaagagaaggaataaatttgtcaaaactaggtgagaaaa

SEQ ID NO: 12907 - DNA, 1213 bp, Homo sapiens
agggatttaaccaaaatcttgctcttccataatcttactctgtgaaatagaggaattcgtgtgccttagatttagaagtgtgttctttaatagagtgtacagggctaaaagagtatttaagttaatatgtaggtttcccccatctgtattccaattgtagaggtgagttttgttaagagtacaattgcaaatcttatctatataggaaaatagctaaatgtcattctccatctctttgttttagtttactgcttccatgtgcaatcctaagcattctttgctggggcaactaaatgtatctttattagtgacttctagtccaaatataagaaactgtcatgttttgtgggaaaataattttataatccatttaaagtgaaagtttatcacacaaatagtacacttattttctaaccaaatacttgataggttatgctactccagtgtagatggccattcctaacttgtttgtgcctgaagatggacttgattcaaatggtttacatatttagtgggtaagggatatgttacagtaccccacctgtaagttatttattagccctaattgtgtttgatttcagacaaaattaacccttttctcctgtgtatctttgaagtggcagataaggtgaagcatcagactggtatcaatattagacaatgttatttattagccctaattgtgtttggtttcagacaaaaccttttctcctgtgtatctttgaagtggcagacaaggcgaagcatcagactggtattaatgttagagaatgttctgaagtgttcctattttgtagttatctattccatttgacatagtagaaggtacattttctttctactctgatgcatggggaaggatgtttttggacattatcaactgagataggtgggaaacctcctctcatttgtggcttagagagctatcaccatttcagaactatgatgcttttcttctcagaacttgtgttaagtagatagtaaacagattgattcatgataattgtccttgactaagactgaaaagactaatgggatgccttttactttgctaattttaaaaactggtgatagatgtcaaatccattaatttatttaaactcttcttaaccttctcttttataatctgttctcaggttttaactccatgtttaccatcatttgcaaaaaggtaccaaaaaaatccataaataaatatggaatacattcataa

SEQ ID NO: 12908 - DNA, 1107 bp, Homo sapiens
tgtactgataatacaaaaaccaaaaggaggaaaacgaaaggaaaagcaaaagtagttagaaaaggtaaaacttttacagctaacatatctaaaactgtgagacgtcaaagacaaagcaaacgccctaggttaagtgtggatgataatgactgggaggatttggactatgcaaaatctaaaagagttcttcgacgttcaaaaataaaaacgagaaatcagggtagaaggactgtgagataccatgatggggatgatgacagaagtttagaaaatgtgttagatttcaatggttgcaccttatgaccttgagggaaagccagttcatttaagaggaaatggactggcatttatggtgaaagctggctgttaaaattatttttttgtcttacaattcagggaatatatttatatttttctatgaaaagttatgaatgtgactaaatcatgactgttatttttatttgcacttgctggtctttgtagcagcattcagcacaggtgccaaaatatgcttcattttgggggcagatctattttgacagtatttgactacatatagcaagagtttgaaatatgttaaacactagacatcctggttatcaaaaccaatgagcattactttcatggcagcaagtgtcatgcagttattttctgaatttgtcaaagaggcagtagtttctaacccctgttctatagtagttacaacaatttcacaacctatgtttacagattcttcataaatacatgcatactgacactataatcatgggaggtgtaaccatgattagtaggcgaggtacctaccacttttttttttttcttcccctggctacttgagtagaatgcattataccagatctggtcactttcattgaaatggtttctaattttcttcccaagtgctgttgggtttttttcttcttaaggaaaacgttgtcacttttatgttataaacttgaatttataaagtgctggtaaattatttttaatgatttgagtgcatgttttaaacctctaggaccagagcatagtcagagcattttcttttaaattgtgcactaacaaaatgctatataatctgtcttctgtccaagatctcctggtttc

SEQ ID NO: 12909 - DNA, 1099 bp, Homo sapiens
ccccgcgtctggccttgactttttaataatagccattctgactagtgtgagatggtatctcattgtggttttgatttgcatttctctaatgattagtatgttgaacattttttctttacacctatgtatagagatagtgagaaattccttgagaagttgcttactgcatcataatgtacgaatatgtatttttcatttctgagatgtatacttttaaggtgacatccttttcagattattgttattttccctcattcgtggtaaaccagttaacttacagcatagtttggaaaatgcccatctaatgtgcattttctcatgttttctaaggaccttaaaagtaaaactactaagcttgagttaaaactgtatggcaaaaatgctaccttctttttaagcctttttttctttttgctttaaatccttctggaaacttgacggaatgcccattttgttgatattgtccttatttaggtgttgattttcattcgcatgtttttctgtgtttcagtcggattcagtggttttggtatcacagtctagacaaaggacatgtaggcgtaaatatccaaattatggtagaagaaatcgtagctggcgtgagttatcttctggaaatgagtcttcaagctctgtaagacatgtgagtggaaaactttaaaatgttataagataatcttaaatgaatttggcttaattctttactttgaatgaatataccccaaatttatatgaaaacacagcattctgcagagattaatatgaaatttcacattttgaatgttaacaaaaacttttaatggctaagatagtcacatactgtatacttgtgcaatccagtggttttacatgttgagcatcccaactcagaattttgaaatgcaccaaaatctgaaactttctgtatataaacatgatgttctagtgtgcatttcagattttggatttttggatttggcatgctcaacctgtaagtgcaaatgcaaattttccaaaatctggaaaaatacgaaatctgaaacaattctattccccagcgttctggataaggggtatataacctgtagtatattgacagagttgggccatcgtcacctct

SEQ ID NO: 12910 - DNA, 1102 bp, Homo sapiens
tgcaacctccccctcctgggttcaagcgattctcctgtcttagcctcctgagtagctgcgattacaggcatgtgccaccacgcctggctaatttttgtatttttagtagagacggggtttcaccatgttggtcagactgatctcgaactcctgaccttgtgatccacccaccttggcctcccaaagtgctgggattacagacatgagccactgcaggttgcctcttctcagcattcttatacattgtattttcaaaacttaatctgtttgaaaagctattgattgagtttgaggtgtgttttatttcatagggccgggcaaatcatagcaaaccaaattttttttcccatccagatacgctctaaataccttgtcttttgaattaacacctgtggattgtcctgttgttaggacagcttcattacattctttttttgcatgtgattttaattgtagcccttgttggaaagtgtgtgaatatagtaagatcctgttctgaatgttttaaggttcctaagtggtagcagagatggaacagcacggatttggagatttgagcagttagaatggaggagcattttattggatatggctaccagaatctcagggtaagttgagattgttagaagtaggtgcatcataggtgttcgatctgtctctctctctctctctctctcgctctctgtgtctctcagtggttattttgttgaggggattatagctaccttctattacgaagagctgtggtataagtgaatagctgcgtactgcatatcaggtgaacagagacatccaggtaaatttatccttacgttgtatagcaaagaataacatgtactttttctatggttcaaagcattgacctccttcttagatgttgcatttaaaagcttctacaagtaaaaaagataaaattaactcaagtacattaagagtggaaattatacttttctgtggataggatttttgaaaaaatttaaaagtagcttagagccaaggctgggaaatagggtaagcaaacatactttattattaaggttaaaaaagaaaattgagctccagcctgggtgacagagcgagactctctaaaaataaaagtcat

SEQ ID NO: 12911 - DNA, 1151 bp, Homo sapiens
ttaaaagaacaacactaattgacattgcgtgggctttttctccctttgtttaaaatgtcatttgttgagcaagagttgtatagtattatctacttacttgaggctgttaatttttcattacagtgttttgtaaatgtatccacgagaccatgatgcattgttttgtgctcaacttgtgttttgtatttaaagcattttgaatgaagtgtattttataagcatttaatatttatgctctttagaatggaacacagaaaacaaaccttataagtcctgattaatctgaaccaataacctgtgtggcctacaaagtataattctattaaatgttccttaaaacacttttttctaattaaaatctttgcaaatgcttgtgtaacttcctgccttacagctacttgtttgctgtgagccacccgcaactgacaagtggctgttaactgagtcaccatatcccagtaaagctgaattttctcactagtttctgcaagttcatatttgtactcttttgtttcctaatgatctaataagtagtttgttgttattttagctgattggactgtgagaagacaaagtgctgtggtcctttatttattgtcatgctgaaggccaccacagcagcttttgggttccacttactcaaacacacatgcacgcaggcttacccagcaccaagtttacttagctttaagaaaggacagagcagggaacgcagccacagcctggtggaggaactggacaccagcttccagtgtccgtcaccacacgggatacattttgcccacaaaggatgagaagccaacctggggaggagatgagagtagcacacggaagctgcaggaactagtccttcagacgaaatatagcaccaagggggcacgtgcctaactcccgttttagtaagctgcaggcagaaatgatggtggacagtcaacagtgcaccggccatgtagagcgtgcccagggaactgctgggatcactcatccgcatacagtgtccatgatgatacccgtatctcttaaagatattctcattcagttgttacaagaattttgacaaatctcactgaggctagaggtaaaaatttctggttcacagctattaactttccccatgcgtgaatagtttgtgatgattaaataggggaaat

SEQ ID NO: 12912 - DNA, 1171 bp, Homo sapiens
aattccttttccttccctactacccaggaacattatctgggaaaagctgctattttgaaaataactacaaatgtctgtgtggtaattcctggccaaaatggtgagggagaatacaaaggccctgaacggatgcactgagtaggtttttagggaagtagccttttaatcaacagtttaaggtagagggttgacttcaaagagaggtttcacgtaacacaatgcaatcttttcagcacagggaaaaagtcccttagcactgtagctgtgctctcttagagaatggtcatttccagataaaccagtccagccacagagtgaactcttgtgcactgcaacagatgaacatttctagtttgagctgcttctgtttttccttcaaaccactccctttctgtgccctctattagacaacataattatttagtgcagcacgccaagtgaagcagttagtaatgctttgttacagagggggcgcatccatgattaattcacaccctctctctattaactttggaatcttaaactgtctgggcccctgaaatacagacctgtatttttttgtcatttgcgtccatttttgttgtgataatagataatttatgagtgagttcttccctttctgcaaggtttttgtcttcagaaagtttctgcagtgcctgcaagatatctttagtcttcagtaactggctgtcagtttctctaagtttcctagatagagttctttccttttcctgggatttcctaagtagttgccttaaattttttacttcattctgatgtttagccataatttgaggtagattattttgtgaattctcatattttcctatagctttcaaatgcctaagctgaagttgtttcaaaaattggttttctgtaaggatggcttccaatttatgatgcatatcagctaattcattttttagtcctttaattttatgaagccttgctgagagtattcgatgagccatagcatctcttctttgggcaatcatatggatttgagaattaaagagtgatgcattccaggtgtgctttttttcaactgatatttccttctggcctgtgtaagcagaaaatccagtttattactagtaaaatatacagatatgcaaatatgcacatatgcataatctctctcccatgcccccatgcacacacaccacacaca

SEQ ID NO: 12913 - DNA, 1193 bp, Homo sapiens
ctttaaaagcattaggctgaaagagtttattttggtggtcaaaaaaaatatgcttccactcatgtaactattttaaatgttaagaagtaaaataatgaaagatatgttaattactttattcagtaaagttttttaagaatgtttatctcagccagtaggcaaatacttggtgtaaaacaagttggtcttaaattgttgcaactcattagctagtgaagatattcatgtaaatatattttaggattgtaattaattttgaaaatgtagaaagctctttattccatgtaagtatgcaggatgcctgcttttttatgcagttgtggaaagaatgtaaaatgttttaatatattctttgttaatctgagaacttgatactgaatcgtttatgtgggagaaggaaggagtaacataaaacatgtttttatcactcaaagtaagcaatggaggtaacaaatattgtgcattttaacagtaatatttgaagatttgtagaatattcacctttaaaactagttagtatgcatttataattttaccagaatatacaactaacaattcaacagtgatgttctttgcatttgtggggagatgtgtgatgttcttggttttctggtttggaatggaacgtttatagccttgcctgtaaaaatgtgccccagcacttaatgagtgaccgtttgaatccatatgtagtcccattggtgctaatgagagtagctgctgtgaaacaggaataaaatgtgtctgttcacggaggtgcggtgtggatgcacctacaaggccaactctctgatcagggtgagggagagatggaagaattaacagatctaaagttggcctttgttgtctcaaattgggtttgtacacacatgcatgcatgtgtgtatacaactgtaatctggaacttcaggaagtaaaattatttgaagtttcttagtaaaaagtaattaggtataattccaaatagatttctgtataaattgtatctaactggattacaagtcagtttgacaatttacgatgtctcagtgatgtttctgcaataattgtgaaatgcattattgatttaaataatgctgacacgtactctttaaaagtgttctttaacactgactactaaactttaagttttaaaaaataggttttcatttatggctttttgtggttttagcactttaagaagtttaattttt

SEQ ID NO: 12914 - DNA, 1173 bp, Homo sapiens
tagaaatacagcttttaaaatattgtggttctggaccttacaagaacaagatggtttgatttcattaatgttgaaattggattagtcttgattgtgtgcatggttcctcattccatggtgtcagtataatcatttaattgaggtttttggttttttattgattagtggaatactgtcgaagtattccttcttttaattattttagacacttgagttctagttaaatcttaaccatgttcttaagtccaaaataggaagaagtggagtagtttgcagtattgatttatatcttagactactttagcaataaaagataaatctcaactttaataagttatcctgacacttgataaaaataaatatttggtattttgtggtcatgtaaaacttctttttgtatgaaaattgtgagaaatttaaatcagcaatagtaacacttagatttttataaactaacaaaaacttgctctcagtcaatataataaatgatagttaaactctaaggaagacctgggaaatgaaaacaatttatggaagtcccctacagtcagtttataagggcttcagtagtgatagacattgttataaaaacttgtaccatgttacatgtacactgcaccacagtctaaattcagaccagcatttgaaggactgcacatatttcatttcctctgatttatgctgtcacaaattgaaaatctgagtgtagttaggacaaaaaacaaagctaaccatatggcactaattttgattttaacattagtgtaacaaataaggtcgggacatatatttacatagatcccagacactcaagaattagcacagctgatgtaaaattctaaattaccatttacttccagatagagcagaggagaaacacctcactgcagtttcaacatgctttccaagaacaatatatacgacatatacattttcctgcctctctcttgtgacaatttctgttagaatttgttgggggtctgatggttaaaatcatgggcaaggccattctctacatcattgcttaatatttcaaaaataggtattagagcactatcagtggtccaaaattagttttagctacttattttgctccatgggttttgggcttttcaaagaatactatgtataatttgtaattgaaagcctttcagtaggatatccaaagttcaa

SEQ ID NO: 12915 - DNA, 1233 bp, Homo sapiens
cttttcacggcacgccaccttcactctcactttttcttttctaataaatacctctggatgggttagtggtaatctctcctcaaaccctgagtggaaaatgtgagggaattgccgtctttggcattctgttggagctgcagccccccgagctctccttgccttcctgctcgcccccttctccctccctcctcttttccctccccccttggtcctccctcgctcccttctcacttcttcctggcccccagaaggctgcgggaaaggtgcaagggtttatccagcatccagcacccctgcaggagaggaatccctgctgggccgggagggcagctggctccccataggatttgcacatggtgtgtgaagttcagcatctcttgctgagccactgctggctgttagagcagctcttctttcaacctttctttcagatttaaggaacagtgacaccccaccccagtcccgtggagggggtctgggcccacccttcacaactgcctttcaaggacagttcagacaaagggccctgcatggaaagagtgacctccctttgccttttgcacacgcacctggaaaagacacagaagccaacctgagaacccctggtgctattttaaaggagacatattgctgaacagcagtgagaaaagtctgcaggaactgctgcctgagccaagccagagaaccgaagacccggccggccctggcctcacaggcgtgtgcccatgcagccacccaaatgcacgcgtgacaacaaggccgggagggtggggggggtgcacaggtagccccgaccctctcaggcattccagccacagaacatcaaagtgagcgagtactgcgctggctgtggcttcagagaacctgtatgtgccacatggaaaaacaggacaccagagcccaccagacagtgccggccagcagagaagcagagagccagcgccacacaacatcaagaaggccgacaaccaggttggaaaccaagacggagctcagacccaccacatcgccccagaggcttttccagcacccatgatgtttcggactgacctaaaaactaattgtcgagaagccaagggtgaggaggcaggaagcacctccggttggaggcacccaggcttgccagccacagagcgccccaaagtcaccgtcatcccagcccctggccttcctgctgccctccggggccatggcactgctgttcagctcaggcacaggggcacagcagaggtt

SEQ ID NO: 12916 - DNA, 1237 bp, Homo sapiens
tctctcacctcaaattaggaaaagctttttaacttgttcccctgcatcctggcatgtcccttcaagaaggaaaaggtgacatcagttgtgaccagctcagaggatggggctgtcccctgggctctagaaagaacattctgtgtcaccagcacaggctcttgctgggtgcctgtgccccctttctggttgaagggaagccagaccagtggagtggaagctcttgaagcactttcttttcatgtcggaggctgcgtgtgagccggtggtggcggcagctgtctgtgtttctcctgttctcataccgcccttcgtgtccgctgcatcttcctctaggagcatctgtgggctgacgtttctggcatggtggatgttttcatgttgttccgccgtctcagcatccaggtgacgtgctgtcccgcagtagctgctcgccacacaggctgttgaaactcagcacgaatgcttgagcctgccccagccccagccgtagcccttgtgctcaggagctgctcctggagagtggctcccttgtgggaagtgagaaacacgtttcggagtcgcagggagctctgtctggcatcggtggcacagatggtgaacttgtttcaggaagtgtgagcacgggcctggctggcacccggtttacagggaggtgattgaggacgtcgttatgatttgatttgaccttggcacacactgcagagccacagggatgttgctgaatttcaatcaccgatcagcaaggatgaaccttctcaacttcctaggaatgtttagcagcaaccgaatataccaggcaaaactccttggtgcctgcgctgtgtgtgtgtgaggtgcgcggtgtgattgtgcgctgtgtgtgtgtgaggtgcacgctgcgtgatcgtgtgctgtgtgaggtgcgcgccgcgtgatcgtgcgctgtgtgtgtgtgtgaggtgcgtggtgtgatcgtgcgctgtgtgtgtggtgcacgccgcgtgatcgtgcgctgtgtgtgtgaggtgcgcggtgtgatcgtgcgctgtgtgtgaggtgcacgctgcgtgatcgtgtgctgtgagtgaggtgcgcgccgcgtgatcgtgtgctgtgtgaggtgcgcgccgcgtgatcgtgtgctgtgtgaggtgtgcgccgcgtgatcgtgcgctgtgtgtgtgaggtgcgcggtgtgatcgtgtgctgtgagtgaggtgcgcgccgcgtgatcgtgtgctgtgtgaggtgcgcgccg

SEQ ID NO: 12917 - DNA, 1159 bp, Homo sapiens
aggcttttcttttttaattagacaatttgttcctcacagatagggttgatgaagaacgcttggtaggtaagcacctgtgtgtgagccgagtcattcataaagaactgttcacagataggttgatgaagaatgcttggtaggtaagcgcctgtgtgtgagccgagtcattcataaagagctgttcacagatagggttgatgaagaatgcttggtaggtaagcacctgtgtgtgagccgagtcattcataaagagctgttcacagatagggttgatgaagaatgcttggtaggtaagcgcctgtatgtgagccaagtcattcataaagagctgttcacagatagggatgatgaagaatgcttggtaggtaagcgcctgtgtgtgagccgagtcattcataaagagctgtccttgtgttggtctcatgggcatcgtgtttcctccgcagagccagccccagtgcctgctgagccgtttgacaacactacctacaagaacctgcagcatcatgactacagcacgtacaccttcttagacctcaacctcgaactctcaaaattcaggatgcctcagccctcctcaggccgggagtcacctcgacactgagggccctcggtgtgaagatgaaccttccaccgtcttcactgcatcctggagtgcaaaaataaaatccactcaagagtcacaaggcccgctgtgcataatcggtttcacttttacctttttttttttttttttttttttgagacagggtctcactctgtcacccaggctggagtgcagtggcacattctcggctcactgcaacttccgcctcctgggttcaagtgattctcccacctcagcctcccaagtaggtgggattacaggtactcaccaccaggtccagctaacttttgtatttttagtagagacagggtttcaccatgttggccaggctggtctcgaactcctgacctcagatggtctgcccacctccgcctcccaaagtgctgggattacaggcgtgagccactgcgcccggccactttcacactttttacagtgagtggtgaattagcaacagtaacactgattatccaacatatattttggaatatctactatgtgcaaggaatttttcttaaactctaaggttatgaatcactgggcaaatccata

SEQ ID NO: 12918 - DNA, 1192 bp, Homo sapiens
aaatgatataacttttagaaaaatcgcaagagaaaatcttgaggatctagaactaggcaaagacaccaaaatggaactttatgaaaatgtagcactagcctagggtgagtgtggatgtatcactatttgtggatgtagaaacaggagtagatgagggtgagtcacttgtcctgcctgccacagagcgaatcagtggaagggctaggctttggctcacagcccacacacctagcactgggatgcaccgaggtcaccaccacgcgcctttgtcttccctgcacaccagatgcagccaaacaccaaagcccaggtcagtggcaccggaacaacacatcagtttagaggatttctgatgttattccactttggttattggcagtagagatggttctatctaatgactaagaactggtatgtaggatcatgataacttacaataatgccacctttttctctgaaagtcttcattttctctgctctagatggtaaaagcaatccaggttttgcgcattcatcttcttgagctggaaaaggttaacgaactctgcaaagatttctgcagtcgatacattgcttgtctgaaaacaaaaatgaacagtgaaactctgttgagtggagagcctggaagcccgtactcaccagtgcagtcccaggtacttacatttgggggtctcgctttccctctctgccactgtgaacatctgcattgagtcatgagaccaccagctctttcagaattcactgggtcatctttatgactttctacaagaaggaccctctaggtctctgaccccagcctggtttgggaatgaactccctcagattatgaagtgagtcctcaatctgcatactgggcccccggtcccatgtttatggaaggcacaattccattcatttctttcttttatttcttctgaaaatattttacttattcttttgaaaaattgtgtaaaatacacataatataaaatttaccatcttagctattttaaaatttacagttcaatggtgttaagtttattcacattgttgggcaaccatcaacaccatccatctccagaactttctcatcttctcaaactcaaactctgaccccattaaacactcattccggattccccctcccctagcccctggaacccaccgttctactgtctgtctctgtgaattcgatgactccaggtctctcatg

SEQ ID NO: 12919 - DNA, 1172 bp, Homo sapiens
ttaccttgctggaattattggataaaaaagctatttttataaattcgttatgaattggatgatgactatattgaggataaaatttctagagaagaaacaatacatgcttgctattaatatttcaatttggaatgttctgaattgaccaaatttaatgaacctgcccaaagttagctaccgttccatggttctttgctctccccgggtagtgatgaacatttactactataaaagaaacagctatttaatgaaattttgatatctgcaaatttttgttgatatgtaatgctcagattgcattttacacttgatctaaacatatatcgaaagatatctgctaaacaggacttcaggtaagtgaggtgaaatggtagccagtgacccgttaggagctctcaccgtacatactccagtctaatttaaatctgaccacagttgcatggtcgctttaccatgttagctgtgtattgttttaaaagttttaacttcaaaatatgttatgcacagaatgtttattataaactaatataaaatgtgctctaccccattggctcagagctagggcaaacagcagatattcagactttattacttaactagcggacatccctggagtcccagcagcgagctggtctggcgagggcacctcggcagcccccacgggttggctcctacgtttgcgtttgtggctggtctcctggtgtcagtgttctcttgtacgttgttgctttcgacttttcagagccctcctgctcacttgaccacgtgagatttggaataactgtaggacttctgtttcctggtaacaagatgaaccgagagagtgggctgggttctgttttctttggttttgatttgttttcattgtttacttaggagtggtgctttttctcagaaaacaggccacggtgtttcatacagaatgtcttcatatcatctgaaatggtatggctgaagttcatttgtttacagggtcgggaatgtcttcagttcttgagagtcaacagtaatgattggttgtaagccaagggacattttaagctagtgaagagttttttctggaattgatttttcccaaaagaatatattaattgaggttaagaagtcagtgggaaacacacagaaatttgttttaaaatctttcaggagctttactgaaagacttggttatc

SEQ ID NO: 12920 - DNA, 1123 bp, Homo sapiens
gtagctatgagcgcctgaagcgtggggtcagtgagggttgaagatggtatgtgtccagctcattttgattatgatttcctgtgaccatttgagttggttctagaagaagacagaagatgcaaggtattacacctgttcacttctaagttgcacatttttttctcctgaaacttttcacacctgaaatcagggtgtgtctcagtcacggcgtgcagtctcttcagcagtgtttttccttatcagtgccgttggcttgaggagctgcgcgtgttgagagagtgggtgtggttctgtgctgcgtgccgtggtttggatggcacggttttctttattttccttggttgcaggcatagatcaagatcccgatcccgggagcgtcgttctcggtctagagaccgtggtcgtggcggtggcggtggcggtggtggaggtggcggcggacgggagcgtgacaggaggcggtcgagagatcgtgaaagatctgggcgattctgagccatgccatttttaccttatgtctgctagaaagtgttgtagttgattgaccaaaccagttcataaggggaattttttttaaaaaacaacaaaaaaaaaaacatacaaagatgggtttctgaataaaatttgtagtgataacagtattcttggtgtaacttatttcttgtggaagttctttaaatttctttttctttataaatctgctagtcatcttggaggtaaagattaatatccatccaccactttgagtataaatgaaataatattttttatcttagggcatgaaataaaacacataccaggtgagatctacatgctaaataatccggaatttctcgaggctgtcatggaaagccttttggggtttcttttctaactggttagtgaagaagtgcttagctataatcagtagacacgctgtagactgcactgatgttgggaagaaggctgatctgtggtgagacacagtgggtgggcccgacccatgttaccttctcgttcctgcgagtttgtgtcaagaaccccatgtgttcgtgggagggagcgtggatgctcacacggcacactgagggccagtagtccgtgtccgtgtttccttatgccaatggctgtgggagacacagaa

SEQ ID NO: 12921 - DNA, 3112 bp, Homo sapiens
gctgagccatgggggtgcagcaggcgggcgtgtcctttaaagtccctgggtgggtgagggtggcggggagcgagggcgccttgtggccgcatctctgagctgctgagaaaccgggtggagaatgaaaggtggggcgcggtcagggatcagccacgcacctgccctcggcagccgcggctggcagctcctcgggcgggccctgccacacgggcactcggaaacccgagaaccctgcgagccggcgcagtgaccacctgtcctctgttcccacaggctgctccagttacagcaccacccggccgctgcacccggctgctcccaggccccccagccggcccctgccccgtttgtgatcgccccctgtgatggccctggggctgccccgctccccagcaccctcctcacgtcggggctcccgctgctgccgcccccactcctgcagaccggcgcgtccccggtggcctcagcggcgcagctcctggacacacacctgcacattggcaccggccccaccgccctccccgctgtgcccccaccacgcctggccaggctggccccaggttgtgagcccctggggctgctgcagggggactgtgagatggaggacctgatgccctgctccctaggcacgtttgtcctggtgcagtgagggcagccctgcatcctggcacggacactgactcttacagcaataacttcagaggaggtgaagacatctggcctcaaagccaagaactttctagaagcgaaataagcaatacgttaggtgttttggctttttagtttatttttgttttatttttttcttgcactgagtgacctcaactttgagtagggactggaaactttaggaagaaagataattgaggggcgtgtctgggggcgggggcaggaggggagcggggtggagggaacacgtgcagtgccgtggtgtggggatctcggcccctctctctgggttcgtcgtggttgagatgattacctcggacgtctacggaaacgagcgggcgcattgttgtccgcttgtgtgtgtgtgtgtgtgtgtgtgtgtgcgcgtgcattgattactatccatttctttagtcaacgctctccacttcctgatttctgctttaaggaaaactgtgaactttctgcttcatgtatcagttttaaagcagcccaggcaaagatcatctacagattctaggaattctctcccctgaaatcaaaacctggaagacttttttttcttattttagttgagaagtttcataaactgctcaaggattagttttccaggactctgcggaggaacggcaggaagaacctcagagagggcagaggtgacttcaaagtgctggggactccgtcctgagggtcacttggccctgagcccctgcgtgcccttgcggaagcccagaagcttcttcctgctgcacctcccgtttccgctgctgctgacgtttatgcatttcatgatggggtccaacaagaacacctgacttgggtgaagttgtgcaatattggaggctgactgtagggctgggcagctgggagacaggctcatggctcatggctcatggctcagggcggtgcctgccctgggccgggacccccctccccaccccccacctaggctttttgggttttgttcaaggaaggtaaagtgagaggtttaggtcagtgtttttaagtttttgttttttttttaaagcaaatcctgtatatgtatctacatgggagacaggtagacactacttatttgttacattttgtactatacgtttgtgttccaggtttcagcttccctcgctcctgttgttaagaagcgtccctgtcagcacaggtgtgcattgaggaaggggccccagggccttcgctccctcagcactggggtggaggcggcaggaaggggcggcccttacctggcaggtctgggcgcacctttagcaggtggactccgtggggctccaccagccagaagcctctggaaggcaacgaaggcaatgctgctccctgagtccagtccccgcccccaaacccagcccaggtgccttcagctacttcggcttcttaaaccctgcagtgttaaacagaggcattgagaaaggggaaaggcgggtatttttaaaagccaaagattgacccagttacttgagggtagggaggcgggcccagtgcaggaggctgcatccctggcctgctggtgcccaccgggggctgtgcctgtgccgggccgcagggaagctggctgcccccattcctgctgctgctgctgctgctgctctgtggctgtttcaaagactgggcgaaaggctgtccggagggcagaccaggtgccttgccgcagagaaaacaccaaagtctcctgttcgctcataaagaagtttttgggatgggagagaatccagaccatcttggggcagccaggcccttgccttcatttttacagaggtagcacaactgattccaacacaaaaccccttcccctttttaaaatgatttctgttctaatgccatagatcaaaggcctcagaaaccattgtgtgtttcctctttgaagcaatgacaagcactttactttcacggtggtttttgttttttcttattgctgtggaacctcttttggaggacgttaaaggcgtgttttacttgtttttttaagagtgtgtgatgtgtgttttgtagatttcttgacagtgctgtaatacagacggcaatgcaatagcctatttaaagacactacgtgatctgattgagatgtacatagtttttttttttaccataactgaattattttatctcttatgttaacatgagaaatgtatgccaaatgattagttgatgtatgttttttaatttaatatttaaataaaatatttggaaggaaaaaaccttgactttttcccttcctctctctctcatctctctgggagctctttccttccaagcggcttccctgagaggccacatcctccaggcttgtagaagtttcaaatcttaaagaggagggcagggagccaactcctgcattccacctcactgcagggaactaatggccttccgtctgcagaggacccctccccctgcggcagccacaggtggccccgtggtctgccccctcctcagg

SEQ ID NO: 12922 - DNA, 1118 bp, Homo sapiens
cgtggctggcttctgagtccttgttgagtctgggaatcaggcccaggttactgtgggctgcgggagaaacccagcccatggatgccttctcagtgccctatttcgagggtggacgggtgcccttgctgcacaggcttgtgccttgcgcctgccgtccccgcccagtacccgcacccagggtgctggcatcatccctgagtccaacccactggctgtggctcacccggcttttctgtgtcataaagatgcctgtccacctggtgctcaggtgtggggcacggcagaagggtgaacctaagtggttctctgtgtggtggacacaaagtgtggcagcccccagggtctggatccctggctgatggctccccttgggtggcaggactgagccgatggcccggcccctgctcctgggccctggcgtgtcaaaccacgtggggcggtgggtgggagcgcagccgaggtcccggccgccctggctcagcctcctggcccctccacagactgtgagagcctgatccgccgcatgctggtggtggaccccgccaggcgcatcaccatcgcccagatccggcagcaccggtggatgcgggctgagccctgcttgccgggacccgcctgccccgccttctccgcacacagctacacctccaacctgggcgactacgatgagcaggcgctgggtatcatgcagaccctgggcgtggaccggcagaggacggtggaggtgagcctggccacacttgccctggcctcacccgcaggggctaggcagctgtctcaggggaagcaggcactcaccagctgagttaaaacgggagcacaggctaatttaggggccggcttgtccaccccactaaaggatattctcagtcacccaagaataacctgggatcgggtgggccctggggctccccgccatccccatgctgatctctgctcctcttgttcccagtcactgcaaaacagcagctataaccactttgctgccatttattacctcctccttgagcggctcaaggagtatcggaatgcccagtgcgcccgccccgggcctgccaggcagccgcggcctcggagctcggacctcagtggtttggaggtgagggggaggagtctcc

SEQ ID NO: 12923 - DNA, 1233 bp, Homo sapiens
ctgggatgtcgggggtggggaccggacggatcgcgggcggcgggggcagggtgtgggagcggggcaggggacggtcctgggatccggatcgagccgacctcgggtggcagggccaggtgtgggagcgggtccgcgcccagaggtgctaaaggggtcgagggtggggacggaaccgacagcgggcggcgggaggcgagtgtggaatcccggctcagggggtcccgggatcgggacggaaccggactcgggcggcaggggcctctatgagagcgggtccgtgcgccccgcggggctcaagagggtcgggggtccgggtggagcgggcggcgggggcgggtccacacctcccacggggctggaggggcccgtggatagagtgggggcgacaggcgtgggagcaggtccctgcgtcccgtggggactgggggctccgcgggcacggatggagccgaccgcgggcggcgggggcgctggtgggctctgagctctgtgcggccccgcaggtgcgcgcggagccatggttatcatgtcggagttcagcgcggaccccgcgggccagggtcagggccagcagaagcccctccgggtgggtttttacgacatcgagcggaccctgggcaaaggcaacttcgcggtggtgaagctggcgcggcatcgagtcaccaaaacgcaggtgcgtgggggcggtgggacccagccggcggggcctccccactggacccggggcgacccgacctttggcgggtggaccccatgcagattcactgctccaggcttgattgtcgtggtgggtaaatagtaaccgtttttagttcggtaaagaaaaataatgctttatattatgttgctgcataatttggacatatattgggagaaagcagagaggataatagcaaaaaaaaggaccaacctaagattgcagtggttcatggactcagagctaaaccctgtaaagtgagcctgcaaatacttaagtcacttacttaactctgattattttaaataacattagtggttactttggttatgttttcccaacttcttgtgaccttctggagacagagtgttgagaaattaacttgcaaaaaatgaaatgtgtaaattaggttgagggtttcttttctttttttaaaaaaacccacagaatatcctttttctttttaaatttgtaggttgcaataaaaataattgataaaacacgattagattcaagcaatttggagaaaatctatc

SEQ ID NO: 12924 - DNA, 1218 bp, Homo sapiens
tgaagtcttctccaagtcggcctctgagttccggagctccctgcccctgcaacgcatcctggcaatgtccaagagccgcaacccccgcctgcaaaccgcagcccaggagctcctggaagatctccgcactctggagcataatgtgtaggtgtgctcggccaccagggttttggtgaaaatgccggtgtcccttctccccagatccctcatttgatactccaaaaccatcaccatgtaccatgtgttagagttggcaaaatgtgattgactagagatggacatgaattgatatgtatcccacataactttgtcttggaagtgagagtgcttgtaggtggttggttaagcttgccaaaggagaggccatgaaagaacctgtccttctggaaaagtggtccatgtctgtgctggctggaagagggcttgcttagggcagcttcttgctgctcagcagaccatgacctgtaggttcacctataaaacagggaaattgaataaccatctaccccattagtcagcattttcttgagatacatttctttgaaaagcaattcattctctctctagtaattgtaattaatccccccaaaatgcaagtttacttttataaccttttggtgaacctgctatttcggatgacattgggcattttagttctatattttttgtgcctcttttatttttgaataaagaaaatcagaagagttgtattacgacccttgctgtctaaaatctaaacttgatattaggaagttagatttctgcatattaccatgctactcttggttggtggaaaaaaaactcttccttaaactgttctgggccctttggctataaacttagaagtcctatttttcttataacaaatgctgtaaaaacaacttgtataatagattagaacacatgcagttagttgagattccataaatgaaatgatagttccagctccctttttgtgcatgggtgtgcctgtatgccagggccctgccatgtctgtgttatctacctactggttgccatccagcttgttttctaggccactggcagagagcaagggagaatacacttcatttctcatggacaccatgattggtgagagttgccttttgtattagtctgctttcacactgctgtaaagaaatgcctgggacttggtaatttatagaggaaagaggtttaattgactcacagttcactgtggctggggaggtctcagga

SEQ ID NO: 12925 - DNA, 2149 bp, Homo sapiens
ggccctcccttgggagggtgagttgaggcatgggatgtggcctcactgccctcctttcctcagaaggctcttgggcctgctctctgcagggccttgagatggccctgcttcgtcctagcaagtgggtggggtcggcacccaggcaggacgctgtctaaggtgttgaagggacagctgtcggacccacttaatatggggccttgctctcatttgggacagaattcaagaagacagacaagagtatcttggtcagtcccacgggcccttctcgagtggccttcgaccctgaacagaagcccctccacggggtgctgaagacccccaccagctcacctgccagctcacccctggtggccaagaagcccctgaccaccacaccaaggagaaggcccagggctatggatttcttctgaggagcagcagagtcccttgtaaaagactgcttttgtacagaatgcgctataaattatacctttaagaatgtggggccttttttatgattttgtaagttcccataagttgtgtgcacgaggttctgagagtgcccgcaggctgctgcgtcctggcccctctgtagtggctgcgggcgtcttggttgaatcttttgctacaaaccatgtttgcgtttgagctctccaggattttacatttttgggtaacctcagtgattcccattggtgtaggaaatgagaccctctctgaagctgaggagagcacgttgatctgaactttaaatcaatcagtgctgctggcacaatgaaaggtggaactgcacttctgttgagctctcagttctgcggaatttggtactcattaccgtattcgccgtactaagttggtttctgttagtcttaacagtctgttttcttttaaaagcatgtagggcttcattgccatgttctgtgggtgtttggcaggttaccgatggggaagattcttgtcacagaatcagcaataccatagtttttctacatgtgctcagctgggggtgtggacaggtaggggtggggaaagaagaggctctgcgttctgggggctttttcttctcctccccctacccggtttccctccctgttttcctacctctacggcaagcccaaagtgtcttcccgggagcccagcgcagcccccggctcttacccaggaccccgccccgtgctgagccttctgctgaggtccttgcgtggagcacactcattcctccaagcccttgcgctcccgtttctctctctctccgtccacgttccagccgagtcactgcctgaccggctccatggcagctccccatcttccctagaggctgcctgcgcatctggagcctgcgctccggctcagcgacctttcctctcaaatgcggaagcgtgcacttacagttcagaccgttctcctgtaagttcattacaaacacgggcggaaggcactcaggctttcgttggagaaacagaaataaggccttcttttgagcagcgattgctggatcattgatctgtttgaggaagtgtctgacctgggcctgagagctggagaaggtgcagattcaaagtgagcggctcctgaggagagccgccaaggctgctcgccttctccgtggcttccgcagctaccgtctgcacggtgagagggcacgggcacacggttcgggctggcgtgcagctctcccagccagccacgctctgctcaggcctggaagtgaaagccgcctccttcccgttatgccccccatacaggagcctcggtttttcagcaaaacgcggccagtccccttctccactgctgcctcccagcagagggccccaggatctccaaggtcccagctatggctttggacaacgtggcttcggcccctggggttgcagagcttgcattgggtttacctcggtctcattcattcatggagccaagggtggggtttcacctgcgaacatcagactgacttgctggcgtcaagagcagttgactcactgatgaaggccctggtgaggagaaagcactctgttcttcgcctactctgtaatcgttttgtcataatgagccatgaaaaaagtaatgaacttgtgctgttaatcgtcactgtaatgagaagtcttacgtacaacatagctgtggtggcttaatggctgcattagataggatcctcacatcccattca

SEQ ID NO: 12926 - DNA, 1173 bp, Homo sapiens
acatgtaacgtctgccttagagccatgaccgaaacttgatatttttttctttcatgagtgtccggcatctgctggtcttcattgtgaaacgtgccagtcgtgctttgtgaaaaataacaaagtggtcacagaaatttgtgatctgaaaacccggctcccttccccacaaggctcctgggcctccgggaagacgggcccctgtttgccatctcgggggtgttccctgtgggagggtgagtgggtgaggccgagcctgctgcgtgtggagcctcgagtgggccctggctgccactaccgtacagaggccgtgtcgcgctgggctgggcctgggtggcctctgtctttgcatctctgagaaggagtcgggtggtaacggttggggtcaggaagaattctgccaagtatctttactgtcattctgaccatagcctctttgttcccgcattcgaacttttggttcttactttgctgctcgtttagtccctggggatttcagatcttaggctgttgtttcaccgtatgggagggttgatgtgagcttgcttggagacacacggtgcagcatcagggaccttcccaggccccagcaaattcaagtcggtctgcagacctctcagctacccgcgggacctcttgtaacccatcggcatcttccaggaatccgccgagtgacttgaggaagatgctaacgcagtaaggtctgtgctgggccaagagcagctttgaagctccagagaaccaccccgtcaggttccttgtggaagctcccctcatccgtggtgcagcaggctgagcactgcgcgtttgccacgtgctgcccgtgacagcacattgagccacagcatttgtagacaggacagaggggtgcctgccccctgcccctgctggcacatttaacccttgtcccctgacctcagttctgtgccccaccaaatgcccaggggcaagaggccaccctggaagctgccaatcttccaaggtgggtgtggggcacggtgggggcgggcagctcccaggcccttgggcaggctggggtgacggcagaggccacagcaccagctctgacaagtcctatcatcctctgctcagcagtgacctccctggccccactttgcccagagtttggggtccccccaggtatagctataggcggcagtgcctgtccctggcctg

SEQ ID NO: 12927 - DNA, 1228 bp, Homo sapiens
aagaagttcttcctggaatttttctttcgattctggcagaataaacaggtgtttttagttttcccactgtctgagccaagcaggaccctgtcccagagcaagagatgtccccttccatctctgacccttgcctgggacaagctttgatggggggccccagcttcaaggctgtggtgggaacagcacccccaaatgccagcctctcctttcttcccatccaccagtatactgcggggccatttctggtctttgtccaacaggaaacccatttctggtgggatatgccttccagtgccacagggccactcaccccatgcatctctgtcctgcccgtcagtgctgggacggacagcaagggcaagcccagtgtctggcggataggtgggtgggaacagagaggggagaatgccgtcctaagcttctgcttggggatcccccacacgacctgggtactgcctgggaaacctgtcctaagtaaaactatggacctcgcctcgcccaccggcctgcgaagccagcatctccgtgaaggtggatggaagcgcctttgtcctcattttgagctgcaagctgggtcagcggctctgaagccctcgagtgactttctaacccaagacccagcccctggcaggaggagggtgggtgcagggctggtgggacaaaaagaggcctcagcaggcctggaagacccttccagtacatcccacagcgtgtcgagcagctgggagaacctgtgtcaagctcgagccgtcataggtccccatgaggtgtctgaagccccttcttggtgatgggaggcagaggtgctgacgttctggagcatggacgtgagtcctcagctggctccgcgtgggcccttggagggtgccaggtgtgtggtgaccttctggatgcctttaacttcatggctgcgtcattcctgatttagaactttaaccggagcttcatctagtgattgcaaaactggaccaatgggaggacggcggcgcagcccgctccctccgtggaatggagctcagctcttcggaggcatcaaagcacctgtcgcctccgtggtccccctgctgagggagtgcggcctctgcaaggttcgggggtggcttcgtttgcctggagtggccggccctgcttgtgccatgtggatgtttgtgagcctcggtcctacagcactgtgtaggctgcatctgtttcgtgctggtcctgttgacttgtatgatatccacaaata

SEQ ID NO: 12928 - DNA, 2449 bp, Homo sapiens
gttatcttgggaacttaacctggcccctcacctcttctgcaccccccgcccccgaaactgtctcgtaatgaatttctgctgtcctcctgggagtggacggccgggtcccgtcccccgggagcatcgctcggctcagcaccttggctcccagtgggggccccgtggagggcgcccgtagtgataagcacaccggcacgaacgtcaggtccattcctcgaagtcggagccctcactctgccctgtcctggggctggctgagggcgaacgccccacctcactttctagagccctgtctgtcctagctcctatctgaccttgtgtgtaaatacgtacatctgtttttaaagtggatgggcccctgagaactcagtgaaatgcagagttctccatgcacctaaagctcctttgtcgctctcatggctgtcagatcctggtccctccacactgggtgctggggagggaggaccctcggggctaccgcgcgcccccccatcccacagatcaggagccaaggagggagaacagggcagcctgtgggactctaggatgcttcagaagaagcgacggcaccgtcaaccctctgttttttaaaggtggttggagactgttaacactgagctcattgacttctagagattttatttttactggttgatctcttggtggttttcaacttcctgctggaaactagaggtggggcaccccccaccccccagcctcgcactgtgtccttggggaaggcccgcccccatcctggccggtgtcactgtggcccggccacccctgagcgcccagctccctacctcctggacgtctctgagagtccaggcagagcagagggcagcgctcggccggtcatgctggctcccttggccttgcagcgagcccctggcccacgccgagcgagggatgcttctccctacagcatgtccactcccccggcatggccaggtggggcccctggggcaatggcagtggtagaacgctcaacttggttgcggtaccatcagcccacctgcatttggctttcgacttgcttgttctaagtcacagcgccctcatctttttagcaaggtaaaaaaaccaaaatgggtgttatctctgatatcttgaaaccagcgttctgaatagaggtaggttgagttttctaggggaaaacaaatggagaaaagaggcatgaagaaaagtaaaccgagaacataattaggcatcgggcctaagtgtcctggggagattggaggggacggcagcgttctgcatgatggaggcgctgccgggccccgggtctgtgggggccgtgctctcagggcgtgtgcgggacgccacctgtgcacacctgctcagagcacggctcctcgcaggggtgaaggggcagaccaacgaaaccagatgagaccaacgacaccatgcgagacacgcttgcagacactgttgttttggaaatgtgcttccctccatctgaaatctcatccctccacccgcccactcgggcagctgtgccgtgggcagggcatgcgctcccctggctgagcaccccagagattctcctgcaccttcctcatgccgcacgctgctcatccgtctccatgtgtgtttagatccatgccattcactgactcactaacacctgcaaaatctttaaggaaaaaagctgaagggtacgaccatgcacatatgtgacctggaaaatgcaaatttagatcttttatgatttaattattattgtttcccatagaagttccctccctttgaaattaatatataatgtataaattctgcactgagccatggcggagctgggcagcccctaggttagagtggagacggaggcccaggcgcaggggtcacacctcatctggtttccttcccatctcacagcttagcttgtgcttctcaacaccaagtctttaagagcaataaaaactacaccatgaatgtttgaattttttttttttgggggggggagggtggattttgcttttcatccagaaggaaaaggggaggagagctcctttacattttttaaattaaattcataaatcccagaacagtcttttttttttctttttcctttacaccctacttctgagcttaattcagttgatgttatgtccaaattcaggctgagtgctcaggctgaagcaactctgtagcccacagtccgtgctggccactgtcggggtgaggcacattctaggcctggcatcgctgatgccctctgcacccagtccttgagccaggccgaggacaggaagggcattgctggcctgtagctcctgttacccacccagagccaggcgccacactggaggctcccaggcgggagggcccaggcccacccacgggcgtctggccggtcaagctcccagcctgggccgtggtctcctggggacgccgctggcctcccagcttaggcccaggtgccaggtgtcatggggtctcctgccca

SEQ ID NO: 12929 - DNA, 1554 bp, Homo sapiens
tgcctgcccctttctctactgagctagtccccaaaccaaaggcaagccccctcgggcctcgggggatggggccggccacacccctgactccgccctggctctgccccatacccctgccgtggggccgacctgggggatgcagacatccggctccgtattcctgcctatcggggccaggatgcaaaaacaatttttgcgtaaaagatgtcacactgatctgctggagtggggtggacacatgaattcagttttatcatgaacactcgccactggctgcttgttaattcagggataatggtggcattcttacaaactgctcgggaaatagaatgacgggaacacttttagggagcccaggaagttaccagggacattggtgtcgccggcccaggcaacagcagcgtacgcttttcaaagatcattgagttgtcttagaatttgaagctgtgtaatgacaatgtcacctggagttcgtctccatttcttaactttttgttgcacaagtatttggacagaagtcgaactgtgaatgagatactgaaatgcactaaattgtattacattaaactggagttacttgatacaatgaagaaatgcatctgatctacttgtatttattgtctcagaattgtacgttgtgacaatcaaatgttacttgcctaaatgccaggaaattcaactggccttttaatcagcaagatcgccagcaagtactgtaactgtaaaggaaaatctctctctctggagaacccacacaaaccattgacctgagtgcgcatgacagccactggcttctttttctatgattgaaaatctgccatcgctgactgttggccagtttcaaagggacccattgtatacagggtgcaaatgtattatacggatgtttccttttgtacacttcatttttacaagttttgctactcacaagctttatgtagtggaggatagaggtatttttggtctttagaagcttgtcggggtgagggctgctaacttacacttcagaggcctgtgtcccaaaggcctggctgcgtttgccgtgctgtgcgaggacctgtgtacacaggcaggtgtgcgcctgcccgagcgcgagtagctcttgtgtagtggtgaaatgctgcaggcatctgtttattaaaattgctgctgtgaaagacagggataaaatatccacaatataagagaaagcgactccgtgcctccttctgtttcttcgtttccagtctgcatagatgtctccaaggggaaaccagggccaccaggcactcctgtcccatggggccacccaccttcagagcccactcccacgggctctgtttccttggaggccatcctgccgatggcacttttcaaggccctcccttccctacgagttgctttctgggaggggaaattgaaaaggagagcggtcacctggcaaaaacacaggggaaatcagccagtccacaaaaatacgcaaaatgacctgatgatgtccaaaaaagggttttaaaagcgatcaaggacaaaaggttttcctaagtggcatgtatacatccaaaactactcttt

SEQ ID NO: 12930 - DNA, 1164 bp, Homo sapiens
aggggtacagagctcagaggctgtggtagaagctgccgggaagcttgcctggggttcctgtgggcagtctgggctgtgccatgacagccagcttgcctcctgagatgaaggcacggcacacagcaggatggcagtcatgtagtgcttgggcccagagctgttggccatagtgggcctgggttttaaagccctgacttgcctaacagacagtattgctgtgggcagctcactcaaccctctgactctcagtctctttatctggatcactgggacgctcacatcccttggggttgtgagaactggggatcatgcatgcctgtgtgcggcactgagacccacagagcacgcccgcaggcttgctaggccgctgggctttttattcaatttaagtcccgagcctgtcctgatgctttaaaacattgcggcctttgcaggctgttattaggcacattttgctgtataaactaaagggcattagttaacctgctttcacagtgacttgtttgtttttaggataccgaagtgtataaagctacagtaaaagatgacctcaccaagtggcagaatgttctgaaggctcatagctctgtggactggttaatagtgatagttgaaaatgatgccaagaaaaaaaacaaaaccaacatccttccccgaacctctattgtggacaaaataagaaatgatttttgtaataaacagagtgacaggtaagtgtatctttaattttacctcatttggttaatacttgacatgatacagattgctggcttcctgggtagtaataaatatttactcagcaatctcgagtgagtgtccatggggtgctgtcaaggagacctggtgcctgtccttgtggagttcctgtttaggcaggcaaagaactcgaagcagtcatcccccgagtgtgctgcctgggaggagcgggtcttgggcccatagtcctgggaggcctcttggtgggtcctttctgaagactgacagcagcagctcctgcagttcttctgtagaacgggtccttaaaggtttttgttttttttttgaaatgacggcacctgtgtttttttctttaccttaacacctgagagttcctaagaacacaagttataaaatgctgacctaaccccttcagaaactgtgaaagggaatcctgaaactttggca

SEQ ID NO: 12931 - DNA, 1142 bp, Homo sapiens
tgtagaacttactgctcgtgttcatgaccagttcatgatgaagccttttcctaacctggtttcttaccgcctgcctcatgtttttgactgtttatagacggaagaagctagatgcggtggcttatgcctataatcccagcactttgagaggccgaggcaggaggattgtttgagcccaggagttcgagaccagcctgggcaacatagcaagacctcacctttacaaaaaaatacaaaaattaaccaggcatggtggtgcgtgcctgtgatcccagctactggggaggatcactggagcctgggaggtggaggttgcagtgagccaagattgtgccactgcactccagcctgggccacagagcaaaactctgtctcaaaaaaaaaaaaaaaaggaggaggaaggaagaaaattgccgctcaggacaatggcagctgctgagtcgtggtgctgtgcatggagggtctttcccagatagtctgttcatgtctttgcaggtgtgttgtgctctccgaccccttgaaggactcttctcgaactcaggaatcctggaatgccttcctgaccaaactcaggacattgcttcttatgtcttttaccaaaaacctaggcaagtttgaggatgacatgagaaccttgagggagaagaggactgagccaggctggagcttttgtgaatatttcatggttcaggtacttgactcattacagaactagacagttccttctctccttccctcctttgttccctccctctctcctcctttctttctaagtaaggcacctctcgtggtaatctcattggcagagtttttaaaaacaaaaaacctggaatatctttaggactagaaaggaagtgtatggaagcagatggggcatgaaaaggacacacacactgccccggggagcctctgggggcaaaagctggagcagtttcagtgacagaataaataaggatagagtcgaggtttaacccatggaataaaattaatatccatgagtctgtatcgatagaaatcatcagttaaataaataaatggaggagaagggtcaactcttccatacagaagaattccacttaaacgcagaaggaaagaaaaacagaaaatcacttttaagccagtgctccagcaagaactgttgg

SEQ ID NO: 12932 - DNA, 1210 bp, Homo sapiens
aggtggtttagggataaatgtttctggaaccctgtggtcccccataatgttgatagaatatcatatgcactgggagttaaatatatttaatttaatgatcattatatatgtgggggttaatatgttgtttttctgtccctttaaagtctttacatgtaattgtagctgtataatcgttatttttcttttgcatcttaagtcttagaaattaagatattccatcgtgaggatgagagaggtcctcagtgtgtttttggtctggttgtagggaaggactcaagtcctggaatgtcctccactggtctactgagttgcagtcacactgttccaatggattatttgctttcggttgtaaatttaattgtacatatggttgatttattatttttaaaaatacagactaactgatgtaatgtttatgtataagttgcaccaaaaatcaaggacaaaaataagtgtgtttgtttttacaggtgtgaaagtcacagcttgtaaataagtgttgtatgtattaaaccttttccagttctccaaagcgatgtatttttgtacacttgaaatagagtactcttaatttactgggcaaatgtgcttggaattgaacttgacaagattagctcaagcagatagagtcgggtccagcagtgggtggccctcgtgtgaatccccgtggatgtgcaagttgtggagagaaggagcaccgggttcctgcccagcactgtgcttgcgggaggcggtggggcatgggaggaaggaggcacagaccggggaaatatgacagccgtcatttccagtattctctgtgttgtcttttagctcattcaataaataaaggtggtgtgatttttttttcctcctgtctttttcatttgtagaaactggagacgtgtaaagaagataaataattgtgtaattaaactttccagaaatttatcttcctcatgtgcagtttaacaaacttggtcaaactagttagcaaattagaacttcagaatctaatgatagtttagggtttctaaaataaggttttttattgtaaaaattgacgattgccctgcatttctaccaagtcctgtgaataaagagatgggagatttgattccgtcagaagagactgtaatccgtgtcgtcagcctgggagccttccccagtgtaatgtagctttctctcttaccttctggaagagggaatgtttcatttattactgttt

SEQ ID NO: 12933 - DNA, 1231 bp, Homo sapiens
cgcagcgccccgcctcctgtcccggggcggtctcggtcgccagaggagccaggccgggggcggggcggggacggggcggggacacggctgcctccagcacaccgcgcgctgggcgctcagagcctcgggcgcggcgggagcgcagttagagccgatctcccgcgccccgaggttgctcctctccgaggtctcccgcggcccaagttctccgcgccccgaggtctccgcgccccgaggtctccgcggcccgaggtctccgcccgcaccatgcggctgggcaggtgagccggggaaggagcggaggcgccgcggtcaggggcggggtggctcggcccgcgcgtccccagctcggctcggacgcggggcctgcggggctcgcctggaggtgccgggctggcagtgcgggtccgaggagcgggcggcggaggcgccggggcggccggcggggcgtggacggcagtgggcggcggggcctggcaccgggacccatggcaggacgcacagccgtgcgggggcgggctcgggggcggggtccctgccagggaaggaggaccgcgaacgctggaaggagggagggaaggcgggcgcaccctgcacgccggggcacgggcgctgccccttccactccctggcactgctgatttcctagaagaagggagaaggagggaggtgaccggccgagcgctctccaaggccagctggtgcccacggtctgcggacacgccctcccccacacacgtgggattccccgcagcccggcagccgatccacactggggaaggcggggctgcctgaaccaggagtgacagcttcctcctggatttttgcgaaaatatccaaaatatactcttcgcaacccacgttgtagggtccgcagcctgtgctcccctgggtgaacctgtgaggcccctgaccccagggatgcctcccgcacagctcagagctgggccacaccggagtcacactccccaggtcccctccccattagaagtgtatgcagttatgatcctgccctagagagaaagaatttaaaggtcccggaatgtcatagccctcccaaatgtcttagccctccgccacccacaccttcaggtaggcggccctgtccatgctgggtcttgaggcaagctcggggtgggggtaggttagatgcaggggtgctgagggtccaaggaaaggacacagaggccgctgcttaggcagcacccagggaggggacaagccagaaaca

SEQ ID NO: 12934 - DNA, 1247 bp, Homo sapiens
tgcttcccaggggaccagcccccggccgggggaggcgggaggcaagggagtcatctggtcccctgttgctcactccacctccatgagaaaaactcccagaatcaggcgggggttccggggggggggtcttaggcacctgggacaactgagaggcaggctgttcccctcgccccctcgcagcgattccttcccagccccatctccggggccacccagtgggcgctgcgcttgctcacaaccttccctcccctcctctcagcagcaggcactgggctctggtttcggaagaagaattgtccctgctggcccagaacaagcagagctcgaagctcgcggccaagtggcccaccaagctggtgaagaactgctttctccccctaagagaatatttcaagtatttttcaacagaactcacttcctctttataaatgagtcactatactgtgaagaaaaagacttttcctagaacaaaggcaactttcctcacgttgtctctttcctcttcggattcttgtttttttgcgtctccgtcgtcactgcagacccacgttccgttgggttctggagactcagggtctctcccccatcacgctggctcatgggacggggcgaggcccacgccgctgcacacaggaccacacgtggtggtgcgcgatgtacttcctgaaagcatttctgtgttctagttgagaagttcgagtatatttattataagatagttattggtcacgtctggtgttttatgtgtaggcacagccatctgtcaccctgcagggcagggggtggaggccagaagtgagcaggaggcgtcttcggagcgcctgcaccgtgtcccgcatgatgcactttctgccggggccttccccttgagaccgctgtttgcgttcatagagaaaccacgcaccctgattgtagctgcaccaaacagcctggacctttgcaaaagtacaggacctcagccttggcagacaaaggagggacctgctgaacagacggtgcggaggccaaggccagatccacacacaaaagtacaggacctcagccttggcaggcaaaggagggacttgctgaacagacggtgcggaggccaaggccagatccacgcacaaaggatgtcacttgtgggtcctaccccaggtggtattgcttgcaaaaagcagggctcctcctggccctctgcagtctgagtctcagtgaggataaacccagcagaaagctctgcctcaggctgtgctcgaatcacagga

SEQ ID NO: 12935 - DNA, 1276 bp, Homo sapiens
agagtcagcaaccatcatcaccatctaattttagaaggttttcatcaccctgaaaagaaaacccatgtctagtaacagtcactccaaattcccccttcttgcttcccttcttttaactctaggcaaccactcctcgactttctctcaacgtgggtttgccttttctggatcctttgcatttccgtatgaatttaggatcagcctgtcaactcctgcccaaaagccagctgggattttgagagggctctgcagctccatttggggactcatgctattttaacaatattaagtcttcttctttttttttttttttttttttttgagacacactctcactctgtcccccaggctggagtgcagaggcatgatcttggctcatagcaacctctgtctaccaggttcaagtgattctcctgctcagcctcctaaagtgctggaattacaggcatgagccaccacacccagccaatgttaaatcttctgatccatgaacatgggatatctttccattttgttccatcttccttaacatcttccaacaatactttgcagttttcagtgtataagtctcatatttgtttggctaaatttattcctaatcgtctgctgtatttgacagcactgggaaaacacagtgtgctttgaatgtttcctttagacatctgcatctgctgcggaagtctccaggttcacacacagcaccctctgtttgagggagggatctgcgccccatgtaaggtaggcagggaggctgggggtgactccctcatggcctcagagcagggatgacacaagccagccttgctttgctccttccaaggacaagttcctggatgccctcttcctgtacgacgatgacgggtaccaatcctactgctccatctgctgctccggagagacgctgctcatctgcggaaaccctgattgcacccggtgaggcgaggggcctgcccaggggggtgaaggggctgaggacacacccatcctttcagctactcattctggagtgtgggtggattttcttcccaaatggatgatttccctgagagcttctgatttctgtctccaatgcgtcatttggcatagagccctgagctatgggaggcgggtgtctacggttggcgattgtgatttttcttttcggtgttgatattgccacatcgctgtgcaggggagcgatggaaaccccacaccccaggctgccagtcatgaccggggtgacaaggggtatgctcacccctcagtcgttactccctcgcctcggctccctccgtgg

SEQ ID NO: 12936 - DNA, 1289 bp, Homo sapiens
agatccccgcatgctccctgccttatggtggccctgcaggaagcccgcgtcctggggttttctgagccagggaggggagtcagggtggctgggcatggggcccgaggtgatggggcccgaggtggggccgctggctgccgatgcagggcccaggagtcacttgacttggccaggggcagccgactgccggcctcgggaggcagcttctggcctggacttggagctggagagagcaggcagggtcctcgatcgggaacagacgggaacggtgcacgggttggaaggaatgggtgttcacaagctgcctgggaggctccccgtggggatcctgtctgcactggcgttggccttggcccaggcagcccaggggagtccagggaaccgggcctcacctgtttccagggtggcgctccaaccccctttgaccggaactatgggaccaagctgggggtgaaggccatgctgtggttgtcggagaagctgcgcgaggtttaccgcaagggtaggtggtgggtgcgacccgaggcctcactttgccctcccctggctccctggggcagggcctcaccatggagggctgccacgtgcctctgtttgcaggacgggtgttcgccaatgccccagactcggcctgcgtgatcggcctgaagaagaaggcggtggccttcagccccgtcactgagctcaagaaagacactgatttcgagtgagttccaccaaagcctcgtggaggcgggtggggctgaggggtggcccagaccttccctgaggcaggtgtgccaggcccagccccactggcaccctgaccccgcaaggcctcctgggcccccatgcccaggtccccgccaggccgtggagagcagggaccatgcccaagtcttctgagcacaacactgggcaatcctttcgggtgggcatgggggcacagcgggtagccaggagtgggcacgcttgagggcggctgaggctgactctgtgctgtgcctccgagggatggggaccccagacctgtcccagctccacggataccgagatgttcagacagaggggcatgcacaggctgcagggtcggggggggtgggggggctggggacgtggctgaagagctgccctgacccctgactccccatcatcctcccatccccgtcctgcacaggcaccgcatgccacgggagcagtggtggctgagcctgcggctcatgctgaagatgctggcacaataccgcatcagtatggccgcctacgtgtcaggggagctggagcacgtgacccgccgcaccctgagcatg

SEQ ID NO: 12937 - DNA, 1730 bp, Homo sapiens
cacaccgccaagcagctcagcattctcccccggcacacttagtgacagtgatgctctgtgctggtaccaaacaaggcagacttgcaagaaccatggcatcttttttttttttcaaacctttcctacttcaaacaggcttctcttctgaaatgatgacttaatgtcgaatattgacagcttactgcagttttacagtattcctcacaaagggcttcaggtagattatcagagctgtcagcactacctctccccgctgaaaccagcagttcatggcttcctgtggattccctccctccctggagtgttgagggggttgtacctgccagacttccaggggacgatggaatacccagaacgctccttctgaagaaatggggccctgtagctgcagcacaggggaagggcccggcaccctttctgggtccttcctggttccctgtgggccccatgaggagtccattacttcctttcttccttcatattttacaggcagatgcttttcttataatctaattacatcttttcatttgttatatattacaaaccatcacacttagaaatacttccaggaaatgcttttttgaagtgtgaattaataagaaatggggtaaatagaaaagaaatttattgctgattggccaggtgcggtggttcgtgcctgtaatcccagctctttgggaggccaaggcaggtagatcacaaggtcaggaaattgagaccatcctggctaatacagtgaaaccccatgtctgctaaaattacaaaaaattagctgggcgtggtggtgcacgcctgtagtctcagctactcaggaggctgaggcaggagaatcgcttgaacccgggaggcagaggtagcagtgagctgaagtcccgccactgcactccagcctgggcaacagagcgagactcagtctcaaaaagaaaaaagaaatttattgctgatcacaaggacagacagttttttcccgaccatactcatcaaagatttacgtttgtatattagtaactagtgcattactagagcaggtgcaggtgaggtctttaaagtttcaatgaaagtttcttctggatctacagaaaaaatttttttttttcaatctaaaaactggaaattctagggtttttgtacattttggatgcactgggaatttattagcacaaaatcattctttgcaactcaaaattcagaagggactctaccatatcttagctcagagcacagaggagtgccttatccccacacttgactgggctgtggaggtgggcatgtgggcccctgggcccaggctggggacagagcccttgttttgtgacttaggattttgatgtggttcccatgttctctaacagggccagctgagcagcacaggccaggaggccacagtgtaagcaataacagatctgccacatgcagaagcaaatatcaggcctgtcgcacacgggcggcatttaaataggaatttctatttttgaaataagggatggtctatgaggcatacagtagatttgatgtgatccttttctccctcccttccataatggatcgtggtctgtgtgactgaacccacacagagtgtcatgggtgacagtttctggttgaagtagctccacgcctggcttctgtggacagcagattcttttccttctcacaaggggctcatttaaaatttggaggctgggtgctgtggctcacgcctgcaatcccagcactttgggagactgaggcgg

SEQ ID NO: 12938 - DNA, 2161 bp, Homo sapiens
ctgagctgcagtgaggggacggacaagagccaaggtgtgaccaggtgatgtcgctagtgtcagggaacactcatgccagtgaggatcttcccactctctgatgaaaactaacaggctcccctctctctcgctgtgcctgttgtgacaaccatgacagctggagatggaggacgaggacaccatcgacgtgttccagcagcagacgggaggtgtgccggagagcagcctggcagggcacagtttctagagggcccgtccccagcccgggccgtccatcctcgcattgctgttgaatggtgagcacgtgaccatgccgaccacaaaggtgtctgcggaaactcgaggacattcaccacgatgattttcctctctttgatgtacttcaagtgcaactcaaaactatatctgcagggatgaatctgtaacttaaattgggccaatcagaattgttatctttgttcaggtaaaatgagttgcaagatattgtgggtacttttgtgtgctcatttgtgttttccccccctcctacaacatttttttaaccccaaaattatagcctgaatgttcgcttttagtctggccagggatctgactcctgagttggttgcctctcccctgctcactccagtcacatagagaattggtgtttcccgcagtggggatgcagctgttggacaggtattgggggcaaggttggtagggaggacagactgtcacttgctgttacaggcacaggtgattaaaatgctaaatattgcaaatttaagctttgtcagtatatggaaaagttgaagggaaaatactggaatgcttcttcaaaggttaaaaaataaccgagtcttttggtaatttgaccccacgtgctctctggccctcaagcatgtaacctcggggtctgaggcccaggacccacccccctgccacccctcccaccccactccctgctcagtacctggcgttggtacacaggcaaggattggcacaaccaaaattggcctttttctccctcttaatattgaagaaattcccacatttctcatttggtaatggtgttgtggcctcagatttcttctagtatttgcttctgatgaatgattatggtctatacataaaaaagtaagactaagtattgctgaatttgcagttatgttgtcgtgtataagagctacttccaagtgtggttacaaatgaacccatggaatgatgacttcatgttcttctcgtgggtttgtgccgtgctgctttccaaataggtattgaatttatgcattagtctggtgatttcagttctgtgaaatattttgggatctataccaattaaacattttcatagttctgcctattgtccttccctgaggctccattgctgcttggtggccattctctgcctttttacagtcacctgaacaatgacccatcatctcttgcttgcttgaaatcttgctgaaatgttctcatttcctgtttgctgtatgggctcgggtgggatgtttgttggctctgttgtgtttattcaccaatttgtacattatttgttgtcctttactactgtaaacagtaaatatagtttggtattctgtctcttggcttctactaaacactgcatttgaaggttggggcatactggtacaattcagtgtttgaattgaccattccaggcagccactgcactgagaaactttgattgaaaagctagccgctggaaggttagtattcgcctggcagctcatttcccctcccctggcacatcaccaatgctagtccagccttcttcctgctgagggatgcatcctctcctcagagacctcctggctgacagctgtctgagctggcatcactgtgacatgttaccctccctctcctgggtttcgtatgtaaagaaagggtggattttagaggcaggtgagcttgggtgttagtctaggacatctctcgttttctggtgtttgaatgtaagtcagctttccttctgccatggacaacttacctatctgctttgaaactgaactgacattgatttggctttaagaatttcccagtgtgcagtggtgtaacaaaacccaggttgaaaatgagctgttttagcccatcagttgaatgaacccaaggtgaagaaagatgggcagctgtggagatggaacacgtgattcacttgcaccag

SEQ ID NO: 12939 - DNA, 1182 bp, Homo sapiens
gtttctgtaaaatcaggatacgtggctttagtaagcagaccaagcgcttcgtggcagggaaagcagcgtgcggggaagtcactgaaaagtgctgcctaaggaagtttggaaatagtccctgttccagattgccttgaattttaaaacattttgctttgggaaagtaggtcagcagcacctaagatcaaggatgcgttccattttcacacttcacagtcatgaaaactgagaagactgtcttcagcgtgaactaaagttcacaggcagatcactgatccagaacacttcaagaactcgtcaaacagctcgataagcctttttgactgtgtacatctgtaccgggaataacattcctaggctgaaatttccacaaagaatagaacctgtacccagttcttcaggctgatttccctgacctcttgggcatttgtatttgtagtaaagtattgcagagattcctaagtattttatagcagccatcaaaattggactttgtattgtttattcataaaagacacttggtaatagacttcagtgaactctgtatgaatgcagtagtgtgtgtgcaaaatccgcttcctgagcgtagggtgctgagctggcgctagggctcggttgtgaaatacagcgtagtcagcccttgcgctcagtgtagaaacccacgtctgtaaggtcggtcttcgtccatctgcttttttctgaaatacactaagagcagccacaaaactgtaacctcaaggaaaccataaagcttggagtgccttaatttttaaccagtttccaataaaacggtttactacctgcgtgtgtttagtatgctgcgtgttcctgtgttccatctcagtggtgtcgacatgaccgcttggaatgctgggaggcaggtaggcttttttgggtaaagtgggcctctgacccatcgtgggatgcctgggcagtctccagactaaatgcctgtggctgtcagaacggaccaggctgtgtcctaaaactgtgcccacgggcctgcctcgcaggggaggtcttggctgtctctgccctccacagctgccctgcgcaccgcatgccctccactcgcgctgggtgccgagggccgggggagaaggcagggctgcctcgggaagggcgaccttggcccccccgtgtgaaacgcacacctgcatgaggctcccgcgctccctgctc

SEQ ID NO: 12940 - DNA, 1282 bp, Homo sapiens
agttcccttcctgagatgcgctggtggaggagggggcagtctctggaatttctgtttggagactttccggaggcgtgttcagacataaaatcacagcagcagcagtcagttttcaagcaaagagacttctctgggcatctctgagacgagtttgagcagtgtggggattcgttttgggagcacggcctcactgacatgcagatgtttgcttgtggaatgcctgcgcctgccctcgagaaggaggtggcactcagctgcttgaaacaaggctgggtcccaagcagcccagccctgccctgtggacagcaatcgaccgatggctacagcatgtcctgacctggggacagctggggacaggttgtggggctgtttcgtcacagctgctgtcacattaactgaccccagccctgggggagggtggctgcaaccccagccgcacagcctggaggaggcagggtgacgagggactccagctgggggagctggcgtgcagagcactgagggggtgggtggattgtggggtgaaacctgggtgtgtgcgtgtgaggatgcacatgtgtgaacgtgtgtgtgagtgagcacgcctgtgtaaactgcctggctccacctctgatgggctccgtgatcttgagcggggtcaccaggctcatgcctcagttttcttcatctgtgaaatgggccgatggccaggctgcacacaggtcctcagagggcataaggcacactcagcacccactgctgtgcctgggcagctggcgggggggcacagcagccactcacatgccactcacatccctgtgggttaccggctgcctggaatgttccagtctaaccggatccttttgtggacggggagactgaggccgggaaggagtatgcattcctgccctggtcccgggctccgtctctgctgggtctcctgggcagaaggtcaggaagggctgagagggacacagtccaaggcaggtaaagccccagctttgaggggaggcacagcagctctgagagggtctgagcccctcgagaccctccccgggatgtttaacgacttgggcagccattgcaacagtggaattggcactgcagcaagctgagcattttttcggttccaagtttcccacaacacaatggctccaggccaggcgcctctgggcgttccaggtcagagggggagcaggggctgggggccgctgcctcagtgcttctgggatggggtcctggcttggagccccaatccagagactcagcagccctgccccggcagagcctagcggagcacgtt

SEQ ID NO: 12941 - DNA, 1214 bp, Homo sapiens
tggtcccttctccccactggctctgcccatcaatgctcaaagcatggaaggggaagcctgtggacaccatgtctgctgtgcccatccctgctcaaagcatggaagggggcctgtggacaccatgtcccgtgcagacaccatgtctcctgcagacaccatgtcccctgcacacaggtttctgcatggagcctgcctgtcgtttgggaatgagtgaaccagggtggccgttgggtggctgagcccaggggatcagggcaggctgccaggcacgtggagagccctcccagactcagtttctcctttctgcccctgcctggctgcctctccaggccgcgtcggtggcccctggttccgtcctgcacagccacctcaccagctgtctttctttttgcagagcgcatcagcgaggaggtggggctgctgcagctccttggggaccccccgccccagcaggtcacccagacggatgaccccgacgtcgggctggcctacgtctttgggccagatgccaacagtggccaagtggcccggtaccacttccccagcctcttcttccgtgacttctcactgctgttccacatccggccagccacagagggcccaggggtgctgttcgccatcacggactcggcgcaggccatggtcttgctgggcgtgaagctctctggggtgcaggacgggcaccaggacatctccctgctctacacagaaccaggtgcaggccagacccacacagccgccagcttccggctccccgccttcgtcggccagtggacacacttagccctcagtgtggcaggtggctttgtggccctctacgtggactgtgaggagttccagagaatgccgcttgctcggtcctcacggggcctggagctggagcctggcgccgggctcttcgtggctcaggcggggggagcggaccctgacaagttccaggtaacccccactgtgccgtcgctgggggactggagcagctgggatggggtggggtgggggtggccactgggacagggacggagctgtggccggaagaggagagcccccaccccagctgtggtcagcccgggcctccagcgcaggcctcctgggttcttggctgctcagccctggcctccggcgcaggcctcccgggttcttggccggcctggctggggtggcattcactttcttggctctctggctcctgcgcccccaggaagggtagccctggg

SEQ ID NO: 12942 - DNA, 1302 bp, Homo sapiens
ggcagctgtcgggggagatggagcagccgtcggggatgggggagatgccagccgctcgggcctcacggcctggcctccattccagggacctgcaggacccaagggcaacctgggctctaagggcgaacgaggctccccgggacccaaggtaaggggctcaggtgctgtccctcaaccccctttgtgacccaggggtggctccagcctgcccagatgaccactgttgggagggacctgggaccccccggctgctgctgtgacacgtgaggggtacatccctgctcgggccgtccctgtggtcacctcccgtgaaaggacccagcctgcgaggcccagtcacagcggccctgccttcggggctctgggtgaggctttgtggggaaggagctggccctgactctgctggacctcctgccattccagggtgagaagggtgaaccgggcagcatcttcagccccgacggcggtgccctgggccctgcccagaaaggagccaaggtgagggccgggcagcctccttccggcaggcgtgggggctcctggggctgtggagacagcctggggagggtcttcctgagggtctggctcctgatgcacgagcctctcccaagcagggctctaccatccaggcctggccctggtggcccctcctttctcgcacccatgtcggcggttccgccggcccctcgtcctctccctgcccctcgtcctctccctacccctgagcccaccctgctgaggggaggttctcagtgggctgcagctctgagctcgcgcctccctggggcctggcctgtggggtgcaggagcccaggctgtaccagctcagcctcagcaggtttctggctgcccctccagcctcttcctgggggccctgatgctgtgggcagggcccggagtcagttcctcaaggggcctgtgcctgcgtccccacccccagcaggcagccgcccagaaaagccctcggggagggtcctggggagaagcctggatctttggagtgtgggccaccggctctcccactttcagagggagcagtgagccctccggggtgtttggggtgggcctcagacacaggatccccaggcccagtgagagctccactatcccacccagctgtgcattggagctggggcctgtggcaaccaggacactgcgtggcacatgccctccaccctccaccctccacccctgcttcagggtcccggggcatgcatgcacgcaccaacctggacgcaaaccccaaacccgaccctcccctcaccagtggctcctgtcctccccagggctgcctgcgccttg

SEQ ID NO: 12943 - DNA, 1296 bp, Homo sapiens
cgcccacagccaccgcgacttccagccggtggtgagtgcccccccaaagtgggcttggctccatctagcccctcggctctcggcagcagaagagggcccagcccctgcagagctgctgggggtcccaggcttcggccatgggtgggggtctggcggctcagggccactcagggcggcttggctggccctgggacttgccctctggtggccaagcagtggtcatgaaagtccagccgctgtcacatccttgaggaaccggcgtacctccgcctacagcggcagctgggggcacccacgtggcccggggctgctctgacctggcagcgtatgggggctgctgcctgggcccctcagtgtgtcacttgcgcgcctcccgctcagcgcccctcggccgtgcctgtccacacaggtgcggggccggggtggtgcgcccggggcctgggtgcagggggcagcgtgggacacagcccgtgacgcgcccctctccccgcagctccacctggttgcgctcaacagccccctgtcaggcggcatgcggggcatccgcggggccgacttccagtgcttccagcaggcgcgggccgtggggctggcgggcaccttccgcgccttcctgtcctcgcgcctgcaggacctgtacagcatcgtgcgccgtgccgaccgcgcagccgtgcccatcgtcaacctcaaggtgggtcagtccagtcctgagggcgcgggctcctcggcccccacttgacctctggggtgaactcccagcggggagctcccctctagggcctctggaggccaccatgttacagacactggcgcctaggctggcgacttcagggcaggctccgggtgggtcacacccctccaggctcaggccaggcctctgcatccctgggcactgccacgtcccccagggcatcccatgaggcccccccgtggccccctgaccccccgctcccccggcagtgcccctcagagggtcccatgctgctggaccaagtgtccacacaggtgatagggctcacatacaagcctggaatcaggaaccgtcctttgggcctctagtgccatgcgggctggtggcccctctgccacagcacccatgtggctttattctgtggccccttttcgtgcactgggctgtggcttctgggtgccccggggagcacccacattccccagaaccaacagcagaggggtcagagacccagggctgggagcaggcggctgtggcctggcgttaggggacagggtcccctgccttagccaaggcctcttggggtctgcagaggctgcctggcc

SEQ ID NO: 12944 - DNA, 1790 bp, Homo sapiens
tccgagcatgtgtgcccttaaaatgttgacagaaatttccagggtatctagaagaacgcttcgtcccaaatgtcgctgtgccctccccacgtgagcgccgcgattcttccaacactcatgcatttaggggtgtctcggggtgccacacagcgtgtccccagcagtgcctggccatctgctgtaacggagatgcacctgccaagggtctctgacaggagtgctgtgggcagggctgggccccagggaaggcctgaaagccaggagcccgggaggcggagctggttcctagcgaggcagccacaggaagcctctgctcagcaggcatgagggccaggttcacccagccaggccaagccctggcccctctcccctctgccgtgggtgtgtctggcagaagcagcatggggggcagtctgggagatgcagccccctccacaggcagccagcagggaggccatgtggccctccaggttgtgggagcctctgcagccccctggtaaccccagggctggcctcctgcctccacctttcctgcccggggagcggcctctgccctaagcagagcaggtctgggtttgactgacggcccggcgcgtcttacaggccccagaagagcgtgtggcatggctcggaccccaacgggcgcaggctgaccgagagctactgtgagacgtggcggacggaggctccctcggccacgggccaggcctcctcgctgctggggggcaggctcctggggcagagtgccgcgagctgccatcacgcctacatcgtgctctgcattgagaacagcttcatgactgcctccaagtagccaccgcctggatgcggatggccggagaggaccggcggctcggaggaagcccccaccgtgggcagggagcggccggccagcccctggccccaggacctggctgccatactttcctgtatagttcacgtttcatgtaatcctcaagaaataaaaggaagccaaagagtgtatttttttaaaagtttaaaacagaagcctgatgctgacattcacctgccccaactctcccctgacctgtgagcccagctgggtcaggcagggtgcagtatcatgccctgtgcaacctcttggcctgatcagaccacggctcgatttctccaggatttcctgctttgggaagccgtgctcgccccagcaggtgctgacttcatctcccacctagcagcaccgttctgtgcacaaaacccagacctgttagcagacaggccccgtgaggcaatgggagctgaggccacactcagcacaaggccatctgggctcctccagggtgtgtgctcgccctgcggtagatgggagggaggctcaggtccctggggctagggggagccccttctgctcagctctgggccattctccacagcaaccccaggctgaagcaggttcccaagctcagaggcgcactgtgacccccagctccggcctgtcctccaacaccaagcacagcagcctggggctggcctcccaaatgagccatgagatgatacatccaaagcagacagctccaccctggccgagtccaagctgggagattcaagggacccatgagttggggtctggcagcctcccatccagggcccccatctcatgcccctggctgggacgtggctcagccagcacttgtccagctgagcgccaggatggaacacggccacatcaaagaggctgaggctggcacaggacatgcggtagccagcacacagggcagtgagggagggctgtcatctgtgcactgcccatggacaggctggctccagat

SEQ ID NO: 12945 - DNA, 1245 bp, Homo sapiens
tccgaggggttcttgggaaatggtgggaaccccccttcaggcctgtgccaggtggtggaggtcgggggggctgtggtgagcactgtggcacctgctcctggggctggcctctgaccgctgtgcagtgttcagggtcagcctctgagctggaggagggtgagcctgggagcaggcgtcggggtgtagggtgccagtgtcccagccaggccctccccacccgcctcacccggcctctctttccagttccagttatactccgtgtacttcctgatcctgtccatcatctacttcttgggggccatgctggatggcctgcggcactgccagcggggccaccacccgcggcagcccccggcccagggcctgaggagtgccgcggaggagaaggcagcacaggcactgagcgtgcaggacaagggcctcggaggcctgcagccagcccagagcccgccgctttccccagaagacagcctgggggctgtggggccagcctccctggagcagagacagagcgacccatacctggcccaggccccggccccgcaggcagctgaattcctgagcccagtgacaaccccttccccctgcactctgtgctccgcccaagcctcaggccctgaggctgcagatgagacttgtccccagctggctgtccatcctcctggtgtcagcaagctgggtttgcagtgtcttccaagcgacggtgttcagaatgtgaaccagtgactctcgggcgcccctgtggtaactttgcaggcggccctcagtgcatccccacgacccctgcctcgagggccgcctgccttagcaatgggggcctccgcttatcctgctagcaggccccctaggattccccctgccctgtgccgcactctggcggtggccacagcgtgctggcgacactcagggcagctgcctggccatgctgtccctgcactgtgccccgcgggctttgttgctggaagaggtgggtggtgggcttctgcgtccaccaggcctcactggctcatgccccttggggggcttgagacaaatcctttctgccccccagggctagtgaagtggcctcttggataccagctcaggggacactggccccacaggagttgtgagccctctagggcagggtgggagccgggaccctcaggtgtagctgagctgtgacattgctggtcatccttggtgctcttgcttttttgaaagatgctttttttttttttaactgacgtagaatgaagaactgca

SEQ ID NO: 12946 - DNA, 1285 bp, Homo sapiens
cagcccggcctcacgtctgcccactgatgagggcgttggttgtgaccgtctctccctctcctgcctttgtctgttccaggctgacgtccgaggtcaccgggatgggcacgctgtaatcctacccagcacccttcccccgcgtcacccacctgccagagcctaaggcccccggctctcgcactctgtacagcccaccttccctgcctcacagataccaatagagaggttttcttaattaacaaaaggacgtatgccatggagaaacacacccgcgcacacagctgctctctacagaggctgcaggctccgccgagtcccccctcagtgttattttatttatgacttacgctcccgtctgcccatgcaccggcatgcagtggtaattattttagaaatattgttccttggtgtcagcgtagctgtctgtcttaggagctgggtcggcgttccgacagcacttcctgtccgcccttctcctctgccatccagaaccgtccagaactgttgcctgagacccctcctctctcacacagccctgccatgctgactcggtttcccctcagagccattgttgtctgggctcgagtttctgccccaggttgtgtgctggaatcggggggtggctctcctgccacccatggggagcgccaggagaggagggtcatggaggatgttggggctctgaccccaggagtggggtggagggcggagcctgctgggggccctgccttcacagagatgccgcgtgctgggaaggctcttggggtcccctgagcgtcttccagggtggctggagagcacagacgcgccagggagccccctctgtgctcctcagagttcaataaatgtcgtggcccctcctcaccggctctggcttgtctctgcgccccccaatgcacccaggccccggcacttccttcccctggggagacattgccctgagcccaatgcttatcgagaagcctgggtttcttctcacacacagataccatttcattccccctttccacaacacacataagcacttctatttgtactttggcaaaactacttaaaatgacaaacacagaaacaccattcctgcccgggcaccaaaatgccagttcctaatttgtgagacttactcccttatagccgttatgggtaccagaggccatgcccggtgacccccagtgcttccacaggtggagcctatccgcctcacacctgcttggggacagtccacgtggctcacttggcagcctgtgctcaccttaagaagcctggctctgcccctgctcaatcc

SEQ ID NO: 12947 - DNA, 1177 bp, Homo sapiens
tgcaagcgtgttggtagatccacaggcctgtgattggtgagaatgcttcttgtatggtggccactcctctcctggtctcctggtctttcctcaggctttacaccgtgaaaagacataacacaagctggctgcagtggctcacgcctgtaatcccagcactttgggaggccgaggcgggtgcatcacctgaggttgggagttcgagaccagcctgaccaacacagagaaaccctgtctttactaaaaatacaaaactagccagccatggtggcacatacctgtaatcccagctactcgggaggctgaggcaagagaatcgcttgaacctgggaggtggaggttgtggtgagccaagatcgtgccgttgcactccagcctgggcaacaagagcaaaacttcgtctcaaaaaaaaaaaaaaaaaaaaaagttacacagagccctgccaagccctgacgggagtgttttgggtcattgtcccagaatagctgggatgtcctgttcttccccgcggcgatgctttatctgagcctcaaatatctttgcacctgttggaacagcagtcacttgtcagcagtgtgacttgacctacacttgtggggtgattggattactttccgggataccgcccttgagagtttggttgtgaggaaagtcctctgaaaacgtaagcttgatttctttttgatagaagtatgtatcccataagattcccctgccctgccctgccccgcctgtgctggtaacacgacgcagagctgagtgcagaagtgaatcgcatgcggccggtgtgggatgctcaaggcggtgtcatcttttctcggattgaaaacccaaatctattcataggttaattattttaatattaagataatattaacgttggtttagatagcatttgaatgtcctaaatgcgttctcaattgaatgtctttgccttctgacattggtattctctgtgcatgccacttacttatgattaaaacatatgtgatatttttctataattgtgtggattttagaaaaacctgaaaataactttttttgaaacgtcttttttgatactgacctcacagcttagaagaacatggtcaatttaaagagttttattccaggctagagcctctgccagggggttgcaggaagaaaatctcctttgagccggcccggtcagattgag

SEQ ID NO: 12948 - DNA, 1235 bp, Homo sapiens
gttactattgttgtatcacaaacaacaacagtcattttattgtctctcatgctttctgtgggccaggagcttaggaaggcctctgccaggtggttctggcttgcaggagatggtgtttggagggagcggtgaggggctgagacagctttgtgtgtgtacatctcaggcccccacctggtctctcagagtgagctgctctgggcttccttgcagtgcagtggcctcaacaccgtccttctgtttgccgggcttcacagggctccaggcgagtgtcccaagacaatcgggtagaagctgaattgacgttactggcctgcattggaagtcacacagcatcacaaccactgtagtcacaggcccttttcccactgagtggagtgtcgacgtcacattgcagaggggcatgtagtttggagacattgcagcatctttagaacatgcgtttctcacaagtctgtaacatggagcagtggctttggtgcagaatcatgctgcaggcaaggtgggcccacctccctggaatttcatccccctcgtcagttaaacccatggtggttttattttctaggccacctgatctgggaggaccacctccaagaaaagcagtcctgtcgatgaacggtctaagttatggtgttatcagagtggatactgaagaaaagttgtcagtccttactgttcaggacgttggtcaggtgatgcctggaggtaagagacataaccagagtgggtctttgtccatgactgattgaggtaacgaaaagggttttgttttgttttgagacggagtcttgctttgtcaccaggctggagtgcagtggtgtgatcttggctcactgcatcctccgcctcccaggttcaagcgattctcctgcctcagcctcttataaatactccaggcttcatagtagtgctctagaagcaagcatacaagtaaaagatttctcaagaatgtttttcagtgtaaattggaattttactttgtaaaatatttgctcagttttttccctccctttgtgctaagtttaaagatgagctaaaatataaagatgtgtatatggcctatgcaactcacttacagttctttgatatttgggaagacggtgataatagctcactgtgttccaggcacaggcttcatacttcatatgtgttgaagcatttaaccccatggcaaccatgtgaagtgggcagctctgaggaaaatggtaatgtttgtgaataacttgataatt

SEQ ID NO: 12949 - DNA, 1677 bp, Homo sapiens
gagatgccgtcttaaaaaaacaaaaaagaggtgtgctgcttgtcagcatgtattgtcacggacactcaataagtgccattttggactgtcaaatttagatgctttgtttcagaaagataagccagcatttagttttaaatcactttcctggtttgtaacttgatgctgtttagttaaattgctagttttcctaacactacaatattaattcttctcgtggaagtgtactgatttattatttttattccaagtcagcagatttggaagcattgtggtaaagtctaaggttttcatatccatagtgctgtttggtgagtaccggcagtacagttgaggggagcagggaacagcattgccccgtattgaaggtggagatggttacattcttcactgctttttgcattttgagttgtgtgcctataaaatttggccaaaccattttattattttgttcaaacttgactaagctgagtgatctaaaattatacagaacctaaatcaaagaagagaatgtaaagtcctttagttacttctaagaatttgaagtcaagcacgaatctaagacatagattatttttatatagctaatgaagagtatgttacgaaattgttgggtttttggggtattgagggtggcaaattttgtgaatcatgcatgcttcacagaaacaaccaggtttttccagaattagtctggatcagtgcctaacaaagctgttattaattctccacacatgagtctggctaactgggccagctctcatgttttactcctgtctggctacaaatagcactgtgcatagtagccctgtttccccatggtgttggactgtggtaaagtatgttgtgacatactggaattctaataatcctgttgtaagtatgtacagaatctatgtaacttattgttgacatacagaggtttgggaagtagtctaatggacattccttacaatagaatggctgggaagggaaagaaaaaaaaaaaaaaactacctaactccaatcttaatgttgtagttttatagcaaacaaaaattgtcagctttttgtattgaaaggtcagtggtggtaagacaaggtgtcttgtaaattaagattttaagaagtgcattaaaatgttttagaattactctgggaattctgtatatcacactaaaatttttatatcattatgttaataaaagttattgactttgtaattctgcattttgaaatgtgtgaaaagggtctttaaattaccccgaataggttgtatcttattttgctttttttctgactataaaagcagttatgcttatagcataaaatctagaaagcacattaaagtataaagaaaattaaaatttcttataattctacctctgagtaaacagcagcattcgtatgtaacataaaccctctcagggatttattttttctttttaaaaattttttacaaaattaggatcaagtgcttttttaaataatttgcttttgtacttaataaattatagactttaaaatctattacatatattcttctacatgtttcagtggctgtattttacaagtgtgccatgagtaaatgtagtatttgctgtattgccgtacatcagcgttgtttcaacaggactgcagtgagcccagatgcacgtttacactgccatgattacaattactgccttgggctcagtt

SEQ ID NO: 12950 - DNA, 1199 bp, Homo sapiens
gtgggtaagtgctgggaggtgagtggagtgagcttgtcagggagctgctggtggagcctggaggggaaggagggaggcagtgagagagatcggggtggggggtggggggatgtcgccagagctcaggggtggggacagccttgtgcgcatcagtcctgaggcctggggcacctttcgtctgatgagcctctgcatggagagaggctgagggctaaacacagctggatgtcacctgagttcatttataggaagagagaaatgtcgaggtgaaacgtaaaagcatctggcaggaaggtgagtctgaagccctgcacccgcgttccgactatcagtggggagctgttagcacgtaggattcttcagagcagctgggctggagctcccctgagctcaggaagccccagggtgcaagggcaaggaaatgaggggtggtgggtcagtgaagatctgggcagaccttgtgtggggaaggggtgctgctgtgacttcagggtctgaggtccaaagacagcatttgaaaagaggctctgaagccagtgtttgaagaatttgttcctgaagtacctcctgggggtaggctagaggcttctggcttcagggtcctgaagaacacattgaggtgccgtctgacactggaatagggtgcccttcattcctatgcctgagtccttaactatatttccaacctccagtgaggaggagaagattcggaaatgtgacaggagagcaaacaggacagtttgcatgtgtgtgtgcgcacacatacatgtgcgtgaaagattatcaataaaagtgcataaatttgttgatctggtaagagtttctagcaggaaggtcgagccacttactgtaggtcaagaagttgctagttgcggagttttttcttgcagttagactttacctagtggtagcagggccaccaaagctctgtgtcccagatggtgtatggcccataatccacccaacagcagcaaaggaccaggcaaaggagaacaggagcagaagcctcccagccactagccttttgggctcagtctctccaataatcctggagaggggcttcgttgggtctggacacctaccatgcattctgtgacctttccctagcttccaataaataactgtttgacgcccagagtacaggataccacaatgcactcttcctgcgtagagcacatgttcccatctgctcccattcc

SEQ ID NO: 12951 - DNA, 1173 bp, Homo sapiens
ctgcctcccccatttcagaagtccctactgaaatgagaaggacactgaggcacacaggggaagagaatggcctgaggttagactgccacgaaaggcacgtgggaactgggcccagaaaattccaaccgttccatacaaaatgctacccagcagggaaaaagagtcactgtcttcttccaagtgaccagtaatgccacactcatggggcagcaagaagggtggcaagggaaccaagccctgacctgagcccagtgatcaggccagagcccagccaatgggactcgcccacaggtccaggctcaccccctcacctccaccgcactgccctcactccaaagcccagccctccttgcggaagaccagctgcacagcctcattcacgtcattcaccacgtgggaggcctccatgagccctggactgaagcataagtctcggtgcccgtggaatggaggctcccctcctccaaggacaggctccgtggactgtgggttcctgggattgtagacgcctgtacacaccaggatggagatgcagctctggcttgctgagggctgttgctgccgtgtgcccccggcccctagttctggcgccccatcatgcgttgccttctgcaggtactggtggaacaggttggcgccgtatacgtcagacatagggttatcactggcaggggcagccacaccggaaaaggaaaaaggagaaaaaaccctaaatcaatgttgcaaagcaaagggagcagagaagagtttcggggcagaagagtgaattagatatagggaaatgggggtgagagtagaggaggagggagagaaggggatgtcataaaagggacaaaggagggagagcagagcctaccccacagcatagagcttccggatgggggcggcccagccccgcctctccgcctgtcgcctgatcaggtcctcggcatactggtaagtgaggatgctgggtttgcccatcaggccctcgtatctcagctccttgcccgtcactttctggtaaatggtttccaggcacagcagaaaggtgccatgtccaaacctgccagaaacgagcacgcagcagttcagtcttcctgatctccaggctcttctagagaacacgactgccactgtctaagcagcaaacacacagaccagccttttccccagggtaagagctgacatgta

SEQ ID NO: 12952 - DNA, 1129 bp, Homo sapiens
gaagatttgtaaccctcttacataaaatacaacaaacacgatttttttttctttaaacattttccccctccttaaatacactcaaaggaattacagtgaccgaatggcagtagtacagatctgtgatctcgatccttaatcagaagttgaagaaaagagtttctctttactacctctttagcaaaagattaatgaaaatttatacagggattagaaacacatcaaacaagaaaaggtacctgtaatgttatttaagaaaagttgtgttaaatgggttggtagggttacaataaaggcatttagcaatatcctgcatatgtcacttgactgtctccagtctggaaattatcttcgtgtattaggcaggcaggacttgccgaagtgcagaatggtaaactgcttttcttaagaggtatgtaaaggccctgtttcttctgcttgttcccgctgctgtgagaggttggggctagtccccttgctcacttctgagttgttttcccagcagccactgcacggctcgaaggatttgtcgttgagggtggagaaggtggaaggatgttgaacagacttttccctaatgagctgtgatgccagctgcaaaggcggcaaatcctgttactcccttcagctactctctgaagctgcagaggggcagtggtaactggtctccctgccctatgctgattagctgccttttctgctgtttttccccccttcctcttctgtcccagagcatcttggcaaagttcagatttctgtgctcacagctcaatgctcacagtgaaaaggaaatacaaaagaggaggagagaaagtgagaagaaaagagagaaaaggttggggtggaggtttttagtagagtcccttattgccttagtctaagacttaagctctgggttgaaaccttaagtggtaaagctttgtaagtagtaacctggatttccaaatagttcttgcagatagttttattggcacatgaacacagcaggccatatattaaaagcatttgaatttctatcgtttagaaacctccgaattttgaaaaggacacttcgcagtttttccacaaactatcattgtgaggaagatgaaataattgtaagataaatgttttcatgtggcatttactg

SEQ ID NO: 12953 - DNA, 1044 bp, Homo sapiens
acgaatcgggcaacccacggttaaggacatttccattctccggcccactgtaagagtgaatgtagaggtgctaggttttacctttgtgtccgtgaaaggagtgaaaggaagtgtacagggaccccaatgtcctgccctctttcagggactcaaacaatttccaggtggggcttgaatcaccacacatccaccttaatctgactcaggcatgttcttcacattaatactgtcatttcagctactgagttattttttctcctcttttttttttttttttgcagcagagccgttgcctggccttgaagagaaaccaccaggtgttggtacttcagagggggtctacctcacacaactacctcaccccacacctcccctgcagactgactgcaccaggcagagctcaccacaagaaagggaaacagtgggcccggagctcaaaagcagctcctccgaatctgcggacaactgtaaagcaatgaagggcaagaatccctggccctcggatagcagctaccccggcccagccgcccaagggtgcgtgagagacctctccacggtggcagacaggggcgctctatccgagaacggagtcattggggaagcatctccttgtggatcggaggggaagggccttggtagcagtggttccgaaaagctgctctgccccagaggcagaacgttgcaggaaaccatgccatgcacgggacagaacgcagcgacaccgcccagcacagaccccggtttgacgggaggcactgtgagccagtttcccccgctgtatatgcctggcctagagtacccgaattcagctgcccattaccacatcagtccaggcctgcagggtgtgggccctgtgatgggagggaagtccccagcatcccatccccagcattttcccccaaggggctttcagtctaaccacccacattctggaggctttccccggtatcgccccccacaaggaatgaggtattcctaccacccaccgccacagccttcctaccaccactatcagcgaactccttactatgcctgtccacagag

SEQ ID NO: 12954 - DNA, 1994 bp, Homo sapiens
agtatatatagtttttattcgttttaagtgaatcatagtaaaatcagtcatggtgatttaaaatagctatcaagaacaagttcttggaattatctgttgtatctgtgataggaaaccattttacagtattaaattactttattacagttgtagagttgaattacactggattctccctcgttagcattctgtatttgattttagctgaaaggtcaccaaagttaggacccatgttttaaacttttgaatattccacaaaagaaaaaactaaggaaaatactgaaattacaggtctttgtaaagaatagcatatttttaagcatgcttttgggatagtagaagagtctctatgaaatattaatctgccctagtttcttataaattcagctgtgggaggggccagtagagtgtttccctccaattccaggattcctagtgaagcatggaactgtcgtgtttacagtttgctaaacatatgctgtccgtggaaaaggaagctaatcggaagcatccatgatacagagaaatgaaagccaagacaccagttccaggatgatggaagttcatatccgtacgcaaatgctgaacctggtgctgctgcctagggctcaggcagatttgagagttgagtagggaacacaggtgcctctaaggtataatgcacaaaaatacagattttctctcagagaggttttaattttaaatttgatgtatttgcaagtggattgagttttgagcctgtgttctcactggatcctaattcttgttagaaacctatcactggcataacctggtttagaagagtgaagaggacagaaggattgtggatgggtctgccctttagctagtatccgctaacatggggcattactacttcagtttctgtgtttgtgcagaagcagggaggaggtaaaaagctagtttggagctggttagacctggtctaggcccagagaatttggccactgacagcctttctcttttcctggtaatgctggtttgaatcagaggcctctcacttctccttaacaggagcactgacactgtgggcctctccccatgactaccccaggggcctgggtgggagtggctgtaagcagcagttgggccattgccccctttccttctgccctcgtggtccttgagcagttgtgtgcacactcttccaggtaatcctgtctcctctctctcccagtgaccgccccaatcagctgttgctagagcgatgctgtgaacgatacaggaaaagtcagtaaatccctttatccttaatctcccttcttggttttcgacagaaaatattaaggaagagcaataggaaatagaactactgtattataacactgtgaacaagaacatcagcagcagcagaattgtcagccttcctgcgtcctgtgtgggaatgtgtccatgccttataggtactagtgcttcgtccattgtccagggagtgtcctgagctttcactggtctttgaagtgcagatctgctataagctgtctggagctgcaaggttgcaggaatccacaggagcgtgagctgctgtgaacccctagcccacccatccccaagcaggatcttcttctcaccttttcttcctcctctagcacttctctttccaagtgtcttaagcagatgcaatgtcttaaagcagatgcaaatgcatttgccatcttctccattaggaaaatgatggttatgtgatatgttatatttaggaagtagtgtgtaaggtatcctgaaaaggtttgctctcaagctagaaggacatttcaccctgtgggtcactgtcaccttgtcagcgtgccggctctcagtggtccccaggaggatggggatagctgagatcgtggagaatgggaaataccattgcatctctttgatttaacactcatggctcacctttagtagagttgttaataagttagaaacttgtgtccctaaggcccaagagaaaagatgagcttcttgggaggattctgggtttgttttcc

SEQ ID NO: 12955 - DNA, 1635 bp, Homo sapiens
acaccaagcctcacgcactctccccttgggacagtagtgtttgggtgaatgttactgcatcccgttttttttcttttctttttttttttttttttttttttgagacgaaatcttgctcttgtcccccagactggagtgcaatggcacgatctcggctcactgcaacctccacctcccaggttcaagggattcgtctgcctcggcctcccaagtagctgggactacaagcgcgcaccaccactcccagctaatttttgtatttttagtagaggcggggtttcaccatgttggccaggctggtctcaaactcctgacctcaggtgatccacccgccttggcctcccaacatgctgggattacaggcgtgagccaacacaccggaccttcattttttaaattaagctgggacacaagttttgcctccaggctggatgttgatcctgctctgtgctagacagatgtgcggagggactgttccgggctcggcttgaccttttcctacctagtttctccctcttgtcctgcacaagaggactaactgaactctaacgtcagaacggctgacgagcagttgattgtccttgcttgtgttgttgacaggggtgggtggggtgggagcaggggtatggatattgcataagttattgaaatgctgacccccgttcaggaaaccatgcagccccttcccttcccttcccttcccttcctttcccttccctagccagggctcaggtacctcactctcctgccttgtgcgtagctcctggggccccggtcagtccccagcagccttggcacacagtgtctggagcctctgctcctgctgcaaaagcagaaaccatgtgaaccttctggccagtactggaaaggggaatgctatttatttttatattgtgtatattttgtcgtggtctgctgattccctgtttcactgagagcgacacttacctcaatagttagttcaatattgtgtgttggataattttttaaaagaactttttaaaaagctttttgatccttggaggtctgtagatttatttccatatgaactggttattttgtataaagtacatgcttaaaatagcaaggctcctctgtgtgtgtggtgtgtctgtccatgtgtcatttccatatcagggcaaacccagacttccatcaggacgaaggcgtgaactaggccacaaggccaccagctgaaatgccacccctcgtccattctcatgcatccagaatccacggaggcggggcacgggtcctgtgcatgagacagaggaatatggttccagagaacttcaaaacagtcatgtactgactggcagttctaaaccatgtcagggataaaacgctcctcacagccgatccttgcgaagctggcccggccgtcagcatctcactggtaaaggcgtccgctttcagaaggttactacacctgaggtgcacgacttctctccttgcaggctttagggtgcctgggatgggaaaggagtataacagtggggcagcggggcagctccagcctggagcccgctgtgcacacacatggccagaagtgggagctccagcctaagcaagcgggcaatcttatacctgccaaggtcatttatgttttatttccagttactgggagaacagttt

SEQ ID NO: 12956 - DNA, 1237 bp, Homo sapiens
ggtttccatagtcctcagcaaccctggagtgagttcgacgggaatgcaggcccagagaggagaggtcacagtcaggatgcaaactcagttctgcctgaccttcagtccgtttgtgtgagaactgcacacgtggctccaggcctgcggaggagccagaggacgggccggggaagcttggggcagagcggtgccctggtggcggcccatgggggcagagctgggctcctcccagaagcccctgcaggtcccagctccagggacttcccgggttgcagcaagatgcctcacccgggtgagtgcggctgtcctgtctggaccagacctgggccagggaggctgaagagggtctctggacacctgtggggctggggttccccactgtctgtgcccctgcccattcctggctgcatccgctccctaacctgcccctccctctgcctctctcctccccctgtcctccccctgtcctagcatcacagccaaactcatcaatggaggtgtagcagggctcgtgggggtgacctgcgtgttccccatcgacttggccaagactcgcctgcagaaccagcatgggaaagccatgtacaaaggaatgtaggtgctggcaggcgagcgtggagggcagaggcgcccgggggagggatggggcccccttccctccagtctccaggcagcgcgcgtgagcctgggggctggggatctgatcagctgggatgtgcccgcgggagcagggcatggaggcggctgggaggcccgctgcacacttactcctactctggcctctgcttccaggatcgactgcctgatgaagacggctcgggcggagggcttcttcggcatgtaccgaggtgggcttctcaggtcccctgggaggctgggcagcaggtgtgagcgtatgggacatggggaactggtgttccttccgttgctgcggggatggggccagggctgccagggggtccttcctgatgagcctctgtgctcttgggtggagacagaggcagctctgggtcctggtaaggcttccggagacccacagagcacaccccccgccaccgcctcagtaagagcaggcgagccctccctacctgcctgcctctctctgcctggctagaagcgaagagagagaggctgaaagggactgagggacggggcctgagctcctggcaaggagttctgggtggctcctccccagctcggtccagcgttgctgcggtccctgcggggtccccagcca

SEQ ID NO: 12957 - DNA, 1271 bp, Homo sapiens
aatgcagttctcataacagagagtgaggcccccagggctgaccatgttagcaccatcctcttccttgttagcccaggtttcacagtagatgggactattgtaaacaccagctcctgcagcaggtgctgattttcttaggacttggccctgctgctgtgacattatctctcctgtagcagcctttgggggaggaatcgaggtgcgtgaggagggctctcacagcaaactcagctcctcaagacgattcacttatgaagggatagaatcaaggcttaaaacccagtgtcactaacaagcagatatttccctatggctgtgttcctccacccccacaagtaacagtttgaagagtgacgggggtctgcttctatgccctttttaatgtttggttttgaaatggacgtagaaaagtagatggtgatagcattcactgcagcctatctgctgtacccactgatgaacagatgagattttagccattcacctttatttcagagtgttccttggttacagggaggggtgtgcaagaccctgggctctgggggaggggctgagctgcccagtcagagccggcctcagccccctcagccatccagggattcgaaagggtgcttggtctcaaactaggtgctgactctgagggctttcacggtcccttgaacttctgatcctccttttcctcaaaatcagtgctaggactcataagttatggagtccaagattaacaatgctaaatcctcaagctgactgaagaatgccgagtttgactgtgaaatagaaatgttaaaatacagaaacaacccttctattgtgactacctgttaaggtcctgcaattaatacaacgaaagtaccatttttgttgaaaagtaggtggttaggggcttccaaaagcccctggtagctgtgcccacaaaggaaaacgagtgtagacacgaaggggaagaaggctgtgctcaacttgttagaatatagggctgtttctcccgagattgaggtagcactacaacgcagaggaccaggcaggccagagtggccccacctgcccttgccccctctaggctaagtgaaacagctagagagagggcggcaagcgcagggacttgacctccagctctgtctagtcaaaacactttaagatgcgctctccaatcccaataaaatagaccccttgagcaatcccaaagagaggtgctatgaccagtgcccggcagccagcgcctttcatgaaggcagatggtccctcctgaatccagagtttcctggggagaa

SEQ ID NO: 12958 - DNA, 1421 bp, Homo sapiens
acttgcttcagggaaggagagggtggctttgatgtgcgtggctttgtgagtccttcccagccacatagaggttcatggctttccacctgtggttaagatgtgcagcactctggccaggcttggtggctcacgcctgtaatcccagcactgtgggaggccgaggcgggtggatcacgaggtcaggagatcgagaccatcccggctaacatggtgaaaccccgtctctactaaaaatacaaaaaaattagccaggcatggtggcaagcacctgtagtcccatctacttgggaggctgaggcaggagaatggcgtgagcttgcaatgagcggagatgcgccactgcactccagcctgggcgacagagcgagactccgtctcaaaaaaaaaaaaaaaaaaaagatgtgcagcgctctacaacttcttcagctgacattgcgtatttattacactttctctccacagatgatgccagaagtccggggagccttgtttggtgcaaatgccaacaggaagtttttggactaagccttcaggaggtggagctcgtcgtcagctctcctgctgtgatgtggaagcttctgatatttgaagaaacacgaatgtctctgtagcttcctcttcactgccccagtattgctctgtatttatcagcgatgcccctctgtcactcatgccttgcctaattgttcacaatggtggaaagcttcatgtaatatgatcaggacccacctccagttcttctgaaagtgtgacagtgtccagccggttctgcagcactaggggagggggcagatggtggttgcatgggcttcctgggtctccactctccgtctggcctaaaggtgatgtatttggtgtttggccctgcagtccccactcttgaggcttaaggcgcatgtggcacaccactccttccagcagtagtcgctttactgttacctgtttaggcctagaagttttccctcatctgtaaatgtgatttaaaatctaagccatgaatatgctttatttattaaaagagttatgcggatttaatgtgatttctagtgtaaggcactacaaatttaggttttgacagagtcaaattcttactgaggcacctagaaaagaagtattttcccaatccccgtggcacttgatggtgacagctgtcagcacctggacccgttaaccctctgggggtcccctgggctgttgcccgttgttcccagcccatcaccaggagcattctttccacccttgcaatcttccacacaccccacatggctcttcagcgtgacgtgcacaactttattgaggaaatagttttattagtgttgcccgaatgagaaaaaccaagttgtttgttttttctttttcttttttttttgagacggagtctcgctctgttgcccaggctggggtgcagtggtgccatctcg

SEQ ID NO: 12959 - DNA, 1087 bp, Homo sapiens
cctggcagtggccatcggggtagccctggctctgagaaagaaataggaggcttttcagaagagaaagacagaaggatgtaaggttggagttgtattggctggaatttgaacctccagcagctgtctggacatttgtggaacactctgggataattggggacttctgctcaacatggcagtggcatgttaggcatgttagggcttgaggtggggcattcacattcatctgactgtaaatcccaagggcctccgctcatgctaaattgagaatcttaggggtaaagcaccccctccaggaccgggtttctcagccttggcactagtgctgttctgaccattctctgtgttggggctgtcctgtgtgtggtgggctccacccactagatgccagtggcaccccctcccagagatgacaaacgaaaatgtctctagacattgccaaatgtcccgtgtgaacatcccctattgagacccactgctttagcgagagagggtttacttaggaagaattgggatagaaattcccagctgagagaacttagctgtgggctcctcagctactgacttcttagctcttaatccccttagaatttcatctttctcgatgagcaggctctgcacccactctttttttgccccccgccctcatcctggagtgtgagggtgctcgcccgtactctcagctgcctctcagggactgcactgttcctcttcacccccaggttcctgctaagatcccacgggcgagggcttgctctggactcagtctgtcaagtccccgaagcttcctgcagctccaccttgtaaaaatgctgcctttgggaatcttcgaaatatgtacacagagaaaatcacatgaaggagacctggggtccccacttgtgagtgcaactgcaagtaactctggctagagagacacatgtgtcttgtgtcaaggcaggaggataacctggatgaccttctgaggtctcttcagcccttttcgctagtggtcacccaccaccatggttacttgccagcaacatctctattgctggatggtccctgtctataaccttgggctagtatattttttccaatatgggac

SEQ ID NO: 12960 - DNA, 1459 bp, Homo sapiens
cagtggcacaatctcggctcactgcaagctccgcttcccgggctcacgccattctcctgcctcagcctcccaagtagctgggactacaggcgcccgccaccatacccggctgctttttttgtatttttagtagagacagggtctctactatgttagccaggatgggctcgatctcctgacctcgtgatccacccgccttggcctcccaaagtgctgggattacaggcgtgagccaccgtgcccggcccagagttagtttttctaacgtcctcaagcataggcgaggcaaggcaatgattttgccggtttttatcattttcctggcactgcaaagcagtattggcaggtcccctgcaaacagttgcgccagttgtttactgcataaggactgactggggacaaattccgacgtgcagcctgtgctctgctcaccatgctgtgggctctgggagaagcgaagtatttttctaatttgtacaaaggcaccatataggctcacttaaacattaagcatgttctactacaaaaaaacaagagtgagggttaggtccaggactggtctcagcttccaattatgtagctgttttccctgtagacattgagtgagatgctttgtggttacagaattcacagtcattgccgatgagctttcattagctttcttgattaaatatttttgcttgtagacaaggttaggcaatctgtcccagcagttatcacaaagtgctaaatgaggggggtgaagacagcaccacgatgcatttcttggtctttttctgtttgttcgagttcgtcccttctcccctgtgtatgccatcataagggtggggctgtggagtgaagtaggggaatacctggaagcattgcttggcctctggacagacaaagaggttggggacttaggagggttgaccaggtatggccacaagtacgtcagctcctggaggatcttcccagtgaaaagcctcctactacattccacagcacttcatggtaattataaccttggctagataatacctgctgtatggtacagaatagtgacattcaattacctcatatataaagagagctccatggagagctggaaagtgcatgccactacaatattaacacatcccatcttccctttctttttgcaaggctgttgaatttcagcccggcatccccacacactaacaccatcaggtcttccacatttgatggttacaccacaggagcccacaccagactgctgcttccctgtgagctcagagtgaaattgttctcaggggtatttgcaaggccttgtcatcagttaaagactagcagctgactccaggtgattctaccccgctgtcacctctccaaaggggaaattgaatagtggtattgctcactgtggtgagtgttctttgcaccaccagaagaaactggttaatgaatgtactatttagaagaaaagttttgacatttaaag

SEQ ID NO: 12961 - DNA, 1169 bp, Homo sapiens
tgaatacccacctcaccgcctgaacggcctgtttttgcagttgcccccatgtagcaaaaagtaggatgcacggataggacttcaggggtctggagaacatgtttttgcataaaccccagctttgctctactgtggcacagagctctggagcctggtttgtgaatgagcctagctgattctggctttttctcctttcttgctctaggggatggactgaacggacagttccagaagtgtgactggctaaagctcgatgtggtcacagctgtatagctgcttccagtgtagacggagccctggcatgtcaacagcgttcctagagaagacaggctggaagatagctgtgacttctattttaaagacaatgttaaacttataacccactttaaaatatctacattaatatacttgaatgaaaatgtccatttacacgtatttgaatggccttcatatcatccacacatgaatctgcacatctgtaaatctacacacggtgcctttatttccactgtgcaggttcccacttaaaaattaaattggaaagcaggtttcaaggaagtagaaacaaaatacaatttttttggtaaaaaaaaattactgtttattaaagtacaaccatagaggatggtcttacagcaggcagtatcctgtttgaggaaagcaagaatcagagaaggaacataccccttacaaatgaaaaattccactcaaaatagggactatctatcttaatactaaggaaccaacaatcttcctgtttaaaaaaccacatggcacagagattctgaactaaagtgctgcactcaaatgatgggaagtccggccccagtacacaggggcttgactttttcaacttcgtttcctttgttggagtcaaaaagaaccacttgtggttctaaaaggtgtgaaggtgatttaagggcccaggtcagccactgtttgtttacaaaatcaggtaactaactgcatacactttttctctttccatgacatcaagactttgctaaagacatgaagccacgggtgccagaagctactgcgatgccccgggagttagccccctggtaatagctgtaaacttccaatttctagccatacgctcagctcatccatgcctcagaagtgcatctggagagaacaggtttctaagcataaaagatgaaagagca

SEQ ID NO: 12962 - DNA, 1600 bp, Homo sapiens
acccggtgcctgcctcaccctggcgctagaccatctggaccactcatgtgatgagggtgcatttccgttctgttttgggccaggccaacagcagagctgccactctcaccctcccagtgagaattccggctctgcagaactcgcccttgtctcagtttgggggccagggcatcaccttcctccgcacatatgttaaagaaggtttcaggatgggccctcatccacacaggccaagagggtgcaaggtgggaccctggaatcatgtggctggtgagaattccctcctcccagcctaagattcacccagacggaaacgcgagtgctgcagtggatgctgggatgcaggctggtgcctctcaagcagatcagcgactcccgcccttccttccgaaggcgacgggcacctgccttgtgccggatcttcatggggacataaagggcgagccccgaatcactagctcctatagccaaactgttcctttctcacggttccgcaccagcctggctgtgtacagctcatcaagccactgagctaatcggggtggggtgcttgtccatcaaagcagtcagcacatagcccagcgaggagccatccggaccagacccgcctgccaggggcgctccagccgcctgccgcctccgtgggctggggccagctgggagcagaggcctggcccctccaaggcgtcccgcagtggagcaggctgagtggctgtgctgaccttgggctttccatgggaaccacactgtgcttcaacttgaacattcatcccagctgcaaaggagcaaagaacctgtgtcatccttgtctgtccagaagctgccatctctctcccatgcacatccgggagataacgccgctagtggccgccacagcgctgattctccacctgttctcacgtgaggcaaaggtctccttttcttttctctttacttaaaaaaggggagaggagggtttctagattccatcttcaaaccccagtcgtcccataaaattggacgtgggaaaagaccttcactgcctgcgtggcctttcccagacctctcctcgaatgccacaaaaccggtccagccccggcagagccgccttcggcccttgtagctcctgctggccccacaacagggaaacagtttgcaaagtggcttggaaggagtgtggcctagggatctgctgtaagtggccagacgtagcaggagagcccagtgtcaccttctggtcctggtcagccttaacactgtggcatcctccacagcacacacggcagcctgcagtctggaaggtggacccgagcctttgcagagaggcgccgcagagccgcaggcctgcgccccagccttctgctcccgactgtgaggacacccagttctagtagagcactttttttaaagctcccattttgtaaccactagtttgcggttgacttgagtactctggtgacttcctgcgtcaagcgttctcaagctgtgagaatgtgcgcagctccaggcaggttttctctcggagagttaagtcttcccttgaaggcagggaagcaggatggatacacatatatcacacgcataaaacaccaggtgcgggagcagcccagactcaaggctg

SEQ ID NO: 12963 - DNA, 1195 bp, Homo sapiens
ccgcagccccagccacccgtggcggcctccacgcccccacccagcccactccccatctgctcccagccccagccttccaccgaggccactgtcccatcccctacccagtcccccatacgcttccagcctgccccggccaaaacatccaccccactggcccctctccctgtccaaagccaaagtgacaccaaggacagactgggcagcccccttgctgtggatgaggccctcagacggagcgacctggtggaggagttctggatgaagagtgcggagatccgccgcagcctcgggctcacacctgtggaccgcagcaaggggcccgagcccagcttccccacgcctgccttcaggccagtgtccctcaaatcctattccgttgaaaagtccccccaggatgagggactccaccttctcaagcctctgtccatccccaaaaggctgggcctgccaaagccggaaggcgagccgttgtccctgccaaccccccggtccccgtccgacagagagctacgcagcgcccaggaggagcgcagggagctgtccagcagctctggcctgggcctgcacgggagctcctccaacatgaagacactgggcagccagagcttcaacacctcggactccgccatgctcacgcccccctccagcccgcccccaccgccacccccgggcgaggagcccgccaccttgcggaggaagctcagggaggccgagcccaatgcctcggtggtcccgccgcccttgcccgccacctggatgcggcccccccgggagcctgctcagccccccagagaggaggtgcggaagtcgtttgtggagagcgtggaggagattccctttgctgatgatgtggaggacacctatgacgacaagactgaggactcaagcctgcaggagaaattcttcacgcccccgtcctgctggccgcgccccgagaagcctcgccacccgcccctggccaaggagaacgggaggctgcctgctctggaggggacgctgcagccacagaagagggggctgcccttggtgtccgcggaagccaaggagttggccgaggagcgcatgcgagccagggagaagtccgtgaagagccaggcgctgcgggacgccatggccaggcagctgagcaggatgcagcagatggagctggcctcaggcgcccccaggccccgcaaggcgtcctcagcaccct

SEQ ID NO: 12964 - DNA, 1173 bp, Homo sapiens
agtaacatgatgaaaccccgtctctacaaaaaatatgaaaattatccggacctgcctgtaatcccaactactcaggaggctgaggcaggagaaccacttgaaccagggaggcagaagttacagtgagccaggatcatgccattgcaatccagcctgtgagacagagcaagaccctgtctcaaaaaaaaaaaaaaaaaaaaaaaagcatctaggggaaggagctataaatgttgtcttacttccctgggtggccgtaggacacaggacgggaagtgcgtggtgtttttctctgtcttccctacagcaccaagcacagaattgggtgcctttccagccgtcggtccttccttgctgagatgttagactggaagatgagaaatggcatcattttaaggcattaaccgttccagccaaggaactctcatttcacaagttcagtgaactcttaactttggcctctgctgcaggggacagcagcgtgatgtttcagaacctgactttggagtcaaacaaagcctggatttgaagcccagttctgccacctgctagctgttggcaatttacttaacctctccctgcttcagtttcctcatctgcaaaggtgctgcacttcataggtttgttttgaggattaagtcgtataaagcacggacgaagccttgatgcccggagttactgctcctgttactctcctggtacagcacaggtctccctcaccacagggccaggggcagggccaggcagccttgtattggtttccttaaacggggttgatgccgggacttgggtttggctcaagctcaccctgtccgagaatgttggtaaccaagctttcccatgccagagtcacccagggcttgtgatgaaagcacaacacgttgggctgagtttctgattcagcgcctctggggtaaagccccagaatttttagttctcaaaagttcccaggtgatgctgtggtccaaagaccacaatttgagaaacaccactttaatgtttctaaatttctctgataataaacatcacctgggatgcttggctaaaaatataattgcagccaggcatggtggctcacacccgtaatcccagcactgtgggaggccaaggcaggaggattgcttgtgtctaggagttcaagatcagactctgcaacagagcaagatccagtctcta

SEQ ID NO: 12965 - DNA, 1988 bp, Homo sapiens
taagaggaagaatgttctacatagtggggagagaggatgagggttggcagtgtggttaaagagcaaaaccaccaagaaagagtcagagccctgaggacgtctctgtccgcgtggttcttgattctgagccagaaggtgacttggtatagcacgggagttcaaaatgtggtgtcccaaaggaatcacagtgtggacctttacagttaatgacaggcactgtcccccagcttgggtggcaaaggccagtgagctcagggctgaggggcttaccctccggcagctcagagtccagaacatcttagtccggcagctcagaatcagggcaccttgcctcccggtgagctcactctgctgctagccttggtagaaaaggaacaggattatgggcagtattttatggctggcatgaaatagatacccttttctcctttgatagagatttccttctttaaatatgaaactgaagctttgaggacttaactagacttccttttgaaaagtttcagaaaagctcaggtgtggccaggcacgatggctcatgcctgtaatcccagcactttgggaggccgaggcgggcagatcacgaggtcaggagatcgagaccatcctggctaacacagtgaaaccccgtctctactaaaaatacaaaaaaattagccgggtgtggtgtggtggcggatgcctgtagtcccagctactcgggaggctgaggcaggagaatggcgtgaacccaggaggcagaggttgcagtaagtcgagatcacaccactgcactccagcctgatgacagagcaagactccatctaaaaaaaaaaaagaagaaaagggaaagctcaggtgtttcagggtcccagaatgtatgttgtagagaacagtcattagctcaggcccatggtaaccgcctctactgtgcactcgaccagtagaggcgatgatgacggcacttgattctcttgtgtgtaactcagccatcctccctagacccacgtcccaggaggcagggctggtaaagctatgactgggcagtgtttgacccagctgtgcttttactctgtgcctcctctttatattgtggcatttctctcttctcctttatgttctttttctttttatgccaaaattcttgctgttgccaaaacaaaaacaaaaaaacacacccacacccaattacaacctgcagttcaaagaaccactctaggtcggctttaaagtattgtctttctctggtaaccaaatctgtacctgctgcctaatttagtgtttgggggcattgtttacagtatttctgtttgtaatgtgcttttaatatagaaatcctcttttttgttcttaaatctatgaatgctgtgtttccaagcttatacttactactgcgtgttagtggtcctggcacagattttcttaccctggccttgtactgtccaccatgactttagaaaaagcttgaacaataggcagagaaaggaaatccccaaaagggattattttccccttggacatgagaagtttagttacaggtttcttgaattcgtttttgtccagaggaatcctctttttatctgatacggttgatgaccaaaaatgaagtagggaagccgaaggcatagccggaaaggaacagaagagctttttccccgagtgctcatcaccgggttcattaccggccagagatggacggggagaagcacgttagtttcctgtcatcttatggaaaagatgatctgaagttaaaaaatgaaggtcacaagtggcagttgcctgacccctgtccccagacattccttgcccgataaccatgaggttccatagttcggatcctgaatgggcctttaggaaatgcaggcctttcccacaccagctagaagggtagccaggcagtagaatttcattcaaccctagggttcccacctgacagagggaagttcggaagtcttactgcttcccacgtccccttcccttctaggcatttatggaaagctttttagtgg

SEQ ID NO: 12966 - DNA, 2937 bp, Homo sapiens
aacatgcatagctttggatcactgtcttctcctttataaatggcagaagagtgacaaaattcattcagaccgcacatgttagaggcagggaatgaagaaggtactgtgggccatggccacacctgatgcgtttttggtgggcttacttggtgcagtgtgctgtccagagagacctgctgacccagtctgggacaggcacagtgggagctgccacagtgccccttgctggccgccctcaggagggggcctctggaccgtcagtgtggcgtaggcagtgggtctgcttcagggaggcagcctcttgactttgtcacaacggttgcactgaagatggcccccacaagcccagttgtgaatatcaaggtgaccctgcccctggctgggagctcccctggggctctggaacctgaagccctgagaaggagagcttggaaggaggttgagctcttcactgtgtctttccatctgggctctgcagcccagctctgtggcaggaggcctgaccccaccccatcagtccctctcccagcattgctgtgcatggctccctcaggaagaagctctggagtggggccgaggccccagatgctctgctggggtctggggactgagctgcctcctgtctctccactctggagccctgggctcttgcctcctgttgaattgcccctgggcctgcccccggccccatttgtgccataaagggttgcttcattgcaggaggggtggctgaaaccaccatcctgggctgcatctatctccttaaagtccactccttacatcaccgccactactgcagctcagtgcccagcggccgcatgcacacctcccggcccctcctcagcagcgcaggggctgggggcccttcctggcacccttttgcctgacggaccctgttgcctgctcctgggcagtggttttgttgcctgacacagggcctttaacatttctgaggtttggagattaagcgggttctgtgcgatttttagcacatccatatcttttctacgttgaatgtctggatctttcctttgtatgtttgtgtctctgtgtgtgtatgtggccaagcgtctgcaggtgagggtggcacatggaacttcacgggtcactgggggcccactcttccagggtcatcgatgcatcctgggctgtgctgaggcagtgctgtctcgctcagtctttccagaccagcggggcagcacctgggaggcctgtctgaagcatgcagttctgtggtgctgctcggggatggactccatgcacagtccacttcttgacacattctcacactgtggctggagacccattttttccatcccatgtggaatgagaatcttgagttgcccacagacagacttgacctttgtgccagaactgtccagagctgtgagttttgttactgaattgcctgtccctgagcttggcctgctggagcatgatgctggaggctgtgtgcgggcaggcttgtgctccccttggagaagggctgctacttaacaaggaagtcctggccacaggagtcccctactggctgcagaggacgaagcaggaagcatgccgtggatcccacatgcactggggcagggcagccaggttccagagcagcaggcatgtgcattatgggtgccaggtggccagtgagggcccgaggaccacgcagcagagtcccccacgggcctgagcctgagagctcagaggattcctgccaggcctcagaactgtgtgtgcgggacagggtggctggcacgagatgtgtgggactgggacgcttcctttggggaccagaggaacattaggggccggtcagacacgtagggggcagtgaggaaacggggtaaagtggaccatgcaggctgcagagggtgggccttgggctggccggggttgctgggtggccccttccccatgggcctccacaagcactcaggccactggcacgttgggccaggcagaaggtccacatggcagggctgcctggaacaccgctgccactgtggctccaggaggcccttgggagcatgaggagagctggactcgctcatctgttcttgcaccaccatccagaatgccccctttgcaaggcctgctgcagtccccagtctgaccagcaagtcccggggtcacccttgctgaaccttgtgctccaggggtcctcctcctctaggaccagcttgccacggtttctcagagcccaggtgccctctgacctgccatgcggaggtgggatttgatactgtacattgtcttgatgcctgtttttttatgttttcattaagggtttttagtttttggttgggttgacactaacttttcttaagatgctgtgagaatcatttcatccaaatgccaaataaacttgtgttccggaagaggcatggttagtccttggtgtggcccccacggctgccacaggctaaggtggaagaggctgggtacccacctttcagcagaatgcacctagggtttgcagcccttgcaggcgtccatcaaaccccctgaggaccaggcagagctgagcctggagcccctaggtggagtgtgcagggagagcagcagccctgagctgcctacagctatcctgcagcacccagccctgcttggggcatcggctgctgccttggcaggtgttgctgacgtgcacaggatccacataaaggcaaggctgcttgacaccatctgggagctagcatgggacggggtggtagggcagggcttggaacctggccgtcagcgccatttcctctaagctcccctcatcatccgggtggctggaaacagcccctccctccagtccaagccacctaatgttacaaagtagcctaggtcctctggggcctcttcactcatgtccagcagtgccatctctaggtctcagagggtagtgggcccaggaagtgtgattgcatgccctgctctgggggcactccagatgtgtat

SEQ ID NO: 12967 - DNA, 1203 bp, Homo sapiens
gtatatattcccgcggcggcggcgccccggccgggccgggcatggcggcagcggctgggggcgcggcgagccgccggggtgccgggcggccctgccccttctccatcgagcacatcctctccagcctgcccgagcggagcctcccggcccgggccgcctgcccaccgcagcccgccggtcgccagagccccgcgaagccagaggagcccggggcgcccgaggctgcgccctgcgcctgctgctgctgctgcggcccccgcgcggcgccctgcgggcccccagaggcggccgccgggctgggtgagtgggcgcggagcggggcgcggggcccggcggagcccggggcgcggcgcagtgggtgccgagcttggccccagccccgcgcctcaccgcgccctcgctccgcaggcgctcgtctggcgtggccgctgaggctgggaccggcggtgcccttgtctctgggtgcgccagccggaggttccggggcgctcccgggcgcggtcggcccgggttcgcagcggcgcacgaggcgccaccgcaccatcttcagcgaagagcagctgcaggcgctcgaggcgcttttcgtgcagaaccagtatcctgacgtgagtacgcgcgagcgcctggccggccgcatccgccttcgcgaggagcgcgtggaggtgagtgccccgcccagcctttccccggagcgcgcgggccgcggctacactggactggggtcctggcgggcgggcgccctttgcaaagacggcctcggcccaagccccgccctggcgcgccggagggaggaggtccctggacggcgctgggcgtccgggggtatgaggagcgggtgagagcagggaggtgccgcgggaaaggaaccggagggctacttttcttttcttttgttttacactttcctctggtgacgaaagaggcccgcgttcacgtccagaatttgggaaattcagaagagcccgcaacccaagaaggggcgtcctggtcgccgccagctggaggctggggcgggtactaagggggttcccatctcgcgtccagacccaccgagtctgtccgcagcgaataagggcaggtggcgcgcagccgcggcccgggtgtcggctctacagcgccgtccgcccacatccctgttgcgaagctcccctctcggtccctgtgggaccctcgggagccggtgggacgcaggacctggggcta

SEQ ID NO: 12968 - DNA, 1368 bp, Homo sapiens
tcactgccccccaggtgcatccttgccctggggcttgacctcaaacccctggcaaacatcagcatgagggaacagcccctcctgaatggccagccacctgaccctcagccttgttctactctcatcctgccctggatggtcagggaactgctcagtcactataaggtcagcagtggctgtgcccacggatggaggagcagaccctgcattggcctcatcctcctttatccccacactgtgttgctcccattccacctgccacttcatcctgcacatttgccccacagctctctcacagtttctcacctgcagaggaattgttctttccttctcccgtgagcagacacaaggttctctgccaggccaggaaagtccccacaatctaggtctcttcactgacacttgcactcagctgtcactctgtgtccacagggtctgcggaagagggagctgctgaaggagctgctaccagtcatcgggcagaacctccgattccagcgcctcttcaccgagtgtcaggaacagctcgacatcctgagggacaagtagcctgccccagcctgccctggctgcagcaagggcagggccacactctcgccgctgatgacatgcaggaccgcctctcacctgaccaggctgtagggggaggagacactggcaggagatgtgctgtcctgcaccagcgccagcccagctccctgggcagatgtgccctgtgtcctgggtctgacattgcctcaggagggggaagctcatccctccctccaagcccccgatgcggagctagggctggagctctgcccaggtgccctggggccagcaaggcagtcccaggcctgccgtctccagcacggccccaaggtggacactagcccctgctgctgcaggcaccatgctgcttcagcagtgacgattgagccatttgtgagagagaatccggaagcgttaggtattacagcagactgacctaagacctatgtaaaaggaaagctgttccaacacacggactatttttgtactagaatttgctaacttgtaatattgaatttcctttggccgataatcaggatttccctataagtcacttggacattggtcacttgtaggaaatttaaactctaattatgacagctacactgaaaaataattgtactgaaattaacttgtctatcttcatttggttttaatttttaaatgtttgtaaaaagagactgttttgggggaatggggcaaaggggtgggcgatttcttttgtaagtgtaaaataaatgaacacgcattgaataccaaaccctcctgatttctcttgccttttccttctaactttcatcctccccacacagtgcatctctctcctgaagtagatgg

SEQ ID NO: 12969 - DNA, 1273 bp, Homo sapiens
gctgctggggctgccattaccaccacatgttctggtgctcttcaggactcctctcaggtgtcctggctggaagccacctccacctccacacacagccctgggcagcctcaggcttggtgtctgtgggaatgtgtggtcataatctatctcccaaccatcctgctagctttgtcttctcagtgtctggcacagtcaatcatcagagttgtttgagctcttggaatggaagcttgtaagcatgtggttatccaaaacacaattctggagtaaataatcctttatacccagagccctcctggtcacttggcccagcatagtatctaggcctctcctgccatggtgccgtcacacacactgctgcctctctgcatacccttgtacctcagctcaggtgcgtgtcctcgagcagccttcttggaccctgcttgcgggtcacttcccactggctacacactgctctgagcccaggttggtcctcacagggcaccagagagcaggcgtcagcccttcctaccataggtccttctgggccacagtgcagaggaatgaagcagggaagccaaagggtaggaacccatagggtttgttcttattgctggtgtgaacggaggcaggggccctccagtggtcagcagcgttcagacgtgctcttgcactcagaggtgttctgacttaggttccctcctgggtgccctgcttctcagcacagaactctcccaaactcctccagcccttcccctaggcatcttgccctccaagcactgcttgggactgtcatttctgggtctgtgaagggggcagtcagccctcggcccagctcacccacttgagtggccacacaagcacagactgtttggtggttctgcctattttaccacagggaaaatctgttggtcagctccccacacacgcgtgtggctgagcccatttggtgccagacactgaattaggtgcttttcatacatgctgtgccataaacacccctgccagtttagtctcagttgagcagaccaagtctcaccaccacaggaactggagagcccctttgggggttttctaaacattccctccaagcactgacatggtctctaatcttgccaaacactgccatctttgaagattcttcaagtaggaggctagaaacccaagtctcactcccagctcggtcctttgcagtgtgcttttgggcacgttactcccttgtgagatgaagtggcagggttgggagactttggggtctttaaccctggcactgcttctcttctctggctgt

SEQ ID NO: 12970 - DNA, 1184 bp, Homo sapiens
gaatagaagatgaaagttgtgtgatgagcacttggagcataatgctaagaatgtgacactgtcacagggagatatgggaggggccgctcaggatggaggatgcctgactaagggtaaaagcagaccatggcttcaggaccccaggtgcaggcttatctcatgagactcattgtcaaagtgggaaaggtgagtggctggagtggtttggggtagaggtgctgtatttaagttgtggagatagggcagtgtgactagagaaaagggttgtaagaaccatgttctaggcctcattctacccgcaaaagctctcagaacagtgcaaagggggaaatgtgaatgcatttgctcacaaccttctaggtgtccataattttgacacatgaaaattttaaagaaatgggagtagtagattgtatcttgacattttttgtgtttatggaagtttgatatttgtgccttttttagtaggctccaaataatgcaaatactagacctccagatcctttcaggattgcgcttgacatgcctcccctcttcttcaccccagtatgaatgctacctctactcctgctgcattgtcaccttctgtgttaacgaccccgtccaagatcgaacccatgaaagcgtttgactcccggttcacagagcggtccaaagccacaccaggtgctcctgccctgaccagcatgactccgacagctgtggaaaggtaggtggtagctgcaggaccctgaaggaccaggcagggtgcaggcatgggtcaacagcacagtggcagtgttcccaccaagcaacctgccttcctgttggggaaaagactctagccactcaatacatgggagcaagactgcagagcccttagtgagccaccaggagaaagaggtggttccttgaagtgggaaggtggctggaaggagtcatgggggaggacgcggcaaaagaaccacaaggtcaaaggcacaaggattggtcagtgcagaggctgaactgagaataatggtgtttggatggagcccagagtttgcacggaagagagcatgagattagttggagaggtggaagactctgatattgatacatcatggaagtgacggccttccactcagaaactgaccagaggtagagagctgcaataaaaatgatgtaagtgaggtctttgtcaagtcagattggcttctgagctc

SEQ ID NO: 12971 - DNA, 2276 bp, Homo sapiens
agaagctgcagcagcacctatgggagcccaccatcccgtgaggaagtgtgtttcttccctgcccattgtcctgcagttcagggccagccagcagggtagccaggcacttgtgcacaagtggaaaggcctaccatagttgtgggaacgtggagtcagagtgtatgccagcaattgagtgactcgatagagaatatgcacagtgcatgctatgcagtcatccagaagagacttttacaggatatttaatgacatacttattgtgtgttaaatgaaaaaacagacacaactatgaagaataaaataaattcttactttgaagaataaaataaatatttgcacaaaatagaagataataattcatcaaagtattaatagtcggtaactaggcccagattaagggcccaggtgtgtatttctgtactacctacacatagtgtagaatgagccttggataaatgtgtaccagagtcccttgggcccagggaagatgtgttgtgttctctctcagggtgcctcatcccctgtctaggctttggcatcgtgtctcctgctccatagaccctctcagaggtccaccctggggctgtccctctcctccgaccatagcccttcagaaacccactcccactctgccttctctgttgctagttatctgtgtataaagctatttcccctgtcagaccacagcaagccctggaggcagggtccactctaggtagcatgcacatttttggcaggctttggttcccacagtttgggatctctgcagctgcagtttgaatagagttgaagatgccttaaatatcagcagccactttgacccaggcttctaggttggttatgttaactgagctgaatacagaaggggatttcagtaatttcattaaccttgactgtgtctttccttccagctcacatgtctgaaacggccgctggtggtcatccatgaactgtttgacaaatccatcatggatatttcctggtaaggtggattctacttacaggaataggttaagaaaggagaagccacacattggaacatgaggccttctgggtgtgactagggtcaggtggccagtggcccctccccaggtgtcatagtagcgcagaccaagagtgctgtttgcacgtgatttgggaactggcagcggtgtacctgctgctgcgagaatgtcctgcctgtgtagaatttgccactggaaaatgccttttcaggatttgtctaagacgaggagaatgacgtgatcctagtatgttccactttactccgtcagtgcatgaaccaaagtcagaagcacactttctgcttctcagtgacctgatttatatgtatactttgtcaagttttttttattttaatagtttcaaaagtaagataagtaaaattgaaaattcttacagaacatatggtaaaggagatattttgtacacctgcttagagctaaagaacaccagggccctttgggatacaattgtcgccccctcccccccccgcccaggccaaagaagggaaccaggccacagaagggaaccaggagtttccagcatctccctagaacactgcccaccatcctcacaggccagctactgcggcacatgtgtctgcctggggctcttgctaccaggctgctgatggccatgtctttcaggactctgaatgggctgggcatcttggtatgctctatggacggctctgtggcattcctcgacttctcccaggatgagcttggcgatcccctgagcgaggaggagaaggtaggctgacggctcttgtgctgctgggtgctctgtggccattgccacaatagctctgagagacccctttgactacaccctcttcttgtgagatacacagacaagtcatttcttaacatgtaatggggtattcatcttttatatcttgtaatccttctttacaaaatagattaattaaaaaacgagtccccatttcagaaataagtcctggagttaagagtagaactattttaggcatctctttttgagctgataataggccatccactgggaggtttttgccctgggaaagagctgaagtgactcctcaggggcccctgctcatgtcactttcaccttcatggtagtaatattggtcatttcttagaacgcattgtctgccaggctctgggaatgtgttttgcacatatgatttcatttaaattgcacaaaacccttcaaggcaaggctcatccatttcgtggatatggaaactaagcctcagaaaatagcatggctctttgcccagactgtatgtgacc

SEQ ID NO: 12972 - DNA, 1606 bp, Homo sapiens
aaagagattcatgcttaagaaaaatggtaactgagtgctagcatggcatgccacagatcaggagggtaatggatgggcagctgttgttggggaccctgatgctcctaaacctgctgtgtgcacccccaccactgggctctgggctcagctcagtcaccatctcctctgtgaaacccttgagcagatacgggctaacacaaacccagttttgcaaaagattgatttttcttattcattgtgtttaaagtcacaacagatggcataacctggcacagtgctgcagtttataactagtaaaattcttctcatatttcagctctgtatttgaagtatgctttccttatggatccaggtcattttaactctttgaaagccaccagcatgtgtggaaacactcagtctggctatggagagggaagctttagagaccggagtagcatttggattacagatctatatggggtaccgtcgtacacacctttgtcttcagccataacttataaaagactcagccacagtcaggccctttgagctagtaggcctcctccttatcagggagctaccagggaggctaacgtcagaagtgctggtgtcacagcccaggaagggcagccataggcagggccgctagatacagataagacctggatcagaactagccccttggtgcctgcctccttgatgctgtcatttcttcaattggcttttgccttggtggagatcaaatgaggaggcccttctgcttctgtctggtgtgggggctggccatggcagactgctgagtcccctctcttgcatatccatcccatggcccatggattgcaggtcatgtttccctcagacaacacctctccacattccttttttcttcacagaaattctagctactctgagaggtcattctggcttggtcaaagggttgacatgggaccctgttggtaaatacatagcttctcaagctgatgaccgcagcctaaaggtgtggaggacgctggactggcagttggagaccagcatcaccaagccttttgatgaggtaagtggggacagctcagggagctgagcccccgcagctgccccagcctcttcctgacttctgtgtacagagagggagctggccatgggccaggccacctggggaatgcacagagtccgggggcctgagcggattcaccaaggctctctggggtgggactctggccctaagagtcagataatacagaatccttcatttctgagacgctgtttaatttccaactttgaaataaaagggatttatagttttgttgttttttgctttgttttggcgacagagtttcgctcttgttgcccaggctagagtgcagtggcacgatctcagctcactgcaacctccgcctcctgggttcaagcgattctcctgcctcagcctcctgagtagctgggattacaggtgcccaccaccacacctagctaatttttgtatttttaacagagatgcggtttcgccatgttggccaggctggtctcgaactcctgacctcaggtgatctacccgcttcagcttcccaaagtgctgggattacaagcatgagtcactgcgcctggcccggatttataggtttaa

SEQ ID NO: 12973 - DNA, 1262 bp, Homo sapiens
tcctctggactcttcccacccttccaggatacccaggacatgtatttcttccccgtcttcctcccttctccctaacacactcctccctgcagctccccacagctgctctctcagactcttctctcctctccacccagcacccccaggctcactctcagcaggtgaatatgccccagactcacgaggtcaaccagagccattgagccctgaggtccaggagaagatatttaaaaattcctcaaattattatgacctattcagtagtttttcacagtagcttgtgagaaaaaaaatgatctccatctctgtgcgctaatatggaagaatcgccaaggtatagtaggtggaagcagctgtgctgcagagtggtgtgtaccataggccctgcctgtccatctgtgtttcagagggtgatgagaggggggaggtacaggggtcttgagggtgctcagagcctggggagtgactagagtctcatttgcacagcaatccctctgtgagagcgagcgggcacgagtccgggctgcacggaagcacatcctggtgtgggccccgaggcagagcccccctccagactggcatctccctctgccacaggagaaggacgagtgacaagcatccctgccattggcctgtgcagcttcctcagtctgtttcaagttgctgttgcacagccctggggactgtgaccagcctacacagtctggtgggtccctgtgagctcttgctcacaggaacatggagcaggacattgctagccctacttgcccacccctcacctgcatgcaggataccctgacactgcgatgttctgcaggacaattgcaccgctttagagcttccaggaggccaagcattatggcaggtacttgtgagcagccaggtcaggctgggcatggtagcataggagatggcggtcctgaggtctaggcttctcaggtaaactgaagggtagccctgacctgtgtggacacacaggtgggtcataatgaggtagctaaacagttgtgccactgtgaatgtctttcctagtccttgggaaactgcctgccacgtcccaggtttggtgagcattgtgagtgctcacactctgctccactcgctcagttccactgcacatgcaggcaggtgtgccgagcaggtagggcttgctggcccctctgcaccagcaggcttcacttcttaggctcccaggtcggcccctggagactctggtttttaagaaatgcacacagctacagaacacacaaccttgcataaag

SEQ ID NO: 12974 - DNA, 1169 bp, Homo sapiens
ccgcttgaacttcagcctggggcacaggatgtgttaccgggctcacggagtgactcagggaactagtgccgccccagggccccaaggtgggcggttcggtgattcagagagggcagctctgtgttaggacacactggggccagccaggaagggtggaaaagatagggaccagcgtgagcatagaggctaagggaccatgggagctccaagcgcgctcacagtggggaccaggtcctgggggctggggacaccagggaggtgaaatacccctccagcgggtagggagggtgggcagaggagggccagcggccaggcatttgggaggggctcctgctctttgggagaggtggggggccgtgcctggggatccaagttcccctctctccacctgtgctcacctctcctccgtccccaaccctgcacaggcaagatcgtggacgccgtgattcaggagcaccagccctccgtgctgctggagctgggggcctactgtggctactcagctgtgcgcatggcccgcctgctgtcaccaggggcgaggctcatcaccatcgagatcaaccccgactgtgccgccatcacccagcggatggtggatttcgctggcgtgaaggacaaggtgtgcatgcctgacccgttgtcagacctggaaaaagggccggctgtgggcagggagggcatgcgcactttgtcctccccaccaggtgttcacaccacgttcactgaaaacccactatcaccaggcccctcagtgcttcccagcctggggctgaggaaagacccccccagcagctcagtgagggtctcacagctctgggtaaactgccaaggtggcaccaggaggggcagggacagagtggggccttgtcatcccagaaccctaaagaaaactgatgaatgcttgtatgggtgtgtaaagatggcctcctgtctgtgtgggcgtgggcactgacaggcgctgttgtataggtgtgtagggatggcctcctgtctgtgaggacgtgggcactgacaggcgctgttccaggtcacccttgtggttggagcgtcccaggacatcatcccccagctgaagaagaagtatgatgtggacacactggacatggtcttcctcgaccactggaaggaccggtacctgccggacacgcttctcttggaggtgagcccca

SEQ ID NO: 12975 - DNA, 1169 bp, Homo sapiens; identical to SEQ ID NO: 12974

SEQ ID NO: 12976 - DNA, 1261 bp, Homo sapiens
ttggcttaaacagaattttagcatcagaactagctttctgggattggaggcaaaccatcaaggtggtccctctccagtctggacacgatgccagcaaggatgacgtcctgccacctcctggagttaccctggcctcctagggtccctttttctgatgaagtcttaattccctaaaagcgcctctttggacactgaggccctctctgcctttcctggcctccggcaacagttttttacaaagattttttgcagtcgagtccatatgtccacccattgatttttaaagcttttgtgatattttagcattttgaaagactttcacagtgagagtagaaggtagatttggaatcatgcattttagcaagtggacttgttgaaacaggaagcaagggccttcagtgtagcccattcttgatccagagctgttgcctgtgacagcggtttctctggatgtcaaaggcagctgcctggtgcccagcttgcttctcgactggtggcccctatgggtgggtgtgcgatggaaatgtgttcctgccggagtctgaggcaccagggtgtgctcaaaggctggccctggtggtggactggcacctgtgcagagtgccgtgtgcttgtggtgcgccatctgaagcaagagtccagcgttctgccgtgtctgtcccccaccatgccccctacaggcggtactgatggcgcttttttttttttttctgtcaggaaaacaatgttggcctgtgggccgcccacaacatatccttccctcactacctgtgtgaccaaggttggcttctgttgacctttaaaaaagaaaccctcaactcaaattgctataattagacacttgcttctgtcttgcctcctgtctgcagctgtgaatagtcatttgactgtgactgttgcccttagccagccagatgcgcctgtgaaccaaagcttcgtgcacatgtgttcccctaaaggttggggagcctcgctgtgtcttgctgttcccaggcaccaccacagcaggtgctgccatactcttgtggtctctgtgcgccccccccccccccccacccgtctgccaagcatgggtatgaatcgtgcacacagccatgcttcaaggccggggcaggggagcctgtgctgatgccatccagggcactgggctgtgcctggaaggcgagccttgattgtctgaacacataaagcaaactgtccagaagggaatggctgatgtctttattctgagggtgagaggctggcaccctgtggacccttg

SEQ ID NO: 12977 - DNA, 1139 bp, Homo sapiens
ccctgctcagaggtctttccagtccagatcgtccaagctgcgtccagtggctcctggaggagtcagtgggtactgtggcctggcgcctggtagctggccgtttggtgccaagtgaccttgtccttgctgtgggcgtggctgccccagcagcctttccaacacggttgggagccgagcctgtggcaaagaggcccatgccccttggttgcctgagggtccgtgctctaccgctctgcccaaatgggtgcagtcagatgaaggagacagaaggccagggccgatgtcaggtggaccagtcctttcttaggtcagcaattaccatgaaatgggtcttctgtgaatcctgactcttcagacccggcagggcatgtctcttccactgctcacagctcttaggaagtcttcgctctcccttccacagatgcacagaaattcaaaacaaagtttgaagaatgcaggaaagagatcgaagagagagaaaagaaaggtgacgtggtgccatgggttggggggcttctttgcagactcactctgcatctgactatacttccaggcgggtgctttttctgtctgccagataaacattccagggtgctgtggccgcctcacgtatccagagtgatgcagctccctggggacacaggtgcttcctggggagccctgagcacttgtcagtgttgctggcctcagtccaattgggcaggcattggagtccgggcactgcctggagctcaccagaaggtgctttatgatggtcctcggtttgtctctcagagggcttggtcacctctgccatgaggctggactgcagctgtggtggcaagtgaccagatgtcactgagcagcctgaccatggtctaggcagtgcttgagtgcatccacctggcttcctttcgtcactgaatttcaagaagacagactccaggaggcggcttggccaggcaggagtctgtcccgagggcgggcaagccgctgtgggtgggtgacggcacttgggaccagcctggcgagggccatgtgcttgaatgcaccgtgcttctgttttctcactgtgctgcttgtgtttttagcaggatcaggcaaaaatgatcatgccgaaaaagtggcggaaaagctagaagctctctcggtgaaggagg

SEQ ID NO: 12978 - DNA, 1193 bp, Homo sapiens
gaggctcctcctccctctggctgccctgagtggtgggcccctggggctgcatggctccaagggcagaaccccaggtgtctgcagtagccagctgtggcctccctcctgttgcagagcccctgcccctcagccgtggatgctcagggacagggccatgggtcactatgtggctcttatggctccttgaggcccagttcctgaggccacggtgccatgtgtggcccccgtgggtgctgactggcggctgcaggcggggtggcaggtgggcagtggtgagaatgccttctccctacaggttccaggccctgattccctgaccctgggggacgacagcatccgtagcctggactttgtgtccgagccgagcctggacctccctgactatgggccagggggcctgcatgcagcctacccgccatccccaccgctcagcgcctctgatgccttctcgggcgctttgcgctccctgagcctcaaggcctcgagccggcggggcggggatcatgtggccctgcagcccctgcgctctgagggggggccccccacgccccaccgtagcatttttgccccccatgcactgcccaaccgcaacggcagcctgtcctatgacagcctgctcaatcctggctcgcctggtggccacgcctgccctgcccacccagcagttggcgtggccggataccactcaccctacctgcatcctggggcaacgggcgacccgccacggcccctaccccgcagcttcagccccgtgctgggcccccgcccccgggagccctcgcctgtgcgctacgacaacctgtccaggaccatcatggcatccatccaggagcgcaaggacagggaggagcgtgagcgcctgctgcgctcccaggccgactcactcttcggcgactcaggcgtctatgacgctcccagctcctacagcctgcagcaggccagtgtgctgtccgagggcccccgaggtcccgcgctgcgctatggctccagagacgaccttgtggctgggcccggcttcggtggcgcccgcaaccctgccctgcagacgtcactgtcctcgctgtccagctccgtgagccgtgcaccgcggacgtcgtcctcctccctgcaggctgatcaggccagcagcaacgccccggggccccggcccagcagtggctcacacaggtcacctgcacgccagggcctgccct

SEQ ID NO: 12979 - DNA, 1139 bp, Homo sapiens
agcacagctgctccccaggcaggctctgcatccctcacctgctttccaggtgaaccctccaagcccagagggcagggactgcacggggccccacaactcggctgcactagtccacgtccgcgtcgtctctgtcttgctgcctcctccgtcctctgtccccgtgttcgtgtgttcaccgtgtgcatgtgtgtatgtgcttgttttgatgcagggaccaccctcagctgaagactcccccaagtaagcttaatgggcagtccccgggcctggcccggctgggacctgccaccggccccccagggccctctgccagccctacacggcacacgctggttaagaaggtgtccggcgtgggtgggaccacctacgagatctcggtgtgaggactgactgccacacatccgccatggtgccacggggaccaggaccccacagcgcaccccccctccccaccaacttctctgccccagggacccgaggccaccccagcctggtgtggacccatcggcgggagagagtgccacgcctccacagcttgccccaagcgctctgcctgcccgtccactcatctgcccatggggaagtcggctcactgggacaagggccactgggctggtctgtgtctgggcctgtcccatggctggggcagtgagggggcccagtcagcctctttggggcaccctctctcagccaggcttggcccactgccatcacccagcaccccagatcaccgccaggccagcccccaatggtccccttacggacaggtcccagagatggacagaggcacccagggcccccaccgtccttctgacacagcctgtgggctcccggaccgagtgtcccccgccaggctactcctaactaacgcgttgcctttcacggaccccgctggaagcttgtagcttggcaaggctgatgcttctgccctggcctgctctgggtggtggtggataggtggacagacggccagccagccagctgtggccgggggcccggctccatgtgtcccgtgtctgtgtgctgtgctgccgcgccgtgtctgatgtgtcagtgctccggccgccgctgtccctttcatcaaagccttaacctttgctttatgctcttgtgggaggcgacgggggggcaggcgggag

SEQ ID NO: 12980 - DNA, 1243 bp, Homo sapiens
ggagggcccaaaagacagcctcctgcagactcggccatccctgggtgagaaagcagcagcctggcccatggacaggatgtttcaacactggccctgtgccatccttccagggggcctgacctgtcagaatggtgggtaactgttgccaccttggtcagtgggcttgtgggggagctggcagcctcgtcccagtgggtgctgggctttattctagccttggctttgcaggtggcctgctacagctgcacgtctggacagtggtcatctgtctgcccactccctgctgggcacggtgagcctggcattgctgtgctggacaacaggatctatgtgttaggtggccgctcacacaaccgcggcagccgcacaggctacgtgcacatttacgatgtggagaaggactgctgggaggaagggccccagctggacaactccatctcaggcctggcggcctgtgtgctcaccctgccccgctccctgctccttgagccgccccgcgggacccctgaccgcagccaggccgacccggactttgcctctgaggtgatgagtgtgtctgactgggaggagtttgacaactccagtgaggactaggctccctgtgcctggcatcagagggaagggaggctggggctgcagggcagtgaaacccacgcagcctaggccagagcactttactccaggcagggcccctgcccctgttggccacagcttatgggccctgccctctttcttcacaccagccccttggccagcctgccgcaggcatctcagggccatgcagatcccaggctgtggattacgtcactgcaggaactgcttctgaaaggctttggccttcctcagtgagccctggaggggttggccttctctcctccctgcctagatcagtccttctccaaaaggacctgggagctggcagcctgggcaggggggctgaggcacgtggtagccctctttctgtgaatggggtggggctgtgggggcagctggggttggaggatgagagctcctgaggggcagaggagcagagatgcatcagctcgcctgggactggctctgtgataaaaagacccctcccgctgggttttcagaccccatgttgttggtcaatgaaataaagcatcttacagaaggtgttaactgtttttctgtagccacagcctcagttcctttccacagtgcacccaagctgcgtccccaggaagcgtggcttctggggtcagagctgccatctgggaga

SEQ ID NO: 12981 - DNA, 1202 bp, Homo sapiens
cccacatcatgagtttagtgtcagatattatttacaaacattttaaaagcagggtcagcaggcccggaggattgcatgtccagtgggagtgggggaggggtggaggccactgagggtgggtcagcggtccccagggttctgtggcttcttccagactggcttggaaaaaatgcttttattttcttggagttcccccatgcagatgttaactttaggagcaaaggaaagacaaaggctacatttcatttctgagtctatagatgtatccgctattgggaagaggttagaggtcaatgactaggacagtatgtcccatgagaatcgagggaggattcttgtctgtatgtgagtgggaagtggtgaagcctcacagcgttgtcaggcaggtgtggggtggtgattggccttgacagagtacccagccacccttcctcactgccctctcacgccatttctcctggtggctccacacaggtgtatgcccacgcaggcgcgacgctggaggggaagatgtatatcacctgcggccgcagaggggaggattacctgaaagagacacactgctacgatccaggcagcaacacttggcacacactggctgatgggcctgtgcggcgcgcctggcacggcatggcaaccctcctcaacaagctgtatgtgatcgggggcagcaacaacgatgccggatacaggagggacgtgcaccaggtgagtggggcccggggcagtccacacccgtcatcattcccaagcctctcagttgttattgatggaaaatgtaattgaatcatgtgccttttaaaaatagactattttttagagcagttttaggttcacagcaaaattaagtggaaggtacagtttccatacacccccttttccccccatacacatatagcctccccactgcagacctctcgctccagaggggtggatgtgtcacagttgttgaaactgcattgatgcatcaccatcaaccagagtccacagtgttcactcttggcacattctataggtttggacaaatgtcaccatgacagtatcacacacatacacatctacctttgcttattactcttaaaaacttttaggccggatgtggtggcacatgcctgtaatccaagcagtttgggaagccaaggcgagaggatcacttgagctcaggagcttgagaccagcctgggcatcatggcaaaacccca

SEQ ID NO: 12982 - DNA, 1171 bp, Homo sapiens
aagagggaactgacatatatcaagggtccactcctatgtgctctctcattttcatcatgttcctcttcactttaatgatccccgttttatagatgaggagactgaggcttagagaggttaaaaacattctgtacgggaggctgaggcaggagaatcatttcaacccgggagggggaggtgttagtgagccgagattctgccactgcactccattctgggcaacaagagcgaaactttgtctcaaagaaaagcaaaacaaaaccaaaaaaaaacatgctgtatatcctgtcacccagtatgtttccaaaccaggacttaaacctagtctgcagtaagccccagtctccagtgtgtcagaaaaggtcggggacaattaaggaggacttcccttctgctttgcctggcccacaacagcccgtatttctgccatcattctctctcccacccccagatgctgttcaccagcccaggcttgaatgggtgtcattctctctgcagatcccagaaattatccatttctgctgtgatttcctcatgtcctgggtggacgaagagaacattctcgatgtctaccggctggcagagctgtttgacttgagccgcctgactgagcaactggacacctatatcctcaaaaactttgtggccttctctcggactgacaagtaccgccagcttccattggagaaggtctactccctcctcagcagcaatcgcctggaggtctcctgcgagaccgaggtatatgagggggcccttctctaccattatagcctggagcaggtgcaggctgaccagatctcgctgcacgagcccccaaagctccttgagacagtgcggtttccgctgatggaagctgaggtcctgcagcggctgcatgacaagctggaccccagccctttgagggacacagtggccagcgccctcatgtaccaccggaacgagagcctacagcccagcctgcagagcccgcaaacggagctgcggtcggacttccagtgcgttgtgggcttcgggggcattcactccacgccgtccactgtcctcagcgaccaggccaagtatctaaaccccttactgggagagtggaagcacttcactgcctccctggccccccgcatgtccaaccagggcatcgcggtgctcaacaacttcgtatacttgattggag

SEQ ID NO: 12983 - DNA, 1126 bp, Homo sapiens
cttgccttgggagggactgagagatgacttcatgtggccccttcattttataggagtaatcgagtctagaaccagggtgctaccatctggcagagttcatggggaacgcaggccactcagagagcaggaaatagaggccagctggccacccagtagtctaatgcgtacttccttgatcctgaactggttgtgagccatccctaggggcaacccctcccccgccccgtcccttcatgccagggctctctctttgcttcatggcgaccacctttcctgtcccttttttctgatcaccctgctcagtggcctgtcattgctctctgttgagtgccccttcccatatgcctctcctggacctcagccaggctggtgtgctggcgatagcaccttgtcaccaggggcagctgctatgcagggcctgttggccagggccctgcagcggtggagtcactggtgtgtgcaaacgtctcttctccttttgtgtttcagcgaggatgccatgaggaaagctggtgtggcacacagtaaatccagcaaggatatggagagccatgttttcctgaaggccaagacccgggtaaggccctagtaagtggagccactctggcagagagacttggagaggagagcatcacagactctggaacccctctgttgggtgtcctagggtgtaggggtggggtggttgctcatcgattgatcacaggcacagttggttttgcctgcagcagtctgggtcctcctgtgtgtccatggtacagggagggcacttgggttgcaggcccagcctctggccccagacctcactgccgtcaccttccatctgtggtcagcccctgtgaatcctacaggaagcttgctcaggcccctagctggtcctgtggaagggatcaatgccgtgagcaagaacctggtttgtcctcagcccctcctaggggtccttacctaagccctacagggccctgaggcatgggcccagaagcattcctgtccccttttgctaagtgaagaaggtgatgcttatctagaactcgccacaggtggagtggagaagaaggatttccactatatgtgggctttctccctgggtggggcaccacactgagggctttatgtgaccacctcc

SEQ ID NO: 12984 - DNA, 1196 bp, Homo sapiens
ggctgagttggactctgcaacagcacgagtggagctgtgtgtgcctgtggacttgtgccctccctgggagagcgtcccctggccactgtgttaccgcttgctcagaagggcccatcgtgctttgtacgctcacccagcaggagggctggacagccaggagaggcaggggttgccacctgccctcaaggcctcagcccatctttagtgtatctgcaggcatcagagaggtcatttgtcccttaacattaggactctggtccaggccaggctagaggtatgggtcatgcagtgaccaacacacctggcgtcctagccattcatatttgggagtctccaggagcctagtctcttactgcttggggctgtgaggggattgagcctgtaggtaggcgagatctgtgctctgtgagccttacgccctttgagccatggtcagtctggtaggccctttcctgagaagctctgcccttgtgttcccacagatcctatgaatgcactccagagcctgactggcggacctgctgcgggagccgctggaattggcatgcctcctcggggcccgggacagtctctgggcgggatgggtagccttggtgccatgggacagccaatgtctctctcagggcagccgcctcctgggacctcggggatggcccctcacagcatggctgtcgtgtctacggcaactccacagagtgagtaccacacttcttggaggatttgccgctttccttgcaaacgacaacacattttattcctgtgcttatgatggtatcaagaaaagcatggagaagctccaaatcgctctggtttttttgttttttaaatctttgttgtatgtggagagaaaaggcttccaattttcgttgagctcccagaagggttaagtgatgctgggccctcctcctcctcctagccctgggcaggagggtggggatggcctgagactccatccaaaggtttgtgttttgtggctgaaatagatacagtgtgtttcagagggttctcagctacaaggcagggctgagtgccagcaaccacaactccactgtctgcccgagctctgggcaccatctcttctagtgctgcccttgccccttggtcaccatgggtgtggcttgcagccatattatcttctggcttcctttctgtgaaggagactctgtgtcctctccacacggctgctgtggtgggaa

SEQ ID NO: 12985 - DNA, 1215 bp, Homo sapiens
aatgtgtggggaattgggtgagcccctcttccccacgtgctcccatctgtaactctccatctgtgatttgcaacaggtcttccactggctcgaggctgcgaggctgaccgacaggggcgcccaatagagtttgtgggaatggagtattgcacagatgcagctgcacaatggtcttcctccacccctctgggaatcaccattaggcaggcctcagtagggcaaaatgtttatttggtaccgggggtctcctgacctgtctagcattcccacccactcttctgcacttcttgcaaggtaacttgaatcatcacttatttctctgccacctggttttaggactggcactctataaatgacgctgactttgtatagaaggattttgctaagggggcaaaaagcccagataccattttaactggcccagttcattttctcctttcattttacaaaagaaatcatgcagaagcatcaattaaaactgatttatttatgttggtacatccaacaaaatagttggagccacaaggcccttgtctttttaaaaaaacaaaatattttgaagatggtgaaagtgactgattttaataatgagataggtcacttaaaataacagtgcctttgaccttaaaacatggcactggcccatgtgacctttgccatttcccagtacttccctttacagtctgcagcctataaacagtggtgtctcaaagcaaaggaaacctccacaagtgctgcaacagtgcattagtttttatgtagcaatttgtttataaaaattcccatcccataatgcatgaccttcctaaaaatatccacagcctccataggcaaggtgagctttctgtgctacccacttgttagattccagccacctcagggattctgatccatgtcattaacgaccatcccagggtgtgagggcctgattaaagcttatcgaactagacatttgtttattagatgagctcggcattattattttctcaataactggtagaagggaaattttaaacataacactcaacccaaacaaaactacttcgtgaggctttcagcaaaaaggctgcttaaaagcatgaacccgggatgcagagcagcttttgtgcacggttccacttactgtaattgtttctggttctttcctctaacaccttccatgtatgtcaactttttatcaccgtcaggcatagactcgtggagattagtcattat

SEQ ID NO: 12986 - DNA, 1120 bp, Homo sapiens
atcccagctactcaggaggctgaggcaggagcatcacttgaacctgggaggcagagtttgcagtgagctaagatcacgctattgcactccagcctgggcgacaagagcaaaacttgtctcataaaaaaggaaaataatttattatagaggagagtggtatattaagaagtttgacaggcactggcttagagtaagatttttctcttagagtaattttctttctctcttaaggtatccaagcccaccaatgggatctgtctcagcacccaacctgcctacagcagaagataacctggaatatgtacggactctgtatgattttcctgggaatgatgccgaagacctgccctttaaaaagggtgagatcctagtgataatagagaagcctgaagaacagtggtggagtgcccggaacaaggatggccgggttgggatgattcctgtcccttatgtcgaaaagcttgtgagatcctcaccacacggaaagcatggaaataggaattccaacagttatgggatcccagaacctgctcatgcatacgctcaacctcagaccacaactcctctacctgcagtttccggttctcctggggcagcaatcacccctttgccatccacacagaatggacctgtctttgcgaaagcaatccagaaaagagtaccctgtgcttatgacaagactgccttggcattagaggtaaaatctgttcagattagctttttgggtcctttgacatttggttttaatttttagttttagtttagtttctgctcatttaagcttatattcatggaattagagcactggatgattttggaagatacgcactgttagcgtttcattttaaaatttttttatagagacgaggtctctaattttaaaagagttgtttgcccaggctgatttcgaggtcctggcctcaagcaatcctcctacctcgacctcccaaagtactgggattacagatgtgagccaccatgcctggcccattattagtgtttcacagcttgttttgttctgtcctattccttgtttgccccaaattctcagccttcttgctctttcttgttcccaaagcctaacagatttagttttgcagttgttggtttttcttccagt

SEQ ID NO: 12987 - DNA, 1198 bp, Homo sapiens
gaaatgctaactttgtcttcttcatccatacaggttggtgacatcgtgaaagtcacaaggatgaatataaatggccagtgggaaggcgaagtgaacgggcgcaaagggcttttcccctttacgcacgtcaaaatctttgaccctcaaaacccagatgaaaacgagtgattgctgttgccctgtttcctgctgctttgttgttctgcctgtcctagtctcctttgaagtgggaaagcattttctctcataggcaagtcacactgcattgccgaagtccagctttctgcagactggcagtcgcacacacatttggaatgcacacagcggctgcctcctgatgtttgtatcatagtcgtattgtcaaagagtagccgattttagagttcttttggatcataaactggaaatactgatggaagcacacaagtggagagaagttgacatggaaagggtcttccttctcattgctgcccgtttgtacatgggactgattctgttgtgttcaccagagaaagcttgaggccatggcgagatactgcatgtttgctgttccacaaagcagtggcttagctgccatcttgcttttctttggacaacaggaagtgaaccttaaggaagagagaattctgttctaaaactccaaaatctggcttttttttttcttttgttttggtttggttttggaaaactaattaattagacttgtgtgggggtttttttttgttttgttttgtttgttttgttttgtttttttgagacggtgtctcgctgcatcacccaggctggagtgcagtggcgcaatctcgccttcctgcagtctccgcctcctgagttcaagcgattctcctgcctcagcctcccaagtagctgggactgcaggcgcgcacaccacgcccagctaatttttgtatttttagtagagacggggtttcatcatgttgaccaggctggtctcaaactcctgacttcaggtgatccacccgccttcagcctcccaacgtgctgggattacagccgtgagccgccgcgcctggcctagacttgtgtgttctaaacaggttaagtagcaggttgggtttttatgatagtgcaaggaatgactcatgcctctgagcttctaaactgaagctgctgtaactaaaggaatctgaaaagaacaaccctgaagcagaggcctttattgtcttggttgccagta

SEQ ID NO: 12988 - DNA, 2531 bp, Homo sapiens
aggcctgttcatacaagccaactggtatatacgtgtggttcatccatcatctgctgcacatagcagactagaattctgggaaccctgtgcaattcagtctgctctcccttgtggaccctggtaaagaaaagcctcagctcatagtgaacacagcagacctagaaatgtagcagcagcctactgagtagctttcatttactgatcatctgctgtgactgtggccctgtctggaggttcctaggttttgagatttagagcaatgcattctggagacagaaccagcagaacagccatttttcaatttttctttaaatcagtattccatcaggcagataactgctgtattcatgaatcttgagagtgttcctgagacagaattaatggtcatttgggaaaactatcgccatggcttcccatctgtggttttcctctaaaagccttggagattagcccttccttgccagtgagaacggtgaccgcctcctgctctgcacggtctgcggcagttgccgcttctggttaggtgtgtcaggttggcttattttgggttcaggcctggcgtagcacccacaagtggcagacatatcacaagagtccccagactctgcctagaaacagtgtttgccctttggccagtgacgtggttcatcccggcccatgttgagccatgagtggagtttccaacagagggaggaatgtgtgccttgttcaaggagggcacgacccttaggcctttttcaaccagatttagctgaagggcttgacacctttgaattacagcagttgactcagagtgcaagaagtctggccattttggaaagcaaggtttcctttcagccctgtctactgaccaataccccgactcaccttgtgtggcgcacttcagaatcagatatacctagagtatacctgtggtttggttttataattaatcagctcgttacttcagcccatgaaaatggcatccagggctgccaggagattcagagctcaaaacaaggcgagcttgagttctgcactccagatatgtgccaaaactagtaaaacttaacggacttacaaccttgtcagtttttttaatgaggcagggatactctgtttttcacactaaacatatgaatgcagcactgctgcctcagctcagcttcgtgcctgggttccccactggtctgggaagactgttgtgctccatagagcagtgcacatctgacccagagggtgggtgttcataactgctacttgctctgctctaccatgtttaaagaaatatttggatgttaaattaactcactatggtttttcacctgggaaggaaacaaattacgtactagagggcattgactggttaaaaacttgtgtatcccgggaaggacctgcggtacaggagtcagccatgtctgtgctgtgtggaaccacctgatgacatggttaacgaggaagacgatgtgttgaccggctgccgtttgaggactttggtcacccagactagacaccttctgtgctcatgtttggaaagctgaaagggaaggacagctgtgccctcctgggagctcatgtgtccctggcgctgtgctagctttcctttacagctgtttacagacaaggcaggcctgaggcagatggccactgctcttgtgatgtttgctcagaggaatatgaacattttatttttgaaaagggatgatgtggttttttgccaggtgtttataattaatcctttaatattatggttattaacctcttaaacatgaatgaattcttgattgttttaacacagtacctaagactaatgctttctgtggacaccactgagctctgcctcaactccaccctctgcgaccggaggactatgcccctagtaactgctgtcggtgtggacgctgtgctggttctgttttctaaaggagcagaaggacaggtctctgagacaggatcgttgtccctacaggaggaacagtggccttgcttcttagacggtcttcactgtgtgttttaaaacaacaacaacaacaacaacaacaacataaaactcttttgacctgtaacttaaagatcataaacttcaggcaataatattttctgtgtaagcttttaaaattatttttggggatcatagcttgttttattttgtgctataaaattaacagtattaaatgacttatattcttagaatacatcgagtgtcttttcttaacagattagtgcctttttatttttgtattccgttttacgttactggtcccagcatcaaaacccttgtttccatggcctgtttgtatattgtctcaataaaacttgcatcagccggtggtggcggcagcttcggtgtttcagtgtctcctcagtccgcccccactagcctcctggcagttcatcagtggtgaaatctctgatgcttctcagagacccttagtgctgctgctgaccaagagctagaatgaagtcttggcatccgcccattccaacactcgggcacccagaggagagcacctggggtctccctccaaaagagaaatctgcctcccagagtg

SEQ ID NO: 12989 - DNA, 1207 bp, Homo sapiens
gaaccagcagaggaccaagggcttcctgtgtgacgtcatcatcatggtggagaactccatcttccgggcccacaagaacgtcctagccgccagcagcatctatttcaagtccctggtcctgcacgacaacctcatcaacctggacacagacatggtcagctccacagtgttccagcagatcttggacttcatctacacaggcaagctgctgcccagcgaccagccagccgagcccaacttcagcaccctcctcactgccgccagctacctccagctgcccgagttggcagccctctgccgccgcaaactcaagcgagccggcaagccctttggctctgggagggcggggtccactggcatggggcggcccccccgcagccagcggctgtccacggcctctgtcatccaagctcggtatcaggggctcgtggatgggcgcaagggggcccacgccccccaggagctcccccaagccaaaggctcagacgatgaactctttcttggtggctctaaccaggatagcgtgcaaggtctgggccgggctgtctgcccagctggcggggaggcgggtctggggggctgcagcagcagcaccaacgggagcagcgggggctgcgagcaggagctgggcttggacctgtccaagaaaagcccacccttgccccctgccaccccaggtccccacctcactcccgatgacgcagcccagctgagcgacagccaacatggctcgccccctgcggcctctgctcctcccgttgccaacagtgcctcttattctgagctggggggcacccctgatgagcccatggatctggagggggccgaggacaaccacctgagcctgctggaggcgcctggtgggcagcctcggaagagcctccggcactccactcggaagaaggagtggggcaagaaggagcctgtggctggctccccctttgagcggagagaagcagggcccaagggtccctgcccgggagaggagggtgagggggtcggggacagggttcccaatggcatcctggctagtggggctggccctagcgggccctatggggagcccccctacccctgcaaggaggaggaggagaacggcaaggatgcaagtgaagacagtgcgcagagcgggagcgaggggggcagcggccatgccagcgcccactacatgtaccggcaggagggctacgagacggtgtcctacggg

SEQ ID NO: 12990 - DNA, 2697 bp, Homo sapiens
tgcccacacccagagctttaatggacagtccgtaccaagcagagccgagaggagggaagccaggggtcccagcccgtctacctccccatcccacccaggcccccagctccccgcgggggccaccgcagggcctgtgggctgggtcacgtgggtctcgctgggacctggtccctttgttgcaggcggcttggagaaagggcagtgggacgctggccacggccagggtggtgtcgggagcaggcctcaccccgctggccgtgtctgtgtgtgtgcacgtgtgcttgtgtctgtgcgggcgcgtgcagccctggttctgcagggaacaggtgctgggggtgcagatccctccctccttgagccagggtggcactgttcactggcgctgggacagtcagggtgaccccaccgcctacctctctacatctaaagagccctctgggcctgtgttgctgttattcctactgatctgttcctctgtttttctttttgatttttgttttttaaaccaaaacagacaatagcttattttctttccgccccctccggggctgagcctgggtctgaagactgaatgtaacaggggccgctggcactcctgcgcgtcccccggctctggcgctgcaggggtgtcggcgcgccacctctccaggccccagaagcccttcttgcccaaaggcttccctggtccctgagccctgcctcggctgcctcaggggagagtgcttttcctgtagtttccaaggaatattctttgtttagaggtacttgttttttattaagagaaaaaccagtgtaacgtttatgtgactgtttgaactggaaggtctggggttccggggggtggggggaggctagactcaatgccggggccgtcggtactcttgttttcatttgtgtgtgcgtgcgtgtgtgtgtgtgtatgtgcgtatgtgtgtgtctatgtgtggtgtgtgccgtatgcatgggcagatgtttcgctttccctccttcctcgctgaacaaggtggagacttctgaccttttgctacctcttgaattcatgacaacgatatgttggtgactggcagtggaagcccttgacactcttgttttccttcgcttagcacctaggaagtcgtgtgcaggagccagcagggcgccaagtggcccagtgcctgcagctcacctgtgggttttccctttgagcctttggccacatccacctcgaggggaccctggcaccccgggcacacaaacctctgtggtataggtgaggggtgtgaggccccagcctggagccaggcactgggtgctgacaggggaaccatgaggagggtggcaggtctttgcagctcccggccagggtgaggcggaagtgagccctcatcctgccactcctatcctccattcctgcaagagttttaagcttgagagagctgaccacagggccccccggggaacagggatggcacttccctgagcagtcctggcccccggccactgtctcggggcccacctctcgcccctcatcttggtaattagccagcctcagatacttctgtgggccctgaagtgggctctcaaggtcagaccaaggttgctgatctcagtcccactgtcttcagccagctgaagctgtggggctgggctggcagcctttattgtcatcttgcttcaccatttttttttctctctcttttcattctattttaagtttagaccaaaaaaatacagagtcatcccctacccccacccctctagagaccctccagctaaaaacagagcctgagttcagggacccaagtggtgagcggcgtcttttgggggtgagggagcttgggtagatgaggctcctggctgagccctccctgtggtgatcccagcctaagatggcccctcttccctcctggtgggagacagaggactggaccctgggtctcaggttccagcaagtcaggctagggacctggggggaggagacccatggacttcacccatactcagtgagggggctcctgccgtcctgacgccaccccgccccatcagcacttaagccacatgacacaaagtctgtaccgcacgggaaatgttcacgcgcctggccgtgtgcatggcctcccgggctgtgggcagccgcatctgtgaggtgactcgtgaaagtaggtgattcctttgcagaacttcagggactgggagcagaggcccctcactcaacgacgtttgtgcgacatagtattgtatccaccttagtattgtatcgagccttttctgtgttttaatgagaaagcagaacactagtttcctatttaagactttaagggtttgtggggcggggcgggattaacacaacatttggctttgttttctttttcctttgatttccacatcaggtgtgtgcgagtgtgtgtgtgtggagatgttaagagcctcacaaggaaactgggttattggaggccaaggcggcttacagttctctgcgttcgtcacttaattcctgaatgtttcagagaaacaggaatcagaaaatagcagatatcatgtaggaaagagaggataaacaaagaaaaaagaaaaaaaaataagctcatacccaaattcacaaagcctattttttaaaccaaagcacattttgaatgagtatggaacctccatgggctcagaaaaaagatgctaatatatttatctcattgtttacataagcttttacagtttcagacc

SEQ ID NO: 12991 - DNA, 2148 bp, Homo sapiens
agggaaccctcccctgctgctggaaacccttctgagttggccctggagtggctcacgggcagagaagggtagccctggggctgggggagggattggaagcctccctggagtcacctgagccctcgtccccattcccagggcccctccaagcccagctggcaccaaagagcttgggcccgtgctgaccagcccccaaggccctctggccggaccatgctggtcctgaccagctagcctacgcggggatggccgtcagttctggccacaggacccgagtctgggcttgggtccccctgctgctctgcccgtgacccttggggatgggttgatgcgagggtcccactcaagccaaaaagccgggacctttgcgcagctctgtcgactctggtgggtccccactcctggggccccctaaccccaccccaggcagcggaaggggctgactgggtctggtccttaccaacatagacggtgcaaacactcttaacagtgttgtttttgtatcaatatgtttgtgcagtgatgaatgtatttatttctcagacttggggcgagtgagcgggtggcaggccgggctccgccactgcatgctcccgccggaccgagccccagcaagggctcctccaggattgcaaaaaaaaaaggaagagaaaagatgaacctttaagcaaataagaatctcagagactcgcagcatagccatacacctcagcctgtgaaatgaacgatccggaccctcaccaactttccccacctcaggcagccctgtgtgtttaccgttcatcaccactcgggggcaccgggccgcccacccactcccaaaatccgtcagtattcactggacctcaggccctgtgcaggagtgcgatccgggctgggccgctgggcaggctgaccccctgccctcctgcggccatcctgagttggggtgaggcctgggcagccggagggcagggctcagggagcaggaggctgcatccgtccacccccaggcgtgggggacaaaagccaaaggtgccaggccttagagcagacaagggctctcagccctggcatgccccctaaagggaccaaggtcctcctatttcccagaaccccgttggggcagatgttactgaacctgtgaatcagacgccaggagtgagggctggggagggacctaactggagcctcagtctgacattccacgccggggtgggggtgggcatgagcggtgggaactgaggctgcccaggacccccttcctaggatgccccggcttcagtcaccccactttaactttctaccaggaccccctccccctacctcaccttgctatttattgctgtaatttattgacctcaaaaatgctgcataacagacctcactggggcagggaggatccccagggctcccaccctccacttggcgggccccgtggggccaggtgctgaggggagcctctctaccccacccatcactagcttccctctgccctctcccaccccgggggggacccaggttgggcactggctcatttctcgcaaatacctcgaaggggaggggggagggatggggttatagctgttttgtttaattggaactggaagagggatcatgttttgttttatgcccttcccagaaggggggagggacaccgggatcgcactcctgtactggccaccgccgctgtcacttgtcacattgagttcatgtcccttgagagtttgtataaattcaggtcagagctgcagctacacagctgcccagtgtcatagaaaagcaattcaccaacgactgatctctccattcagaagtgtgcagtcttaaatgtacagcgataagaaactgttattttatgatcttttcattaaaagcttgattgaaaactctggtgtgggacctccatattctgctttggctgttctctctagcaaagtgacacggcttctaagtcttagaagggtggggtctgggatgggcatctgcctgccactgttcagtggtgcttggtgggtcctgggggtgtgcaccgtgccagggaactagcactttggggtcagcatcctcttgggcagtgttggcctgagttagctgaggctgtctgggaagcagcgatgtgtgtgcagttacagcagcatggacctggtgactggggagaggaggatg

SEQ ID NO: 12992 - DNA, 2359 bp, Homo sapiens
tttcttaatcaaaagtggtctaggtaacctgtaaagaaaggattaaaaatttaagatgttctagttctgctctctttgttttaaaaatcactgcttcaatctacttcaaaagaatggtgtttcttttcttgtccaattttatccaaaatcttcaagttacatttaacccataaggtttaaaaaaaaggaaaaaaaacggttgtggttccctttcttccctacccttgccactcccactttctggcaccgagtttatttttcacttacttacttccccagaccccgggctcgcctccacaaaggagaaaagactgccctggcggtcctggtggcttttcttagcatgtgtggcactgttgcccagtgtgggagttggtttaaattctcctgactccagtttataacatccttttaaaaaatttaaaaacaaacagccacacccctcctccagtccttctcctcagttcttgtgtgaaactccagctgatgttaccacagtaacatcagttaattgggcaagccctgatgtcagtgtgtgtaactgacctctggcctggcctgcacagagaagccctataatcacaggtctgtggtggccccgaaatggggggcctgctagtcaggaggatgctgtgcacactgtgtgtgatgaatctcgccagaaaggctcctgaggtcccaggttggcacttctccctgcagccattgtagaagatctgctggtccttgcaggcaaagctacagccagaatgtccgtttgaaactcctagctcatctgtcaccgagcttcatccgaatgtgccacggagcttgctctccacttcctccgtgcagtggccctgccacagccctccctcggcacactttgaccctttgtaggattggaattagcaggactcggctatttaaagcaccagtctggggtcgcctgggcccctgctgaccccctcctccagagcagccagcccagcccgggaacaagacggacttcctctcccttcggactcacagcctttgcagagtcaagctccacttgaagctcactcagtaatatcctttcaatgtgttttatattgttttgactgcctttttttgtagaaataaaaattgaccttagaatttatcgtcagataaacttgtaaagatttgaatattaatgtcttttcaaggcaaatgggattgtccccgcactagtagagaatccatgtcgctctgacaccccaaggaagccgacgatccaaatgccgtgtgtcaccaaccccgcttctgccactggcggcttcccttcttggctcttgggggggactagatcctgtggagaagatgacttaaactttgctttttgttttaattttaattctataacttgagatctttccggggcctacaggcgtgtaagacagcttggtctggtctgtgcagaagtggggagtgatgggcaggttcggcagcctaacattgttcaggcgcatggcccctgcggtgtgtacacgaactcggcttcttttgtcctaggtacgccaagggcaggtttctggagactcccttgtgcccgggatggcaagggcaccgggctggcgtttccacatctgtcttcattagcagaaaagtgatgatggattttatttcactcacactccagtttgtaataaaatgccaaattctgtcagctatccaaacaagccaccatttgttcttgttgcttctctggatccagaaatgttgccattcttggaaactgtcccattgcttcgtatttctgccaacgtagctctgcctgcctgtcaacccctcactgcactctgctcatcacgggaggatacctgtgtgccggcagcccctcagggactctcagccctggcactggcaccccagggttggccccgtcagcagaggcttggctttcgagccagtgggtgtctctcctttgggcctgggcggcttgctcctgccagccatgccttcagggtaggctctgagcaagctggcgaacagccctggctgctccaaaaccaaaaagctgggtcctctggaggaggggcgagctgtggagcagccacccactgctgccccaagctcactcaggaattcacacccgcctggtttcttgaagtgtgctgggtccttccctctgctccctactccccaccacggcagagaataggctttctaagatgctgcgatcccgttctgctgcccgtaataaaaatgctctcagacactggttagtcgtgtgggtttcttccttcctgggagcgggcagtgccaggggcctatgctcttggagatgggagggctggctggggcccaggtcctggggcttctgatctctctccccattcccagcctctccaaaaga

SEQ ID NO: 12993 - DNA, 1217 bp, Homo sapiens
agtggtctctgcacagacagatgcaatggtgtgtgcatgtgtctgaagagcccatgctggggagggagtgctagaggttgcgggggcgggtcatggtgtcaccttttgcagctgtgggagctgaggctccaggaagggtagggaagaacccgaggctcggtgtactaggtgcgaatgccgccttctgtggtgaccactgtcttctcatcctttgcacctataggaggtgagtgcctttggggaagacggcgagggcgacgacctggacctatggacagtgcgctgctctggacagcactgggagcgtgaggctgctgtgcgcttccagcatgtgggcacctctgtgttcctgtcagtcacgggtgagcagtatggaagccccatccgtgggcagcatgaggtccacggcatgcccagtgccaacacgcacaatacgtggaaggccatggaaggcatcttcatcaagcctagtgtggagccctctgcaggtcacgatgaactctgagtgtgtggatggatgggtggatggagggtggcaggtggggcgtctgcagggccactcttggcagagactttgggtttgtaggggtcctcaagtgcctttgtgattaaagaatgttggtctatgattgcgtttcactgtgagcctgaggatgaccaggaggtgccagcccaggcccagttgatcatttcttcctcagtgcaaaacctgtctccagcccagcctgactgctgaatctgtccaaaccctttattatttttttttcggggggcgggggggaggtttgcttttttttttttttttgagacgaactctcgctcttgtcccccaggctggagtgcaatggcgtaatctcagctcactgccatctccgtctcccgggttcaagtgattctcctgcctcagcctcccgaggagctgggattataggcacctgctaccacacccggttaatttttatatatatattttaagtagagatggggtttcaccatgttggccaggctggtctcgaacccctgacctcaggtgatctgcctacctcagcctcccaaagtgctgggattaaaggtgtgagccaccatgcccggcctgggttttgctttttttttttttttttttttttgaggcggagtcttgctctgtcacccaggctggagtgcaatggcactatctcggctcactgcaagctccgcctcctgggttcacgccattc

SEQ ID NO: 12994 - DNA, 1111 bp, Homo sapiens
aaaagtaaactacccaaccacatgccacgtaatatttcagccattcagaggaaactgttttctctttatttgcttatatgttaatatggtttttaaattggtaacttttatatagtatggtaacagtatgttaatacacacatacatacgcacacatgctttgggtccttccataatacttttatatttgtaaatcaatgttttggagcaatcccaagtttaagggaaatatttttgtaaatgtaatggttttgaaaatctgagcaatccttttgcttatacatttttaaagcatttgtgctttaaaattgttatgctggtgtttgaaacatgatactcctgtggtgcagatgagaagctataacagtgaatatgtggtttctcttacgtcatccaccttgacatgatgggtcagaaacaaatggaaatccagagcaagtcctccagggttgcaccaggtttacctaaagcttgttgccttttcttgtgctgtttatgcgtgtagagcactcaagaaagttctgaaactgctttgtatctgctttgtactgttggtgccttcttggtattgtaccccaaaattctgcatagattatttagtataatggtaagttaaaaaatgttaaaggaagattttattaagaatctgaatgtttattcattatattgttacaatttaacattaacatttatttgtggtatttgtgatttggttaatctgtataaaaattgtaagtagaaaggtttatatttcatcttaattcttttgatgttgtaaacgtactttttaaaagatggattatttgaatgtttatggcacctgacttgtaaaaaaaaaaaactacaaaaaaatccttagaatcattaaattgtgtccctgtattaccaaaataacacagcaccgtgcatgtatagtttaattgcagtttcatctgtgaaaacgtgaaattgtctagtccttcgttatgttccccagatgtcttccagatttgctctgcatgtggtaacttgtgttagggctgtgagctgttcctcgagttgaatggggatgtcagtgctcctagggttctccaggtggttcttcagaccttcacctgtgggggggggggta

SEQ ID NO: 12995 - DNA, 2353 bp, Homo sapiens
agcgtaggctgggggagtggcgtctttcctatgagtgttgtggaaaccacctcagaactgtctgagaggaggtgcctgtggagtgagggctgaccctggccccttcagaactgccatgtgttatccttgcccaaatgtgtccaaagaaatggccattttgcaggagtcttttttcccttttctgttttcataatgctattgctgctgctgctgttttaatgtggttcactgttgtcacttttgtgttttgtgatgctgatgatgatgctgttttcacatggctcactcttaactcagtggtctgtttgtgtttctataggacaagggctcagaggactggacgtgctcagacatcggtgttcttcttcccagttcttgacccctggtcctgtctccagcccgtcttggcttatccactttgactcctttgagccgtttggaggggcggtttctggtagttgtggcttttatgctttcaaagaatttcttcagtccagagaattcctcctggcagccctgtgtgtgtcacccattggtgacctgcggcagtatgtacttcagtgcacctactgcttactgttgctttagtcactaattgctttctggtttgaaagatgcagtggttcctccctctcctgaatccttttctacatgatgccctgctgaccatgcagccgcaccagagagagattcttccccaattggctctagtcactggcatctcactttatgatagggaaggctactacctagggcactttaagtcagtgacagccccttatttgcacttcaccttttgaccataactgtttccccagagcaggagcttgtggaaataccttggctgatgttgcagcctgcagcaagtgcttccgtctccggaatccttggggagcacttgtccacgtcttttctcatatcatggtagtcactaacatatataaggtatgtgctattggcccagcttttagaaaatgcagtcatttttctaaataaaaaggaagtactgcacccagcagtgtcactctgtagttactgtggtcacttgtaccatatagaggtgtaacacttgtcaagaagcgttatgtgcagtacttaatgtttgtaagacttacaaaaaaagatttaaagtggcagcttcactcgacatttggtgagagaagtacaaaggttgcagtgctgagctgtgggcggtttctggggatgtcccagggtggaactccacatgctggtgcatatacgcccttgagctacttcaaatgtgggtgtttcagtaaccacgttccatgcctgaggatttagcagagaggaacactgcgtctttaaatgagaaagtatacaattctttttccttctacagcatgtcagcatctcaagttcatttttcaacctacagtataacaatttgtaataaagcctccaggagctcatgacgtgaagcactgttctgtcctcaagtactcaaatatttctgatactgctgagtcagactgtcagaaaaagctagcactaactcgtgtttggagctctatccatattttactgatctctttaagtatttgttcctgccactgtgtactgtggagttgactcggtgttctgtcccagtgcggtgcctcctcttgacttccccactgctctctgtggtgagaaatttgccttgttcaataattactgtaccctcgcatgactgttacagctttctgtgcagagatgactgtccaagtgccacatgcctacgattgaaatgaaaactctattgttacctctgagttgtgttccacggaaaatgctatccagcagatcatttaggaaaaataattctatttttagcttttcatttctcagctgtccttttttcttgtttgatttttgacagcaatggagaatgggttatataaagactgcctgctaatatgaacagaaatgcatttgtaattcatgaaaataaatgtacatcttctatcttcacattcatgttaagattcagtgttgctttcctctggatcagcgtgtctgaatggacagtcaggttcaggttgtgctgaacacagaaatgctcacaggcctcactttgccgcccaggcactggcccagcacttggatttacataagatgagttagaaaggtacttctgtagggtcctttttacctctgctcggcagagaatcgatgctgtcatgttcctttattcacaatcttaggtctcaaatattctgtcaaaccctaacaaagaagccccgacatctcaggttggattccctggttctctctaaagagggcctgcccttgtgccccagaggtgctgctgggcacagccaagagttgggaagggccgccccacagtacgcag

SEQ ID NO: 12996 - DNA, 1200 bp, Homo sapiens
cagctccaatttatgacaattctaaatctgtctctcaaattgtttcaaaaaaggacggatgtatactttggaaattctaatttaataagttaatcaactttgtgggtttgttgttgttttgagacagagtctcgctctgtcacccaggctggagtgcagtggcacgatcttggctcactgcaacctctgcctcctgggttcaagcaattctcctgcctcagcctcccacgtagctgggattacgggcacccactaccatgcccggctaatttttttgtatttttagtagagatggggtttcaccatgttggccaggctagtctcaaactcctggcctcaagtgatccgcccgcctcggcctcccaaagtgctgggattacaggcattagccactgtgcccagcccaagttaatcaactatgaagagaaaaataaaatcacataatcttggttgttcagcctctcataagaaagccaaattgttttttgcttttccatgttgtttacttgtatttctgaattgtagagtcaaaggagaagttcagagtcccatcagcaatgcacctgtcatacaggaagatctcatcatgtcctgtaacaccagataccattttcagtcttttctctctttctcctgcagggctacaccaagtccattgatatttggtctgtaggctgcattctggcagaaatgctttctaacaggcccatctttccagggaagcattatcttgaccagctgaaccacattttgggtaaggttcccgagcccttcaggagctagatttactcaagtttgtacagcttacatcaaagtcacttcattaaattaagaagagttctaatatactctttaacctgtggtaggtgtgaatttttaaccttctctgatttaaaatgttaaggacttttgtgtaaaaacataagaaaggtaaacatcaggagtggtgataagcaacggctcatatcaattatcagggttcattccgactcagagttgatggtgtgtagtcatttaccttggtcctgataactaatagctaatttttttatctgataggtattcttggatccccatcacaagaagacctgaattgtataataaatttaaaagctaggaactatttgctttctcttccacacaaaaataaggtgccatggaacaggctgttcccaaatgctgactccaaaggtaaatgtt

SEQ ID NO: 12997 - DNA, 1092 bp, Homo sapiens
gcggtggctggcagcacgcctgccttgctctgccccatgccctgaacaggcatgagagctccacgtcccctagtgcaccctgagagggggctcacaagtgaccgatcctgggtgcctcagggagctcactgagggcgtgcaaagttgaaagtggcaaggctgggggagggtgtcgggtagagggaagagggcagggggctaggggaggactcagaggccatctgcagggccaagccacaggaagggctgagctggaggtgggcagggctgctccaggcaggtcagagcagtgcagggggaggagaggagaaagggaggaagctgggctgtgtggtccccatgaaggcattcagagtccacctgcagacagcgagagccccaggaaggtttgcacagctgtgccccaagcaccttggcctcctctcagctcgccgaggaggcacgctagagccgccttcccggtgggagccctctgtcccacagggagcggggagccagctttgctggggccctacctgcatgcccagccttacccctcattctcacagcacagatgaggttgagaccatgcagtcaatgcattgcttaaggtctcttatttacaaaaaaaaaccttaaacatagtcgctgtcattcagacattcagagaatggttggccacaaacaatgaccaagtattgcttggcttaacttgaaggcctgctgtctccttctgggggtcagggacgcagctccaccctcaccactagcccaccctgcccgtgggcataaccttgacgaagagagagaatgattggcatctgcttttctcttttctttgctaataattctgttcctggctgccgagagtgaagtttcaccatgtggaggtttggctcctatcacctggtggtctgattcataccctagcctgaggctccactggaagatctcgcagcctcagtgtatgggaaaccctttccccaggcttgtcccagcactgccgctccccacccctgagccaggaccccagaggatggccatgccccgtgcctggcagaggtctggtgccagcactgggagctgctccgcccttgccttggggccgaggga

SEQ ID NO: 12998 - DNA, 3239 bp, Homo sapiens
ggtggtctcgaactcctgaccttaggggagcctcctgcctcagcctccccaagtgctgggttgtgtgagtcactgcccctggcacctatttattgttttggtatttcatgttactcctaagcttgaaagctcttttttctatatacagaattcatagaatttttgaaatacttagttttctttacagctttttccatgcattcagcatttcatggttaactctagtcagactggaatggctttgttatgccctggcccacttgctgccgaattcccagaagtgcctctgctgtgctggcataaaataacctgaaaagattctgaaaagccaggatgtggaattgaaagagaagctgctgcgtgagcagagaccaagaaggcggaggttagttgagggagagcagtggttctttgttctagttgaaggataggcacacattcattctagtcttggggccaggtcaaaaggaacactgcttcagagtatctttacctacctgaaaacatccaaggaagccaaaccattcaaagtaaaatggttttgtttggtgaagggcccctgcagacatcaaacagccgtcatgtatcattggtttgaggtgaaatagcaataaaattaatagaatggtgcctggtactagctgacttcctgttctgtgatctaaaggtgaatttgattcattccctctcctctcccttctggctagccgttagtggagaatgaactggccatattctcagccacagctgtaaagcaagtttcccaaggggaagaagccctaatatctataatttgaactgtactggacccatagttttaactgaaaagggccaaacaagtggtgtctgtccagttcctggactgggctaaatttagttttcccactgttaagctggaatgaggactgtcccaacaacagtaggtacagtggacaaaaatagcccagggtgactgactgaatttaaacccataatggctttatatttttctgtgcatatatatcttaccctaattgaacatgtgaagcttgcaactttatgtcttgctttggacatgaatgtattacagcttgcagctattctgttaaatgtatagtttcccagttttttgacactaatgctgtttgggtcttacctgacacacaccagtgtgcaagaaatgtctctctaattcaataagttttaagacttagagttaatgtccttcatctgatctatcctatctaatctgtactatgggtgaatctttttcccttgctctccccaggggctgtttcacagtattctggagtaccttttgagtattggttcctgaacatcagcagtcttggctgcctctgtggactcccggagttgtctccctgcttgtgttctggtgccatcctttgttcctccacccctgaccaaggtgcccagcagcctgtcttcaccagtcaaggaatccgccatcttggctgtagacataggtctggagaaatctctccctttttccttgatttctttttaaaggtaccttatctctccccactcctttcttccctcctcaatctagttaaatttcctaagctttcacaaaaatccgggaagagataattaagagcttagcatccctcttagagtagaaggcagtacagataacaaagaagttgtgagtatattatctacattttagaaaattttctgactctagatccatagattctgttgtatttatttgccggacactcatttgattgatttgcaccttgaacactatactaggtcttttcagttacgttgcttgggttaagacactttgctaaaattacagcctgaatcctttctttagttgaagaaagggtatgtgtgtgcaagtgggtgtgtgtgtgccagtttttcttgtctcaggtagatactcccactgtgtataaatagatctacagacttttcatacttacctcccgtattctgtttctgtggtaaaaatatgaagtgttttagttgtatgttgagtgattggttggtattatcaacactgttgtttgcagtttcattaaagcatgctcttaaggagtacatatggtcattaattgccaactgtagattccagtgatctggcccctgcctacctccttcctctctttttcattctctgtcatgcttctccactgttttccccaatgacgcactattttgacacactggccttgctattccttaagcaaatcacattcttcccaatccaaagactttgcacatgctgttgtctttcttagaatgcccttcccctaggcctgcatggcttgctacctcacttaattgtttgacacttcctttggttcattgagcttcaaggctcttaaaatgccactgacaatgagatctccctttaaaaaaaaaaaaaaacttctacttttcctcttaaaggcactttactctctccccactcttttcttcctcttcaaagtatttaaatttcctaggttttcatgaaaaagctggaaagcgatcagcatcaagggctttgcttctgtcttagaattgagctagcttgagtcaatttctgtgcctgcaaccaaatgaaaattaatatagtgagttctttcaggagctttctctgtttttctattgatacctctatatatttttaaggcaatgtcactttgttttgtttacaaatatattgaatatgtcaagattactattttgttattgccctttgtgaatttccttgtctattttgctcgcttgttctttcaggtgaaatttattattttattaatgttgccaaaaattataagtaaaatatcaattatagtaataaaatgttttgtgaaaaaaatgctgttgctgtattgttgctgtattgtctttccaccataagtaaaatgggacgtttgttttgttttttgagacagagtctcgctctgtgacccaggctggagtatagtggcgcgatcccaggtcactgcaatgtccaccccctgagttcaagtgattcttcctagcagctggtactatgggcgtgtgccaccatgcccagctaatttttgtacttttcgtagagacgaggtttcatcgtgttggccaggctggtcttgaactcctagcctcaagtgatccgcccacgttggtctcccaaagtgccgggattacaggagtgagccaccatgcctggcctatttttagtttttaatttttatttagtaccactgtataatctttgcctttttgccacttgtgttcatttttagccttat

SEQ ID NO: 12999 - DNA, 1120 bp, Homo sapiens
gtgaggaggtttctcaccccacagataacccaagacacaaatgtgcaattaaaagtttattttagaccacagcctgttgtgtgcctctctcgatggcctgtcttcagggagctccctggctgatgaggtggggtcaggatggatgtctcactacagtgtgcaatccatccccttaatcagggccctgggtggggaggaggagccctgttgcaatctgcactgtgggtagcacaggacagattccttgggcagtccagagtgaggtggagaggcattagtcggtgatcccaagggcatctgactctgagggtggaatcccaggatgaacccatggtctcccccttatcagggatacctgccacctctacccttcttgtctctacctctgcatcccattctctgcacccacagcttaggtgcccctggcggcctcaaatcctgtctgaccttgcccctcttgctgatgcaacttctcagcaattccagattctgcaagaggagtcctgctgggttgttgtctgtttgcacctgatcacacaaggcagaggtcatggctaacccccttgggtctgagtccaacttggctagttggcagtagtgtgccaggtccccaagcctgccagaatggaagaacaagcccttcaaacccagtgtgggccgtgccatcacacaccatgctgccgccttcattgagttcatccagcagttgtgcactgagctcctactgtgtgccagcccctatgccacatctgtgaagcctgaggacattccggcccttagtgcgctggcactcccgtggggtggtggggacctgtctcagggtacagtgtgttccatctgggggtatatgtgcgtggagttggtgttgagggtctgcccctcatcatatgtgtctgtcctgcaggaagggatcccactctgggtgtctctgtggatgtccaaatctgctctgtacctggctccctgccccagctagcaactcctgggtggcagggagctcacctttctgggccttgaagtggggctttgctcatggcggcctcgccgagtgcccatacgcttcctccagttgtggcccacagaggagaggcctgacagcctgcgcagttcctctggaagg

SEQ ID NO: 13000 - DNA, 1184 bp, Homo sapiens
cactagtgaaactagtgggctttgggtcacggcagctctgtgcagggtgaaagggtgctcttcagacactctgggggctctgtgggagacactcccatggagacatttgggtgtggacacagcatgtccttgggcaggtggcaaaactgcttcccacgtggcaatggcgccttgtagagagctgccctgggcctgggtgtgtctgtgagcatgtgcgcgatgcttcgtagtctgccctgtttgtttgtgtctgtaggtgctgctgtggttttgtccactgcgggaaagtagtggttcttttaatgcaggagccggagcttctttttgatctgctgctatgacatttccactcacttgcttaaaacagtttcctttttgttccccctcctcccctagcagagcatcagtcgctaacacagtgagtccccagctttgcttccccctccgcaagtccctgggctaagtcttgggagataccttccccataagcgattgatttctccaggagaagccagactgggcccacagacaggtagctcttgacggagattccccggaagagctaggggtcgagctgcctagaatctgtcctgcttcccaggcagcacgtgtggaccggctcggggatagaaattcgtgtttggtgtgaagcagctctttccaactctctgggctcttgttttaaaagaaaagtattcttcatcttccattccatctccccaccttgcatcgtgttgtggattgtggtggtgtcagacctcttcccactggggtgttactctgggagctttcttttcccctgagtgaggaccaagagaatatgttctggagtcgagtgtccccgctggtcgtgctgtattgtagttgctggtgctgccctgagcacttccctctgccccgagccagtgctcctggggcagattagtccaaatcagtcccattggaggctctacccagcaggacttgtaagtaaagcactcagtccagattgcccttttggaagaggccagcattcagcagtagtaagtttgacaccttgcttttcccacctcccgcatgcgaggaccttgatgtgctgcatccacttggctggctgctgtgtgccaccgccaccagcagagtgacccagtgatgtttgtctgttacagatcacggatacacgactctagccaccagtgtgaccc

SEQ ID NO: 13001 - DNA, 1371 bp, Homo sapiens
gagaagaagatccgcgaccaggacaggaacacgaggtacccctggccctgtggtcctgggctctgcccacaggcacctggctttccaggcagaggcagggccattgcctttcccagtctcccatggtctctgagacagagtacctctagtgctgctagaggcaggcaggcttctgggtgataaggccccatccaaacgccagggtatgtttccctgcatggaacaaacataattcctcaggctgagggtctgaccacagcccagatccaggttttggggtccctggagtgatgagcagggcctgagtggcagacaggcgaggctgagagaaggctgggtctgaccctgctgggggcccacatcctgcctctgttcccacccctacacttggctgccctgtagagccttgggaagggcagcgcccaggctgggagctggccccgactcattgccctccccactcctcttccaggcggatgaggcgtcttgccaacacggccccggcctggtaaccagcccatcagcacacggctcccacggagcatctcagaagattgggccgcctctcctccatcttctggcaaggacagaggcgaggggacagcccagcgccatcctgaggatcgggtgggggtggagtgggggcttccaggtggcccttcccggcacacattccatttgttgagccccagtcctgccccccaccccaccctccctacccctccccagtctctggggtcaggaagaaaccttattttaggttgtgttttgtttttgtataggagccccaggcagggctagtaacagtttttaaataaaaggcaacaggtcatgttcaatttcttcaacaggtcatgttcaatttcttcaaagttttaacataaaaataatgagagccaggagtggggccggggcctggggggacgaaggtggtatgtgaacaaggttggcacacaggcctcaccctcctctgcctcagattcccaagtgggcaggtgggggtgaatggggctccgggtagcacctcagctcctctcagctcccctcagcctgttctccttccagacccagagagctgagaagagtagctgtgaggctcagggcaagaggctctctgcctttcaggaacagccctaaccctgctccccttgcttggcctcaggaaggtgccgcgagctctcctgccgtccctgggccgccctggctctgctgtgtccagatggtcaggctactgccagctggggccttgctgctctgaagtcccctgcggagggcccagtcctgtgtgggcactgctgggctgtcgccagcctgggtgcaggagggctgttctagctccagtggcacccatagccaggtcagctggggccc

SEQ ID NO: 13002 - DNA, 1078 bp, Homo sapiens
actagcagaaaccagccgagcctctttagacctaacagagggggaatcagaattaatctcgggctttaacgtcgaatatgctgcaggcccatttgccctgttctttatagcagactatataaatatcattataataaatgccctgaaggccgcaagaggttcgtgggtgcagtgcacaggagaccatatctggggacagcagctgcagcagaccccaagctgggccatccctgccacttgccaggtggtgcttggcgaaggcaagcagctcccacccgcccggggaatacagcgcgacccccggcggcatgctcttcagcaccaccccaggaggtaccaggatcatctaccactggaaattcctgatggagtgttgaaacttacccgtgaccaaaacactcccaagggatctgcccaccattcccggggtcaccagccctgccagtgatgatccccccaacggaagccagccagagccacctgagcaatagtccagaagataagcagggcgggcagtgaagaagcacagttttgagatggacatttaaagcaccagccatcgcatggagcactgccaagggacccctcaggcccttcctggaggagtcccaccagccaggccttatgaaagtgatcatactaggcaggcattggtgtggggccagtcaccccagccctctctccctcactcgcggcacctgccccctcctctttgtgaacaccagcaggtacctccttgtgcctccgctgatgcaggagcagctgccccaaggggagtaacccctgccagcacaccctgcagctgagggccaggaagtggacaagaatgaaccctttcttccaaatgatcagctcttccagcccctgctgggggccccacgaccccttccttaggttgacgtgcctgggaaagctcacctccccctcttccctaagagaggaaataaaagccaccttcgccctagggcaaaaaataaataaataataaatcccgtaatcactattgtcttcctaggagcactgcataacatatatataccagaactctataccacaaatttcgtcacccaaactctca

SEQ ID NO: 13003 - DNA, 1259 bp, Homo sapiens
tggggctcagtgggctgagctgatcatggttcttgggattttctccctaatctcccaccaatgatggcaaatgagatttggcagagtgggagttttccaggaaataaatagggtgagaagtcagagttccctttctgccattggcacttgtttgtagagctttgtttgtagaggttcccccaggaagggagcagggaagtcagggagtgggtaaggagactgagctcaagtttccacatactttttccctttgctttgttctttcctctacttaggctcataacctttgggactgaactcagtgttgatcttatggaagccattggcccaggaagctcaggtcctgaaactgggttcccaagccatcttgttggagtgttagggtggcaggagagagatggaaatccaccaggaatgcagatgtcccgacagggagggagggaaggtagggggaggtgtttcatagttgccgagggtgaaaactaccttgcagagctgccttgtgcctcctgggttttttccacctctggagagacagcttccaaccctgaaatgtgtcacgaggacacagtcccctgattgctacttttctgtctggatttattgtgtctggaggatgggctgcaggacacatgttggcagctgttcgagctgctgtgtgcttcagcttttgcccagaaactcctcagaggtggtggtgtaggagaacaaatgctttccccatgatgtcagttctcaggcaaggggaaaggctttggagccagagcgttctagctgtatgacctggaagcagtaacctgacattcctgttgtggttccttctccaaggcagtattgtgagagttcattgggaacacctgccatcagccatttcctgagcccctctcatgggcaccccatatgcaaggtgaatgaggtgcctattctgctctgaggatggcaaggtagtgagatggtgtctagtagagcttctgaaacacagcaggccctcagtgactgtccctccttttcctgtctgaggtattgtgacctccacaccacaaggacagggacattggcattgtgccctgtatggggaaggggtgggggcttagcctcttcccaagggtctgcatggtaccagatgccagcccagatgggccacttcacagctaccctttctttcttggcaggtggctgttacaggtgccagtggcagaacagggtgggcaggggggctagtgacttggtccaggtcacacagctacaaagcaattcaa

SEQ ID NO: 13004 - DNA, 1691 bp, Homo sapiens
acatgaattcagtgagtcatggatgcacttggtgattagtaagagccatagtgactccatgaaactgagctccccaagggctgcaccacccagggcggggtcccaagccctctccctggcaggctgaccaaggcctatgagaacaccatgtgtgtgcatcgtcccttttcagccttgaggcaggtgcagcagtacctccttctcacagctgagcacctggaggaggccagggaggttaagcagccagcctacgaggtggggctgttgggagttgagccaggactgcctccaaagcttatgcctggtagggctggctgtggcttggtagagggcatcaacttgaggctgttggggaggagtccttgccagcccccaaccccaggcctcgtgcattaagggccaggaagacttggctctgcagcaaacatgcttggtggccctgggcaggtcccctcccataaaatgcccagagctgcccggagttcacgtcatggagtcaaaggggagctgggcaatgctgccccagctcagcccaggcctgttattcaggagcagtgccacctccagagtcccgtcagccccttgctacctggaagagtgtggtggggtagccagaggtgcagaggagggaaggcctttctcaggcaggtctctgggcccagtgtccttctctgataactgaaacacagccctggccagctggcagatgtccggagccacacagatgtcaggtgggagaggcccaggttgggctcaccagcccccagaggtgactcattgcagtggagacaccagcgacacagcttcttacctttggtttctttgtaggggtcagaacgcccagggcccaaggtctgtggcctccccggagccaggatgaccaccgatgtctcacacaaggccagtcctgaggatggccaggagggcctcccccagccgaagaagccccctctggctgatggctcagggccagggcccgagccaggaggcaaagtgggcctcctcaaccaccggcctgtggccatggatgcaggagacagtgcagaccaaagcggggagcggaaggataaagagagcccacgggcagggcccactgagcccatggacacgagtgaggccactgtttgccactcagacttggagcggacaccacccctgctgccaggtcgccccgcaagggaccggggccccgagagccggcccactgagctgtccctggaggagctgagcatcagtgcccggcagcagcccaccccgctcaccccagcccagccagcccccgcccccgcccccgccaccaccacagggaccagggcagggggccacccggaggagccgctctcccggctcagccgcaagaggaagctcctggaggacacagagtcaggcaagacacttctgttggatgcctaccgtgtgtggcagcagggccagaagggtgtggcctatgacctgggccgtgtggagaggatcatgtcggagacctacatgctcatcaagcaggtgggtggcaggcagaggcctgggggcactagtctgctggcagcatccccactcttgcctttctatcctcaaggagggtctcccaggcctgcccttggggcgggttttaggtgttgttcccacaccatccctgctgttcactttctgcaatgagctttaaaaagtcaatattcaacctggaaggaagt

SEQ ID NO: 13005 - DNA, 1101 bp, Homo sapiens
gagcaccaggccaagactcctgagaacaggcagcccagtcctgcgactcccgcatccccaggaccagacacctgggacctggatacttgatacctgggcatttaaccccctactctgtcatctcagaccccaggcaggaggcccagtgttccaacacccaagccccgtgctagcagcgctccgtgctcttccccaaatactcacggctctaattccccaaacctgaaacttcataccctgggattctaatacctatgtcctgagccctgacactcccacacctgagcctcagattccaatagctcactccctagagcctgacgccggggcccctgacccctgagcctcagattccaatacctcactccccagagcctgatgccggggcccctgacccctgatctacggaggcctgctcccggaccgtgcgggcaccagtgcagtgctgccttggttcctggacccctgggcccatcctgggaccccagatggggtaaggagaggccccagaaccccaaagcagacagcgagacccccagcggcagaggcctccctcggcactccaggcttataatttcgaactcttctggaaggtcactcaggaacaccctccctgcctgtgcaaagagaaaacaagcgccttgtttccttccctggtctcctggtgttcatgctgcgccctggttctggagagttccatgaccgcctcccggggtcaccaccaacagtatccagagtgaggcaggtctgagccctgcctgcttcctccacgaggttgccggggatgctccctccccaggctctctctccatgtatgcagtgggatggagaactgtggccgcctcgtggggtggggaggccgccaacacagcacagggctcacttgggtcactcaggagatggagaaggacaacccctccctcaacagaggtgccaccccctcaccacgccctggcgtgctctggcaagcactgccctgcagcctcggctccttggctgggtgcagtcgctggcaggatcagttccaagtcctcaggagaccagcgcccaggctccttagcccaggaatgtccagaatctgggcacagagcccaggcctca

SEQ ID NO: 13006 - DNA, 1219 bp, Homo sapiens
aagagcggcaggggcagcttggcagctcatcaggtccactagagggtgtcccagacaagagcagcccccgaactgaggtcaagaaacaggttggattctcagagctctgattggttggacaggggttccagatggacaggggttctgggtagaggagcagtctatgcaaaggctcagagaaagagaagtgcagtcatgtctgcggaatgacaggggtgggggccagccaaggcctcccctgccaggccaaggcatttagatttcatcctaagagcaaagtgtggcctgcctcgggctcccccacccccaccagtctccctccaggatgggcccttggtctgcccccccacctcccctttccagcaggagaaagggtgccctgtctgtggccccagtcccagacatcagatgttcccagtgccaggggcaggccaggctgggaagccccaccacctgccaggggcttttcctggggcccgaaagagatagagacagggcctgtgcaaaggcagaaggcctggagccggtgcagactctctagagacatcaaaggcagggaccgctgcctcagggagatggtctcccaaatagcagcccagggcttgcaggacgggcagccatgggagcttgcgggtggcttacagtagggttgaaatgatggagtatcagagtcacccaatggccggtaccatcgtggtggtaccagtcagagtggggcagatggtaatccagggctttggagacacaggtgatgagagagctgggggggtcaaacaggagccgatgaggtaccagcaggatcctaagacccaccttgggcagaagggcaaagggaggaaggaatgtgctatgggagccaggcccagatcccatggaagcgggcgtcacgcaggcctgtgggccaaggggagtcacagaggtgacagcccagctgcaggtcccctgctggctagagtagggaagcccggcttctctgtgccccctgccctccagcctcccactaggtctcctgttggctgagcacagtgggtgcggctgatctgggggccagggagggctctgactcggtacagtacagtacaggcacagctggggagcaagggaccccttcttctgccaagctgcttccttctgcaagccccagggtggccgagtgcctgctgtgggccagacctctgctaggcccatcaggacacccctgtcctcagggtccaatgct

SEQ ID NO: 13007 - DNA, 1712 bp, Homo sapiens
atttttgttttgttacgagcaatgctggaaaaggtcgctcctgttctgttagtaccaaagttacattgtttcaataagcatagaaatctaaacaacatctgtacattagcatggtgagagcaaggaataaagcaggaaataggagaaaagtaaacaactttagggagcccaggcagtgtcatttaaactcactgagtcactaagacataattctcctaggccagagttaaagaaagtgccttaactcttcttgtgagggcagccactgccctccgtggccaaggcaggacctccaagactcagtggttgagttgtctcctaccaccatgcccgccctccccaggtactgggtccatgccccctgtgcccaccctccccaggtgctgggtccatgctgtttgaaccaaagccttatttaaaggtggtcactggagatgctctcaggccagaactcaacagctatttttgggaatagggatctcccgtgtgcctaacgcagtagctattggtttgaacaatgtccagacaagacctgtacctttgagaatataactgtgtttggcacctgcatagcaccatgaggaagaccagccaccagtggaagcggggtcactgccccacagactggatgcaatgaggggctcacaggaggcccagccagcccgattgtgggctgaggggtctgcattcaagcacgatgttctagaataggagtttaacgtgtctacgtaacctagaatgtggttattaggaaaggggctgtgcatgtgggtgcagctggcggcacacctggtcaccagatggccagaagctgcccatcagccctgcccagatgtcagcctgggagctcaggctgctgccgctggctggatgccctttggtgaaatgcctgttttcagctaagaaaggagaggccaggcaagcaaagtcatgccacaaagcatatcagagacccccgcagactcctggccccgtcccgccccctgtctgagttgtgtttttgttgctgttcctctgttgatggccagctctgctgttggcatgagccactgatgttcatgtgagaattactgtttttaagtgtctctccacttaggtgtcctcagttcccacttttgctctcatttgccttcacagaggccactccacctgtccggatccagctgtctggtcatggtttggtttatttattttgtccttcaggggctgttttgccctaagaatgagggggcttcccctggtctgcagttcccaactttatcccttgctggccatgcgagcccagccctggtgcctcatgggatgggggggtaggggtccccaggatcttctggaggaaggtggccatggatggatgggctgtatctgtgttttccctctgggagtctcatgggtccagcatcaggcctgaggtcagcaacagggaaagagggtgggcacggggagggcttggccccgcctatctagaggcttgcctcgggcccctccttggggaaggtttgcgtgcagagctgcaagggagagggttccagaagcattgccttttgcctcgtctaataggatccttaggacactgtgggctttaggaatgactatagatgctcacacgtgtttaaagtgacatttggagatgctctcagtcctgtggcatctggcacgaagtctccaagaagccactttgcctcttctcccttcaagcacaagctttactg

SEQ ID NO: 13008 - DNA, 1195 bp, Homo sapiens
tcagagaaagggacttggccagtggtttaagtacctgccccttcacctctcagacgaggcagctgacgaggcagctggcccagtcttgggagtctgctcaggacagtggtggagctgggtcttgaaccccagtctgcacctaaaaaactaaaggaaatggatttttttttttttttttgagacggagactcactctgttgcccagactggagtgcagtggcacgatcttggcttactacaacctccgcctcctgggttcaagcgatcctcctgcctcagccccccactagctgggactacaggcacatgccaccatgcccggctaatttttttgtatttttagtagagaccaggcttcgccatgttggccaggctggtctcgaacccctgagctcaggtgatccacctgcctcggcctcccaaagtgggaaatgggtcattttcaaaggggcaacagtgataccatccctgcactcctgggtcctgctcttccaatgcccaaggcatggcatggtggcagctgtgcccccgcccattgctttggagcacagatgactctgggggcagaggtgggctctgtttaggagggcagtgagaccacccagccaaattgcttctcaaccctagacaaagcctttggccaagagggaggtgctgttagttgggcagcccttctgggtttcagagaccggtgttggctctagactggtctcatctccattgccttaatgccaggtggcccaggagtacccatgcacagcagctgtggggtgtgggcatcttcaggtggtgttctggtaaaattgttagaatagctgtatgaaggaaaccagtgggaggaaatgaagttttcaggatggtgggatgtgatttagacagtgcacatgctgttagggctgtcactagggagtggccttcatggagggtggtaacagcacctcagtccagccaaaatgtttagaaacactcagtctctggtcccagaggatggcttctcagggcatgccacaagttaaaggtcaccttcctgaaagatgaatgagaaagctgcccattctcaagactcatctgcctagggagggtcacagaggcaggatgtaagacacactgtgttgcattcttgcacaagtcatgaaaatggagccagagagcctggacatcagggacttttgcccacagcacatgacaccgacag

SEQ ID NO: 13009 - DNA, 1164 bp, Homo sapiens
ctgttgctcaagctggagtggagtggcacgatcatagctcactaacacctgggctcaagtgattctcccacctcagcctcccaagtagctgggactacaggtgtatgctaccatgaccagctaatttttaaatatttttgtagagacaagggtcttaccatgttgcccaggctggtctcgaacttctgggctcaagcaattgtccctcctcagcctcccaaagtgctcggattacagacatgagccactgcacctggcctgaaacacattcctagtcttttgatcctgacttcttatctgggctgctgtctctctttccttcaggtggaaaggaccccttggtaccatctcaagcagtaggaaaggacctgctcttacatatattgatggtcctcatgcaaaactctcaattcttaattagtcatgtctcagctcaaggatatcagacaggaatgaaacacacttgaaaatgagattgacctggagattttttttccctaatctctcataccttaattggaaaaataatcaattaattctatgttaattaggatatacaaagttcaccctccttgaaagtgactagggcaagccctgaagatcttcctcacctccttttatttttctataaccttgtctcctccagcaccacagggaagacaatcacagtgggtcaagagcgaccctctttcacgtgggctctgccatgacctctgagacctgcttatgatcagtgcaatgaagttagaagtaactgatgattgggagcctttgcagatagctgggcaaatgggtgatttacttatccccattctaaatggagtgagctctctttgaggctaagcaaggaggcgttgtatgctagtttctagactttgcctggagacccctttggaaatctgtcttctttttaaactcacttaatatgccttaatcatctgtgtgtaatggagtcatccgctcctcaatctaaccctcctcccctggggctttggctgtcctcaatgagagtttcatgcagaatggaaaatcctctatatgtacaatctctctccccctcatttctcttcctcctcacctccaccacccctttgcacatcagcattttaacagctgatcttttgagaagcctgtatctttttcctcttcagtagatacccttct

SEQ ID NO: 13010 - DNA, 1234 bp, Homo sapiens
atcacacgggctacaaattatgctgttttctaaagaatttgaacttttttttttttcttttcttgagacacggtcttgctctgttggccaggctggaatgcagtggcacaatcatagctcactccagcctccaactcctgggctcaagcaatcctctcatctccacctccagagtagcctagatgacaggcgcacatcaccacgcccagctgatcttttaaatctgttttgtagaaacaggatctcactatattgcccaagctggtcttaaacttggtctcaagtgattctactgcctcagcctcccaaagtgctgggattacaggcctgagccaccatgcccagctgaatttgagctttttaataatctcattccacatagccttatagatcctgtaaatagggggggtcacaaaagtaatatattgtgttatggaagataattttgtactgtgctgtttcctaaatcataccaatatcctaaagtcatgcacttcccagatgatcgtgatcctccaaatgctttgtaagatggggcagggcgtggaaatatatatatatacacacacacacagagacacacacacacacaagtatagtatatattttcctaacctttcttctgggtccttcctcagatctttgagtcacgatagaaaaggagctcgagttctttgtgtaggaaagttaagcttcctgcctgcggtgttcttgcaattgccttaggaattcacaagctctaggagttctgaacggaaggcagacgagaggcactttatccagtcccagaaagaatctctaaccgtgtgactgagaagtcatctagaaaaacttatatttttaatgtaaaaacaaatggggcttaccagacctcacagagtattggacgtctacaagtgcttttatattttgtaactgtaaagaagtttcatatgcacagaagagcagttggaaatctggtcgactgcaataaaacaagatgacctttgcatgtacaaagatgttgcattcagactatgaaaatagcaaataaagctttggtgcaagttgcattggagaagtcggtgcgtccatgtgtgaatgaatagagtctcccatgcatgcaggccctgactggggctggctgagtcagtctgtcctgtgctgagctgtgggccagccagcgagagggcagagctggggtcctgggagagggtgtccatgcagaatgggaggccatggaaacaaggcagga

SEQ ID NO: 13011 - DNA, 1210 bp, Homo sapiens
aagacacttggctttgaatccatgtcacttccccacattcttcctccgtctcagctttcttttctgtaggcagctcttttgttcgattactaacccgtctaacccctggggtgcctcaactgcaccccgatcatcccttaacaaactaacggacctgcgtgcgttcttccttttctcttagcgactcctgtgtgtgtctgctgaggtgccctgtccgctggtgctgtgctctgacttactaacccagcccctactaaccctgttttctcttcttactaaccccagccctgccgagctctgggctccccccgggggctggtccccctccttttggcaagcagatgacctggggctactggccctgtagacagatgtcccactttgctgccccatattggctgtaagatcagagtccactgggccaggtctaaggcaggggatggccctattaacaagactcagaggaggaagaggtggtcctgtggatgtgggaggctggactctgagtatgacatctctcctatgtgcagaagtctggttgccactgggagtaggtgggaccagggaaatctctgggacgtgagtgtggaggcctgttggtctagactctagactgtggagctctgagcttttgtgtcctctggaaggaagctggggaagaatcctctccattgttaagtgacggggatagaagctgtcctgcacaggaagtcacgaggggggcgtatcccacgaggaaggcaggagggggcgtgcccctcaccggaaattagcagaggggcgtgtcccacaccggaagtcagaaagcggagcctttcttacaccggaagtcaatgaagcgggtctttcctacgctaaaaaccactgagtggagtatttagtacacaggaagtcggccagagaaacatttctcatatttgaaggccggaaagagggacatttctgacaccggaagtcagtgagaggactctttcccacacaggaagtcagctagagagccgtctcccctctctggagccgagagaggccggtttcccccaccgtaagtagacgtggggccgtgaccggaagtccttgggaaagatccgtcccattcccggaagctagagggcgttagttgtcgggttgaaaaggggtgtggggaggggaagcagctttaccccgggctcggagtttgcaggagagagaagtggggagcaagaagtgaacc

SEQ ID NO: 13012 - DNA, 2219 bp, Homo sapiens
atactgaagggattagtacaatttctccaaagtactgtacctatcttcagcaagaatgcaaaagaaaatattttcaatatatatacctggaacagattttaataattatcagagtaataccattaatggacaaattgactgcaatgtaatactagctggtatgtttcataaatgtcaagctgtggaccaacatatatagccttttattatttttctcttcttttaagtcagtctgttataaatttttttttagtcccataagcagtagactcccacagaaaatttcttcaaaattttttggtgttccaatgaatctgggatgtaaactctgaatgtatttataactatttatttctggatggtcattatcttgtagccaaatttgacaatataaagtaaggagcaaagttacaggccagtttttacttgtttgccctgagggaaaaatccttttaaaaaaaatttctggtttttattggatttttgtattttaaatttcaaatatttttctacatcaaacctagcaaaaatggagatgacggtttctgatttataataaatactagacagttttcaggctcctgttagacaaacacattgatgaagaaattagtcttaataggattgtaggctgtgtagaaaagttggaaatatagcacttcatggagtcttgttttgaagatgacagttttctgtaactacagcttggaaactatgcaaatggtctagattcctcagagctcacatgataggatatagttagtgatgacattttgctcttcttgtgggaacacacacttcaaggaggagatagtgactttgagataggaacagtttaagatgcagtgtgagtctggcctgcgtgcggtgaggaggccccgccaagagactggtggacatctgactgtgggatgtgctctcaagtaggacgtcatcaggacagattctgaataggcatcatgagagtgctggtcagaaacggctgccactttttttaatttaattttattttttatttaaaggaaggaacaatagctaggtaagatttttatcagctttctctgtctgaatccagtttttcctctgtcagtcctggaagcttgaatagaattatattgttgaagccttcaggtcacaaactgtcttttgtaacctcctgtccctcctaaaacacgccaacccctgcagtcaaatcacattagtaatctgatttgctgacagtcctgccctgcctgctcctcgttttcccacatgtcctgcatccctcccccactggagtgatttcagtgaatcagacaaggaaggatgtgtaggatcactactgcattgcaataccctgttatcctcagcaacaaaacccacatttcatacatcctttgtgtactcaggataaagactgatgtttactctctgggcactgttgtaagataggttttgtcagagcataatcattgtctgcaaagtgtttggtgcgaggaagattattgctaattttgtgaaataaagagtctagccctctccttttaatgaacttaactctcgctggcatctgtagtatcattgggagcttaggcgcacatggaaatgagagcccggcgcatggattttaatgtttttctaacaactgtggagatttgagggaatgtgtggtgaatgtaaaatacctagtttacttgccagtctcttgtgtaaattacagtaaaacaaagtaaatgaaatttaaacaaaaaataaatttgatcacaaaatgccacttgtgtgcttgagtggttgtttccctgagccatgtctggtttgaaacacctcagaccactactctgtttttcatgaattctgtaattcgcagcactaccagtctgggaaaattattttgttttaattgcaaattcttattcttgaaatgtacctgtgccacactaagtggttacgtttgatttcttaagtaattttctgtctttaaaagctaagcagtaaactaaaggattatatattattagtctcagtggttttcagatttatttttaaaggggaaaacagggaaaacccatcgtatttgtaaagcacttaggattttgccgtttgtttctgattgtttgaagattagggctttttggtgcgtggtcacctttcacctctccttttaggatttagtcctttccagtctgctctttttgtgcgtgtcacaaccatattcttgtggttctggctcatattgtaga

SEQ ID NO: 13013 - DNA, 1176 bp, Homo sapiens
gaatagtagaagtaaatattttctcaatttcaatttcttcttttgaagaagaaaccaaggtatcctttccagagggactttgctggcttcacccaatgtggagtaaaagtttctttttcacatcctttgcttcttatgctactgtataaattcttctctgaaaggaaggagcctattgcagtaagcacattggtatgttctcagtgagtatttgtgggatggaaagaaggaaggaccaaagagcaagcagacaagccaggatgctgcacaacatgctggctctggccgcccctctccatggaacacaactgttgtgttcagtgtcatgctgagagcgtctggacagaagggcctttcagttcctggatattttctctccaaaagtctgactctaaggacatattaagcaaattaattccctttttgtcagcatacctaatgcttgtccctcattgtgaatggagttccttcattgttttaggccaaagagccattttaaaacatggatctgtgcatattttaaactaaaatgaaaagatgtgtgcataatttgttcccatttctagggtttaatatccatattaaaaggctgaaaagggcttgtacagatcggctcaggccttgtttctagccactccttgttggggtcaccttgagtatgaacaattggatttgaaagattcatttcaacttaaaatctttcaccatagaagagaattgactgatactgttgtgcatgtctgaggatgatgaatagcccttttctccctcgcccaataggaggtggatagcttctgaacatttcttaatgcagaactcaatagccagcctcagaagtagtaattgctggatctgtgatccaactttttgtgtgtacattaggtttactcattaaagtctcacatgcaagggcagaaggaagccattctcactgcagaatgaattttaaagaggaaatacttttactgtagctttagacattaaggtaccaagtgccaagacatgtttttcttgtcagcaaaaggatagggacttaaaatcaccttcgggtcgtgtaggttttctgggttacccacagtggcagccatgaactaaacttgggattttccctcttttgaaaacatgtgggtgttgtgttctgctttacctctcacatctggtgatcagagctctagg

SEQ ID NO: 13014 - DNA, 1222 bp, Homo sapiens
tggaaacaacctcccacagataccacagatacctcttacggataccaaaggatgactgactggactatattacatttgtgaatgtagattaaagtatttaaattataataatccctcttttaagaatagtaaggctaaaaatcttatgagagatgtagagttttaaattttgaaatataacaaatggataaataaacaaaagaatgcctaaatagtcttttcaatttatgtcatccaggacattaaaaagaaaaacctcacactgaagtggtcagcgtgagtaatcagaatggctgtactgtgctgatagaattctgggaacagcaaagaaatgtgactttttgttagactgcatagtttttcctagagaaactatatttccttttgaaatattgaaaatggtttatgtatctccatgactgtcctgggactgagatttgccaattgcttacattagacacctctctaatgtgtagaattaatttcttagttgggtgttaattgaaattttatatgtaagtagctgagagtcctcattttaatcacaataagaggagtgaaatcctcaaagaagctgctctgaggaacagtggattggtctcaacatgaaacagtgaatggctggtcttcaggcccgacctctgaggtaatgtctcagaactgagttttcaataaaatagataaagaatttttattaagtttcctgagctggaaacacatccatcctctcattttgctggacaatatgtttgccattaagggcctgcccgtctcagggagagctcaaggcaacgtggagggcatgcaaccctgcctcagggggaagtgaagcttgcctgaatcccagttgcattacaggtcctggtggaggtgctgaccttttgcccttgtccttgggaaattcatcagttcctagagctactagagattgcaagacattatctcattcagccctctgactccaagtaggaattcacttaaattatctctggcaaaggagaatgtcctcatgtactactagtataattaaaaattaattttaaagattttaaatcacctgtgggagattttgttctacctattcctaagatctgtagggatagtgagttgccttgctatcctatgagaagtgatgataattagagcttacatatattgagcattttttttcctgcgtgccagatactgaaataaagactttctgtgcattcacttatttaat

SEQ ID NO: 13015 - DNA, 3184 bp, Homo sapiens
cctttctgataagccaaagccatcctctaatactaagaactatacaggagagagccaagctaagcatgtagctgctggcactgccttccctcagagaactgaactgttttcggaacctcggccaacagggatgtctctttataatagtttggagacagctactagcacagaagaagagatggaactctagaaaccaatttctacactaaagttgtcaaatgttagaagaatcctgtgttcagttatgagactctttgcatagtatagggacttgaaagttttatgagacgggtgtaataatatctccacctgtgatttgggggtgggactcttattttgggtagccatttattgacttcacctttttgccaaggacgtttgtctcaagggaaaagcagttttctgtggggcttattaaaggaatgttggtttacattgtcttcaaagacaagtatagaagctgtatgtgtaagggtgacttaaatcatatgtcacattgtctaaactattcagacacttggagaatattctccttgaattaaaaaagatgattaagaaggatgctcctacaactgtatcctgacagttaagtcacagcttaatgtgtagatatgagctgtttacagtggtgactatatataattggggagaagaagggaagagagcagcagtagcttaagcctgttgctaagaaatttaatttcttagcaacttgtaatttagttatcaattcaatatagctctgttgattaaatagccgatagtattgtggctctcctctttgactatgaaaatatagagaaagttttttctttaaggcttttttgccttgtgccactgttgctccttggtttcccttgcgtaattgataagcccagttattcagtaatgtttacaaattaattgactttgatagttaaaagattatgaggtaacccatctgcaatttgcctgtgggagaagcatcctttagttcatcttaaggaagtgctttatcagctaaacccaacattgataactttggtaatttttttaaaaagttatacttgtattagcaagtttttttttttttcccccaccgcaacctccatctcccgggttcaagcaattctcctgcctcaccctcccaagtagctgggattacaggtgcccacctccacgcccagctaatttttgtatttttaatagagaccggttttgccatgttggccaggctggtctcgaactcctgacctcaggtgatctgcccaccccagcctcccaaaatgctgggattacaggcgtgagccacggcacgcagccagcaagttgtttttaaatgttaatatagaaaacagtgaaggattagctgaaaatatatgagcaggtgacattgaggtttactgaaatagccaatttgactggtgcttagactattgtgcagtaaacctaaaaggtagtggagaattgcttcctgctagcaggaagccttcatcttcttgagtacccaaaccaggcttcaggtgtcctttgaggatagccaggtttgaaatttttagtttctcaggaagagctcttctatgtggcaggggctgatagggcaaaataaaatgacaatttctttattgctacagagtatcctctataagttattaaacgagtgtaatggtataatgcccttccatcacacaacaggacaccaccccagttttgttttctgggtttcttccccctttgtaggaatcagataccttttgtagaaaaaaatggcttatgccacgtaaaggtgaatttttagaaaccaccttctaggcgtttttggaacccttactgaaatccctccccttgttacagatggcgtagaagtcacaagtctgttaattggactgttgcttctttgcctgttcctgctttctctttctgtctggatagtcaggaaaagatttaatgtttaatatttaaacaaaatatttaatgtctatacagtaaaattattcaaacttcaaaccagtattgaaagcagttggaaaccagctaatagtttcttaatctcagatttcgagatgaatgtaaactgtattcttttgaaatgtgcaagtgtttgattcatgccatttgataaacttctgccttgtagtcattgtttgatgggaccaacttgtaaagtatgagccttaaataaatctccatgctgaaaaatgtgttctaatgcaacacaaaaacatgaagtgactgcccagaggtagagttagtgtttaggtggaaagggagatgacagctttccaaagaaggacctaaaacacaccaagattgtcttctacaggaattgctgggcaggtctccgactaaaggtcttatgatgaaaaggaagaaacaagcccccaacacaaggctctgatactactggtaaatgtaggagagaattaagaatctgttaattaaaatccaaacagagcttatttcagtagtcaagttacctgacatgataattatttctgcaggataattgatgttttatgttcttttttggactttatcttcttgcaaaaatttctacaaaaattgttttcttcatccttgtggtgcttattcatctgagccgtctccacagtcccaatgcctctgctttttgttttacttttgtagcataaggtttttgcttttgctttgccttaagagttccctagggagttaccagggcttttcgttttgtgtagcttttgcagcatggatcaaacattggcttactgtgctaatgtgtgaagagaaaaaattctctaaagcaggtgagctttaatgaacaaatgtgtattttatctgagtttgagtagggtgcgttgtggattttgttttttgggttttttttttttttttgtaattatatgaagaaagtccagttctcataaatattgatcacttaaaaaacttactctttcttgaaaaggtacacatgtaaaatttaggaaaataactaaagtaggggctggaaccataagaagaatgtttatcagcacgttcatttattattttggatttggaacttggctttgtttttcaatagtgacaagaatggttcagttctaggaatgttctggaagatgctgttaattttactttaaaatgagaatctggtgttactgtattttatcgttttcaataaaacttcttaagtgttttggacttttgagatatttgtattactcca

SEQ ID NO: 13016 - DNA, 1369 bp, Homo sapiens
ctacgtgcacctctgcagcaggtgcaggcccagttgtcacccctccagaacatctccccatggattctggcggtattgactcttcagattcagaggtagggatcattctgacttattaaagagctatataaccagttaattccatctgtttgatgcttgacatccctaactagacagatgagggttgaagttagtttttggtggggttggaggtgaacatcaactaccttcctagttccaggtaatatagaacatggagtgaagtgtagataaatgggtctggtgggtcccgaggtcatcttatcacataatgactaatttacattatggaacccagtacaaagtgttccagttagattttccattgtattctgacagttgtacttcatttaatttttgcctcttacagtctgatatcctgttgggcattctggacaacttggacccagtcatgttcttcaaatgcccttccccagagcctgccagcctggaggagctcccagaggtctacccagaaggacccagttccttaccagcctccctttctctgtcagtggggacgtcatcagccaagctggaagccattaatgaactaattcgttttgaccacatatataccaagcccctagtcttagagataccctctgagacagagagccaagctaatgtggtagtgaaaatcgaggaagcacctctcagcccctcagagaatgatcaccctgaattcattgtctcagtgaaggaagaacctgtagaagatgacctcgttccggagctgggtatctcaaatctgctttcatccagccactgcccaaagccatcttcctgcctactggatgcttacagtgactgtggatacgggggttccctttccccattcagtgacatgtcctctctgcttggtgtaaaccattcttgggaggacacttttgccaatgaactctttccccagctgattagtgtctaaggaatgatccaatactgttgcccttttccttgactattacactgcctggaggatagcagagaagcctgtctgtacttcattcaaaaagccaaaatagagagtatacagtcctagagaattcctctatttgttcagatctcatagatgacccccaggtattgtcttttgacatccagcagtccaaggtattgagacatattactggaagtaagaaatattactataattgagaactacagcttttaagattgtacttttatcttaaaagggtggtagttttccctaaaatacttattatgtaagggtcattagacaaatgtcttgaagtagacatggaatttatgaatggttctttatcatttctcttccccctttttggcatcctggcttgcctccagtttt

SEQ ID NO: 13017 - DNA, 1150 bp, Homo sapiens
tgcttgaatccgggaggcggaggttgcagtgagctgagatcacaccactgcactccggcttgggtgacagagcgagaccccgtctcaaaaaaaaaagaaacccaggtctgcctgggttgcttgttcttgtttttgccaagtgaacagaacttggctggttaggattttgacattaattcaagtctaattttgaacaacatataatataggggttcttaacctgagggtcacagactttcagagatagtccatgaactcctgcaagtgtatgcgtattcttgtctatgggcagttacaactttgcctcttccagggttctgtgatgtgtcccctctatacccacaaggaaaaggggaaactctaatctagtagagcattgaataatccattaccaagagtttgagtggggttcaggctgacaagagttgtacggaagtctacaggtctgggtgcctccattgaacatatttattttgtagacatctatcacagccctattctgtaccagacactgtattgctgttgtcttctggagttcagtctcctatggagacagacacatgcatggataaatgataattcttaccaaatgggtttctccaccgaactgagcccttaggccctgaggcatccattgtctataatgaattaacttccctcctgtgcactgcgcagcatccttgggagaagagagaatatagtcactcaaagacttttctgcatttacatggcaaagtgtaagaacttgacactctgaatgcaggatgtgggaaagcagagtatagttccgtttcatagttcattgaaaaatgaaacggagcacctgtcgctgttgaaatgcctgaagagtagcttctcacaccttcccttgtggacctggaccccatggggtctgtttttgctcatttctggatcgaccccctgggttcccactgcctgctatgcatgaggcactcagtattgaatgaataaatgatggagagtggacatcaggcaggcagtgggttttatggattatttatgctttaattgatgagaacaacttgctttggcttggctaataaattctgggattatccttcctttttgattgttatttccagaaacttgcttggatggaaaggatagctctctctctggttcccataga

SEQ ID NO: 13018 - DNA, 1164 bp, Homo sapiens
caccaagtttacactgtttcaagaaatcaaggggttgaggtataaaacagtaacaatacatcaaatactagcctgaaaaatagtatttctctctctcttcctacaaaatgtgaccaccattctgaatttggcattttcatgtccactgtcacatctagcttattctgtccagcatttggctaaatgtattaccaacacttgcgtattcctaaattggggcctttgacttatgagacagcttttgaagtttgtccttctccttaactacaaaccaagtacatattctaccacctgcaaaccagatcactcatcactttcagagtcttctctatctagatccctgccagcccttctgtcttgttgtttccttctactcaggctcaacctgatactaagatataggagaccagaactgttctcagcacttagactggataaaatgttactttcttttcagcagcaaagtgtgggaacgtggctgatgtccactgaggcagggtggttaagaacccaggctcacagcctgcctgggtttaaatcccagctctgccactaacttgtatgtgaccttgagcaaatttctgaacttggcttcctcatctacataaaaaaagaatatctacttcaaaggtagttgtaagggtcagatgagttagcctataaaactagcagaacagtgcctggaacgaggcaagcacatagtaaatgttagtggctgttattttctgttttagtagttgtgtcggggacggctatggaagtataacatacattatctccaatcttaacaacaaccttataatgtcagtattagtgtcctcgtgtgtggctgatgcaacaaagatggaaagaattccagctgtgctaggatggctgagccaggtggcactggtctgcatgggtctaaagctttgctggttgccctcggtcctgctcccttctcttttgacaggccctgggaaccagctctatccttttggcctaaagctttggcgcagttgaggtgagagttgggcacaccctcttttcaagcatacgagacaaggcaaggccaagaccttactaattcggctggtaaaggtatcacaagccacttttggattcaggcagtttattacttacatagacagcaaaagaaagagtagccaaaggtgccagctcccc

SEQ ID NO: 13019 - DNA, 1161 bp, Homo sapiens
ccaggggtagcctttaaacagcctgttaattacactggtgatttctgtggtctctgcatagagtccgggatgtgtttccagatcctcttgcgtaagttgaagtagacatgttgttgaagtctagaagccaaacaatcttggatactaacatagctagtctcgtctgtaattgctacttagtgttaaatttatggtatttcacagcaatttagattggcatttatatgggaattgtgctgttttctttccctagatcctattgggcagtttccaccttggatcaccatcacttacaaggcagtaaaaaagcatgcataacatacatttataatggctctatagtgttctccccagtgctcagctcattgtgctgaaataaaattccccttgggttgaaaaactgtccccactcttaaaattttaagttttgacgttacttttggctatagcatctgagaaatacacaatatgagtcaagcaaatgtgtagcttgcctgctgaagttttctttccattttatttcctagatgcacccactgggcctatgtaataacaatgacgaagaggacttgtatgaatatggctgggtaggagtggtgaagctggaacagccagaattggacccgaaaccatgcctcactgtcctaggcaaggtaagcaccaggcccttggaatcactgtgtttctggttggtgttttccactcttccatttcagcattcctcaaatagttgattatggagaagagccatgctggcacagtgctccttcccggctgaagttgcatgaggtggggactgagacatgccttgcagtggcccaccagtgtttacaagcccagactgaaagagactgccagtctcagagcgggctctaccctcttgtccattgtgtggccttgggcaagttgcttcccctcaaggagtcttagtctcttgtctgtgaaatgggctaataatagagattcacaatactttatcttacacccttgggccagatgtttcagaattctgagatttggggggtttagaaaggcattaaggggtatagattttatattaagtaacctccaagagacatggggaggcactcagtaaccaaacacattcacatttgtatagcaaaccatagagatcttcacattaagtgggataactaaaat

SEQ ID NO: 13020 - DNA, 1687 bp, Homo sapiens
ctctctacatccaagtgagaggctggctctccaggaggtacctgtgctctcagcacaaatggagcccctctgggaacaggaacctgcttcagccctttagcatacacaggcctgccacatgctggggacagggccacctgagtcccttgcctggtcccatgtgtggtgccagctccctcccctgatgattgttctctctctttcccaggaccgagatctcactcagcagacagcagcagcccgggagcctgagctcaggaggaactcttacctggaaattgggaactgtatggagactccaaactgacttctttcaaaaaacaaaaacaaaaaatttttttagctttgacaaacacacaaaagtggtaataaagagagccctccttgtcaacccaaaatgtgagccccctgtggcaaaaccaccccctaccccattaacaaatcaacagacaaaattctccgagtcctttgcctcttttgataacatgttgttctgttttgtaaagtgtgtgtgcttggggttccgaggtgtgggattgagttctctgctttgtttttttttaagatattgtatgtaaatgtaaaaagttatttaaatatatattttaaagaaccctaactgccaacttttgctgaaaaagaaaaaaaaatcactgctgcattaaatgaaccacatcatgtgtagatactgttgtctccctgaagggagctcaggcctttgaaaagctcagggcttcacctgccttagaaaatgaaccagaaacttgaagtaaagctagttgataggggtacaggctctgaggagcagtgcaaaactgcctctttctttctcgtggcaaatcccaatgtacacgatttcaggtctcagacgccatgcctctccagcccacgcctttaggcaggtgatggcagcagctaggaatagggtgtacatgatccacagccctgcggagccaggtcaagccgctgctatgaaagctccagggtgatggggacgattctgcccagtgtcctcagtctgtcccctcaggtcatggtcccaagtgaaatgacagagttcacagccctggtcttggctgaggtccaggtcatagtaagggcatgttcttggggccctcgacctgaactctgaccctccgggcagggaagaggaggttgtcccctttggttgtcctggctttggagtcctttgcaaaaatattttgggccccctgccactggctgcagaaatggctcgacggggtgtgtggggacagacacccagaaggaatgtacttttgtggccttggtgtccgatggggctgggggagagtgctctccactgacccagcagcacacccatgtgcagtgcgcctgcatctgtgtgggggcagccacaccccttggctgctgcttccttgggctgcctttctgggggcatgtgactggacctacgaggtctgcactgagctccatttgaatgatacctttcctatcccatttcccccacggaagcaccgcttcagggttattcagtcctctgcctcatggctgaaattgctcatctcgtctgcagatgtctactatcctgtctacctaatgcactattatgtattgattctccatgagacagagagagagagagactatcagatagtttacacccaaagggtaggtttttgtatatttttccagccttttttattaa

SEQ ID NO: 13021 - DNA, 1096 bp, Homo sapiens
ctactcgaagttcgtgcaggactaatgcttttaaaatgaggtctaaaaaataattactagtcgagactattattctttaaacagaactgcctttttctactctttatgtaaactctttctattgtgttggtctaacaaggcactattttaaaattttttaatttttcccatagcacttaaaagagattttgtaaagaccttgctgtaaagattttgtaataaaatggtctaagggctctttttccaacattaccatttttaaaaaatgttttaaaagctagaagacaacttatgtatattctgtatatgtatagcagcacatttcatttatggaaatatgttctcagaatatttatttactaatatatttatcttaagccatgtcttatgttgagagtgtgacattgttggaataatcattgaaaatgactaacacaagaccctgtaaatacatgataattgcacacagattttacatatttgcagaccaaaaatgatttaaaacaagttgtagtcttctatggttttgtaacaaattgtacacatgactgtaaaaaaaaaatacaattttatcaagtatgtgttatatgttgtcattggtctgttcagtaaaagtctgcagattcaacaaggggaggtttgcatggggcagtacttttaacttctactcgtccatggaagcattcatataactttctctcctgttaatatagagtccaggttattgggggtttaggcagtgtcacaggagagcatctgttataaggtgtgtgggtttacatccttgtgagaatggtaggctttctgctcagccctatgtagaaggagctagggaaagtgatagtgattgagcctaggggtccactttttattttttatttatatttatttatttatttatttatttttgagacagagtctcactctgtcgcccaggctggagtgcagcggcgcaatctcggctcactgcaaactccgcctcccaggttcaagccattctcctgcctcagcctcctgagtagctgggactacaggtgctccccaccacgcccggctaattttttttttttttttttgtatttttagtagagacggg

SEQ ID NO: 13022 - DNA, 1106 bp, Homo sapiens
tgacttcacccgccctgtcccccacgtcaggacaggcttgaggcctctctgggcgtgagcgaggaaaccaggctgctctaacttctgaagagtgggctctggctcaagactccaatcggccagaagcccacagagatcaaagcactagcaagttcagctgtcctggccctcgggtagaacccacgggcgtgcctgggtgcggctccacccacatgccccactgtcagcccaggcaggagccttcctggccgggctcaggatctgcctgcagcccagccaggccatcacccagccccgatgcatcctggcactgcacgcttactcttcacaagcacttatacgcggatggcctccgagaccctgcctccctggtctgctgaggtcaggccaggtctcccacggagccgggcagctccacaccccaccacctggcaccgttaggtttcagatctcccgtgtggtgtttgatgtcggcttttgttcctaccttgggagtttggattgtttcctctggtgtctttgtttaccttcctcactgttctacctcctggccaggtctcagcttagcttccctggtgtggggtgtttttcaagccttccagccacagctgtctcccctcaggctggacggctccggggtgacagggcttcaccctctgcctgcagacccctggtgggcacatctcacaggcttccgtcttgctgagttgggtacggaggcagaagtggggtgtggaggaaagtcagagggaaatctgcttcagaaaggaagggtctttagacacaaagactggaggcccttccccgcccgcacgggagctgccatcgtgggtctcatgcacgtcaagaccttcccacatccaaactcagcttccagcagggattttgactttggatgacaaggctttatttgtaaatatgctcttaatatgcaactttgagaataaaatagaaacatcatgtattttaaaatataagatgaagtgtgacgcactgtatacaatttaatatatatttttagggttttgttatttaagaaaatggaatgtaatggtacttttacaaacgagaaaaaatgttatttttactttctggaaaaaataaat

SEQ ID NO: 13023 - DNA, 1652 bp, Homo sapiens
atttccatggacaatctgttgagctcaagccatcttctaaaacatggaaatgtcatctttgtggcatatattaagtggcagtttattttctttccctgccagtatacttcgttgggtcggggagaacaaagaatggttttgaaaccagagctttcagttcccttcatggtttccagaggtgagaagcctctgtgggtagtagatttgggatggaacacacacaacccttctaatgaccctaagttgttaactaactgcctttgaatggttgtcttgaaatacctggtgtatatactgcagaaaaggaatgcagctgttttccacagtgtttgtccccaacttctgtttgtactcagaatcgttgaacatatgaagattttggtcccataatccttaaactatagcctgaggtgcacctgattacatagagtttggatggagcaaagaaaaatccaatagcattttgcagagtaatgtatataattatgggctcacttcctactggagatgttgaaagtctaaatcggtttgaccattttgattgatggcacaatctggtttagaaaactttgtttagatcaatgacataaccctgctgcctctgcctgcccttcccctcccttctcccatccccttttccctatctggtgtctgtactttgatgaaggtgagctataatattggtggttaacataatccagaaggcttagttctgtgtgtgttctgtccctatataaactggtaaagaaaaaaaaaagttatgcagaatgttagatatttacatttgatacggtgtgccactattcaaggaaaaattaaatagcattttttaaaaaacagaatgaacttcaaaattaaagttgatttttaacttccatattagcaaatactcttcactactgaaagacagtactattttgcatattctgcataactttaagaaagtctttagtgaaatctttattggaagaaagtcatttgacaacaggcaaaaatttaatgattcggtatgaagtaaaatcaatcttctgatttggaaaatactctattataaaggtttcacttctttttggatgttttaaaatagacatagacacttgaaagtactatcatcacgtctcaaatcacctagaattcctagtatttttaaattgcaaatacaatttcaagtttatttaaatactccagaagttataatcctactaattgtgctagactttgctagtagagggggcccctctttctggatgagaagtctctcttgcagccatagaagagaccatggctttccccataggtttttcaacagactgtgaagcagtctgtcggatcctgtggggatagacgggcatttccctcgttgcccccctttttattgtggtgtggtgatggttttcagtgtcttgtacaggtaaggcactcaatgttgttaacatgccctttttcattgcctcagtattttgatattttcattggctgttaaacgtggaaactttttaacatgctttgtcgcatttatatgctacaggttacaaagtgagagccttgtatacacttcaatacttaaaaagtacccgtactcagtactcagccggcagcataatgaaaagtgggactagacacggtgtccatatggagaggaaaaatataca

SEQ ID NO: 13024 - DNA, 1098 bp, Homo sapiens
gtgcgggtcattttgagtttaatgaatccccatcaaatggtggtatagtagatagctatgtgtgtttgtaaggtttgtagcttgcaagacgtgcactaataatattttatatgatctttcctggttggcaggacccatggatgaaggaccagatcttgatctaggtaattttgaattctagttgtgcttcatatcgtgctttgtaaattaatggtacagaggtaaatgcatgcgtagagttcagcagccttatagaccagtgtgatattcttgctgtcaaggacagtttgggaaatcctatgtgagcatctactcataattgccttaagtgaagtaaaccaaaagtttgatagcattcttcttagtatgcttggtagttttcttagatttatgatgaatatccttgggcagtagtgatcaggtagttaagaaacccctatagatacatgataataattctcctgtcttgttgtctctgaaaggcccacctgtagatccagatgaagactctgacaacagtgcaatttatgtacaaggattaaatgacagtgtgactctagatgatctggcagacttctttaagcagtgtggggttgttaaggtcagtaaaagcataaccaggtcatctggcagaactttaaaccacagagcattttaaagagattgaattgatgttgagagttgttttctaaggttgcctttgcctgacttctttctaggtatcttatggtttgttcctttttaaaaaagattagcctttttttttttttttttttgagacggagtttccttcttggtgcccaggctggagtgcaatggcgcaagtcttggctcactgcaacctctgttcaagcgaatctcctgcctcagcctcccaagtagctgggattacaggtgtgcgccaccagctaattgtgtctttttagtaaagatggggtttcaccgtgttgggcaggcgggtctcaaactcctgacctcaggtgatctgcccaccttggcgcctcccaaagtgctgggattacaggtgtgatcccctacgcccggccttccctcctccacccctagggacagagtgttgctcaatctcagcctcccagg

SEQ ID NO: 13025 - DNA, 1177 bp, Homo sapiens
cggccacgctgcgccgcctggacgccgggctcctccacccacagctctgcgaccttcacgagctcgaccctttctgcgcctcagtttcctcatctataaaatggagataatgcctccgcgcgctgagcccgagcgcggtcgtgctgttacactattgctgctgctatgtcgttaatgacggcacagcccttatggaaggggggccaaggaaggcacggggaccttcccgcaggacatggggtgggcaccagccctaagccatgcacataacccactctgaggtcaggacctgggttcctttcgtgtccactgggggccttagccgttgtcttcacttctctaggtcccagcccttcacaatgggcgcgcctccctgcctgagagggaggccccagccaagccccagtttccaccgcaaaaagccacacagcaaacacttaatggaccctaaatttataaaaattatcccatagagtcctatgaggcagggaatgttactgtacccatttcgcagatgaggaaacttggggcaccgacatttcccagagccaacatgtaaaccaggcatttggcctgagtgacagactggtgcaggtggccagcagcttaatttgtactgagcgcttactgggtccccacagcgatcctgaactgtgttcctgcccacagtgactcggccggtccgggcatggcagacccagtggcgggcatcgcgggctcggcggccaagagcgtgcggccatttcgctccagtgaggcctacgtggaggccatgaaggaggacctggccgagtggctcaatgccttgtacggcctgggtctcccgggtggtggcgatggcttcctgacagggctggccacgggcacgaccctgtgccaacatgccaacgccgtgaccgaggctgcccgtgcattggcagccgcccgcccggcccgaggtgtggccttccaggcgcacagtgtagtgcctggctccttcatggcgcgcgacaacgtggccaccttcatcggctggtgccgcgtggagctgggtgtgccggaggtgctcatgtttgagactgaggacctggtgctgcgcaagaacgagaagagcgtggtgctgtgcctgctggaggtggcgcggcgtggggcacgcctgggcctgctggccccacgcctcgtgcagtttgagcaggag

SEQ ID NO: 13026 - DNA, 1206 bp, Homo sapiens
tcctcttcgtccctcagcgtcctgggtggcaaatgtggccaacctggggactctggccggacggccaatgggctgcctgggccccgaagccaagccctttccagctcctccgatgaaggcagcccctgccctggcatgggggggccactagatgcacctgggagccccctggcttgcactgaaccctcgaggacctgggcacggggtcggatggacacacagccagaccgtaaaccctcacgtatccccacgcctcggggcccccgccgcccctccggacccgcagagctggggacatggcatgccctgcactcagtcaccccgagggctgagccagattcctggatgtgatggaccagctcagctgtccccagaccccatcccttctccttttcctttgtggccttaacccttctgcatcagggagccccctctgcctcttgagtaccagacctcatgggaccagaccccttgggaccacatggcacaatgggacctctgttgtacattccggttgggggatgagcgttgctatttaattactaatattattgaatgccttagaggaggccgggcgagcccggtgttctgaagacctgtggcccagcagagcctctgacagtaaagttttgctccagccacctgtctgtttcttggggactccaccttggggccattcagaccctttcgaggaccctggagttaactgcctggaggccaagcctggcaactctgacctctaggcttaaggcgttatcccgcccagcccagaaatcccaggcgcactcaaattattttcccttttattatcccgtggtaggtgtggcataaagaatatgtccagtgaagctccaggagcaggctgcgtgtttccagtcaagttcatagccaagtcctttccatccaatgggattgtgacccattgaggtcccagaaaggactggtcatctccaatggagcttgggacctggttgggtccaatgaggttcaaaagggggccagtcgcttaggagactgggttggagctttcctcatccaatcagggcggagacttccctgtccagtcccagtgaagttgggcgatcccgtccaatccaggtccctgattgtcccagtcacaaggtggggcccatggatggcactgtccgatcgggtcacatgaggctgcagcgcgcgggatgcagcgccccctgcaggcgcagggcc

SEQ ID NO: 13027 - DNA, 1115 bp, Homo sapiens
acgaccctatctacgtgaagctggagaagctggacatcatgatccgcctggcctctcaggccaacatcgcccaggtcagctgcgtgtgatggtcaggacacgggctcagtgtgggaccattccaccaccaccagactgtaggctctggcccaggtgaccagtctcaccattaacggtttatctcatgaagagtgtttagcatgggacatggggcttcgtaagcaagtaaaagaactgatgtttttattactaaagaatgtttctccatgttatcacctgtcatcccttacaacgtggtgttggatatgttagctaaatcaaccccaaacaaggttgtccaggccttctttccttttcaggcacctgccagctctctcccttgggccttctacctggagcaggaggcagaatcccattctcctagggagtctgtgtatattcactgcccaggagtgttccagcagattgccccatcaggtgccccagccccatcttttctgtttgggccacaggtgttggcagagctgaaagagtacgcaacagaagtggatgtggactttgtacggaaggctgtgcgtgctattggccgctgcgccatcaaggtggaggtgaggctctgggactctgtccttggctggagaaggaaaagggggctgaaaccgggaaaccagtctgattcaagcagaatctgccagcttgcttgtggtctgggaaggcctgaggctcatcactggagcccccatggcaagcattgtgcagatctggtggggttccttctcactctatagtatcctttaggccttcgagttgctgccgatcaaattaacccatcataatcatggttctcctgcagcatttgttaagatgctggggcagccacaagttaatggacttagcattcacttcacagagctctggggtaagggccctgcctgttgaacacttcttggcaaatattgtcatcattcagctgcccacgtgcctctgtgtcccagcgtcccagggccactctagactcctgtgtcctggcattttatccccgtcctttctctgtctgtggagatgttcctcgaccactaagccagattctccttaaatgggtccactggtggcta

SEQ ID NO: 13028 - DNA, 1795 bp, Homo sapiens
taattttgtatttttagtagagagagggtttctccatgttggtcaggctagtctcgaactcctgacctcaggtgatccgcctgtcttggcctctctaagtgctgggattataggcacaagccaccatgcctggccaacagataactattaaaatttaagaaaatgttattctcatcaccaccaaagtcctgtcttatcccataatttgagggatctggtgctcttcatgggcccttccacgagggcaatgggacattcctgtcgcagcatctggggcctcctcctgcccactcaaaggccagcatgtgtgggtggggccaggggaggttgttggcttgcttgagccccctgtgtgacctctgccttctctctccgcagtccccctggtgcgacacatggagtctaggatcatgatccccttgaagatctcgcctctgcagtgatgctgcctacacctccacctccttccccttctccctcaggcaaccccgacagacagtggcactcctggtcctgctgtcttggttttgtcttggctctgggaggactctgaggggcagtgctcagttcagacaagggggaactgaaggctgacaagttctgaggattacagctctgcccaggccctttctactttccctgcctgcctccctccccctgctagaagtagtttctgatttccctgaatgaaagatagtgatcttttaggccttcatttatcttctaaaattcctcatctcaaggccaccagtccccagttatcacccttggaaatcctctgtttagcttagttgcacaaaaggtagtatgtccagtggctagaggtggggtgggaagagaggaggccaggccaggccctcaggaattccctggtttccactgggccacccacttgctggacagtctgagccaagtccctcctgctggagaaaagcctggaactgccaaaacaaaaaaacaaatacaaacaaacctcgtcaccacggtcaggaggaggttcagacattctgcccagaggggctggggaaagggatgggagccaggaaagatttaggggcaggagacagacacgtaacaggaactcggaaggtagaacttagaattcagaacttgggtttcaattgtagaatttggaatctggaatacagaattgggaagaagaacagagatgacaaaagaccacttgaagagaggttcctaatactagacagatggagagtggcttggctgtttccccctgcatattggggttgaaaacttaaatgtgtagttccagtccttctatgcagagtctctcctgccctccctccttcctgcaggcaaatatacaagctagaccctgttccctcaccctgtatcctgtctcccctaattgacattctatcagcccaaccctcattctgcagggccacctggtgtgtggaggtggcgggaggggtcagtgactctgggggtctcctcagtgacccccatacctcatcatgaacccttgggtagcttgattctgcctaccatccaggaaaacttgtgctggaattgctgatggaaacaattaaatatttactataaatcagtgtcttttcttcatctgcaaggaactttagcaggtgcctgaggcagggcacagtagagctggtgggcttagtcccacatggcagatctaccctcctggagggtactgtgttcttgagctattctcaacagtcagtactggttgggtgcagtggctcacgcctgtaatcccagcattttggaagtccgaggtgggcagatcacttgagtgaggtcaggagtt

SEQ ID NO: 13029 - DNA, 1206 bp, Homo sapiens
ggtttcccgggtaaggtcagcagaggtccgccgcctcaaccagtcttgttagagtaggcacaaaagcattcagagtgactgccactgtagccactcaacgccgagcctaggcctgctttttttgcagttagagtgaaactttccattggtggagtcaccccaaaggaggcgggacggagcgggaaagtcctgcctaccttggccttcccagccaatcgcagcatctatgcgtcagcctccggttcggttgcgctgcgcgtagtggtctgggcgacctgagggcggggccgggagcaggccccgggctgtggggagggtgcgcttcccgcgggcgcgcggagtgaggacggtgacagccacgcgcgcgcgtacgcgcccgatgcagcgcggccccgtgaccctagtcggccgctgagaggcgcgcggagtctgggccgctgccgtctaggggtcccgtcccgaggcgtccccggcatctccggcccgaatcccggagtgccgggtcgcgcctgcaccgaaggtcccggctcctgtgccctccctgcagccgtcagggcccgtcccccaactcccctttccgctcaggcagggtcctcgcggcccatgctggccgctggggacccgcgcagcccagaccgttcccgggccgggcagccggccaccatggtggccctgaggcctgtgcagcaactccaggggggctaaagggctcagagtgcaggccgtggggcgcgagggtcccgggcctgagccccgcgccatggccggggccatcgcttcccgcatgagcttcagctctctcaagaggaagcaacccaagacgttcaccgtgaggatcgtcaccatggacgccgagatggagttcaattgcgaggtaaccggccggcagccccgactgctgcggtgacagtcgaggtggaagctcgagaggttctctttatatcatcttatgggtgtagctagagacgggcagaaccggaagggccaactaggcccaaaacctcatgttaaagatgattgctgctttttttcataggacttttgggttttggcatttcctgaaggttattttcattcattgttattggaagaagctggatgctcctgtgatagaaaattcaggatttcagtgtcaggcttaagttaggcttacgcttaaaagcttgaaagtttattctttcattaggtaatattgttatgtaccca

SEQ ID NO: 13030 - DNA, 1108 bp, Homo sapiens
taggtgtgagccaccacgcccagcgctctaagccgtattctatcacggacctaaatattggcagtaggcaccaagaaaaaagaaataaaggaagattccactacttcagataattaaaaaaccttccacctaccataaaggacagtgtccaagactgctgagtgatacatttctagtttttaactattctgtggccctgagaacatttatgccttaatcctagctctgctcacttcttggggctattgattaatttgtttcagaaacaccataggaagtgaatattacctcttgctataggtgactttgtgaatacttcaaactgtaaaatcacaactttcaggaaatgtgataaatttagtgggaaaaaaatttaatgcacgccttgcaaaggcttctttgagggtagcacaggaggaagtgccaatatagtgtgtttgtcttttgctctgcaattctgcaggtactggatcatgatgtttcaaaggaagaaccagtcacctttcacttcttggccaaattttatcctgagaatgctgaagaggagctggttcaggagatcacacaacatttattcttcttacaggtacatcagtcaaggctaccccccagttctgagagaacttgcccaggagtggttgcagagttggcctcagagttgaccacaaacacctttgtattgcaaaaatattctacctctggaaggtcagcccctttggttctgtaatggaaaaaaggcttcagaacagaactatacttgagtgatgaaaattggtgtcagatgaaattgtgaaggtgtgatggtgaagaatggatacaagtagctacctaacttaaaacctccttgaaaatgggtcctattttcttctagctaacttaaaagtactcaatagtttcaaaggaaggctaaagagagagtcttataaagcagtagttcttccaaaagtttaaaatctgctctcattaagagaggactggccgggcatggtggctcaggcctgtaatcccagcactttaggaggccgaggcgggcagatcacaaggtcaggagatcgagaccatctggctaacatggtgaaaccccgtctctactaaatatacaaaaatt

SEQ ID NO: 13031 - DNA, 1191 bp, Homo sapiens
gctggagcagagtgtattcagcttggggaattgagctgtttgcagtggcgaggggcggatagaggagatgaggtaggggtgggcattgtggtttttaatcctcagtgttgttcatcttattcattagccacagaagcaggcccgccctcccttttgctcctgccgattttacagccctcactcatctgtcactgggtaataaaggcccgtttctcacctctcactctctttacctgtccctcgatggcttctgagcatgtgaaggcctgagatgagtgagcattgcttctgactgagctccgctgtcagaggtggtctctgtgatgtatcgcccaggcagggacaggggcactgccagatgagggttgcacctaggtctgagttatcatgcagctttctgagttgctcctccaatagaatggtgccttatttacacgccctctctctgtgtgactatctccctgggtgtagctttttaaaaatagctttactgttttgtaaaaatgatgcataattataaaagtggcaaacaataccaaatttacttcatgtgtaggttttttattttgctctattttttggtaggtaataaatctgtatcagatgactccggaaatgtgggaggagagaattactgcttggtacgcagagcaccgaggccgagccaggtgaggcccattcattgttggtttacattcctttatgggcttttttttttttttttgccttaaagaactgcaaaactaggacatgcttgttaaacaaaatgcagtactgaagtctataaaagaaaaggggagagctggggagctgggagtaacgttggtcttcagttttgtgtgtgtccttttctagtacgtatgacataaagtaggtatgtgtactgcctgtcaagatatatagacctgtactcactggtaattaagtttaagatttttttttttttttgagacagagtcttgctctgttgtccaggctgaaatgcagtggcgccatctcagctcactgcagccttgacctcctgggttcaagcaaacctcctgcctcagcacccccagtagctggcactacaggcacacgccaccatgcccagctagtttttctatttttagtagagatggggtttcaacatgttacccaggctggtcttcaactcctgggctcaaagcaatctgcccacctcggcctccc

SEQ ID NO: 13032 - DNA, 2425 bp, Homo sapiens
tgggtgccacccagccacttagggtctacagggtgggactccagacctagagcgtaagtatggatgttgtggccctgtgtcttcctagtgtgacccagccaggagcggaagcttcaggcgtttgtaaagtgaggtctggctctgcctcctccgttttttttttttttctgtttctgtttctgttttttttttgagatggagtctcgctctgtcgcccaggctggagtgcagtgtcacgatctcagctcactgcaacctccgcctcccaggtacaagagattctcctgcctcagcctcccgagtagctgggactacaggcgtgtgccaccatgcctggctaatttttgtatttttagtagagatggggtttcgccatgttagccagactggtctcgaactcctgacctcaggtgatcctcccaccccggcttcccaaagttctgggattataggcgtgagccaccatgcccggtctcttctcagtcttgaagcccatccctggatttccaccaggagttactttcctcctgacctgtaaatttgttctttaacaatggctgcaggtgggagcatatggtggtttataaaaacgctgtcgggctttgtttccttctttagctgccgtgtctacttctgaagtctgggaagtgccaagccacgcggcctcaagggagctggctggtgtttgagctgtggcagaagcacctggggctccagggagcaggctgggaactgcaggaccttgctcagccaggagcacttccccctccttgaggcaggaatactgaggtgcctccccacagatggagaaggtggagaggaggatgggcctcaggagcatctcaagccccagtagcaggagaaagaaagaaagagatgcctggttttcacagactggttcctgtggctgggatgactgcatccttttttttttttttttgagacggagtttttgcctttgtcgcccaggctggagtgcaatggcgtgatctcggctcaccgcaacctccgcctcccggattcaagcaattctcctgcctcagcctcccgagtagctgggattacaggcacgcacctccacgtccggctaattttgtatttttagtggagacggggtttctccatgtcggtcaggctggtctcgaactcccgacctcaggtgatctgcccacctcggcctcccaaagtgctgggattacaggcatgagccaccgcgcttggccagactgcgtcctttttaagcgaacattttagggcctgggagtttgtcaagtaaggaagtctcaagcccaaagagcagcgtcctgaccatggtggtttcattacgagcccttctgctggctctcaggcagaagccccacagcaccgggaccattcatgaggtcactgcccagctcatgatgtccgtgaggctgtccttttggccagtagccgtgtgcagctgtgtggcacagatggcttcgttcatcctgatcaaggccccacctcagccacagcagtccccccaacctgtgttgtccaccctattattcatgtacctgccaggccctgctagatagcaccccgtggcattacataacacttcatgagtggctgtgtcttgtaattttggggacaggtttctctctttccctctcttttttttgtcaaaagcccagagactgacaaccagctgcagtgtctaagtgttcctcactgacagggtggggcctcaccacccctggagggagcagcgttggcagggagacagcctggcccagtgaccctgggcccaagccagcccctccagggctttcagggaagcgccatccattttcaaagatgtcaaacgtcacttcttcctgtagggcccgagtcctgcctcctatcagggccagatcatagaaggctattttctattctggggaacgattataacttaaatgattgttttaataaaaattctaagctggaaaatacttgccttgggcttcctcagtttgcctgttgctcaggccattgaggcgtcaagaacacggctgggtggtggggctgtcttgtggttctgtggagaaacgagccctctgctgtctctcactgcttgggccttcacctctggccccttgtctttggtggcaaaagaatcacctccttccacagacctctaatgacaccttcgccagggaactgcctccctcttcctggggcacttggggggtggcaagggccctgcatggcgtcccagcactccatttcctctctgtggtccctgcccatccgtgatttcagaccagagaactagggagctgggctgggtgatccttccagacatttctgttttcggcgttccaggctctgggggtgcatgcagagcccctggggcccaggcgctgtctgcagagtaaatgaggcgcagccactgtcagggctatgtgacatttgcact

SEQ ID NO: 13033 - DNA, 1156 bp, Homo sapiens
cagaccactgtggtgacagactttctttataaacatttggaagttttctcccccatcttcttaagaagcaggggggcaggtggaggagagtgaggggagagctgcccggtgcagacccaggacgagggctgcacttggtgtggccgtgtcctgagcctcagtgaggctgggcagatggtctcggagcctccatggggcgtagcaggaaccgggcttggcttcctattgtgactgatgagaaaagtgaccacgtgggggtcagtcgggggcaaggggctcagccccactggactctgggctgcagaggccaccccccaggtgggggtgcccgcagggatggaggcagctcctgaactggtggccagcccacggggtactggaagacagtggttctgatgggttcagccctagagagagagagagaagcggggagaataagagtgcactacagcccaggcttatgccacccccagcccacctgcctcaccaccctggctgtggggagggtcagctgcctgcatgacttttctggaaggcagagcctcgaaaataggcagaccgtttgagccagcgacctcacctctaggaactgagcccaaggaaatagcggggttgcaggcagacattgagctgcgagacaatgggaataaccttcgtgtccacctgtgggggactgattcaatacatatgcacgtccacagcagagaatgccatgcggcctgtgtaagaattaaggcagatttatatgcactgatgaggaaagacatactgtgtgatagggagaaaaagcagcttataaaataatgtatatagcatgatactatttttgtttaaaaatatataaaatatataaatgcataaaaaaatcctggaagacacagcaaaatgttaacagtggtcctatctgagtggtgccattatgggtgacttttttactcctttatatttctcaaaagttttacgagcacacaagcctttgaaatcagaaaaaaacattgtctaaatttttttttaaagcctaatttctcatgctactcactgtcctcctcctcaacgtccaccccgagccacctcccctggaacttggggtccatgtaagtacttgccctaggagaggcatcctccgtgcccagcccggggcaccctgccaaggccc

SEQ ID NO: 13034 - DNA, 1203 bp, Homo sapiens
agttggactgtgaagaaacatggcggccgcgacgttgacttcgaaattgtactccctgctgttccgcaggacctccaccttcgccctcaccatcatcgtgggcgtcatgttcttcgagcgcgccttcgatcaaggcgcggacgctatctacgaccacatcaacgagggggtgagggcctgtgccatccctgaccttggacccgcctgaggggtgacagtggagtagaggtgggatgggactcagtatacttttaccaggaagggggtaaggggtaaaccgtcggcgtcttctgtctcgagtccgccgtctgtccccttggcttgatgtgaattctaaaacgttaagcgaggttaatatatttcattttgcaggggttgtaagtattgctgtgtgccaccctacatacccacttgcccattatcagaagcaaaaactaaaggctagtgagagcaaaggacttactagctgcacaggaagccaggggcaagtcagggccagaaacgggacccctgtctctcagagtttcaagggcagatttgagcaggcgacggtcgtgaaaaggacgttagacaccttagacgccgtggctgaagtttcagacggcgcttctggtccccaaggcttcccacgtagacagttggtattaatggttgagagtgggggctatgaaatcagaaagccttggataggaacactggtccttgtcacttaactgtggcattaagttgagcaagtttcttctctgaactccgttttaactgtgagatggagatattaatagtaacctgagcacgattgtgaggattacatgagatgcaggcagggtgccacatgcctggtaggtggtaccactgaaaaataatcattgcttacattcctcaggagaaagtggaagcatgaggtaggaatcgcaacacatttttgacttttatgtatcatgcactgtgctaggtgcagtgcatgctttatatcgctaaattatgactgtgctggagtaggccttatacatatagccctgttccaccactcacttgtgtttttaatttgagactgtctgactctgcagcccgggaaggcactgtccactagtgctatgctgcctgtgaccagtgcaacttcctgccccatatgaaagcattgctactgtcccatctcttgcaagtggttctgttaaccactcccattgatctggagagacatcc

SEQ ID NO: 13035 - DNA, 1220 bp, Homo sapiens
gtatttcaataaaatatgtgtatttcaataaaatgttagatcaggaggctctctttaaatgttattttatctatatcaaacacatttaaaccatcaaagcccagacataccagcatatgttgtggcatgccccagttcatcattttgtatgcttaaatcaaaatacttagcacttcagaaaatgatttaccatcaagttttaaatagctacctgatatcatatattctcttttaatttcacagcacattgagtaaaatgtgtctgtaggttttgataccgtaaacatcattactttaattcacacattcactgaatatcaagttccagttcctgtggtaaagaatctctgtagtagagtttatgtgtagcatttaaggtatacattgctcctattctgtgcttttcccaaattattatatatttacagacatagttctttgaagcttagataaattataaacaagtgttcaagtggaattcatgaacgtttaaaagtttgtttgtgtgtgtgtgtgtgtgtgtgtgtgtgtgtgtgtgtgtatgtgtttgtaatttaatagactgcttctcaatctgctgcttctaaaatccctgtaagtagtatgaaaatcctaggcggttgctgcacctgtgcttggagcaaattggttttgagtgttagatgctcaccttgcaaatcagcagaatgtttcccctctgcatgagtccttttcctcttactggaccaaattccagttgtatgctactaggagaacaatttgtagggtaaggaaaaagccctgcagtttatacataagcagatggaattgtgaccttcaaaaaaatgtagaacaagtttctgttagaaataatttgtaaaatcaacactagtttttttttctttcactttgttttttggagacggagtttcactctgttgtccaggctggagtgcgttagcacagtctcggctcactgcagccttagtctcctgggctcaagttattctcccacctcagcctcccaaagtgttggaactacaggcgttagccaccacaccctgctgcgaaggaggttattgttaacatttaatgcactttgatctagcattcatataacagtgggagcctctgaaagcagtgctggaggcttgtaaattgtcaaaggtgaacaatagagtttgaatcttaaaccagtgacagtcttctgctgattagtgggtttttggtggttgtttttt

SEQ ID NO: 13036 - DNA, 1144 bp, Homo sapiens
ggaaaataaggagtctgtaaaaggatcttggcatgctagatattaccagagtgttctgtggagaagcagctctacctgaaataaccatctgttgggttaaagatgaaagaaaaatcataaagtaccctaaaatatatgcaagtattaattaaacttggggtatagaaggattttacagacttgactttgtaacaccagaggcagaaatgttaagagaaatttaggggaaaagtgtggtttttatatagtgaacacaagaggctaaaaatacacattcaagaaaggcttagataaacgcagtcagtaccattttagtgatcatggaatggagttcagggaattgggaaatttccctaagtgtgtgcctcatcagggatagagccttccaccaaagggcaaggccgggtgggctttctgggaggctgttagaggggattgctttctgtgacaccaggcttaggactgtcacagtctggatagtctagcacaaatggtctctcctggatgcttccctgcagggtttccaggtcctcgtggaaatggagtggctggattttggccataaatttgctgaccggtgtggtcatggggagaactcggatgatctgaatgaacgttgcccagtgtttctgcagtggcttgactgtgttcatcagcttcagaggcaatttccttgctcttttgagttcaatgaagcattccttgtaagtttcttcattttggggactttctcaatttgaaggagggtcagtacaaatgttagtgggccagttctcacatgaaactgtgctgcctcttcagaatttaatagaggtgatttttttcctgtttctgcttttttttttagtaaataattttgctattttcaaaaagagaaaatccaggtataccaggtttgcatgaagtccttgtgttgttttaaacttagtttttttttaaagggatggtagaaaccctaaatagcagttagaaatagaagcaatcagaatgtctggaccatactccctccagtctgtctaccagacccccatgactgtctcagactctgcaccctctcctttgatggagggtacactatccctgccctctttcagcccctctgtccatttgtataccagctctcatctcctctcatctgctgcac

SEQ ID NO: 13037 - DNA, 2861 bp, Homo sapiens
ccctccgcatacctgctggccaaaactaacattgttctgtttcttctcatctcaaggaattgtgggaacgtattctgctccagttgttgtaaccagaaggttccagttcccagccagcagctctttgaacccagtcgagtatgcaagtcttgctatagcagcctacatcccacaagctccagcattgaccttgaactggataagcccattgctgccacttccaactgaagctcagtgacctgggtgggcagtggccaagctgctgttcctatgacaggcccactcaacctgggcagaccgagaggcccgtgcactttggaatgggagcgtggaaccacctgtacagagtgacagatttgggatgcaccactggattgtagattgatttttctttcctgtccccctactccctccctaccttttccatcctcctcctctgccttcaaaaaaggaaactttcccttggttgtcttaattttttttttttttgatggaagaccaagggttgccaggcccactgtaactgccgagctgcctgctgtcacgtgacactgagggatggcttgtttcttccgggtgggaggatggtggtcagagccaggagtatggagatctgagaccgtgagcagggaagaaagccagtgctaacatgcaaccattcctcacgccaccgccacatcagagctggttgggaaccctttgctgctggggaggctggaagcatattccccaagagcactgccctgggcatcatctccctcctgcgaggagctgagccagtcccctcacagatggataaatgaggctgatgtttggagggagaggcacacggtaaatggcatccccttaggcgcctctttgggaaaggaaagtggatgctcctttgaggcaggcgaggggctgggagtgggtagccgtcatgttgtcccccgtgggatcccatttttaacttgacccagattgtcttgggctccttttactttcagggggctgctttcctgggccaggctgtgtagcacttcccaccctcaggcatgagtacagactggtcaaaatgtttatgcagtcaaggccaaagcctgccctgagcccagacacacctgggtccccattctggggcctggtcccctaaacaatctcttcctcagccagcacagggaaatccagactcagggttccagaaatcccccgttcccaaaccaaaccaatcatggatcttccctttaaggggtagaatcagcctttagagttacaagcccctggaaaagggagcaggtcccatacaatcagcctttctcctcttctcttcttgggacaggaataactgctgagcagtccccctttgccactcctggctgtctgagtgggcacttgtctggctgctggccagcagtgaagggccacttggtgacttcgtagggttccttagagaagtgacatggccttgaggagattcagggcacctttcctcagtgagctttgatatggtccaaaaacagccttaaatcaagaatatttgtggaggtaggtgtggggaaggttggagaagagttaggtttgtgctttgtaatcttggcatccatgttttgtgcctgccctccctcttggggaggccatgcttgactctgctgaaagctgctaactggtgacagggtggatcatggtgaggactaggggtaaggtcagggaatgcttaagctctggccctgccctgtattcctcttccccttggtagcagttccctgaccaagggcaaggtgtgtctcaggaaggtggttctgtgcatgcctgggtgtggttaaggcgtggcccagaaggcttccctggtgctctcagtccaggcaaagcccagagcatctgagcacgtctctgacttccagtggcaacacagtttgaacgtggtgaaacagggtgtagttcttttccacattctgtgtcatctagtcgtgcaggtagggaaaaagttggtctaattgaagattgtgcatttcctagtgacaggtgccaagaggttatgatacgggtttcttgggtctgatgtacagtgtgaataaatgcttgcagctcttagctcttttttgatcgatgaagcacttttttattaatattttcctttgttaaaggaggaaccgtaactctccatagctgtacatataacccttttctcctaaagaggagtcagtcagtgctcctatatttttcattttttgtcaaagcaagaagtaaatactttagaattgttaaatatataaataaagcaaataaagttgagtgttccacatggtagcatttgctaacacttcctaattctttgccctgtggtttatcccctcttcgtcccttttccctctcacacagaagtgtttgagggcctgctgggaaactgacctttggcaaaggaaagctacagatagccttccgactctagaccttggcaaggagcctcaccatgatgttcaagcactgaacgcatttcctcagtgattttgctcctaaaatctcccaggctaaaagagggcaaagcagtcagggatctgacctggcagctattcctccttctctgaagagttcccatcagtagtcattacaactacctctcgcctcaaggctccatttttagctgctgctctgatttcagggcagccagtactctggccccttcagtcggggagtggaaggagatgtggggtgggggtgagaaaatgcttctgcctgttgttcttgaaggatagactatgggtgggcagagagaactgggggcagaaatggaattagatgtgattgggttatgcagtcaactagaggtctccttcccgccctctctccacacagagaggaacctctgctccttagctcttaca

SEQ ID NO: 13038 - DNA, 1224 bp, Homo sapiens
tcaagaaatgtttttgagcctttgctatattgttacactctgagggaataacaaggattaataatatatattgagtctctaggtgatttacaatgtattttctcctctgaatatatttttgaacaaataaataatcttataattttcattgagtgggtggaaaaattcatccagagaccttatgccaaaattatagataaaaatgtttattaaacttatttcccaatgagtatggtcaaattttaattatatagttctcctttggaaaattaacaataggtacttttttcaactcaaattcattttatcgtttagatagagcctgatagaattatcttagcattcattcttcctttgctcttcaaaatgtagcttggtaaatttctctctgaactgaacaatcttgaaaacagtttatacttaactgtctttgattttaattttttgtttgcttttagactttttcagtttcatttttgggcagagtaagagaggaagcattatatttggcaaggtctctaattaattaattattttttaataggttggacttgttgaaataatcctgatacattcctacaatggccactgctcagctttctcactgcatcacaatacacaaggcttctaaggtatttgttaagaattaaaagaaaatcaatgaccatttagtgagttagttcagaattatgattttaatcttttgtgtgtgtgtttttaagcagcagttttatcagttaattggcacataatattctgggagagtatgtgtacattttaactgcctaatagaccaaggaccagaaaattaaaataaatttctacaaagttacttactgggtgcttgtttcatgtttatgtaatatatttaggtcttctagagtaaaagaaatcagaaacaaaaagatgtttaaagagaatggttcttggttagacattcacttcctaaagtgttaggaaacttgtgttgcacaccatggtgtaattataagaacagaaggggagagcactgagagaaacttggatgctaggaggtctaggggagcatcccagggccaggcatatagtttagtttgtctcatgacattcattaatgcatcctttgtttattcattgagactaaatattatgtagtataatattcattatactgtgtaactcactgataaaatacaaaaatatgatcttcatcttccaaaagtttataatctggttaggagttaa

SEQ ID NO: 13039 - DNA, 1509 bp, Homo sapiens
tcttggctcatggcagccttgaccttctaggcccaagcgatcctccaacctcagcttcccaagtagctgggactgcagttgttcgccacaatgcccagttattttttaaaatttttgcaaatgtggggttatgttgccccggctggtctcaaaggatccccttgcctcagcctcccaaaatgctgggattacaggtgtgagccactgcacttggccaacactcacctttaatagattgcctcataaacttaactataagtagtgtccatttctagccacaatatacttttagatactttattttagaaaaaaatcgttgtaggatgaaatcctaagtaagcatgaactctaccttggccaaatatttattcattcagcaaatattaattgggttccttttatgtgcctagcactgttcaaggtataaaaacacaggggtgaatgggataggcaagatccctgctctctagaagcctacgttcttatgaggtaggataaacaataaataaataaataaaaattagtacaaacaatttcagatagacatagtgctatgaagaaaattttttaaacaggtgatgtactagagagtgctgaagtggagaatgaagaaggagggattggatggctgtgttagattgggcagttcctaggaggcatccctgagaggctactgtttgagctgagatgaataaccagaaggagtcagcccatgcaagtctgtgaagggcaatggcatgtgacaggccaaataacaccacagttaacatcacaggcattggcgtcaaatcgcagttctaccacttactagctacatcaataatgagactaatgtctacttcagagtgttggctacacaaggagatgaacttgtgaaatatttagggcagtgcctgaatattattattatcattaaccggagaccacatgttccagaatatagctgtgcaaaggccctaagacaggaaggaatcttgggtgtttgagcatagaaaaggtgccatgagcctggagcttagctgagtgcaagggaaagtggccagagataaggttagagaggcagacaggggacagatgggtagggccttgcaaatcaagataacttttggattttattttaagggtggtgagaagctaatgggggtttttaagaaaatgagtgacatggtctgatttgtattttcaaaaactacttttggctgcagaacagagaatgagcatcagatggacttgcaatttgctttagagatagacctgaaaagtcttgccaatgggttggaatgtggagggagaaggagaggctgcatatgttgctgctgctttggcctatgtgactatatttagtatgattcatagaaaccactgatgagcagttcaatggttcatctttattaggcaacacattagtctgaaaagtgttatatgaggtgttaagaatagtgcctgctgtaaatatactttcctagataagccagagtcagactgaagttaattaaggattagcatctt

SEQ ID NO: 13040 - DNA, 1599 bp, Homo sapiens
aaggaaagcaggaaaaatagttagatagccactgtagtaatcaatgcaagagtgaggaagggatacttttgcgagataatcagacggtagaaagtcccagagctggtgattgattttatgcttgagagttgtagaaatgtctttacgcttatctcacaaatgagctaactgacctagagtgtgtctaaatgacttgaccaaggtcattcagctagttatcagcagagctgatattagatgccaggtcacctaattccaaattcgttgttcttactgttgtggtatatgatttttttcaaatcaaatttttaaaaagatcgtattttaaatgcttttagggaatttgctacttaagaaattctttgtatatacattgcaaaaagtaccatcgctcccctaatttacattctaaaaaagtctcaaaatatactaatgtttaatttatatttactcacatagtcaaaagttttgttccttttgggatagattgccactattgtatatgatcaaaaagtatgcttttttttctgtgtagtcatagcagcagtacaagctttgaaagtggaacaaacaatgaagatattaagaaagccagtgttctactgatccgtaaattgtatatactgatgcaggaccttgagccacttcctaataatgttgtacttactatgaaactccactactataatgcaggtaggtagagaactttaggcaaattcctccttaagtgctgagctaatattttctataagtaaaaggattttgcaggcatctgaaagagaagtctgttgctacacatgaaagattaatcggatttgttgtattgaaactcagttttcatggctttttgcccttttcatttcgcagtgaccccacatgattaccaacccctcggttttaaagaaggggtaaattcacacttcctgctgtttgacaaggagcctatcaacgtgcaagtgggatttgtctccactggctttcatagcatgaaagtaaaagtcatgacagaggctacaaaagtgattgatttggagaacaatctgtttcgggagaacagcactactgagatcgcccatcagggtctagactgtgatgaggaagaagaatgcaatgaccatgtaaggcaaagctttagagattttctatcgtgtcagttaaacacaattgatatttttcagtttctacccagggcatgcacgtggagtgtgccagctataaaaactgaaacaaaactagtctctgacatcaaggagtttttaatctaaaaaagtttaatcttctaaaaggaaatatactttatcagatgaaattgtccataactaggaggaaaaagattttctaatatatttattttattaaagatatcataaatttagaaaatttgaggttttctttcctttatttgtaaatgacataattttagggttgaaaaatattctaggtatttattcatactcattggaagtataaatcagttcttgatactgagataattggatgggaggagttggggaagataaattttatggataaacccgagtcagcgtgaaaacaaataatagttaacttctggttatgtggaggaagacaagctttggg

SEQ ID NO: 13041 - DNA, 1098 bp, Homo sapiens
ctgttcgcctaccagggagtgagaggttggaggtaggtgtggctgtccattgaggtcactgtccacctcctttgtttggcactacctgcactttcccgcttcctggcttcccctactggaactgttccctccacctgagttgcccacctctctcccccgctgcctttgaagtccttcaagcccagcacaaatgccatgttttataggaagccgtgtgagaccacctctttcttccctctgctccccagcaaactcctcatccttccatggggcagaagaccatggtggaaagagtgtgtgctctggactcagacagacccgggtttgcatcccaactctgctaatgactagctgtttgaccttgggcatgttacttagcctctctgagctttaattccttcatctgtagaatggggacaatacttctacgggttgtgagtgaggagtaaataagctatggtgccaagatcagcgctgagcgacaggaaatgcttggtaaactgacagcttttactgcagtccgtatcagagtgcctactatcacgattagctgggaacacatctgcctgcccgcagactggtgtgtgggagcccttgttgtggggcaggggcagtgtctcactcccttcccacttcctgccctgcaacctggcaccccctgacaagacagtgctccaggcagcatgagtgcccagggagtgtctgcagagttgaactatgttaaagagaagtccagttggccgggcgtgggggttcatgcctgtaatcccagcactttagaccgagatgggcggatcaggacgaggtcaggagatcaagactaccctggctaacacggtgaaaccctgtctctactaaaaatacaaaaaatagccaggcgtgttggcaggcccctgtagtcccagctacttgggaggctgagtcaggagaatggtgtgaacccgggaggcagagcttacagggagtggagatcgcccaccgcactccagcctgggcgagagtgcgagactctatctcaaaaaaaaaaaaaaaaaaaaaaaagaaacaaagaaagaggcgtccagcaaagatctcagtggagagtcctaggcagagggc

SEQ ID NO: 13042 - DNA, 1433 bp, Homo sapiens
gcagtgagctatgattgtgccactgtgctccaggctgagcaacagagaaagaccctgtccctttaaaaaaattaaaaatatattgtcagatgaccccggaaagaaggttcttcctgttgtacccctttccaccagctcctggtgaaggttctagtggcatccagctttcccaggtggtgtagggaaatggggcagttgccaaggctccttccagctctgggagtttaggattctcttatctcgagatttgtgggcccatgaaataatgttgttaaagcagggctagcgcatgttttctcaccatgaagtgggtcaggtagatttttttcctgtgagaatttgtgaccttttcttgaagctctgcttttaagggatatagctttgagttctgtgccccccaccctcccttctacacatacctcagcctgaccttcgccttccccctcacaggccaacaagctggcggagaagcggaaagcccacgatgaggcggtgaggtctgagaagaaggccaagaaggcaaggccggagtgagtgcctgcggcccctcacagggctgaggccagcccctagcagctggatgtggcagaggcaggccagaggacctaagtgtgatggaccagagtcacttctcctcctcctttctccagccagccctgacccctcatgctctctggctgggccagtgggcagccctcgcttcccttggatggagctgccctgctggtgcctggtcagagaagaggcctctgtgcccagcctgattctctgctcccaggagccagtgacatgaggtgcagaggcccacccagccccctacctactgcccccattcatcctggctttccacagccccctcccacacagttggacccgtgattctcagggtgctgtgatggggtgagggtagggggagcatttgttattaaatgactggacttttgtgccaattgcattttgtgtccatgagccttcctagggttggaggaggcctacctagcactctatgctgcaggctgggccagccctgggtatttactgagacagagctgggcactgctcagagctctctggatgtccaaggacccctccaggtccagggatgccaaaaggtaggtgcagaggttctggacctgggcttcacagcctgtctgaccatggttcacattctaacccaggcattttccctctgcacctgcttcctcatgtgtcagttactggtagagattctgttctttgaaagggatgtgttgagggttctgtgataactttatagtctcagaccttatggacttggtaatatcaggtgtgtggtaagtacttggtaaacaccaactgatttatatcacttcctgctggactcggcccagaaggtaaaagccagaaccggaaggatctgtgggtctgcggtgaggtcctgccctcagcttgcc

SEQ ID NO: 13043 - DNA, 1111 bp, Homo sapiens
aggggaagcagcccccaccccgctccctgctccaccagggcagcttcggtttcccattttccattttggacctccctgtagagtgtctgtgcactaaagtttccaccttcaaagagagtcatagagcccctgactccgtctaccgtcgtgcaccacaaaatccgcacgtgggtcaaggctgggtctttggtgagcattcggtgtcttgaggacccccatcgggacttctctggtcctcagagcctagtgggcgcatcctggttaagtggttcctcctaggggctgtggtcagctgtggggaagctgctcctgccaggtcaggaggtggcagtggtgaggcctggcttgaggaacggggcatctggggtgggataaggagatcagggtcccccttggcacccacgctgaacaggccccatgtgctgcctcactggccatgcaggtatcccacgttcatcgatgccctgcgggacctggacgatgccctctccatgtgcttcctgttttccaccttcccgcggactggcaagtgccacgtgcagaccattcagctgtgccgccggctcactgtggagttcatgcactacattatcgctgcccgtgccctgcgcaaggtgagcctgggactgcccggctggcatcccaccctgccccctctcctgccaccccatggtcttcacccagatgtctcctcctctcccctaggtcttcctgtccatcaaaggcatttactaccaggccgaggtactggggcagcccatcgtgtggatcactccctatgccttctcccatgacgtgagtgtgcctgtcgggaggggacgggcttgtgctgcctcctagacagatatggatgtggaggaagggggattttgctgtccatggagtttagcaagtgctgggttcccaactgttgatgaggggtgaggcgcggcagaatgtgccacacagcatcctcattaagagcgggagcctaagctagccctatggcagcacctgccagctgcgtgcccttggacgtgttcctttcacctctctgtgcctcagttaacagtgtctacacccttaacagtgcctggtgcttggccttttagggccgaataaacagtgagaa

SEQ ID NO: 13044 - DNA, 1231 bp, Homo sapiens
cttccttttttctattttagccgcataaccgcgaatgaaccaaagagaacccgaagccggtgggaactcagcgcagtctcaccctgcccctcgggaaccgcttctcagcagcggcagccgaagtctgacgacgcttagcaaccgttaccttgacaacgcaatcctatcgcgcaccatggagtgcggcgcccctctgcatcccagaaggcaccgcgctgtccctaagccttccgcccctctccgtcccaacatgcaacgaggctcacagtcaatgaatcgtcatcagggtgattacagaaaagcctgtatatccacgtttgttttaacacttaaagtgtttgtaaccattgtgagcgggaaagatctggaaagagtgttctcagtgatttttttcagactatagttttaaatcttgaggaggaaatccccatctttccctggacttgtacaggcatctcattgggcagcccgcacaaacagacagcgtggggtggggagggtcctcggggtccttggcagggcacgtgcgggaggaagtggagctccctgtacgcgcggccctagtcggctcctcaacgtggagcgatgggaggccttgagaagaagaaggtgattgggaaagacggtggggattcccgaggggtggggtgcgggggcggcagagcatggggtcgactcttttcccgggctccgtctcgtggagactggaaagacgggatcgacgtgaccgtaatcagctgcgagaaggggtccgagaatggacaaggatggcagtattcgtttagtgaaatccgagaacgaactccagagttctttctgtggagagggctgtgaaagagagttgaacttaccaagcgtagcttcattccaaaagcaggccgagccgtgggaccactatttaccgaaagggtgataaacattacgtagagctcaccgttactgcaccgttacattagttggttagtgttgtcttggaagttctcttcgaggcataacatttcggctgaaatgggaaagatcagaacgtcttggatgggttctggggcatgggagtgcttagcgagcaggcctgacaagggaaaccaagtgccaagatcagtaggcagggaaggcttgctgtgtgtaaggagttggaaggacattaggatgactcgcatgtaaaccaagaaaagaatggcatctgataagattggggttggacacgtactgtatcgtgcaaggcctgtaagct

SEQ ID NO: 13045 - DNA, 1203 bp, Homo sapiens
tcatggcctcaggaaccctgtgggaagctgagttcagagtctttgagcaggctttagggaggttccagcttcccaccaccaagccccaggtggattcttacagactctagcctcagggtggggggtctggaagatgaggttgcggggtgcgatattctgcccaattcgcccctccttgctcaatctgtttctgcaggtattgctgactacagacccaaggatggagaaaccattgagctgaggctggttagctggtagcccctgagctccctcatcccagcagcctcgcacactccctaggcttctaccctccctcctgatgtccctggaacaggaactcgcctgaccctgctgccacctcctgtgcactttgagcaatgccccctgggatcaccccagccacaagcccttcgagggccctataccatggcccaccttggagcagagagccaagcatcttccctgggaagtctttctggccaagtctggccagcctggccctgcaggtctcccatgaaggccaccccatggtctgatgggcatgaagcatctcagactccttggcaaaaaacggagtccgcaggccgcaggtgttgtgaagaccactcgttctgtggttggggtcctgcaagaaggcctcctcagcccgggggctatggccctgaccccagctctccactctgctgttagagtggcagctccgagctggttgtggcacagtagctggggagacctcagcagggctgctcagtgcctgcctctgacaaaattaaagcattgatggcctgtggacctgctacagtggcctggtgcctcatactcctcaggtgcaggggcagggacaagagaagggggaagtaaccccatcagggaggagtggagggtgcctgagccgccatgtgggcattgggggagtgatgggaatgccagcagtgatgacattgactactgactgagcacccactactatgactgagcactcactcgctagatactatcttgaactgctctgtgaggttgttgatattttcatttttatctgtgctttacaaatcaggaaactgggaggccgggcatggtggctcacgcctgtaatcccagcactttaggaggccaaggcaggtggatcacaaggtcaggagtttgagatcagcctggccaacatggtgaaactccatctttactaaaaatacaaaaaattag

SEQ ID NO: 13046 - DNA, 2379 bp, Homo sapiens
gcctcctgtgaggaggctcccacagttgtctgagacagtggtggcctggaccttgggcagtgacagagaagggagagaagtgggcatatttgtagtatctgagggaaatatacatctaagacaattgggaacatggggtagaggcagggtgggcgtaggaaatctgggcatcatctgtgcacaatagatgagggaggggagagtgattaagacaggacagaagcctgacatccagggcggggtgggaggtcagggagaggactctgggctccatcccaggagctgagagaagggtggaaaggtgagccccccaatcactttctggcccccagttgatccctaccctgctctattccaggacatagacatcaacacagatgatgagctggacgcctacattgaggacctcatcaccaagggggactgaaggcaggagagagagcagctcccctgcccacctgcccctcaaccctgtagctgcagggggaggggacttcattcatgggttggtggtcgcaccttggtttgacttacacgggacatttgtgtttttggaggaaaagataccctgattctttgaatcttccttaagtttataaatatttattttttaaaagaagatgctgtgcctgtgagaccatacttttttttttttttttttttttttttttttttttttggtgactgcaaaggacagagaacctttccactttggccatactgggttgctaagccggagccatttcagctcctggctcctcaagataacggcgagtccagtgccatcttggagaagctccaggggcagggctgacttttctcctacaggaggaacaatgtggggatctgagggatgggagggagacttccccctagagtggtggtcctgctgggggctcatatccagggacccaaaaggggggctgtgtaggaggttccacattggaggggctctctctctcgcagctgtcagagttggtcctggctgtggcgtccaaacagcttgagggaaaaagatcctgtctaaccacctcatctactactcaagttctttctgaaggagggatttcttcagttaaccatggacagtgaggtttctcaccacagtaacttgagtccaggttgagggggagacagatctgtggtaaatctctgacttgggcagcacactgagtgtggaaccccacaggactccttagggaaggagcttgtgtgtgaaagaacccctggggctgagctggtgacctccatgtgtgggtgcagcagggccttggatggtgccaattgatctggacagcctgttgatgcttttctacttccacccttcggcctggccccactgagccccatcaaggtgcctgaagagggggccagtgagatcccgtggccacagggactccagaggcatctctgcaggaagcacaccatgccttccctccatgttccatcacggcgccacaatctgtgtcccttaacttctcagggtcaaagacaaaggcaagcgttgctgaattttctctttaatggccattggaagagtctggttcagtttttcccaactctcttcccactcgtatttggggcctctgggttttctgaaggcacaaggactgtgactttgtaccactaacctgtggttcaaacctgggtgtgtttctggcatctccctaacccagatcagcaatggccaccctgctcctctgaggtcagcagaagactgggaagcagaggtgagggatgcaggccacactggaatgggaagtcttttccccactggatgtgcctgtctggtgggttttggaccttcccagactacatctctaggagaggcctgtttggagtagtacactgagagaccctggcctcttctgctggaagactgtccaagtcttggggtttcttgagctggtgattcctctgccatcctgctctctctcttcatctcaggcagcatggggtccacttttgtccccaaacctaatgttttaatccaaatgcaaattggttccacatttttactggagggtaatcagtttttaaaattcacacacatgtaatcgaaacgcaatactataaagttctactggtgagactcctgaactcagtctgttttcttagtaaaatccagcaccttccttctcttcattctttgtatcactgtggctttaaactgtcttcaagttattcctcctcatcacctccattgttttatcttcacccccttaacatccacagaaacagactggagttcttgaatgttttagcttcaacttctacatgtgcccactttgctttgttaatgctaccacagctgtgctgaatgaagcctgtttcccaggcagagatcctgccactctggatgggaagataaaatgcagg

SEQ ID NO: 13047 - DNA, 1115 bp, Homo sapiens
caaacactataaaaatgtttgaacaattggatttcaaacattttcgttttgtggagtggtgctcaccaagtggtacagccctaagcaagtgaacacaaacacatttaagtgtattttgtctgattagatgttagccagttatgctatttcattcaaatgtctgaaaaaatcaattgactattcccttttcctaaagggcagagacagataatctcacttccagagaaatgacttggagaaaaaaaagtgttggtctttttgctcttttgtaattaaatccggatgtacctcaaaagacttaagactgtggtgataagatgctttcctcagcagaaaggagggaaaaaaaacaactggaactcaaagcttgaaattctgtggcaaaacatgagatgtccaggattggaggttgaaaagatttcactacagtgttctgcaatagttggagcagataactttcagtgtagccacagccatggactccagatttccagattttcaagacctggacctggaacccgaaagagcttgtcacgatgcggcaggaacactggaggtagatttttttttatttttgaattttgggactgttgaccttgctgtgagaaaagagacaacgactgagcaagcactaccaccagcactgttactgggaattagaagacctgagtttctgtccagaccctcagtgcaaactgaggatgctccatccaaagtgaattatggtacttgccattttccaaaatgccttatcctttaccatctctgcacttttgttcatactctcattctactttggaactgctgctctgtggcttttcatctgtcaaaactgccattttctcagtatccaactcttatgccctcttttccatgagtctcctaactagccagaatagagctttaaagttttatgacatttcgttatgtatcctctatctgtatacaaaatcctgtaaaatagttacttgcctgcatttactgtctttgcagatagcagactccttgaaagcagggtccttgtttagtgcatctttgcccacatacaccacaacatatcaagatgcatttattaggaaggaggagtttagagagcaggctatcagaataaccac

SEQ ID NO: 13048 - DNA, 1089 bp, Homo sapiens
ataggaaaggaatggaagaaagttaattcaccccaaattggataaattccatgacatttagcaatatacttctgtatccctagaattgtatcataactttagttcaaggacattgcatctcaggtgggttaaggaggttgggaaggggagaaaagggatgaggagatattttcttgagatttatctccttgagataatgcttgagaagtcatccagccatggacttcttggagtaatacttacaaagaattggatgcattttgcatccttaggcaaaaaccccagtgctgttacaactgaaaatcattagccttgttctctgatagatacttacaagcccaactgcaggcaatcaaaatttatagcagatgagttctaactccatcaacctgtaatgtggtccatcttagggaaagaataggaaaacaccttggtttaccacaggctttgcttacagtttctgctttctgtgacctattttttgtatttcagcattttgtgaccgacttattcttagatcattggttttccaaaggctttgtggccatgaagccctttgagtgaaaactgtgcagaagcccagagtaaaagtgaagctgctctggatgaagtagtgaagcaagagtaggggcctgaatcctgctacaactatcttcctttaccaccgtggtgacacctaaggggacttccttacaacaccttgaactcttccgaacacagtttgaaaaccactgccccagacagcaatatgtttgacctgaatggcattccaatcttttctgtacctccactcagcacagttcatgttcagtagatgctgaacattcttagaaatactgtgtgtgaacttagaaaagtgcaagaagacaggcatgtctttgaccccaggaatgatcatttgctgaagatggtgtcaagtgaacctagattaacagccctccactccagatggatatccagtgattcctagaatgggatatagccagagaacaattctatgcaccctacactgacagactcccttaagcaacaccagatgctctactggtacttgaagtacatgactttgaagtcttgaccctccatgaa

SEQ ID NO: 13049 - DNA, 1194 bp, Homo sapiens
agataaagattggccagtgatgaagcccatctgggtgcaaaggccgagctgagaggcttctaccaactggagtgtgccagtgagggtgagcagaaggtggtctccagggagaacatgggcagggtttggagccagcacctccccagggttggaggaagcagacccaggacctgcctgactgggatggggctctcttctgccatctccgcctccacctgcctagctctgctcccccgccccgagagatgcctccaggcttgggtagatgaagccaggggcttcctgccttcctggaaggcttttccctgtctggagtttatgaaagaccagcaggcaatgcggcaataaaaaagaccttggggtagaggggcgccacgagaggcgggtctggcgctgacatccaaccccgtgccccctccctgcaggatgctggtggactgtgtgcccctggtggaggtggacgacatgatgatcatgggcaagaagcctgaccccaagtgtgtcttcacctatgtgcagtcgctctacaaccacctgcgacgccacgaactgcgcctgcgcggcaagaatgtctagcctgcccgcccgcatggccagccagtggcaagctgccgcccccactctccgggcaccgtctcctgcctgtgcgtccgcccaccgctgccctgtctgttgcgacaccctcccccccacatacacacgcagcgttttgataaattattggttttcaacgatcctgactcctctctgcgtctcctgggggtggggagggggtttgaaccgaaggcagctccgcaaggtctccaactccagcagggatcctcagaggttcttcttccgacctcccaccccacccgcccgcagcaacgaaggagtcgagcctcagttaaggcaggagggaatttagtggagctggggaaggaagaaagtggggttgggagaacctccccaaccccatccctgctggcccggggacgggcatcggctctcagcaagagaagtattcccgggatgctgagcgcttcattctgtctccaggactcaggcaggtaggtcccagctccgccgcgcccccggacctacaggtcagcgtggtccgaagtttcctctgggggcttcgcgggcgcccacacgtactcggggggcacctgcgcgtcgggcgccgccttgcggtagaagccgagctcctgcact

SEQ ID NO: 13050 - DNA, 1767 bp, Homo sapiens
ccagttggcgatgacccctgaatatcgccaccgctgtaaacactctataacttcaggccttggcattgagtcatctctcatgggtgacaccatgaaatcttgtttcagccagttctgcaggtcctgactctgcagagggaagaggcagaaagagagaaactgtcagagtataatttcacctgagtttaatattacagaaacaaagggatgcaccaaatggtatttctggaaattttcatgtctttaaataccccttggtaagttgcttctgaagccagtgggggctcctcagatagagaggttcccctttcaaatcccagtgccgctctgttctctttccttcccctcccactccccctcttcttcctctgtagagatgcaagaaattgctgtcccataaaaatcataattgcagtagctaaagctggggtcacttcgtgaattcaccagagactcaaagatcttttattggctctgggctgtgctcagtgtctttggcctcagagaacaacttgaatgacttcctggtttcctggcataaattattcctggtgagacatgtggcttaactcacaggtttcccatcagctttctccctaaaactatgttcatctgcctctctctgccagagaacatacagccgagaatactgccgaagctgagactgactactgtgcattaggaaagacctggagtcaggactttggtgggatttggagctccgaggcagtaataactgaacaagcagccctgtcccctaggctgcagaagcttgaatgcatcctctcccagaacctgccacaggaaactgggggctttgtcaggtcagcccaactgcatgcaaaagaccaccatcctcagaagccaagttgtcttttatgaagaggcaaggaaaggggaaacccacatgtgaccctgattttggtatggcttgatagagttccctgaaaactccttgtatgtgtgctaaaaccagggaagcatgtgactgccaagcaggcaacccctgatgatttgtaaagccaggtggcagggccttggggagccccagcacaatgatattgtgtggtcttccctcctgtggaatcgaggggaaattattcttcccaataccttgatttgattttcagtttcataagcttcttcctctgaatcttattgagggactatggtaccaagcaggtaggactgttcacctggtggaacagttcttgctctgccttctaggcttcatcccagaaatccagcctctttctggagaccccaaagctggagggagatgggctttcctctgggcctctctcctactttgccatccacactgctcctggctaaccccagcaataaccaacaaatggtaggaagccccatctattgctttttctcaattatgactgcatagtttatggaaacaaagatcttgaggaagatgagggaagccctcccctcttcacagtccccatctcttctcctttgtacctgtcaacaccagagttcagtgtttaaacagacaaaatataaagtattgagtaggtggttcatatgccgaatccacttggtaggaagaaaccaccagctttatagtgtgcctgatagattttaaacattcctgggcacccactcaagagtgctctttttatcaccttctggaaatccgcaaagttgcaggggcctctggagtgtctcttctctagagagaattggtgggacccccctcagtgcagtggccccaactagtggagggagagaggacttaagtcagatgga

SEQ ID NO: 13051 - DNA, 1993 bp, Homo sapiens
cccaccccatggccctgctcatgttccacctgcctctaatttacctcttttccttctagaccagcattctcgaaattggaggactcctttgaggccctctccctgtacctgggggagctgggcatcccgctgcctgcagagctggaggagttggaccacactgtgagcatgcagtacggcctgacccgggactcacctccctagccctggcccagccccctgcaggggggtgttctacagccagcattgcccctctgtgccccattcctgctgtgagcagggccgtccgggcttcctgtggattggcggaatgtttagaagcagaacaagccattcctattacctccccaggaggcaagtgggcgcagcaccagggaaatgtatctccacaggttctggggcctagttactgtctgtaaatccaatacttgcctgaaagctgtgaagaagaaaaaaacccctggcctttgggccaggaggaatctgttactcgaatccacccaggaactccctggcagtggattgtgggaggctcttgcttacactaatcagcgtgacctggacctgctgggcaggatcccagggtgaacctgcctgtgaactctgaagtcactagtccagctgggtgcaggaggacttcaagtgtgtggacgaaagaaagactgatggctcaaagggtgtgaaaaagtcagtgatgctccccctttctactccagatcctgtccttcctggagcaaggttgagggagtaggttttgaagagtcccttaatatgtggtggaacaggccaggagttagagaaagggctggcttctgtttacctgctcactggctctagccagcccagggaccacatcaatgtgagaggaagcctccacctcatgttttcaaacttaatactggagactggctgagaacttacggacaacatcctttctgtctgaaacaaacagtcacaagcaaaggaagaggctgggggactagaaagaggccctgccctctagaaagctcagatcttggcttctgttactcatactcgggtgggctccttagtcagatgcctaaaacattttgcctaaagctcgatgggttctggaggacagtgtggcttgtcacaggcctagagtctgagggaggggagtgggagtctcagcaatctcttggtcttggcttcatggcaaccactgctcacccttcaacatgcctggtttaggcagcagcttgggctgggaagaggtggtggcagagtctcaaagctgagatgctgagagagatagctccctgagctgggccatctgacttctacctcccatgtttgctctcccaactcattagctcctgggcagcatcctcctgagccacatgtgcaggtactggaaaacctccatcttggctcccagagctctaggaactcttcatcacaactagatttgcctcttctaagtgtctatgagcttgcaccatatttaataaattgggaatgggtttggggtattaatgcaatgtgtggtggttgtattggagcagggggaattgataaaggagagtggttgctgttaatattatcttatctattgggtggtatgtgaaatattgtacatagacctgatgagttgtgggaccagatgtcatctctggtcagagtttacttgctatatagactgtacttatgtgtgaagtttgcaagcttgctttagggctgagccctggactcccagcagcagcacagttcagcattgtgtggctggttgtttcctggctgtccccagcaagtgtaggagtggtgggcctgaactgggccattgatcagactaaataaattaagcagttaacataactggcaatatggagagtgaaaacatgattggctcagggacataaatgtagagggtctgctagccaccttctggcctagcccacacaaactccccatagcagagagttttcatgcacccaagtctaaaaccctcaagcagacacccatctgctctaga

SEQ ID NO: 13052 - DNA, 1176 bp, Homo sapiens
gtggctcatgcctgtaatcctagcactttgggaggctgaggtgggcggattgcctgagctcaggagttcgagaccagcccaggcaacatggtgaggaaacctcgtctctactaaaatacaattagccaggcatggtggcatgtgcctgtagtcccagctactggggtggctgagggaggagaatcgcttgaacccgggaggcagaggttgcagtaagccaagattgtgccactgcactccagcctgggcaacagaaaatgtgtcaactcttgggcaaataggtgctgatttcatggcatacaaagcaaattgacttctggtataaatcttctgtagctataagaacttcacgtatgcatgtatgtattacagaaaaatcctttgacacttaaatgtagggggaaaaaacacctctacttgagtatttgggttagttaaggctttattgaactttcttgcgtatgtttttttcttactcttcagtggcccgaacctgtaacttgatcttgattgttctggatgtcctgaaacctttgggacataagaagataattgaaaatgagctggaaggctttggcattcgcttgaacagcaaaccccccaacattggctttaagaagaaggacaagggaggcattaatctcacagccactgtaagtggggaatatgacatggggcaggctgctgcaggaattggaatggggagtggattggggtgcatggaccctgacattggaaaatttcctggcttttccctgcactaattgagataacacaatgactttataatgactgacaagaaaaacttcaagattaggataggagccagtctcagacttacctttgctacttatttcctcttttggattatctattgggaatgatatgggcgtgtggaccaatattatgcttgcataaagtagatggccgccaatatcttctgttttcattcatttaacacaaatttatagagtgcctaccacgggccaagcattattttaggctctgggcaggaatggaagagggaatagtgaaaccccctgcttttatattctaattggatagaatagaaaacaatgttaatgagtaaaatataatgtattcgtcaatgataaatataagaacacaaagtagggaaaggagataagagtgttggtgtgagggttgcagttttaa

SEQ ID NO: 13053 - DNA, 1182 bp, Homo sapiens
cttaggctataaattctcaacataaaaacttagtgatataatgaccacggtgcaggcagcaatcttggcaatgttgggctatctgggattcttgtcccaggtaacaagtctcccagaagactcatatccttctgcaggatgcacagcaggagcttgtcaagttttaaagaatagcacttcatagttgtggtcccccagtttctagcatctaaacattttaggtttagtttatgccatctcttagtacacaatttgattttaagtgttattagtttatttttggtgtcagtcttttctgacagtctcatctcaattttgaaataaattattttcatcttatctgtcatactagccaaagagaattcctaccagatatctctttgcttgatttaacctggacgttctcaacttctcagcacattcaggggttgtgctttcagtggaggaggtagaagcaggtctgaagggcttgaaggttgaccagcaagtgaagaattcaactcccttcatggcagaacacctagaagagaccttgagtgccgtaaccaacaatcgacaactgaagaaagacggagacatgactgcgttcaacaagctagtgagcacaatgaaggcaagtgggactttgccttctcagcccaaagtcagcgtaagtatctgacacaaaccccccacccttttctcctttttttttcttctttttcccaccacaataaaaggatttttaaaaaggtattctgagtaagttggaaattctttagtagtcatttggtccttgatgcttttgtgtgttccttaattattgatatgctatttgttactggaaaaagcaggcttgtggttaatttatatgtattgtgggtgacagtataaagattaaaagattcagtcttaatggtaatgcctgtataactttaagtcactgctaaaatgaggtataaaactatctttttggatgaactccagagacaattttcttgttattcagctacttaagttcatattctttaccatatttgtatagtaaaatctttattcacatcttctaattattcccagataccagggattacctgcattcttgcagtcatacaaatcatttgtaaagtatctaagatggggctgagcacagtggctcacgcgtgtaatcccagcactttgggaggctgaggcaggcagatc

SEQ ID NO: 13054 - DNA, 1748 bp, Homo sapiens
tttggtcaaaataaaggcactgcaaagactaatcatggaaaattatttatcgtgacgtacttctattgctgcaaagaggaaggccaatgtctcagccttatttaaatacataatgtacatgttaccctgaatctgctgataagcccaattttagtggtgactctcttccaaccatccccttcctcccatcagtcatggacatactatctaaaaaagaagaaaacacccttgttggtttgtttaactttgtctttcccacgtccttccagatccacgagagcgtgtgaaagaagatgacttagatgttgttctcagccctcagagacggagctttggagggggctgccacgtgacagccgctgttagctcccggcgctcaggaagtccattagagaaagatagtgatgggcttcgtctgcttggtggacgtaggattggcagtgggaggataatctctgcccggacctttgagaaggatcaccgtcttagcgataaggacctgcgggacttgagagacagagaccgagagagggacttcaaggacaagcgtttcagggtttgtcttttttttttttttttttttttaaattgagacggagtttcgctcttgttgcccaggctggagtgcaatggcacgatcttgactcactgctgcctcagcccagtatctgggattataggcacgcaccaccatacccggctaactttttatatttttagtagagacggggtttctccatgttagtcaggctggtctctcaagctcccaaccttaggtgatcggcctgcctcggcctcccaaagtgctgggattacaggcgtgagccaccacacccgacctgggtttgtcttctagattctttggtagttcatgtgcttggggacttgatattcactttttttataccaggttactttgagaacaggcatgaacacagcctgctcttaaaccagtcagggaggaaggggtgggggtggtgatgggcctcaggtatacagcatcatatcttcctttcactattgaacattacaacgaagaccttgactgaagtagaaatggcttgactagaaattttttaatcttgctttatgtacttttccagagagagtttggagatagtaagcgtgtctttggtgagcgtagaagaaatgattcttacacagaagaagaaccagagtggttctctgctggacccacaagtcagtctgaaaccatcgaactgactggctttgatgataagatactagaagaagatcacaaagggagaaaaagaacaaggcgacggacagcctctgtgaaggaaggtcagttcaaactttgggagggaagttcgctgttttaaaatgagatgtaggctgggcgtggtggctcacacctgtaatcccaacactttgggaggccgaggtgggcggatcacctgaggtcaggagtttgagaccagcctggccaacatggtgaaaccccgtctccacaaaaattcaaaaattagtggggtgtggtggctggtgcctgtagtcccagctactcgggaggctgaggcacaagaattgcttgaacctgggaggcagaggttgcagtgagctatcacaccactgcactccagcctgggtgacagagcaagactgtctcaaaaataaaatagagatgtgattatcactggctaattgtacacttaggaatgggcaccagatgtataggaaatggcaagtttttcatgatgcatcctgattttgaaatcttttttttt

SEQ ID NO: 13055 - DNA, 1742 bp, Homo sapiens
gtgacgcacaccaatagagagggcgtccccatgcgtaagggcgagcacctgggcgagttcaacctgggctccaccatcgtgctcatcttcgaggcccccaaggacttcaatttccagctgaaaacaggacagaaaatccgctttggggaagccctgggctcgctctagagtctctttcctgattatggctgctaagggatcttttccaaacagagtgagggtcttttcaagagggaggcccatgaggccatccaggtaagggcctgcctcagcgtggttgggagtctgaccaggtaggacttgaatgattcggctaccacctgttccagaggtgcagacaagaggtggcgagagcccccatcatgcccctcaacctatcccgttccttctgcctacaaataaaaagtgcaggctggaatgatctcagtcacatttggatctttttaaacactgtatagacggaagagcctgcattcctgaccgaaccttcagttggtctcggttgtcgttttttcttgctgctcctccccccatcacctgagctgttttctgttggccccttttgttttttggccttaacgctcctgctgcacagggtgaggtgcctccttggcacagactgtggatgcctctcccccagcagagccacacagccttcgtgacaactgctttccgttcccacattcacctcatcctgctctttagaaaaagcagtctttgtgcttgtggctgaacgcatcaccctggactctgctagtgtcttctgaggacactgatgacactgattaatgatacagacctttgcaggacctgatgagtgacccttctggagctggccaggtcctctgcagcaggcaagaccaatcaatcactgaacctgcctcatggcaccagagtgaacagggcaggcaggtagtaggcccagctggggaaatgggagagttcctgtccccctccacatatccctacatgaaatatgggaaagttgctgctattgattcagggtctgtcttggaggcagaggacccttggtggatagttggtcagtgcctggaaaacctgtcccagtttatcaggaacgcaggcctggggagcccccagtggcggggacagggccagatttcatgttgaccctggggatgctgtgaatttctcctgcaggagagacatcattgaattttttcaactgtatcagtagcacagtatttttgtatgaaaagtgggagacttctgaacagtaattcatttaattgcaaagcattttgaaataaaaaaaatcaaacttaaaactgtgttctgttcctggaggtggcctgaggcctccccgacagcccagcacctgcgttcctggtgcgaacacgctagcacagggcctgccgcagggcctggatgcgggcaacgcaggcgccaatgggctggcgctgagcctggagctcctctgccagcagctggatctgcatttccacctggggccatggagggacaggcagggctgagagggagcacagcccggggcgtccccagggacacctggggatggcctggggcctcacctgttccagctctttctgcacctgctgctctacttcctggtcctcaggccccggctcctctctgttcagctccagccacctgcgcaggctgctcgcttgccgccgacaggacctgaggggtggagatacccactgcctgccaggctgggtccttggcagagccccatccggctcagggagaggcacctc

SEQ ID NO: 13056 - DNA, 1208 bp, Homo sapiens
tccctgagaatccatgtgcagaccacactcgggctccgtgctgggtgctcactgtgttggtggcccccacgtctgctcctactccacagccgcgtcgtgtgactccttcaagaaccagctggtcacccgggaagggaatgagctctatcactgtgtcatctacctggcccctggggactaccactgcttccactcccccaccgactggactgtgtcccaccggcgccacttcccaggtcagcccggggccagcgtggggggagctgcctctgtgggcttcatatagaggctctcagcttcttggtgttgggggaccaggctccagatcagggtcattgaggccaggagttgactgctttatgcaggctggttgtgggcaggggaccgtggggcccagtcagctcagcatttggagtgacatcggggcaacaggccatgagtccctttgggtcttggctgccatggggtggacacaccgggctctggacggggagtagcggcattccctgcctctgcaggctccctgatgtcagtgaaccctggcatggctcgctggatcaaagagctcttctgccataacgagcgggtggtcctgacgggggactggaaacatggcttcttctcactgacagctgtgggggccaccaacgtgggctccattcgcatctactttgaccgggtaagcaggatctaggccctgccaaagcccaagggccagacctcttgggtctacctgccttgtctgctgtgcggcggatgcgttgggactgaattctagggaggccacagctctggtcaggcctggctctgctgagcagctgtcctgagaatggccgctccacctgccagccagctgaggcttccctccctccttgcactgctggctggaagtggctggaagagatggagggaattaacctccttgcctggcacctggcttctgctaggaaccatggtcaaaggtgagagtgaggagggaacagaaagggagtgttgagctcggggtggctcatgttggttacagcatgaggggtcagcactcgcaggtctgctgcccaccctgcccccaggggctgcctttttgggtgtcagtttgtgaccaacggccttggctcccacgggtgctgctctcccagcaccatgcatggagaccactgggccccactgttccctgtcctccctgggcccagttcacagcaggtgtcaag

SEQ ID NO: 13057 - DNA, 2260 bp, Homo sapiens
aaaaactactatggttgggtgtggtcttaatggtttttatctgaaatggtgttaggtaacaaaattgagtacaacggcttgggcagtgatacaggctgacccacagtatttgtggctttccaggcagcccgcttcaagtgtggggagagagtcggggtcatgtttcagacccagagatgtgttcctgcagtgggatctcaaaaatccccagccagccttctttgagggccacctcattgtactctgggctcctacgtcacatctaccggaactgtcaaatgctggagttagccgagtttctgggtttgtgcctgcaggagtctgtgggcagagggatgctgtgggtcagcagcctcgaggtcttgttccttttccactgaagtcctgtgtgtccatatcctgctccccttcccctccttctctaggggtttctctttctctctcaaaacaagagtttagagaattaacattccatggctagtgagtgggatgcaaaagtcatcgtcaggacaccagcatcacctcttcatatcctcctgggagccactggcatggagcagccgccgatgggaaccgtcagagttctagggacatttccaagtcagtctattagagaagagtgagtggcacgtcctggaatgttggccaactctcctaggtttcttttgcttccccatttgctagtggatggggagatgggttgggggtggggggtctctatgtgccttgcttttgcaggttgacagtctatgccacactggagcagaaaaactgacatgagccagagggaaaagtgtgccacggctatgttctaggcccactgcctcagacatagcattgagacgagtgaaatacacacttggtcatccacggaggcttccaaggccatggccaaatacagttagaagagagccaggcttccgtaccagctctgaatgatgctaaccagattctgtcattctacatccactttgcccagactgtatagacacgacctatgtttcacctcaatacctctcccttcctgggacagggttcttagacactaaatgcttctctctgacttttttgcttaagggagtgggatgagtagtacattttgcccttgtccaggcatgtttaaggagctcctactggacaggttgcagactagcagtgagtcaacagagccctgtttgccagctctgttgccagtatagatgcagtgatgtggcggctatgtttcccagagacaacagtgggcacagctatagtgtcaccaacatggcagagatagtttcaactgtgcctgttacaggtgtggcactcgaaggaccagaagcagcggtttggaacatgggtaactgggagcagaggactggaagaaacagagctgggctccttccctgtcctgacaatgtaggagaggagttgttgtgaggccagccctgcccgtcgttgaaattctggacctaccctctagctaggtcccttcccctgctccaaagttgagaagggggccccactgcaaacttgaaattacttacctgaaggtgatgtatatacctaggctccagctgcgctcagccacacctgtcttaacattcagtttcggcactgagccagctgcagtgttgtcaggggtccccaggcccgtggtccctaaccacgatgggacatggtaatcggctgctggcacaccacctgcccagagctacaggaggtctggttctggggtggagttggtacagtttctgagtatgggaacttccctccccaagtggtgggaagttacagttaactacagcttactcaactatcacttccagaggtttagtgtttttaatatgggaaagaggagaaatctcaggtctaatcagggttctgcccatcagcttttcactgaaactttcaactgtgttttgttttttgtttttttttccatctttcagtttctagctgtgtttgccttctccctccgcgttccctcctctttttttgcttttggtctcctttccagcttcatgtctccatgagttcagctgtacctcatctcctgttaaagcagatcatgtccactttttcttactgaccttactctaagctacagtagctgagggaggtacggtgaagacatgtagcgtttgccttattcggagcctgaggagcccagaaacccatgctgtgaatcccaaaactcagcgctcctcaagagctgtgaaaatcatgatactttgtcacaattttgcctgaaagggtctttggcacgggctccagagcc

SEQ ID NO: 13058 - DNA, 2317 bp, Homo sapiens
ggagtaattctagtgacagagacagcgtatgtacctgtgtggaaaagaatgcttgcaaagcttgtcaccctcacgagaattcctctgacagacatttgcctttgacagtgaaaacagatattaaagtgaaaggagaagaaaccgaagagcatcagaggggacgactgggttacttaactgttggggagcaatctgaggagttggttaccagagaaactggcgatggcgatcccgtgagcaacatctctcagacccattttaaatgccgggggatacttaatcatgctgaaaaacagcagagccctgaggttttggactacatgttgcagaaagaagagaaatatatacgtcaacaaaaagcacatacgatatcgcaacagtgcatatcatctagtctgttgttagatgatgcacaaaatcagaaccaaccgaaggctgacaaagatgagtccaccatgatcaatgaaatcaccctagcaaagctggccaaggacagcattgtggcacagactcagaagttagaagaccagaaggaggaaaggttacatcatccattaaggaaggacactgagtcatgcacaagtccttgccttcttggtgcccctcggaaagcacaagacccctcctctgctgggtgtgatcaaatacatggtgcctttgcgaagaaaggagttcttcccttaaagaagcagccccatcgaacttgtaagaaagtttcctatcaggagcaaatcattgttgggagaaaaataggtaaaatcagaagttctgcctttttaaagagttcttccaatcccatccccacaaaagcgcacagacttctcagtttgtgtactctgtctgcacctacacgattagaacctgaaacagcacctaccaagagcttggttagtcacataccaaagcagatgtctacaccgtgccatcccttgaggagcctgaattttaggaagactaccaaagaatcagccttactaaacaagctgtccatccttgcctccaaactggccccagccatgaagactcagaagctaagataccgacggtgttcctctgaacttcttccaatggctaaaagctacaagcgcctcagatataaaagactcctggacggattttcatccagcacagagcagctgaatccatatttggcagctagtggatgggataagaggcctaacagtaagcccatggcactttattctctcgaatccatcaagatgaccttcatagatttgagcaacaagatgccgtccctgctgtttggttctgaaatcttcccagtatcctttcatgtgaaatcatccagctcagattgcacgactgagtcctcaaggacttttcctgagcactgtgctccggcaaggcttgccttaggagaggccctccagtgcccgtctcaacctcccaagtggaccttttctttcttcttgtcccacggttgccctgggatggcaacattcagggaagacactggcgtccatagtcagacccacactcaggctcctccccagcctccagctcctctccaagactatggaggcactgccatagtccagaccagagcagactgctctgtccttggccttcacacacttctagcactttgttccccaggatgttaccgaatctggacaaaaaaacggagcttctccagccacatgcctaccatgcagaggctcttcatgacccagtttacacagggcctgaaagggttacggtctccagcctccatagcagacaaggtcttctgttctctgccctactcggtgggcagagtcctatccatttggagccagcatggtccttctgtctgctccttcgaaatctcttctcttcattcccctcactgcaagcggcaaccaagtctgggcaccacaagcaggtaaaatctgtcccctgttctttacaaatgtcccatatttgcttcctgtctctggggagatgagaggggaactgcgggaaatgcaaggctatttagagtcctcttgggtctgcattttctatttaccttgcgaaatctctgctgagaaaaatccaatagtaattcttaagcataggacccccaccccctgctcagttttcctgtagaacctacttctgtatttcacaccattcttttttctgtccatttcattcttcaaaccatcaaatctgttgaatcttcttttttttttttttttttttttttgattaactcttcttgcccaggctggagtgcagtggtgcaatgtcggcttaccgcaacctccgcctcccgggttcaagcgattctcctccttcagcctcctgagtagctgggattacaggcatgcgc

SEQ ID NO: 13059 - DNA, 1572 bp, Homo sapiens
tcagaaggaaatgtacagattacagctgaaactctgctaaaatccgccgaagtacaaggtatgaaggtcaatgggactaagacggataataatgaaggacacaaaaatggcaatgtgagtaaagatctctcagctggatgcggtgaattccaagaagtagacaaaatcatgaccagtgatgaggtttcagaaaccagcacattagttaccccagaacctttaacctttgtggaccctgtattaacagaagcaactcctaaagaaaaagaatgtgaagaattaaaaagttgtccttggttgtcattaccaggaaacagtgccatttctaatgtggacaatgggaaggaagagttgtgtaaaccaaacctggtctgtgaagcagatgacaatcaccaacagcttcatggccaccataatgaacaacccagttctacacatgatagtcccacagccacaagccctttgaaagaaaattctgaagtttcatgtttcacatcagacttgtctggtccagaatccagaacaatatccttagaaaactgtggttttgaaggtggtggtttgctaaagagatctgctgaaaagacagacagttcttatttttataggggggatgatcaagggaagaacttggcttctagagaagaaaatgaggaacggcttttgattcctaggagtgaaagaggtggaccttttctttttaatgccagggaaccagaaaaggagattagtggtcgttgttctggtgaaaaagagcctgttgtttctccaaaggaaaatatccacaataactgcattcaagacagtctccatacagggaactctagttctttaatgcccaattcttttactgaagccacagaagtaatgttaaataaaaatgatttgaaaattactgtacacgttcaaggtaacttgacaaaccctgaggaccataaagaaacttttactaatatgagccatcctggtggacactctgaagaaagcagtttttcctccttgatgcagattgaagaggcaggacagacaacccctgtagagcccaatatattaagtaaatctttttacactaaagactgtaactccttagtcagcatccagagaaatctggaaggcaacacccagttaaatgaagcatcatgtaatgattttctgtttgaaagaaaatccattgtgagtttaatgccagaggatcaaataagtcctgtaagtgaggtattaaaacccaagcaaggtactgctctgttgctaccatccccagaatttgattacagacctgagtcagaaaaagttatacagacctcacatgatgatattccacttttagatgaacagagcatagcctgtgagatgaatgaactttcttgtaccaatgaactggttgtaaacaaagtagaaagtgaatgtgttttaaatcaacaagtgtcccttaattctcaagaacatgcaaatttgccaactgactctctactgcatttaaacaaagagatgcctttagcaacaggcagagatgcccatcagagccatcaccctccattagagggtagagcagatgtcattgctgatatacaa

SEQ ID NO: 13060 - DNA, 1226 bp, Homo sapiens
ccctcaccttccacacctaaactcccccaccttcctcacctaaacccttccaccttccacacctaccctccccccatcttccacacctaccctccccccaccttccacacctaaacccccccttatacacgtaaactccctcaccttccacacctaaaccccccaccttccacacctaaagccccccaccttccacaactaaacccctccaccttccacacctaagcccccccaccttccacacctaacctctcccacctttcacacttaaacctctcccctgttccacacctgtcagaatcttcctccagggattcccaaatgtttcctctctgaattcctctttccctttctttcaaaacactctgaatgtattccagtgacttgggggcccttggagggcaggggtatgctttttcctatttgtgtttccttctataatgcctagcaaggtgcctgcctagagtagtttcatatgtagcttttgcatagggtggagctttaagtgcaactgtggctctaaatgacacatcagcccacccataaggtccatctcagaaagagctaaaaaagtgtccatcttcctcagcccctaggctgtgacctacagctcctccttcatcttcctcagcccctaggctgtgacctacagctcctccttcatcttcctcagcccctaggctgtgacctaccgctcctccttcatcttcctcagcccctaggctgtgacctacagctcctccttcatcttccttggggcaggtggagatgattatatcccctcccctgcccttactgcgtttctgtcttgcattctccctgagtggacagtcaggtggccaggaaccatgtggttaaattgcctttttgttctttcctggtgacctaaggaagaaatgaggtaaaaaaaaattactctggtaaaaaaaaatcaggctgatccatgctgaggaaatcagtagccttaattagaaagtagagagaaagcaggctgggtgtggtggctcacgcctgtaatcccagcagtttgggaggccgaagcaggcggatcacctgaggtcagcagttcaagaccagcctggccaaaatggtgaaaccccgtctctactaaaaatacaaaaattaactggtcatggtggcgcgtgcctgtaatcctagctacttgggaggctggaagcacaagaattgcttgaacccgggaggtggaggttgcggtgagccaagat

SEQ ID NO: 13061 - DNA, 1187 bp, Homo sapiens
ctgtattggcagcacagctactcagatctgcactcctgtctcttgggaagcagtttcagataaatcatgggcattgctggactgatggttgctttgagcccacaggagctccctttttgaattgtgtggagaagtgtgttctgatgaggcattttactatgcctgttgatctatgggaaatctaggcgaaagtaatggggaagattagaaagaattagccaaccaggctacagttgatatttaaaagatccatttaaaacaagctgatagtgtttcgttaagcagtacatcttgtgcatgcaaaaatgaattcacccctcccacctctttcttcaattaatggaaaactgttaagggaagctgatacagagagacaacttgctcctttccatcagctttataataaactgtttaacgtgaggtttcagtagctccttggttttgcctctttaaattatgacgtgcacaaaccttcttttcaatgcaatgcatctgaaagttttgatacttgtaacttttttttttttttggttgcaattgtttaagaatcatggatttattttttgtaactctttggctattgtccttgtgtatcctgacagcgccatgtgtgtcagcccatgtcaatcaagatgggtgattatgaaatgccagacttctaaaataaatgttttggaattcaatgggtaaataaatgctgctttggggatattatctctgtttggtcttgatttttcccccctcgaggaactgtttaaccagtcacaaattgtggtttgaatctctcaaacatggaagcatttgtagtacattatccaagttttcctcccctctcattacattacatattttgcagcacacacataggattcatagattttaaatagttttctgtgaacccagctaacatagcctctctgatcaattttcctgataactggtgctttttaatgagcctcgcagaacaaaatgcagtcttccacagtatagcacctctgaaacattgtgggctctgttgaacttgagagtgtatttaacactgaaggtaaatacggagcttatacacgtcctcaagttttcttaatgtaataagatactaggggcacaacttgcacccctgaaatctttagtgattattgttaagcatttagtattctttaaaatagaaaagcaaacctcattgagtt

SEQ ID NO: 13062 - DNA, 1182 bp, Homo sapiens
acatacacaaatcattaccattgtgttacagttgcctacagtattcactacagtaacctgctgtacaggtttgtagcccaggagcaacaggctataccatacagcctaggtgtgtaggctatcccatctagtttgtgtaaagacactctgtgatgttcccacaagggtgaaacttcctatgacgcatttctcagaacatatcctgttgttaagtgacacgtgactgtatgctaatcgatagcctgcttctctgggctttccacaactgaactcccaatgagaaaaagggaaagagctcttttaccaaggacccgccaacatgtgccgcgtttgcaccaaaaccgtgaagaaggcggcccgggtcatcatagaaaagtactacacacgcctgggcaacgacttccacacgaacaagcgcgtgtgcaaggagatcgccattatccccagcaagaagctccgcaacaagatagcaggctatgtcacgcatctgatgaaatggattcagagaggcccagtaagaggtatctccatcaagctgcaggaggaggagagagaaaggagagacaattatgttcctgaggtctcagccttggatcaggagataattgaagtagatcctgacactaaggaaatgctgaagcttttggacttcggcagtctgtccaacctgcaggtcactcagcctacagttgggatgaacttcaaaatgcctcggggacctgtttgaattttttctgcagtgctgtattattttcaataaatctggcacaacagcaaaaaaaaaaaaaaaaaaaaagggaaagaagaaaaaattatagcagctctcttcatccctcatctttgctggtgtctcattgtcaatgaggccccttcacacccatcatttgagagagtcattgctgtcaatgctgtattacagatgttcaaagagagggttgcaaatgccaagtgagctgtcaatggtctactgcttgttggtagctgagctgagaatcaaactagccaagtaggttctctcttcagccccttacttcccaaaactcacagactctgcacttaggctgttgatttctttgtgtggcaagagttcaggagctggccattccactgtggggtcctttgccaagaagcacagtttagccagtgagaggtggacattgtaccattgggtctcctggggag

SEQ ID NO: 13063 - DNA, 1316 bp, Homo sapiens
agaaaattaaaattgccagtaattctaccatcaagagataattatcactaacatatgatggttgggtgccgtttcttccaatcaggttctggtgtgtgttttatttacttacatttactacatttcctagttatacaagtaatacatgttctttaaagacattttgaaaaatacagaaaaaaaaaaaggtgaaagtgttttggaaatcagcactgaccaacatcaggcttacttcttttttaaatttttgctaatttcataggcaaaaaaaaactctctgtattattttagtgtgcatttatttcatcacaagtgaagtttggtgcttgtaaagactgtgttttcagtggacttgtacaatgtttaaattcctctcctgcaggctcctgagtcctataagaatgtgacagatgtggtaaatacctgccatgatgctggaatcagcaagaaagccattaaactgagaccaattgctgtgatcaaaggatagaaccttggacagcagggctgcctgacaccaccaaccctctctgaagtggaagtggactgacatgctcttctgacatcagactcaaggcgggacaagttgcaaagtgtgcagctgtaactgctcacgccaaaatggctgatggggaggctgctgctttcaggggcccgtgcttgtaaaataaccttccaggaagaggcacattgcccacctttggaaagggaggaatatgccttctccttggttgttccacagagttttaggaaaatctgttagggatgggtagatgtcaaactgccttacgcagtcatactgatctttagccatcagattgatcttcttcacaccaagctctgtttacattccgagaggtgtcatgaagaaagttctgttcaataaggttttggaatgtttcctttcgtctgttgctttgtcagtttgtccattcatccacccatttaggcatcacccctgcactcagcaaaaccctaaatacccctcttacttggagagcacccagggagttgtaatcaggctgttagatgaatggatagtggaacacattgaagagggagtatggggaggtttaaggaatagcggcccaaaagacaaagtcttcatagctttactacctttcttattctaaatacacggcagagtttttgtatccatggggccgggtgaacaaaatggaggtaggtggtggtgctggtgatggagggcacagcagaaccagaggcctggcctccctcctacacatgccttgcagggcttttttttttttttttttttttgagactgagtctcgctctgtcacccaggctgaagt

SEQ ID NO: 13064 - DNA, 1150 bp, Homo sapiens
ctcagattttcactctcgtcctcttccttcccctccgatttatcaaagaatcaaagtactatcttaatatagtttactagccgcgcgtttagaagtctgggtttctccggccgggtgtggtggcttacgcctgtaatcccagcactttcggaggccaaggcgggcaaatcacgagttcgggagatcgagaccatcctggctaacatggtgaaactccgcctctactaaaaatacaaaaaattagctgggcatggcagcaggcgcctgtggtcccagcaactcgggaggctgaggcaagagaatggcgtgaacccaggaggcggagcttgcagtgagccgagatcccgccactgcactccagcctgggcgacagagcaagactcccatctcaaaaaaaaaaaaaagaagtctgggtttctcctacaatcctacagtgcaagagaaaatttaaattttatgcataaaaagcctatgtttttctgaattttaacatgtttgatttatgtgcatcctcagctcactggacagccagtgctcattggtggcaccatgggaacctgtagttatgttcttactggcactgaacagggcatgactgagacctttggaacaacctgtcatggagcggtaaggaaaacagaaacttccttagaaatgctctcttcagtttagctatggttttccattttgactggtaaatgtagctgattgaacattaacagagttgagacttgggcctatcatgtcttgtacttcaaattgttccccataatgtatactatttagtgaactgactggggtcacctagtatctctgcctcagtgagatctggtagggttagggaccgtttcttatctctgcaagtccagaaaatccagactgggaaattgtcacactagctgagcttactgtctggtttataagtgatagaactttaactgatgcaaatatcacagttgatctcagcgactgactggacctgctcctttgtttaatttgccccttcctattgtgtaggtccacgcaagattggaaggataggccctatttgcaaattagagcccatgtacagtctacacacacacccatttcaaaacactgcctctcatcttctaagcccaggggtcaggaaactcttcccataaagggc

SEQ ID NO: 13065 - DNA, 1100 bp, Homo sapiens
ccactcagaacttctgtgaagatgggaaaacagcttaaaatttaacctgtgttgcctgaggaattctagataccttcatttatttgaccgtaattcataaatgattaaggtgtgtacctggttgaattagtcgttagagagtgatagctgattaaggttacagagttgttgttgttgttttttgttttgttttgtttttgtctgtttaatcactacctcatggaattcaggatcagagaggcaaaactgaatataaaaaagatttgaaaattaacaaggagcagtataaatgtcaagtagaactataatgatgtctaatagggcatttatcattttatattggaattatttatatgactgcattcctcaaaaaaccagttactgagagcttaaactttgtatctgactcaaggcttggaacacaggagatagtaaatgtcgagtttttctctgccctttaaggatgtggtcatccttaggttttgatctgcctttgctgtgagatgactagcaccttttatacttatccagagacttggaggaggccttggagatgggggtggactggtccttaagagaagggtatgcctgggctgaagacaaggagcactgcgaggagtacggaaggatgctgcaggctgaccccaataaagtttctgcaagggcgaagaaaagaggccttcctcaggtaactcactttggaggggcaacatgttaatttttttttcatattttgtttttattgggggaaaaaaatctatatcttacatttagcaaacatattcccaggtttttttatggtatatcaaaaaatacaaatttgtttatgcttcatttttattctaaaaaaactatcagggctggatgcggtggctcacaccagctttgagaggccaaggaggaaggttcgcttgaggccaggagttcgagaccagcctgggcaacataagaagacttagtctctacaaaaattaaaaaaaaaaaaaattagccaggcatggtggcacatgcaagtaatcccagctactcagaaggctaagacaggaggactgcttgagcctaggagtttgaggctgcagtgagctgtgatcacgccagtg

SEQ ID NO: 13066 - DNA, 1248 bp, Homo sapiens
aaaaaaatttgtgtgacttggtttattgcattggtttgggactaaatccacaatatgtctgaggtgtgcctatagatctttactatgaaagcaaattagaactaaagggaaacatccagatcacttaccttatcttgttcttttatttttcttttttctacagctgtacaggaagaggcacatacaaagaaaagaatccccgaaagggcggtttgtgatgctcctgccatcgtcaactcacaccattccattctatcccaaccccttgcaccctaggccatttcctagctcccgccttcctccaggaattatcgggggtgaatatgaccaaagaccaacacttccctatgttggagacccaatcagttcactcattcctggtcctggggagacgcccagccagtttcctccactgagaccacgctttgatccagttggcccacttccaggacctaaccccatcttgccagggcgaggcggccccaatgacagatttccctttagacccagcaggggtcggccaactgatggccggctgtcattcatgtgattgatttgtaatttcatttctggagctccatttgtttttgtttctaaactacagatgtcaactccttggggtgctgatctcgagtgttattttctgattgtggtgttgagagttgcactcccagaaaccttttaagagatacatttatagccctaggggtggtatgacccaaaggttcctctgtgacaaggttggccttgggaatagttggctgccaatctccctgctcttggttctcctctagattgaagtttgttttctgatgctgttcttaccagattaaaaaaaagtgtaaattacatggtggtcttgacttttattacagaaagatatgtagtaaatattcagaacagatacacaatgttacttggacatttcagaattatcagagaacatagcataggcagataatttttgtaagggttttctgtttgtttgttttttttttttttagcagcgctctgtcttctaataaaggcctgatttatgaaatgaatgaaaacagagctagtttggttgaactggacttggggtgggtgctttggctacacacctactcaaatccacctcttctctcgacttctctctctctgcagctctttcttgggttctgtggtggaactttctgggctgtgaagcaatgctgttgaaaggccatttggtattagggactcctgtttgtggctcctgggatgagg

SEQ ID NO: 13067 - DNA, 1629 bp, Homo sapiens
aattcaaaattgagccatgctttttcggtttgtttttatttatctctttggcccagccaagctgccctcactacagagaccttggacaaggatccagccagtccctctctgccccacaaccctgcattcccagaggttagctatgcagcccacctagatgagtctcttcaagaatgggaaatcaaggggtgacagggagtaaaagggttatcatcttactgcaaagccacaagatcagggcagggctttaggatgttctggatgctttttaataattatgcttcccatcataactggggagaaagggaagtcagggttctaggggttattcgtcccaggaaatagaagtgaaattgtctttattaagtgaaaactttcccctttgccctgcaatgtagctgggcattcaaacggagggcaaaccgatgatctaaaccaaccacttggaaaaacccaatggggacattgtaaccagagggtcctggaggtggggttgatgggtttccttatccccaaagtcactcctgttttgttttgtttttctttgggggttttgtttatttttggggctggcaatccaaaatagaaaatctgatcctttgaggctctaaaggaaaatcagctgcctctaccaaccaccctctatcagcagtggcccaggaaggaggtcaagcatcttcggccgatatttaaacatgggcagcttccttcaggatgatcaccgaggctcccgtgactttgaactccctactctccagaatccaggggctatagcgatggggactgcggaattacgagggctggctgttttacaccggtcacattttctattggcagtgactgattcatgggaaagggctttgaaggaactacttcagtgcacacacaaggtacgaacctctcaggcctttcgaagaactttcataattcatgaaagcccagttctgaagattcacgtatccatctggagacctacaggaagaaagtgattgggttcctctggttcttgcctgcttcactgtggatgggaagaggtgacaacctcagtctccctttgggacctgtccaagggtaggcaaccaccttcaccttcacacagattgaggagacactggactttttacccattttctttaatcttcaatattaatattgtgtttacattgatgagaacaagagttaatgccctaccctctgctgggctgtttgtattgagttgcaatgtgaccagcgaaagctgcatttaataaatgaaagtacagactgtttcttccccattcccctcccactcttgcaggaagctactgagacacaccttgacatagagagctaaattgcagtggataaacagcaacttcacactttctgttcccccattctatttttctcatcatttgaactttagccttttttttccccttttgcctgaagttagatcccactctgtctctaactcaaaccatcttcaagttttccattccgcatctttctcaacactggagccagatgttgtcttctaccagatgtgggctaggagggtaaatcctggtaatcaattgtaaagggaacatcccatccttgggcctggtagtcatgtgggaccctatagcaatccggtttgtgagatca

SEQ ID NO: 13068 - DNA, 1212 bp, Homo sapiens
agcaacatttctaaacacaaaatgaaaccaaagaggcataatgattttgtggaaaatgttctaagctagtatttttcttcctttgcaaacagaaaagactgaaaataattaaatttttttgtaatatgactcagttcccctttgtgccatattataatccatggaaattactgagttgtgcagaagagtttactcctagggtatacggccccaaaggatcatgcttttttaattcttgagactgctctttgttcttcttttttaatttttttggccagccataaggatactacgcagacatgctcaccattcctaaacttcctggggaaagtttaaaggtggctacagcctttccagtgtacagcacaaagacattttaattttaatgatttatctcgctcatgagcttttctcatttacttatagaataaagttttcattcttcatttagaaggcttttctttataactagtacaagttataaaacagaccatctatcctttatattctcttaagaaatttgtgtttgtggtaggtaaaatgaaaagttactgccgttgtttttggtagaatttacctggtgttcaccttgaaaggatatgtgcttgtgggccttttaaagcaaaaacaaaataaaaaaaggattgaaacttctgaagttatctaaataaatattcttggtatgtattgctgtgaaaacaaaattcaacagagcttttagatgtacatgtcagttatatcttatattttgtagaacttgagaagttggcatgtcagattagtagatgctctggatgcggagtttttcaatctttgtgacaggtaggatacatttaaactttggtcagcttccggagaggcatagcctggtctttcatcatatatctgaaggcaaaaagatagatggaaatctctaagcagtatgaattgtaagtatttctgttgagttataaatacctcaaggaaaagaaccatcttagttttcttttattcacttaacaaatatatattggcttttgaagtggttgagtgtagagttctagagttaaaaatattttggacttaaagaaaaaaaaattggtttaaattcctgctgtatccttggatgattcagtgtaggccagtttcccttcacaatagttattgaggggctactgggtgtcagttgctatgccaggtgtattagcatgttctcacgctgctaataaagac

SEQ ID NO: 13069 - DNA, 1186 bp, Homo sapiens
aagagtttccaggattctgagtttttataattgcagagacatggaattcattttgttctgcttgagtatacaggagaggcggtgtgtatgagacattaaaaaatatcaaaatcaggccgggcttggtggctcacgcctgtaatcccagaattttgggaggccgaggtggggggatcacctgaggtcaggagttcgagaccagcctggccaacattgtgaaaccctgtctctactaaaaaatacaaaaattagccgggcgtggtggcgcacgcctgtaatcccagctactcgggaggctgaggcaggagagtcacttgaactccagagacggaggttacagtgagccgagatcacagccattgcgctccagcctggaaacagtgagacttcgtctcaaaaaaaaaaaaacatgcttgtctgctggttcttccttcactgtaacagaaatatctagggcttttttttttttcattgttgttcttcctttatctcttatgaggctttccaaaaaagattttgttctaggaatggaataaactgtagggcgtttaaggcttcagaggtaattttgggcaacctggagttgcaggtaatcacaggctggggctggaattgaaaatgcagtctcacccataatttgagcctcttttgtcgcattatggggctgtgccttggacaggcagcagacgcagatggagatggaaccctgactactgagagagctttgcttttaacatagtccttttctgaattaccaaggccaattgggaagaaaggacttgccgatctttccagctctccatggtagccatagaatttaggaagatttacagcagaacgtgggcatctagggatttctttcttccttttcttttttttaaattttaaattcagaagggaatcttgggctcttgagtgttattctgtggttagggattgctgcggcttccttggatacattaaatgcatatttgttattattgagtaaggttaaccttgctgcggctaactcgaagccatcccctccccttttgtttttagaacagttgcgtagatccttcatgtgccaacactgtttgtttaagagccttcttgactgatgtcagctctcatctggaaatggcattttgtggttgtttcagaagccaagggaggcatagaggcaagcccataggccggtggggct

SEQ ID NO: 13070 - DNA, 1143 bp, Homo sapiens
cacccaccgcgccgcgatccactcgccgcgcctccgctcccgtgaccttcccggggcgcctcccctagccccgcgcccccggccccgcgccccaggccggggcgaggccttttccggcgcttctttcccgcggagccgcgggcgggcggcgcaggccctgggggagagcgcgccgcggccggttgcagccccccccgcgccgccgcgttcggcgcccggcccggccagtctgctcctgccccgccgccgcgccggagcccgggcgcccgaagctgggggcgcggccgcgctcgtctcgccgggctgttcgcgggcaggccctgccctgaagggacgaatcggcttggagcgcgggaggtggagtcggccccggcggtcgctccctggacccaacccgaggctgacccaggcccctgcccatgcggggcgcccctggctcggaagagtcccccgggccgggagcagctccaggcagcggccccggaggaagaggaagaagggacagtgctcagcttgggggacccggaccctcgccgcggcatttggagccgggggcagtcccgaactctgtgcttggcaccgccgctccgagtagggcagcgcctgccgggaccctgacccggaccccctgcgcctcgtaggcggcggcgccgccgcgccaccctgttcttccgtgtctccctctgcctggcggcagtcacggccaaggtaagagccccggagcgcgagagtcgccgcgggggcgccgtggtgtgtagcgccggacaagttctccgaacctgtggctggtaccccctgtactcgggatgccggcggggaggccgggcacaccctctgctgccccggccgggagccctggagaggctggaggtggaagcccccagtctccgaagtccccaggaccccctcagggcctgctcggcttctgggcacacaggctgctggcagggagcgagccaggaggagtttctggttaacaccacgagggcatgtgaccgatacccgcacccccggccctcttgttagcggtgagcacctgtggttcgcggagcctgccgtgtttggagagggccctgttgggcggtacgcaactacctttcgtggtgtgatgctgtgaataacttttcttgttccttcttgcag

SEQ ID NO: 13071 - DNA, 2220 bp, Homo sapiens
acttaagaaagcagcattctagcccttgaggtactacaattcctgtgtttcctgtttgctattctgcacccaaagacagtacaggaattgtttccctcttttttacgaggattaatgggagaagtcagcagaaaagttcctagcataacaaacagcaggatgccgtcttcattctcacctgtttttctaactccatttgatttttcttatctctctccttgaacaaagaaacatctctcaggaaaccaaggtacagtactcttcagttgaacatttttctttgttttgcagtcaaacacattagacaacattgcttacatcatgccgggactgtgacagcaaagaatcctgggacagaaaccttatcctacaccattgctggtttgtgtatatatgactgttgcagattccttcagtggcctctggctgtaggttttaaatttttatatctatacatacatatatacatatatatataatgtacaatatatacatagactgtaactactttgcttttaataattttatgaaatggcaaaggtttagccaagaggaaattttggcatgaatacaggcttgggattcttttttctcctgtggtggataaatctgccttaaaaatcaatgtaacttgggggctgggggcttgttctgggtgccaagcgcatctctttatggacagctaaaatgtgattattttccaagctcagttggacctccagacccatcactgaccatttgccttacctgtcttagtctgaaatgtaataggaaagataacgggaagatgccagttgactgaaaattcaaagcctttcaatttgaagtgacctaggtgggaggtgataaaatttgttccctttatagttatggaagtggcttaggtgaattgagtagagggttcattccaattcctactgtataggtgtctgtgtctcaaaatttattgtaatcattggtaccattggtggcctcaacagaggccaaggagttctgtgagccctggcagcaaaaaacaccttggggggtgaagctgtcaatgccaccagttggacctccatacattctgagctaacccagaatctttagtcggcagaattaagtgctggtgtctttcactggcagcatgaagttagccaccaagtcctcacaagccgtgctgcttagttgctcggtggttatggataaactttgcccagcatgatttttgggttcatcttatcagttcccctggtgggcagatacacagtgttctgcattccacatgtaagtgaattgcaaaaacaaaacaaaactcactctcttgtaggtttatttatgtgtgtgtgaatgtgtattttaattatgtgtatttaactctttaaaatctcttagattttaatttatcctgtaaatttctgtatatataatttaataacagaagcctccaccagcaacagcatgtggaagatacagatttgtcatttctcccttccgccctcccttctttccttccttccttccctgtttccttccctctttccttccttcctcctggtctgttccaaaaactctgaatcatctacattttaaggtattttacctcaaaaatgaatcattgtgttaggattctaattctttataaagaacttcatgggcttcaataatgtctagaaagtaaaataaagaggaatgttaccatccccagctgcccttatttccagagaaccagacgtttgtttcccagttggaaagaagacagttgagcacttcaggatggtttttaaatttggtatgagattctctgccaacaccaagctctgagttaactgtgctttcttctcctggccctgacagagcactacagcatcaaagtaaatctttggggacagtgtagcccatctgcatcctatttaatttcttcccttctccccaccagtgttgtcacagggctatgttgcttaaaggtagtctggctgctgaatccctttctcagctcagagcagttttaagatttaattgggaatacagagaaacaggattgtttgagaaccaaaatcaagaggaacagaaatcttaacttgatttcatgtgttagaacattgtaccatgcctcttctgtatctgtggaagtttcctgtttgacacagggtatctaggaggggcggggaagacatggatagtataggaagacattaatcctagcattgtcatttatatacattaatgaaatcctgatga

SEQ ID NO: 13072 - DNA, 1237 bp, Homo sapiens
accacagaccctgaggccgctctgctttgctttcctatgacatcagacaccctgatgcacgcccacctgttaatgaccttgccccattttctctttcagattctgcccccgtggagactcccagagggaagcccccactcaacacccgctcccaggctccgcttctccgatgggtccttacactcagctttctggtggcgacagttgctgtagggctttatgccatgtgaatgcaggcatgctggctcccagggccatgaactttgtccggtggaaggccttctttctagagagggaattctcttggctggcttccttaccgtgggcactgaaggctttcagggcctccagccctctcactgtgtccctctctctggaaaggaggaaggagcctatggcatcttccccaacgaaaagcacatccaggcaatggcctaaacttcagagggggcgaagggatcagccctgcccttcagcatcctcagttcctgcagcagagcctggaagacaccctaatgtggcagctgtctcaaacctccaaaagccctgagtttcaagtatccttgttgacacggccatgaccactttccccgtgggccatggcaatttttacacaaacctgaaaagatgttgtgtcttgtgtttttgtcttatttttgttggagccactctgttcctggctcagcctcaaatgcagtatttttgttgtgttctgttgtttttatagcagggttggggtggtttttgagccatgcgtgggtggggagggaggtgtttaacggcactgtggccttggtctaacttttgtgtgaaataataaacaacattgtctgatagtagcttgaagtagttttcatgggctttgttattcttggggaactgaccttttcctccctggtttcttgcgtgctcggtaggagaagtggtgatagggggttggcaggagctggtctgtttgagaatacagaaggtgagcttttcttttctttttttttttttttgagatggagtctcactctgtcacccaggctggagtgcagtggcgtgatcttggttcactgcaagctccacctcccaggttcaatcaattctcctgcctcagcctcctgagtagctgggattacagaagttcatcaccatgcccagctaatttttgtatttttagtagagatggggtttccccatgttggccaggctggtctcgaactcccgacctcagctggtccacctgcctcag

SEQ ID NO: 13073 - DNA, 1183 bp, Homo sapiens
atcccccacatctaatcactcaggaactctggccagctccacctttaaaacgtgtccaggatctgaccacttctcatcctccccacctgctctgagcccttgtcagccctccctggatcaccgttgatcctccccagtgttcgtctccaccttgccctaccttctctgttctgcagcagccagtgagcgatgctgtcatgaccaagacactatatcactcctcggctgaaaggggagaccttccagtggtttccaaggtcctatgccatctggccctctgtttgctcagaacccttctccccacttcccctcaccctttggaccctggaacacaccaggcccattcctgagggcttgagagctgggatctctgtttactcagataggttgtgctgtcctggccctaagggccctaagggctctgccttctgggaggtccctgagctggtgccaggatgggcagtgggctggaagagctcccttgtactcactcatgcgcctgctttgcctaccaaggccgcagctttgctggggccgtgagcccccaggaggaggaggagttccgtcgcctggctgccctcccaaatgtctatgaggtcatctccaagagcatcgccccctccatctttgggggcacagacatgaagaaggccattgcctgcctgctctttgggggctcccgaaagaggtaggggcttgagttcccttgggtttggggaggcggctgatgatggggctcacagtaggataattactggataatcaggactgggcactcttttttgtatttcctgggcccctcagtctgccaggcacctttgccagcccccaagcttgccatcagctggctagtggctgatctgcgcacctgtctcagcgatgccctgaccctggcaagggggagactgggggcctggcaagtgcagtgggagagcactgagcttagggtcgtgtaggtaccaggacttaaatctcagcactgagcttggggtcagtagcagggatattattagcagctgccatttactgtgttcttcctatgcacagccattctttgttttttttttttgagacagtctcactctgttgcccaggctggagtgcagtggtgtgatctcggctcactgcaagctccgcctcttgggttcacaccattctcctgcctcagcctcccgagtagctg

SEQ ID NO: 13074 - DNA, 1725 bp, Homo sapiens
taggtgcgcagactgaggcttagagaaaggtttagagcttcggttctagagtcagatgggacttaagtcccagctctacctcttaattgctgtgaccttgagcaagtggcttagcctccgtgtgcctcagtgtctggtacacagtgggcactcaggaagtgtgggccctttaggtcaaaggagcctgagtacaaagttccccgtgagcctggggatgtctgggctctgtcggagtcccctcgggcagcacgtgccgttagccagccatgtgctcccacagaaatacccggagcacgccatccacaaggtgctgcagctcatgctgcggcgcggcgagatccagcatcgcatgcagcgcaaggttctctaccgcctcaagtgagtcgcgccgcctcactggactcatggactcgcccacgcctcgcccctcctgccgctgcctgccattgacaatgttgctgggacctctgcctccccactgcagccctcgaacttcccaggcaccctcctttctgccccagaggaaggagctgtagtgtcctgctgcctctgggcgcccgcctctagcgcggttctgggaagtgtgcttttggcatccgttaataataaagccacggtgtgttcaggtatctgtgggtttgtgcactcggtgacctgtcacctccatcgtgccctcatggcagggtaagtgtgagggaacagggtctggaggcagactggccagggtttctgacttggatctgccactcagacttctgggtaagtcacgtgacttgagtgctccggtttcttcatctgtttagcggggctcataaagccactcccttgatgctgggaatccagtgagaccagggagtggggaagcgcttctcaaagtgtgtgattttgatccgcctcacctgttccccagtaacttattggggggctgcgagccgtggtgcggcggtcagactgcctggattcatggaccctctccatgccttagtttccttatctgtaagcaggctgatactagaacctgcttcacagggttgtgcttagggtcagtgagcagctgttagtgaggggaatgtagtggccaccaggcaggaactaggactccagccagttctttcctggtgggccacgtgtaactgtgtggccttgggcgagacatttcacttttctgtgcctgagtttatcagtaaactggagatggggggattcctcaccctgagttgtgaggattgaatgacagaaggcactagtgacagtgatgctggaggaaggagtgttgccaagtgcctcggtcactttgcctaatttcagaaagtcactctgagttggtatgttttgtgtttttaaaaaagctaggattcataaaattaaatagaaatcagtgaaataaaatatttgatatttaaaatacatttagaaatacaaagtgtcaagcaaaacgtgaatttggaaatctatggaacattagataaggtatttaaaagtaattgccatgtaaaaatgacacgaacttgaagtaagattatttgatttttctaaaaatacaagaaagcttggtgcatccgcctggtcattgttgaatcacaaatgtatttttgtgcagaagattcctgcagctcaaagccctttctgattccatactgttcggggaaatggagagatgagaggagctaaatcagctttcctctgactcactcccgttcaaagctcatttcttttctgataatt

SEQ ID NO: 13075 - DNA, 3883 bp, Homo sapiens
gacaatttttgttgtatgtatataaatattttagttagaggagcggggaatgggatgcgggctttcacagttctagggaatgggggcagggaggattttgcttttgcttttgctttgagggagaactttagctgactaaaaaaacagaagtttggggtcatgatcacaaaggggccattcccaaaagatggcaagccacgtattcagtggagactaggccaaattctaaatggttttatccatagcaggggagaataggagaatgagtttaagagtttttctcttcttttttcctagaaagaggtaaggataatgggaaaggtagagaaggcggctcccacagaccttttaagagaggcagaatcttgagcttgaggcaccttgagtgcatctcagttcagctggttctggctgaggcctccaaaggcaagctctgtgctttccagtggtttctgctgcatttccagggatggtgtttaacaccgcttcctccagctcccttttctaagaaagaataaatggagttctgctttttatgaaagggtctttggttttcagtgtcaacactgagaattggggctcttgcaagcatctggatttcacagtatcaacctccccgtcaccttttgaactttgagactccgtacggtcaacttcaccagaggcaggttgctcgaagcagcactgcttgtctgttcctgactctggttctcactgtattaaaaaagagagtcagaggagtctggcatttcgtgagtttgttagaggatgctggctgataattccagaaaacttactgatgctaaatcacagtacatgcatgattctttttcagctttactatagttcatgacctggactttctgtactcttggaagctgggctccttaaaggaggcctctagtgaacacctttatctccatgtccctcttagagcccagagagctgcccataggcattttccagaattcctcatgtcacctagttcaatttccattaactcagatcagccattgtgattcaccatttgtcaggctctcaggtttaacaaaacctactatcaccatcatccttcaacagccacagtctgaattgagccaacatttttttttctttgagaaagaagtggactggggcacaacttttagtctgaggggagctagtggaaatctagacaatagaagtcatcgatagcagcttttcctcaaatgtgtgactcctcaggggctaaactgctcttagcttagaattatgctttactagagatctagcagataagtgggttaatcactaccatcctgtaactagttatatagcttccagacatgagggagacatcaaacagggatggaagcaaccccaaggatatgcaagaagggcatgatgaacccccttccctctggcaggagaacaaggccaaccaagggacagactggaaagcacttagatgtttaaggaggagaaaggggaagctttgaccagtccttgccttttgccaagttcagccagttctccgctgcttgcaacctctagcgcagtaacatttgcagaattgcagattttcccccagatactaggaggaaagggactttggggggtggggaaggggtcgtggtgttttaaaagcataagttacctgtttgcactgttttaagataggaaaaaaaaatagtgggcaaggtgaacatcagacgtaaatttgtgtgtttttattttgtcatgctcttgaaaatgtttgaccatttgtagtatacacagtgaaacttgattctctgttgcataaaacactatatttttttggaaatgttactgtccaaaagcctcttccctccctttccttttcctatgtacttccttcatacttgctttactgatcagccaggcaatagccatccaagagctagagcatgaaacagggccctttccaagtaggctctgggtgtcctaagccagcgtgtgccctctggtttagtgagtgtaatagagtccctggcacctttctttgcaaatgaggctaacagaccagactgcagcaagttatcagattcctcaatcagatgcactaggagtgaggagcccagggatggagggggttcctgaagtattgcagttggctgtagtagctgagttcttttccatgttaccgaaactgtagccagttacagtttactcaggaaaacggtagatcaattcagccatggtagtgctggttggcagggattggtaacggagagaactgctcatcagccaaaactcaagccttgccttttaggaggccaccagcagagggacttggtcctccttgtctggtacttgtgtacatgccggtgacctgaggactccactcacactggcgagcaaaaagggagcagtgattctcttttctctccccaccccctgccctttgttaccaacaccagtttcccagggggtacatgagtttctgaatttttaaaaaatgtttttggtttggtttttctggggactgataagtgctttaagcaatgtccataccccgtcaagactcccagcttagtcattttcttgtatttttctgttcacagtatttgtgtgtgtgcttgttttggcagctcattttggctgtattatatattgagtgatgaattgatcctcttttttccctaagggatatgaattgtttttcttgtgttatattctgcttgtgaatagctggagcaaacctggggctgacacgcgtaagctagggctgcaaagcgagaagagagccggtggagtgtacttgtccctgacaggctgacctacctgagtctctgagcttttcagtccaaatctttgcaaggctcaaaatgccacagaacctctcctcttctccccactccccatggcagggaccggaccatccctacatgcaacatgctgttcctccagcccctcccattgccatggcaaaacaggtacctttggggcatgggggcattacatgggatgcttgtgtaatcgaccacctagccttctctctcccctcccgtcctcccccagaatcacttcctaggacacccgagctgcttgcccagggtcctgtttccctgctaactccagagaagcatcccagggctttgtgacagtctctaattcccttcccttctcgttaagaatcatattgtatagtagctttcagaccatacagtattcattgggttactcctattattatcaagtagctggaattgtgaaggtcggagtagttagatctttagcttttattccttatttttttgtattactctccatgtgtataaattattgatcatgttgctggcttttataaactctaagcgaaggaggagcactgcctcagcctttgcacatggtaatgaagcactgtttttaaataaaagagagaaacaccattctttgggctgtgtgtattaatcctcgttccctgttgcctctgcctgaggctccaaagataccacttggatttgactttttaagcggggggcgggggggacaagaaggaaaagtgccaggcgttctaaggtgagacgttctaaatggtgatgagaagccagaaggtaagcgtgtgtcagctgctctcagcttccccagctgtgaactccagtctgtccaaaagctgcttctgaaatctttcagcttcacttcttcaccgtccaccctcccctagattcaactgctgcctttactgtaccacagacactgtccttgccaggggctgtggccccacttgaccttatcaaagtgttatttccctgccttgcctcctctgtccctgctgcccctggctctccggctgccacccaggctccttcactttttgttcagccatagaaaatatgtcctgcctagccctttcctccctgtttcttttctttttttcccc

SEQ ID NO: 13076 - DNA, 1097 bp, Homo sapiens
aatgcatttccatgtctgtatgtccgtgcttagcttattctatcaatcacggaagaggcagtcaaggaggaaggagagacattaggagccgataaatgcatctgatcagaaatcagcagacagaattaccaaagtgtatctggtgctgaatgactgggggacaagcagaagtggaagagatctttctgcaacaggatattcttctagtcttctgagtttctggtctttgacaggcaattctggttggctgtggctggaatccacatgctgatagataggaatttgtgcttacaaagcaggagaattaaaaagacgctttcctctcctcttccctcctgtcttctccgttctttttacaatcatcttacacgcacagcctgagacagctggcatagtttttggaattatagtattgatatttccaaacgtgctctcagacagtggataataaacacctcattaggaaaccgatctcagaatgaactctggagtatgaaaaagatcatttctttttgttcctgtaacctagcattccttctaggcttcttctcctttaattgaaccacagcttagctcatgtattcttttattaacaccctgctctcatgtccataagattcaggaatttaggacccagggacagaaaagtgaataagccagtgaccagatttcccccagatgtcttgaggattagaagtacaaattgttgacagccattaaagagggtgaggaagggaaaaggaatattagaagatctggtatttcttacttttttcttgcctcagaaagtacaaagtttaaaaaatagaataaagaatctgctggggaaagatagagtaccaggtcctaggtcagtagtccctggaagttttggtgatgaggacatggaagggcaggcagaggcactttgtacttgctccaaagccataggaattttcatcttccagagcctttatgagtcacttctctatccacagtcttgagcctgtggctatcccgctgagcttctcactgtcctccaaaaacaccccgctgagcacccggaccactttgtacacattaacactacaggacataaaatgcagaggccctgagat

SEQ ID NO: 13077 - DNA, 1220 bp, Homo sapiens
attactctatagtagttttttcttagttgttgactagttttttccttttttccttcttttgccttcatattctagatttggcttacttagattatagaatgaatatatatcatatttgtgcacacacgtgcatacatatatatttaaattatttcatgtgaattttagtctttttactccctaatcctttataaaaacatagaatcacctgtatctaagtttctttgattaactgaaacagagatagactaggcttttaaaaatgtactattaagatatatgatggaaagtggtattcctgccaaaaaattaactaatttattcatatagaacctagaaaattattatatgagtttatgtagctttgttaattctccagatttcaccagtaatgacagattattaacacaaataataagataatgcctagagtgaccatatttcctggcttatccaggctagcctcaatttacacctgttatcttagcataattattaataaatgacccctttctctctcagaatgtcccagtttgaatgataaactatttactctccttatatatgctttgggtaacatcttaaaaaagcagtctttgaaaaggaaaacatgatgcttaatgaaaagtataaagaaaaaaatacatagtttattaaagagaaatgtgcactagtgatattctcatgtatccttctagtcttattttctcatatagaaccttaaaacataacccaaaatggtcacctagttcagccccctgtattcttgaccttgcattctctgctagaaacttttagtgattaagaacttgttttattcaaaagttattccattgtgggtcagactttctaccatcttactcaccatcatccaaccacataacaatttttggtgataattatcaagcttattaaataaagaaatacacagattgtaacatttacattttctataagtttttgccaaaatactttggtatatcctctattgaatggatatgtattaaaatattgaatatgctgaagttgttcagctcttcagatagtgctcattattaagtctactaaaggactacaaatattatacagcccagcaataattatttagatttctagcaattttttttcttttttaaaaattgatagatattagatgtacatattttcagggtatatgtgataatctgatacattcatataatcaaatcagagtaattggg

SEQ ID NO: 13078 - DNA, 1879 bp, Homo sapiens
tggcaacatagtagtagtaactctagagctaatagagggaatgaaatataaaaatatttccttatttcatttccttgagagagcctgagatcatagaccaaaaaatgaagtgacctccataactaagtacaacagactctattttcaaaatagaaatatcttaaaaatagaaagttctaagagtctaagaatgaaggaactatttttgtatcttcagatcctaatgtatctccatgtgatcttgggcaagtcacttagtacttccgtgttcgttagctcccattttgttagcatactataaatactcaaaacaccaacattttgtttgtagacggtagcatttagaacattaatagcatctttgtgttttgttgttgctgctgttgttgttgcttttgtctttgaagggactactgtgatttttgcttaaacataccctgtttggggatgattgctgtggggggataactttaattattttaaagtaattgtgtatatttttcattctttatttctttgcttagcagacagaaggtggagcacagacagacggccagcagtcacagacacaaagtagtgaaaattcagagagtaaatctaccccgaaacggctgcatgtctctaatattcctttccgcttccgggaccctgacctccggcagatgtttggggtaagtctctgaagtctttttatggattttacaattaaagtagattttaatcccccagatgtgttattagtcattattactttaggattaaactacaaatagattgaaagaacctgaggtaaatcagtcttttcatcagtctttagaagcctttttctgtcatccagtctgctctagacatagtcttgcaggtggctgcacacataaggtggcgatatgacccagcttgctgtgactgaggggtttcttgtgatgtgagactttcagtgctgaaaccaggatggtcaccctactcacctaccaaactcagtaaacataccaataatatgcttagtttcatctgcaagaacaaacatgcacattcttttagagcaatgattcctaaacttgtttgcacactggaaattacctgggaagcttaaaaaatattgatgcctatgcctgacattctagggttgtgatttaattggcctggagtgtggcttgggctttggtatgtttacaaaatccccagctgatactaatgtgcacataagtttgggaaccattgcttattcatcctgtcgccttctttgttttttctttaccttccatataagtccagctcaatactgccttcctctcctcttatctccctcaactccaagaccaaagaaactaggttcagggatgcgttattgccactctctacttagctttgtaatgtctaaaaagattcacaatgtagagaatacaggtttagaggtggcttattgaagtggaaagagtatagattttggagtcaaagagcctgggttcaaattctattcgcatgtgaactttggaattcatgtaacctttttgaatttaaatatcatatttataaacatagagacagtaatgtctacctttcagagtgttataaattaaatgaaataacatttgtgaaaacagtacctcagtgttttgtttttataatacgttgttgctcatactgcacagtgtcaagaccaatatctaaaatcattgtagaggattggtttgctacctctgatgtattctttcaactgtttatttcctcctgaatcaccatcatgaaaaaaagttaaattgcaaagatttgagttgttgggaagttagtgaatggctgctaaggatcttaattttttctgagcctgcttgttattgctttttgaatttgaccaaactcttaacccagagataatcaa

SEQ ID NO: 13079 - DNA, 1217 bp, Homo sapiens
aaactggtgctggtggtttattactgaccccacccatccctgtcttttgcaataatctttgtgagtggtgattgtgtttctagaagtagaattgcagagagagattccctgaaggcaaatacagagagagtgtgctgtacactctagttcagatactcagagctgggaactcccagagagagagagagaaagagagagagagagagggagggacggagggagggtgagagggaggagagagaacaacagaacagtcagctggagcggaggggggaggagaccagtcttttcttttttttttttttaggattttttaactcaagtgattttggggggtttctccccacctcaaactcttgccccccagttttggcatcttctttcctgtggttcactgaagtgcctttttgcagtccaggatccactgaccgctgagtttgagcagcccgatctgacatgatgtacctctgggtgagtacagagtgctgtgggtgagggtttgcacttgcacatataaggagtggaaagctgcgaggttctgctgttgcacaaatggcctccccacagagcacagactgccacatccccttctgttccaaggtgttaggtttttaaaacctagcggtgattgtgacattgttttttttcctccccctatgttgtttatcttgtcagacttaggcgcaagggctgaactccctgcgcagtaccatcccctgggcttggtaggtttggagaaggcaagtggggcaggtgaagttgtgagctggttgcttcaggaactgcagtcttcctggtggctcaggatcgacttgtgttttgttttgggggtactgaccttgttaagccatgtctttagatattgagagccaataggcggcatgattattaattaggaataagctttcataagcttttatctaataatttttactatccttcacaatagtcttgtgaaataggtcactcactactgttattaaaattgtgtgaggaaagtaattaagccacaaagagtgacttgcccgtagttagaaatcaagtctatagcagttagaatagtaattaataatgagacattataaagcattttatatttgccaggaatgtagtaccttctattactgtaatttaccgtcaatagtagcattgtagtttgggatggagagaaactttctgggactggagaagtttgtaaattatgaaatgtgataact

SEQ ID NO: 13080 - DNA, 1459 bp, Homo sapiens
gtcttccagggtggtttacatcccctaactggaaagtggcagccatatctacgccttctcccatgagtcgctactgctgcatgtggccagtgcctctgtctagaccagcttctcagatttcggtgtgcctgagagttacctggggcttttgttatcatatgattttgattttgtaagtctagggtggggcctgagattcttcaaatctaaggagtttccagttgatgctcattctgctgttgctggtccatgtgtcacatttgagtagcagaattctgttagagattgccctgtgggaatccctgctattttaagctgagaggaagtgagggaaaaagagcctcattctttcgacttttttttttttttttaagtcagcttcatagacaatactcatacatctcatttctctacctcagtgttgttttggtgagtctgtattgtctctaccagtccaggaagtgataggaatataaactatgtatagagggttgcctcagatttcttctgaagaatttttagtgcctgatttctcaggtacatttttgagaaattgtgctggctcccccggtatacctacttccccccgctatcctcttacaaccacagagaaactcgtataaaacaagtagcctgccagcctggccaacatggtgaaaccttgtctctactaaaaatacaaaaatagctgggtgtggtggcaggcgcctgtaatcccagccacttgggaggttgagacaggagaatcacttgaacccgggaggcggaggttgcagtgagccgagatcatgccactgcactccaacctgggccacagagtgagactccatctcaaaaacaaacaaaacaagtagcctcttgaattattggagtcagaggcagagcatctaaaatgtggctccagaccctttctgcccaccagactcacattgcaaaatccagcatttttgagatgtaggaattcaggaagcaaggttagaattattggcaatacccatattgctgtcccagattatctgatttttctttctcagaagcaagcatgccagaaacttcttctgtgggccctcctcagaagactttctttagtgctcaaatggacacattctctcctctgaactaacagatagggtgataagctatcagtcacaaagtctgataacatgctctcctgatagaatgaagtatgtgtgcatcttaatctctgtgtataagactgtgattctttttagagtctctttatagtgtggagtttttacacctttttgtctcttaatgtgaattgtatatagctataaagcatagctttccttatttgactttgataattggaaataaatttttttcttctcctaccactttgttcccccttttttctttctttctttttttttttttgttttgttttaaaggtagaaaaatgtgaacatgcaggagcatgaataaaaaagataactta

SEQ ID NO: 13081 - DNA, 1132 bp, Homo sapiens
ctggttgtgtctgaggggctgacaacagacagttctaatctaatctcaaaccttttacttgctggactggttcttaatcccagaaaccagcctgaggtcaagaattggttcctaattgccataggtataaaggtggcgctcctattgagggagttttcagtgttcctgctctggttgtcaccagtgtggcttgggagatggtttatgttggtctgtcccccctctatggatataaactaattgttaaacagttactgactcctgtaagtttagacagtttatagcgccagcctttaaatttcattgtgaaatataatcttcagatttattagaacagtttaacggaagaaaataagagaaagagctctaaaaaggtgtagactgtcaaagaaggctcatggaggaagcatcagttagaggactctcacagtactttataattacctcatcattatcaagtattggactaacattgtctttgaacatctctctctgttgcctgtagattataaacttcttgaggatagggcagtttctgttctttttttgtatttgactctggccttcttgatcgatttggtaaatatttattgagatcaattaaaataagatgctttaaaactgagcacaaaggacaagttacatttcagtagcttagtagtgaatttaattctgcaggtcttggtgctgtacttctttggtgagtttgctgggcccagatggctaggcttgtactttccttagacattttaatggcctgtcttggttgtgatgtctctaagcactaggaggacagggaatatggctcatagaagagggtgccaactgagagcctctgtccattctctccacccccacacaactcctttctgtacagtctttggtaggtaataacatttctttaaagtgatgattcctaggtgaaaccggaggccagttttgtgtgtactcttatgttttattaggtgtgtgggatttgaggaagttgtggtgctggaaagaatctgccttgccccatattactggtgaaaaaatagagacctaggaaggataaataatttattccaagccatatggctacttagtggccatcaagactattgtccaggtctccttagtgctagacatttac

SEQ ID NO: 13082 - DNA, 1852 bp, Homo sapiens
ttgcttctttctggtgggagcagccaggcacctggtttccctctcgaattcactttgagatgtgtgggctgtgctgtggccgcccctggcctggccgggcccgctgaccctctgcttctacctctgcccccaggcgcggggacctgccgtttgtcgtgccccgccgaatggcccggaaaggcgccggggatggctccgacgaagaggtagatggcaaagcggatggggctgaggccaaacctgccgaataagcctcttctcctgcagcctgagatggatggacagacagacaccacagcctccccttcccagaccccgcagcacgcctctccccaccttcttgggactgctgtgaacatgcctcctcctgccctccgccccgtccccccatcccgtttccctccaggtgttgttgagggcatttggcttcctctgctgcatccccttccagctccctcccctgctcagaatctgataccaaagagacagggcccgggcccaggcagagagcgaccagcaggctcctcagccctctcttgccaaaaagcacaagatgttgaggcgagcagggcaggcccccggggaggggccagagttttctatgaatctatttttcttcagactgaggccttttggtagtcggagcccccgcagtcgtcagcctccctgacgtctgccaccagcgcccccactcctcctcctttctttgctgtttgcaatcacacgtggtgacctcacacacctctgccccttgggcctcccactcccatggctctgggcggtccagaaggagcaggccctgggcctccacctctgtgcagggcacagaaggctggggtggggggaggagtggattcctccccaccctgtcccaggcagcgccactgtccgctgtctccctcctgattctaaaatgtctcaagtgcaatgccccctcccctcctttaccgaggacagcctgcctctgccacagcaaggctgtcggggtcaagctggaaaggccagcagccttccagtggcttctcccaacactcttggggaccaaatatatttaatggttaagggacttgtcccaagtctgacagccagagcgttagaggggccagcggccctcccaggcgatcttgtgtctactctaggactgggcccgagggtggtttacctgcaccgttgactcagtatagtttaaaaatctgccacctgcacaggtatttttgaaagcaaaataaggttttcttttttcccctttcttgtaataaatgataaaattccgagtctttctcactgcctttgtttagaagagagtagctcgtcctcactggtctacactggttgccgaatttacttgtattcctaactgttttgtatatgctgcattgagacttacggcaagaaggcattttttttttttaaaggaaacaaactctcaaatcatgaagtgatataaaagctgcatatgcctacaaagctctgaattcaggtcccagttgctgtcacaaaggagtgagtgaaactcccaccctacccccttttttatataataaaagtgccttagcatgtgttgcagctgtcaccactacagtaagctggtttacagatgttttccactgagcatcacaataaagagaaccatgtgctacgagccgtgtctgtagcatttgtctgcggccagggggccctggacaggactaggcctggcttctgcagccaatgccggctctgcatcgtcgggaaccagattggctgaggcgtaggctgagctagctgtgggcggttgtgcagaaaagctaagatggaaaggtgggctaggccagatccaaggaggctaagagcatcttagaaaccttggttc

SEQ ID NO: 13083 - DNA, 1015 bp, Homo sapiens
tgtgtccccagggtaggcccctcacttctcccgcccaccccgcagagccctggcgttagaggagaagcggcgtctggaggcccgcatcgcccagctggaggaggagctggaggaggagcagggcaacacggagctgatcaacgaccggctgaagaaggccaacctgcaggtgggtgccaggacttctcccactctgggctctggctggagccaccacggcagagctggccttggacccagccggcagaagcacaggccaagtgccagctgctccccaggcgcttaggggaaaatgtccaggcacctggacctgaaaggtccccctctggcttctgtgttgggtgttcagaagtttctaatcttcccttttctgggagacccaagactctggaccccaagggtttggtgggatcctgctgccaccttcctctggccctgctcatgccctccagccagggccccagccctccccaaggtcactggcccttcttctgcagatcgaccagatcaacaccgacctgaacctggagcgcagccacgcccagaagaacgagaatgctcggcagcagctggaacgccagaacaaggagcttaaggtcaagctgcaggagatggagggcactgtcaagtccaagtacaaggcctccatcaccgccctcgaggccaagattgcacagctggaggagcagctggacaacgagaccaagtacgtgcccctggccccgcccaaccccagctgtcctggaaaaaactctggcccccctgcagtcctgcccaaatctgggccacaaccagctctctgtctcctgagcctggggctgtttccctccctcctgatggggccctcatcccttccacaggttgggtggttgggggagcttgtggggtttgaacaggattctctgttccacctctaaagccaggagttttggtggctgtgtctgagagtgaatcagagcaggaggtacaggggggtcctgcccactaggacagttgtcctatgggctcagcagga

SEQ ID NO: 13084 - DNA, 1158 bp, Homo sapiens
gagaagcagctggctgcggagaacaggctcacggagatggagacgctgcagtctcaggtgggtgtcagtgcaggctcagtccaggtcgcacgacctgcctggtgctgccacctgctggccatcggtaggcacggcatgctggaagtttctattactataggagttttctacaactgagtttcctattactgtaaacagtgaccagtctctctgcagaccccattgggtgttaagtgatgtagggaggccacttaatagagtggaacgttcacaagtgttgggttcaaacctcagctctaccacatgacttgagcccatttcctgggaccttgctctggagctcatggggtagtgaaaaatcaaggacacgatgtctggaaggtacctggaagcttcagagctctccagatgaaagctacttttgtctgcatgttcctttccctctgggatcccgagccatggcgtccgtccttgaggatggagtggcttgagggtgttgcgaggagcttgtgttttccacttgttgtttgcagctcatggcagagaaattgcagctgcaggagcagctccaggcagaaaccgagctgtgtgccgaggctgaggagctccgggcccgcctgaccgccaagaagcaggaattagaagagatctgccatgacctagaggccagggtggaggaggaggaggagcgctgccagcacctgcaggcggagaagaagaagatgcagcagaacatccaggttcctgcccgctgcacccggggaggggtggcgccggaggggcagggcggggcggaggagcaggaaccaggagctgggagaacatggaattagggtccaaggaggctgctcctcacgcaatctgcttggggctctcagtgagaggtgttccctttgggctggtagtttgtgacatgtgcatctgagatctccatgagcactgcctgggccagcatcaaggccaatttgatttccctgccattagccctggccctggctagccgaaggggcacagggccagcacctctgcgtcctgcctgtttcatgggtgggagcttgctgcaggaaacccttcagaacattgcaccgatgttctggccctgtgtcccagtttgaaatctggaatcctacaaatggggcttgggccctgcctcggctg

SEQ ID NO: 13085 - DNA, 1164 bp, Homo sapiens
accctctagtttaggaggctgcccaattaaaaaaatatatttaaaaacagaatatatttccaaaaagatgaaactgacacatactcagagaaaatgtgaacattctaaaaagacaaagaaaaaacaaaaattacttgtcttatgactaaaaagaaatagtaacattttgttgtccttccaggattgtttttctttgttcatattacctaaaaattttaaaaaagctgaaacccagcacggtactgtgtggccaccatgccatgtctagagccaggctcccgttgttggccatgccttgctttgaggctttggctctgcacgagacgccgcagagaacgtcttgatgcctcgctccccttatcctcaccacttccttcttaggggtggaaatgctggatcaaagggtcttcacgttttctgacttttccatgcatggggttagcctgtgctccggagaccctgtgagcacacatgtccccagcgcagcttgtgactcctgcctctctgaccccgccaggtggattacaaagctgacgagtggctgatgaagaacatggatcccctgaatgacaacatcgccacactgctccaccagtcctctgacaagtttgtctcggagctgtggaaggatggtacgccctttgcccttcgccccctgcctcctcttggctgcggctggtcatcttcccacctccacagtgggccgagctgccaaacaaggggtacacatgtgccccctgacataggccaggtggtctctgccctctgtagctcccatgagagagggctcctcggaccgaaacaggaggccactgccttgcgcacacaccgtggccgggtcctcctgggcggagcgctttccgtgtgtgggaaagtcaagggcagccccgagcctcgaagcccagggtcccagccccgcgccatgttgcattcccgcctctactccttggtaggctggttgctttgagtggttctttttaattctttctgttggtttctccttttcctttgcctgggttttgctttaacctctctgttgcagagatgcagagcactcagagagcctatttctatcatcgctttcctattctccacctagaaccaggtgactggccgcccgagtggtgtctcttgtgtgtgtggtgcgtccaaagctgtgcaaga

SEQ ID NO: 13086 - DNA, 1201 bp, Homo sapiens
gtaggcggcttcagcagttactaactcacggcgagtcttggctcatcgtttgtcttatctccccctgcccctctgcccactgccttattttgatgagatcgggcgcgtttagggtggtatggccgtagactgctgccttattttgatgagattgggcgcgtttagggtggtatggccgtagactgctgccttattttgatgagatcgggtgcatttagggtggtacggccgtagaccactgccttattttgaagcatcactttttctgtaaatcctttagtgtgtcctcattttatttcaaaagatctaagtttattgtccccatattgttagatattaggttgtttctacttttcatcattttaaataacaccacagtgaacatatttgtgtacgaagatttttttttttcccccacatacttagggctgttcctctagggggaggactctaaaagtgaaattactggggcatagggtatgagggttttcagatcctttgtatctgacaccacgctccccgggtgtgccccgcaggctgactttgccatcgaggccttggccaaggcgacctatgagcggatgttccgctggctggtgctgcgcatcaacaaggctctggacaagaccaagaggcagggcgcctccttcatcgggatcctggacattgccggcttcgagatctttgatgtgagccttgcccttcattacccaccctgctgcctccttggcctgttggttgccttatccttggttaagaaccctgcttctcatggtcctgcatcgatctgagttggccatctcctttgcatgaagactttggttgggtgtggggttgtttttttttttttcttttttaaaagatagggtctcggctgggcacggtagctcatgcctgtaatcccagcactttgggaggccaaggccggcagattgcttgaggtcaggagtttgagaccagcctgaccaacatggagaaaccccgtctctactaaaaatacattagccgggcgtggtggcgcatgcctgtaatcccagctactcaggaggctgaggcaggagaattgcttgaacccgggaggcagaggttgcagtgagccgagatcacgccattgcactccagcctgggcaacaagtgtgaaactctgtctcaaaaaaaaaaaaaaaaaaagtcagggtctcgctttgtcactcaggctgga

SEQ ID NO: 13087 - DNA, 1223 bp, Homo sapiens
ttgggaggcccaggctggcagatcacgaggtcaggagatcaagaccatcctggctaacacgatgaaaccctgtctcaactaaaaatacaaaaaattagccgggcgtagtggcgggcgcctgtagccccagctactcagggggctgaggcaggagaatggtgtgaacccgggaggcggagcttgcagtgagccaagatggcgccactgcactccagcctgggcaacagagccagactccgtctcaaaaaaaaaaaaaagaaaaaatagcagtggaccaggtatcaccatttaattgacatttgatcccaagtgttgctgtctctgtgctgccctgctctgaccactgatatcccttcccctgttagttatgtgtctcggtaccacgtgaaagactcctcacgccacgtcatcctaggcacccagcagttcaagcctaatgagtttgccagccagatcaacctgagcgtggagaatgcctggggcattttacgctgcgtcattgacatctgcatgaagctggaggagggcaaatacctcatcctcaaggaccccaacaagcaggtcatccgtgtctacagcctccctgatggcaccttcagctctgatgaagatgaggaggaagaggaggaggaagaagaggaagaagaaggtgtgtagcagcccactttctgaggtctagagtgatctgtgggctagcacgggagcaagctctgtagccattgtgatctttaaccttgataaaacttcgagaattccctgagacttaagtatgaagaagcattcactttggctccaagagcttcttctagagcctttagatcacatcaagtggttggggaggatagcggtgttttagagaagcggctggactgtggcagaggtagaggaagatgagggaagtcccagattgaagccggtggtctagagggaaaagctccgctccgggttaaatagcctgaaagttgtctctcctgctccaccagctggtgactgaaggaaatacctgcccagccctgtgagcatctgaaaggcttaacttcggaatggaagtgttgaaaactcacgcacagtccagcagaggttcagaaaggaaagtgaacatcatatcacacaacctggctcatttctcttacattttttgtgtctttcagaggaagaaacttaaaccagtgatgtggagctggagtttgtccttccaccgagactacgagggcctttgatgc

SEQ ID NO: 13088 - DNA, 1109 bp, Homo sapiens
taaaaatacaaaaattagccaggtgtggtggtggacacatgtaatcccagctacttaggaggctgaggcaggagaatcgcttgaacccaggaggcagaggttgcagtgagccgtggacacaccactgcactccaacctgggtgacagagcaagactccatctcaaaaaaaaaagtgtttatattctgagcctgaagcctgaggtctttattaaaaagcttgcaaaatcattctcttgaggaatccaaaacgactgaaaagggacagcttcgttactgtgtgattgaattgaatgttggacagtatcttgagttatcctggagcagctgccccactcccccgcttatgtgttccacaccagggagacccactttaggagagggcagttctttgaaggaaggacttgtgttgtttgcctctccacatctccccacagcgctgcgcacattgtcagtgactctttgttgcatggtgagtgaccatgccacgcttttgcagacctcctgacagtgagtgagactgccaatgagccccctcaagatgaaggtaattccttcaattcaccccgcaacctggccatggaggcaacctacatcaaccacaatttctcccagcagtgcttgagaatggtgaggaaacgagtctctgggcattgattcattcttatttaatcagctgctgtttgtggagcatctgctttgtgctaggctcttggttgtgggactgagcaggtcagacgcagtccccacctttagcaggggagttacatgcctgggcttggatgttaggctctctgactttgaacaaagttcctgcccttacagaatttaatgatagtggaggaggaaacacagtgaacaataaataataaattgatttacatcaaatggtgaatatatgccatggcaaaaaaatgaagtagagatgagcatggttactaagtcattgttctaattcatcaggtgctaacagttgggaggggtcaagtaggcacaaaacaggcagcgagctcagagccccatcaagggccccaggaacctggccagggctgcaactaagcagaggtgctgggtctgactgattggccttggccttgtcaacaaagttagc

SEQ ID NO: 13089 - DNA, 1428 bp, Homo sapiens
aaaagactactaagtcttagggaagttgagtttgtatgaattggtgaaggtatatctcagaaccaaaacaaggttactatatttgaaaaaacattaggacattttatcaaatctgacaccattaaatttttttaaacacttatgtaacacagaaaaagaaaaactaccaatcaatacaacaccctgtcaaacacaaggtgcagcctcattttaaagatgttacagtaaaaagagagtgtcgtggaattaatgaaatatgaaaaatcagttttgtttgcattcttctcagttttaagtacatattcacagtataattaacaaaaacagtagtagtcgctcaacagttgagggttccattttgcgtgttgctttttgagttctatcatttatgtctttgcttacttcatatggagggtgttttgtactctgaggccttcgttcatgccgctactcacatgatttatatttttcagattttggaagatggcaaagttcatgacacccgtgatccaggacaacccctcaggctggggtccctgtgcggttcccgagcagtttcgggatatgccctaccagccgttcagcaaaggagatcggctaggaaaggtacatgcctgtcagcaggagtctgaatctttgcagctgtggctgctactctcgagtccctgtttagattttattgtctcaaaatcttaactcctgaatttcttatagggatgccagctgagaaaggttatctctgggtgtagtcatagaagagctgggcacttacagaggtgttgtgaacaaattctgagactcttccacgctgtcctctcgcgctcagggatttctggttctgcagaaacttgcctggttgacctgtgcattctctgtcttttcttgttcttcgtaggttgcagactggacaggagccacataccaagataagaggtacacaagtaagtgtttctgcaactgaatgccccaatcagggccttgggaaagttgttctttattctaatgaccttcttctgaaagctttttagaatgggaagaaactgccaacaataattcataacttttagggatgtattctgggctttaacaataaccacatttttggaaatagccctcaaaacttagaccattcattaaagaggtctagcctattaaaatggggttttgggcccttttaaaaacctgttgaaaacattagctgggcgtggtggcgtgcacctgtaatcccagctactcgggtggctgaggcaggacaatcacttgaacccagaagttagaggttgcagtgagcagagatcatgctattgtactccagcctggtgacagagccagatcctgtctccaaaaaaaaaaaaaaaaaaaaaagtaaaacccctggttttaagatcctggtaccataaaaaggctttttctctctgccacttcaga

SEQ ID NO: 13090 - DNA, 1176 bp, Homo sapiens
cccagactgcgggcctgcggggaagggcgaagcggggcgggaccgggggcgggagcagcgcggggcgggaccctacccgcggcccacgcggagccaggaggcgcggactacagctcccggcctgccccgcgtgcggtccccgcccgcccccagcgcccgggaggaggatgcagacgccgcggccggcgatgaggatggaggccggggaggcagcgccgccggcgggggcgggcggccgcgccgcaggcggctggggcaagtgggtgcggctcaacgtggggggcacggtgttcctgaccacccggcagacgctgtgccgcgagcagaagtccttcctcagccgcctgtgccagggggaagagctgcagtcggaccgggtgaggcccccggggtgggcggcgagcgggcggtgggtcctccgctcgcccgacgcggggctgtcgggcctggctcgcccgccaggctggggacccggccgggttcatttccgaggaactggaggcgggaagaagcggcaggaggaggggagggggaggtgggtctggtagtgagggatgtacccattgccgtggcaacgggacgacgcaggccgcggccattagaagctctccagccgccccggatcggggcctctccttctcctttggggctgtggacagggagagacctgggacctttcctccctcccaaaggggactcctgctctggggaaggagtcgacgaggctacttctcccgctctttgggatgtgggtggcggatgggtgcagggagctagctggatggaggagccctggggcgccttctgagcgggctgaatctagaaggagcgttggcccagcgggcactatttctgagcacccaccctgactctgctgcacactgcctgccgcgaccttgagtcggacccttccctgcactgcgctcagcctccttcctcatctgtaacacgaagggctggtctgaagatgacctctaaggtctcctgtcccccatccgtgaccctccgatgctgtggcctttggcaagtcgcctcacctctcaatgtctccgatctctctgtagagtcgcatggaagcccaccctgcctccctgcccgcccgagtgtccagtgagatagtgactcctttggaaacttgtaaacatcccctgaaagcctagggacctgggggcgaca

SEQ ID NO: 13091 - DNA, 1469 bp, Homo sapiens
ccagccctgagcaacccccatcccacccccttcagagtcttggcagaatctggcctctgtaggtggccgccaccgagcccaagacggggcatggggctcctggatgggttagttggggagcccttgctgctccccccaactcagttctgaatccaccttctttgggcctcagccccaccccctcctccagaaggaagcctgtgactcaactgcctctctctctctccctctcccccacccgtcaatctcctctccgcccccttgccctgcatcaccccctccttaccggccccacctccgcccctcccatcctcctgcccttcccctcttttttttctagctgttacaagccagaggcacccggatgtgaggccccagatcacctccagggacttggggttcccatctgaaatcctttatttttgtaccatggggtgggccccgggcctgagaaggaagaagcaccctctccccggcctcctctgtctgcacccgtggggctgtgacttactcctgcctccaggggcggggcggggcccccctgggacctcttaaggcccaaggtgggccccaggacctctgggcagagtggactgctcatggcagatgtgtggcaatgtctggctgtgtctctccggcacctgcgtcccctctcccgggctcccctgctgcatggtggatgtgctccttcctggcccggtcacattgcctccttgagccttagtccagggggtcactcctcccaccccacctacctcacagggttgttgtgagggtgcacagaggagcaaagtccctgaaggccctcaggcagtatataggggccgcccaccttcagctgccctgggatgggaaggacccagcccgacccctgggcataacactgtgtttgcaaatggagattcaggtattggggatgcaggttgtggggagctggcctggcagagtaggggtagttggcttggccttctctttggtgatcccacccccagccatttgcattgctggcccagcgcctggcctggggggcggggagaggcagcagaaggggctgggcaggggcggtggaggactcaggaactgcccggggagagtgggtatggcggctgagccaggggccctcctgtgtttgacttcccgggatgggtccttgcttctcagctgtgtccgaccccaccatgtaataaaacccaaaggaacagcccagcctggctgttgccctctttctctgggccacttttggggacggggctaaactaaaggtgtggtagtctggtccaaaggaacgcggctttgtcccaaaagcccagggacgctgccctgttgtcattttcctgtgtgtgttgcagggagggcttggggaactggctatatcctttgccctggggccggataccagagcacctgccctacctggccgggagccagaaaacagaactctagggagagccctgggctgcctctgccac

SEQ ID NO: 13092 - DNA, 1185 bp, Homo sapiens
ccacctgaaacctggggtagcctctagaacagaggggctggggagaggaaggggcagagggaccggtcactgtccagcctggagggaggcattggtggccaaggacaccctttgttgcccatggccattcacccccaggcctggtgcttctccccacacccctgtaggcctcaagtgactcttccccctcctgctccggccccgcccctgctgagccaaacccagtaggaggctgggcctgggtttgtgccgctggggtctccatcaccgggacctggagagggaggggctgtgtagccttggaagaacttgggtcatggggaggaagcacagctgttggggaagggccaggacctcaggcccagccccaaccccagctggggtggggtcttccccacctgtctcttatgccttatgggaaggcccagccataactcgggggccatgctggagctggggaccagcttaggcctcctccataggaacccagtgactggggggtgacgcctacacccccagctatttgcactctggtgtgtggtttgactctgcttttcttccggattggccctgtggtcacagcctcagggggccaggctgggggaacctcacctggcccgtactcctgggggtttccctttgccattgggccccctgagggactgtgggggctcaagggtaatgccagaggcccatggccccagcgaggggctgtggggcacctagagttctcggtgtgtctccttcattcattggcctctgctggggcctcctatgggtgtcttacgtctgtccatccatctgtccgtggtcagaagtggggtcagtgtgtgagtgagagcaggagtatttatgaaaataaaacgtcgtttttcctggaccagctgctctcgtggccctttggaggttgagggagatgggaggggttgagtccatgttccctagggctgccctgtagacctctccacttccgtctttggaggtcaggccgtgggccccctccccaccaccccccgggccctgcaccggaaaaggccctgcaaaggggcctgtggccagtgctgagtcaccagagagggcgctgggctgtggcggaccaggaccgtcccagctggaagtgggcgaccgccagggcctggcaggagccccagctgctacagacaccgagggggaggcccctggctg

SEQ ID NO: 13093 - DNA, 1239 bp, Homo sapiens
aagtctcaaatattacagagactccactgctgaggaggtgaggccatgggtgtactgatgaacccccggaagggcctggggtggcctggctgggttcactggggtgggtcacaccagggcccacacggaccatagtgggccctcttgctccaggcagatgagctggatggtgagatcgacctgcgttcctgcacggatgtcactgagtacgcggtgcagcgcaactatggcttccagatccacgtgaggctgtgtgcagcttgggggctggtggtgggcagcatggctggaggtccctgggggaggttttggtgttgaacatggctcaccatggagactggatcccttcactcatttacccagaggccctatcttcagagccagagctgtgatgccaacacttagcatatctgggggagacgctggagccagcagggctcttcccaggccaatggaagggaggttttgtaccccctgcccaccccagactcaagaccttagatgcatcctgggaaggaagggccaccctccctggggtccatagtggggagggagtcatgcggctggccatgtggcaacctacccatgcggtggccttgcagaccaaggatgctgtctataccttgtcggccatgacctcaggcatccggcggaactggatcgaggctctgagaaagaccgtacgtccaacttcagccccagatgtcaccaagtacgtactaagctggactggggccttgagggaggcacttacccttgcgtccccgagtgggtttctaggtactcacctgagggctgcacctttctgggccctcgtttctctgtcaacaacatgggaagagagtagtgagcattctcggtatcatccagaagtacactgagggtttgaggtttgatctgtcttctcaaatgtgatggggcctcttctctttggaggagatgcctgtgagtcaaaagcccctgccaggtggctgttctgtctctgtgtctgtgccgtgggggccgtgtctaagcctgtgttaggaaggggtggttaggtagttcagccttggcgcccacacctcccgggatggggagctcactccttctggaggctgccacgggcactggggcaggagggctgagttaccgagtggcagagccccccacagtttatacccagatgcccatggcgggctgggacttggagctgctgggcagcgggaacagagtgtggtattaaagggggctgggctgggt

SEQ ID NO: 13094 - DNA, 1215 bp, Homo sapiens
ctgcctcttagagcttgtaactgtctttgttgatccttcttgcagacttgggcatagacctcgggcctggtccctgcaaggagcgggtgtgaatgctccacggccccttagctacctgtgacaccttgtgcccacaggttccgtagtaagatggaagctgctggcttcactatctcgggagccagtcaccccatctgccctgtgatgctgggtgatgcccggctggcctctcgcatggcggatgacatgctgaagagaggtaagggtgctgagacaagggaactggtggtgggtcctgagagaagagaaagggaaacccctagactgtgacccagccccgtacccagccacgctgcggcctcttaggccagctgtctgtctaagcttgaacaccccaagccatgaggcagtcccgaatctgagacctggggcagttcccttgccctctgtgttctgcccccaagcctgttggttctggcacgcccttgctttctaccctcccaggcatctttgtcatcgggttcagctaccccgtggtccccaagggcaaggcccggatccgggtacagatctcagcagtgcatagcgaggaagacattgaccgctgcgtggaggccttcgtggaagtggggcgactgcacggggcactgccctgagctctgggtaaggacgagaagagccaaggtccgcctactgccacagggtcaaaggaggttttcgatcagcccagaccagaggctctgagccctgaaccaaagtcccagagctgggctgggacgtgacctgtgctgagggctgtgagaatgtgaaacaacagtgtgaaaattggctgtgacactctggtctgctttattgtctctgggcaggcccagtcctgtggccggttgaagaatcaggcaggagccagggctctgaggggaggcgcctgaggactgcagatctccactgacctctttccctagattaagatgggacccagtggccgggcacggtggctcaggcctgtaatcccagcactttgggaggccaaggtaggcggatcacctgaggtcgggagtttgagaccagcctgaccaacatggagaaaccccgtctctactaaaaatacgaaattagccaggcgtggtggcgtatgcctgtaatcccagctgctcaggaggctgaggcaggagaatcgcttgaacccgggaggtggaggttgcggtgagccgagat

SEQ ID NO: 13095 - DNA, 1216 bp, Homo sapiens
tcccaaactggtggggttacaggtgtgagccacggaacgcggctcctcttccttctggatatggctgtctcagatggccagaggcctcggaaaggcttccggtttcccggcaggcccgagtggggctgaacttccggcctcaggacgcaggcgcgggccgctcatttcgctctttccggcggtgctcgcaagcgaggcagccatgtcttatcccgctgatgattatgagtctgaggtaaggtggccgtaagggcgcggtgggctccacgacggggtgatctctgggaccactggatgtgggtcccggcgcgaggcagcttccgggtcgcggccagctccggccgacctcccgcccggccctcaggctgctcccacagttcccggtccctagacaaccctggctctgcccgcccacttcgcgtgttcgattggcttgtccttcccctttctaagaccggagactaaggcctgttagacgtttctgtgtttctgcacctgagtttttttggtctaggctccgtctggtcaaatctcgctgattcccacagcctcttgtcctttgctccacctcattgcacccgtaatgttgtattgtcattgtctgtttactgtcccttttctctaaggcgtgtgagttcctcaaaggcaggcacagtgtcttattcgcctctgtatccttagctctctgcttggcatctagactctaggatgagcgttttgaattcacgacttggcggctgtccttgactgtgtctctttccttctaggcggcttatgacccctacgcttatcccagcgactatgatatgcacacaggtgagaccacgggttaggctggctgagtactcgtagggatcagttcctttggaatgtcttagaaccagctctgacaggcatcaaaaattgctctttgatggtccaggtttggagtcagtcattagctgccagtgcgaggggttttataaagcctaataaaccaggctttttatcatagtccacctcagtcttggaagagaaggattacttacctggctatggttttcttgtgtaaactattagccaaataagaaaagcttttttgtttttgtttttgtttttgtttttgagatggagtttccctctgtcccccaggctggagtgcagtggtgcgatctcggctcactgcaacctccgcgtccctcgttcaagcagtagttctcttgtctcagcctcctga

SEQ ID NO: 13096 - DNA, 1243 bp, Homo sapiens
gcctggcctgttcagtgttttttaggggaacttgagcatgtttatatgttggactaaaagagccagagaagcaggaggggtggggcttgaggagattggaggaaagtattaatagctgctgagggcatcaggagaagaaaattaaacaacctgttgcaggtttgtcaagtagcagtgtttggattggataggcagcagtgtttaaattggatgctgtaggtctgttgtggccttggactgcagcagactgatttgcttctgtgtttagagacgtttggatgtgctccaggagatggaaacgctgtgttaaagaatggtggccaaaaaagtagttcttatagcagaaaacagcaagcagttaaatatggctatagttaatgatacagaggcaggagattatcctgaaaagcttgatgggtccctaactgatacaaaaacaatattttcttgtgttgagaaagattgaagtgtggagttgggttgaggacagttgtgggcttgaagggctttggcctcagctctgtttatttgacatcttcccctttctaagcctgggtcctcatctgtaaaatgttaggattggcattctccagtccttttggaattttagagatttttttcttgatttttagctggaccaagctgactgaaagattcttcaagaatacaccttggcccgaggctgaagccattgctccacaggttggcaatggtaggtgtgagctctttatatcttgtgcactgagtggaatccagtggctgagtcattagacaggaagctcaagagggtctgtgtctgttttgctcaccattttgtttccttggtgcttggtatgtagtaggtccttggcaaaataacttgtcgaaggctggatgatttaagagaggacagagatctctcatatatggtgaaatttagatctttgtactgacttgtttctatttccttctataatttgggggtcattacagtcactctggaataagctctctagcttcccacctttgactttcttagatgatgtcctttatatatgggtgaggtaggcaaatccaacttcattattttgcttgtggatattcagctaccctggcaccaatttatttatttatttattttattttattattattattttttttgagatggagtctcgttctgtctcccaggctgaagtacagtggcacaatcttggctcactgcaacctccgcctcccaggttcaagcgattctcctaggttc

SEQ ID NO: 13097 - DNA, 1099 bp, Homo sapiens
gtgtcgttgcctgatttatgcttaagttgacagtaattttacccaacatagtgtttgcatcatgcaaaattcaactcagtgggaagggcaagtaacatcttagtgttgttattaggaaaatagctttgacctcatgtgctttctgaaaggaggagtcttcgtggttgtattttactgatgagaggggcctttgcatgtgttgggaccaaaaaaaaaataagcaaaatgaactgccatcctgtaagcaaatattggtaaatcgaagattagcataagattggttttgctgtttcttggtattcctttgaagttattccccagttgttgagggaagctttcaaggctggcagtaggtgagatgcctactgagtaacattcagaggtcaggtgtgcctgcctttacctgcctcctatcagtattcacggtgtctgtctctttcaggtgaccctgagagtgtggctggggagtatgggcggcactccctctacaaaatgcttggttacttcagcctggtcgggcttctccgcctgcactccctgttaggagattactaccaggccatcaaggtgctggagaacatcgaactgaacaagaaggtgatgcctattgcctctggcccctcttgccagagccagaatatctatttctagagaaccactctgatctcttaggacaaatttccaggagaggaaagaggactgttccctcaggccattgaaagttgagactaaaactgggcaaacagctgtggtaaaaagctagacctggacgattttggtagttaacaacagttttttattttgttttcaaaatggaatgatgatggcagcttgctctgtcaccaggctggagtgcagtggtgtgatctcagctcattgcaacctccgtctcctgggttcaagcgattcccctgcctcagcctcctgagtagctgggactacaggcatgcgccaccatgcccagctaattttttttttttttttttttttgtattttagtagagttggggtttcaccgtgttggccaagatggtctcgatctcctgacctcgtgatccgcctacctcggcctcccaaaatgctgggattacaggcgtga

SEQ ID NO: 13098 - DNA, 1149 bp, Homo sapiens
ttactgtactgaataccataggcagttgtaacacaaaggtatttgtgtatctaagatacagtaaaaatacaggattataatcttgcaggatcaccatcctatatgtggcccatggcccgttgttgactgaaacgctgttgcacggcacattactatttagtctatatttctgtcgtcatcaaggttgcatcaaaggttttgggtaactcgatcctaactgtgtaaaaggattgacctgctagtgatgtgtgggacaaactggagagactaagacagaggtgccagtaaggaatccagaagatggctaaggaggatctggagctaggatggaagttaggtagatctagagggaggattggaagagatgttggggaagttcaatggctggtatgaaacaactgggtaagtcaaagatctgtgcagagaatggtgaggccagttggcagtggggacctcaggaagtccgtctcatttgacccagtaccactctccaccccatccccagattaacaagcagaatgagcagatgcatgcgctgctggccattgccctcacgatgtaccccatgcgtattgatgagagcattcacctccagctgcgggagaaatatggggacaagatgttgcgcatgcagaaaggtgacccacaagtctatgaagaacttttcagttactcctgccccaagttcctgtcgcctgtagtgcccaactatgataatgtgcaccccaactaccacaaagagcccttcctgcagcagctgaaggtgttttctgatgaagtacagcagcaggcccagctttcaaccatccgcagcttcctgaagctctacaccaccatgcctgtggccaagctggctggcttcctggacctcacagagcaggagttccggatccagcttcttgtcttcaaacacaagatgaagaacctcgtgtggaccagcggtatctcagccctggatggtgaatttcagtcagcctcagaggttgacttctacattgataaggtatgcctgtcccctgggcttggggtcttgtattaagtgttcagtatctttcattcactattgtgggcacatgaagtatatcggggaacaaaaagattcctggccttgtggtgctgccacaaggtgccaggtgtggtggctcatgc

SEQ ID NO: 13099 - DNA, 1140 bp, Homo sapiens
cggcattcggcttctgaaaaccatcaagccggtaggtcctattgagcatgtgtgtgtctggcgtgtgagggtggggaggggagagtgtggcatgcagagaaggtcgtatgctggagtcctgtgcctgggtacagcctctggctcagtcacccacacagtggactgtgggtgagtcactgtgcccccttgggccttgccattgacctctgggctggcttctgaccctggctcgccactgagtcacagcttgccctaggcctggcactagtcttctcatccttgagagggacaaggcatcagggagcaccatctggctctgatagtcgagtccaccaacaagggtgacgcatcagtgccattcattgtcaccctggcacacccctgccgtgacagcctcagcatccacccaccctcttccagatgctgacggatctgaacacgtacctcaacaaagccatcccggacactcgcctcaccatcaagaagtacctggacgtgaagtttgagtacctggtgagtagtccaggtgcccaggctgctagggcaagcgcccaccctggagatctgccccacttcagtcagccatgctgcggccagcgaggccagccagagctgacagcatgtctgctccaggtgtgggcccagaggcccagggaggtgcagccaaagccctgctgcgcctgcacaaagaagcatctgagagcctggggcgggcatggctctcgctgtgtgcactctgaccccttgggatttgttgcctttaaacaatgggttagactaggtgagtgagcataaaatgggtgtcagtgaacgttcgtgagttttacatttaattattctacagtcaaaggaattgagagaaaatgctctattaagcaagccaaggttcctttgctgcaggacttatcagagcctttgctaggctgatgtgcagtgtgaattttcaagggtcttcctaagctcctttaacgacagacccctttttccccagagcatctcttgggccttgagtttggtcaactcggccgcctaagcctcaggccctgtcatccctcagcacctgccgctgcccgctctgggactccctgaacacctgcgccagcctctcctgctgcgtgtgggtgatgggggtggagctgg

SEQ ID NO: 13100 - DNA, 1247 bp, Homo sapiens
cagtgaagccctccctccctgcccatgcagagcctcctcatcccaacttccccttctttcctggaatcccctgggtggctcagcaggcaccaggccttcatgatgccaaagggaagggccacagccatgggctgggaccaggaggcctgggctctggtcacaggctgcatgtccctggggtaggtcacttccctctccaggcctccttccccatcgggtcaatgtcccctggggcattcaaaggtgctttccgacctgggtttctctggctgagtccagggcttggcgctaggttagaattcaggctgagccccggggtggcctccttttgtgtcccgatcctagtctggcccggtttccccttcccggattcctgctccccttcggggttttggatcaagtccacccaccacctcggcggctaaggcggtgaaagaggaacaccgcgggtggagcgggggggcccgtccccagtcccctggacctcagtttcctcatgcccgcagatcaagcgagagctgagcgagaacacgccgcacctgtcggacgaggcgctgatggggctgtcggtgcgcgagctgaaccggcatctgcgcgggctctccgccgaggaggtgacacggctcaagcagcggcgccgcacactcaaaaaccgtggctacgccgccagctgccgcgtgaagcgcgtgtgccagaaggaggagctgcagaagcagaagtcggagctggagcgcgaggtggacaagctggcgcgcgagaacgccgccatgcgcctggagctcgacgcgctgcgcggcaagtgcgaggcgctgcagggcttcgcgcgctccgtggccgccgcccgcgggcccgccacgctcgtggcgccggccagcgtcatcaccatcgtcaagtccaccccgggctcggggtctggccccgcccacggcccggaccccgcccacggcccggcctcctgctcctagtgcccgcccccgccatgcctcagccacgcccctccggcctcagctccctccccaaagtgcctgagcgccgcctctgtgcccaggtcccatttctctgcagcactggccccttggtgcacacacattcccttcgtgggccctgtcttcctcttgcagccccccaaactgggaccgaatgaccctgggaaggggaacttgggtaggttggggatggggcagaggtctggatctgggatcgcccttggctgaaagtttagcctttttagattgagagatacagag

SEQ ID NO: 13101 - DNA, 1219 bp, Homo sapiens
ttttggtccttcctggaatgaacaggttccctccctgccacctgtgaggagagttggggcccagccgtcttcctggcctccttcctttcctcgtggcagaggcctgcatgtgggtgccagaggccagctctccccctccatcttgggggggcggagcagttgggcccaagctgcccgggagggtgggtgcagacacaggctgaggaccagccctggccctgccccgccatctgctttcaccaagctgtctctccaccgtggcttcccttctccctccaggccaaagtgctgctgattcccactcccttggttttcgcctgcccagcgttgctgtttgcgtggagggtggggggagctcagtggcagggaatcagcggtccgtggggtcgtggggacgggaacatgtgcccgaccgctccatcccctcctcctccttaggatgcataacctaccttgtcttttttttttttaattttctttccaggtagagtagctctttgtacataaagaatacttgaaaaattaattgtatgatgtatgagaagacagagtctcctagttttgtatcttgttgtatgactgccatgagttccaccagaaagccactctattttggtctctgtgacattttaaatgcgtgacagaagtgagcaaataaagtgaggaagaaatctatatatgagataatatagattgtattgaaatctctgcctgtgggtgaggtttttccttcctcctccctgccccctgctctggctttggggtgggtggagtggctgtgggtacaggcggcttaggaaaccctctccttcctgtgtgtaacctttcagtgatgggggttcggattgatagggaccaaggtcaaggcccaggccccccttggacaaagggtctccccaacctccagccagttcccaacccaggacggccgggccgcaggcggtcgatgctccttccctgtttggtcaaccaggtccatggggcccacatgctggcagccccgctcctgcaggcatctcccaggatttcctgggatccccctttcagacgagcttcctgcgtctctgggactgtcctccaccctgggaccctcagggccagggaccctggggcagggggccgctggctgtgggcacagtgcctggcctctctggtaccgcatgccttcttggggcctggcttgctgctgacgggagcactcaggaatgcggtgtgggtg

SEQ ID NO: 13102 - DNA, 2127 bp, Homo sapiens
agccaggctctggggcccagagggagatagaccaagggacgagaagacaggagtttggggggccaagtgcagtggctcgcacctgtaatcccagcacttcgggaggcccagacaggtgggtcacttgaggtcaggagttcgagaccagcctggccaacatggtgaaaacccatctctactaaaaacacaaaaattagccgggtgtggtggcacacacctgtaatctcagctactcgggacgctgagacaggagaattgcttgaatctgggaggtggaggttgcagtgagccgagatcgtgccactgcactccagcctgggggacagagcgagactccatctcaaaaaaaaaaaaaagtagccagagacagctgtgtacctcacctgtcttttcccttctcccttctagtgtcttcactgtattttctttaaaaaaaaaaaaaaaaaaaaaaaggcaaaaataaaccactcaaaagaacaacaaaaaaacccagcacaaaaccgacgatggagtttgtttctttgatttctttgccaatggcaagaagatgagatgccctcagcactgaggattcttgcccccttgtggtgcccgctgcccccaaccttcaggctgccagatgctcccctgacaacaccaggctacaggagccagacgccagggcctgcccggcctcctgttcctgcccccacccaccacctgcctggagaggaacgggtcgggtccgtgtcggagaagtgacaggtcccagagccaaagccggccctcaagcatcatcagggagtggtgtagtcagttgaaggcagttcccaccgagttttccgagcctcagaatccaggagatacgcacagccccacccactctgagatgacagtggctgacttcccgtgctgggcttttccattgtccccctggcctccaggctcctcctctgcctctccatggagtgggtggggaggtggtgggggccggcgtcccctgcgtgtgtgtgtgtgtgtgtgtgtgtggatgtattgacctgtgtttcccaagacagcaggtgccacggcccgccccgcctgccagcccgaattcccgttctcctgtgtctactaacaaggacatgggggtgggcggtgacctccgcatccctcagagctcagagggtcctcgctgccaccggtccccccctagcccgtcatcagccggtggcagctccatcttccattcctggttttagggcagaatccatggagactgcttccagaaggcatctggctctgagttataaattacttccctggtcctgacagtcacctggggtcccccctctccctggttccacctttctgaggaggagcctggagtcagggctgggttttggattaacccatccttcctagttaacacctttttgtttttattttattttatttttgtttgttttctccgtgtgtgtgttttcctaatttatttacctctgtttcccctttttcctttttttttttaattaaagagcaaagctttttattactttgtaatttaaaaaactgaaaaaaaaaaaactgaagaactttggggggaattttgtacttttttcctgtgtaaatattggacttttttgagctttatcgtggttgttaatttgaagtaataaagtagaaaagataaagtgatgcaggcagccctttgtccacctctgtgcccttagggcctctccctgcagacccggaagtgggtcttgctgggagcagcaggagtcagtgaggaacaagccctcgccctgaaggcaggtgtggctggggccactttcagaacacttgggctgtggttgggatgtccgggggctttgaaaacacgagtgcacacaggtgccacgccacaggtgccacgcgggggtcttgtaaagagggctggggtggggctgagagcttccccctgcacactccaggtgtgctgatggcctggggcccctctttgagaagcaaggccctaaaagctcttcacacatgattttatccacacaagtatcctgagttaggtcctgttaatagccctgccttcggacaagaaactggtcctgctgtaaaatatcttgcccacagtcacagctctggtggcagaggcaagacgagccgaggtcatct

SEQ ID NO: 13103 - DNA, 1321 bp, Homo sapiens
gctttaacaatcgaacatatactgtgagccggccattaagagatgataccaagattatgcatcaagttataaagcagtcctttcatcagatggtaaattcttatttcatctccattttcttccagtccttaagggaaagaagttaagtcttccaatgccaatctgaggaccttcagagacagtctacgccttaacaagcacatgaaggaaactattttgaatgttctctttggcaacttatccataatttgggatcaaatgttaaaaccagaaaagtgtttagtgtggatttcagcaaaacctgatcatcccacccagaagaccttctcatcaatagatcgcccttaaagacccattgtaaggtcataaaaaacctcggccacctgcacaaagatggtgcctcactgcaacaagaaaccttaaggtgtcttaccgacgaaataaaaaacataaatgattgttctccaaggcctgagggcaagactcatgatgagcaagtcaaccccaatctggaacaatgtccctcctcttagaatgtcccaactaaagaccagttaaaatattagggtacgttcttgtgaatttccactttccaggtagatgaccaaatttaggtggtcaagatataaaggtgtcagctagttttaagtgtgaaacttatttcactttcacactgccttcaggccagaagcaaaccaaatttaccaggtttggctggaggagttttgtgactcatcttttactggtttgaattttttcaaaccagtggctgatacctgccttgtacttagtaccttaataccaataacctaatggtacttaggcgagtaccatttgcacaatcactgttttacttatgagcagatacagatatatccaaacccttacctactaggtatcctgctagggttttcaattccaattcttgtattaagttttttcctttcagttttaggtgcgaaagtaatcagtcaatccaatatcccccatctttgtcttgaaacaaaaactgttttaagacgtctacgttgaattattcagagaattaagcaataaaagctcacaccttattgtcaacagtgtttttatttatacctacaaaaagaaaacaagatgatggtatcaaaaggacaatttacaaactaagaatagtaacatagctttcagcatcctgtgcctgaacatcacacatctacaagtctttcaagtcttaatgcaacaggaatgtgtctggagaccagcaagaacatcaatagagagcactgatcccaagcaaaagccactaaccttttagatgagaagtccacacaacgaattgtta

SEQ ID NO: 13104 - DNA, 3394 bp, Homo sapiens
ttaaaaatcttcttgtatcttcccattaggtggtcgttctcgttaccggaccacttcttcagccaacaatcccaatctgatgtatcaggatgagtgtgaccgaaggcttcgaggagtcaaggatggtggccggagagactctgcaagctatcgggatcgtagtgaaaccgatagagctggttatgctaatggcagtggctatggaagtccaaattctgcctttggagcacaagcaggccaatacacctatggtcaaggcacctatggggcagctgcttatggcaccagtagctatacagctcaagaatatggtgctggcacttatggagctagtagcaccacctcaactgggagaagttcacagagctctagccagcagtttagtgggataggccggtctgggcagcagccacagccactgatgtcacaacagtttgcacagcctccgggagctaccaatatgataggttacatggggcagactgcctaccaataccctcctcctcctccccctcctcctccttcacgtaaatgaaaccactcaagtggtagtgactccagcagacttaattacattttaaggaacactgtctttcctttttttttcctcttcgccttttctttttttttccttttttctttttttttttttaatttttccccccaaccatcgtgatttgtcttttcatgcagattagttagaattcactgccaggtttcttctgcccaccaaaatgatccagtctggaataacattttgtaaaaaaaaaaaaaatatatatatatatatatagctgactggaagagattaatttcttcccccaacttcttgcatgttgaagatatttgagctatttttcatctaaaagagtaaggtattaggcccttttgtgggagccccatgttttgtttttctgagttggtggggagggagggagggggagggctgaattgttttgcagaggaagatggcatctgtgctttaaatttctcattactgggttagaaaacaaagagggattgccctgcacattttcttttgtgcttttaaatgtttcttaagttggaacaggtttcctcgggcctgttttgactgattgctggagtgcatttgatagttaaaaattactaattggttttatttcccttcacactctgcctccccacttctccccccgttactgaaaaataaccattttagtgtcaggctagaaattgaattgctgagttttgtgtatcctttaaattaaaaaccacaagtgtttattgtagtggttaaactgtagcatctcagcatctgggtggaagctgcctatatttcttcccagtttaactggggaccatctgtgaaattaattttccatccagacagctgctgtgagcaaatgaacataaatgctcgctggaaatttactaaccagtttttatattgacctgcagtgtaaaaagcacatttaattataaacaatatattcaaaatgggcaaattttattttcaaatgcagtgtagagctagattaaaagcaactctttgccacctactctgcccttttggcaaagttaccttgaacaaagaatcttaagggtttattaagaactctttattttcttcataccctgttctctgcagtgctttctaacagcttctgggtgcagattttcttcggcatccttttgcactcagcttattacaggtaggtagtgcttaagaaaagtcatggaggactaaagcctaagtccttttcacttttcctccatctgaaggtaggtgagttcatcctcttcatggtaatgctgttttaccaagactttatagcagatggacccagaaagaattttctgctattgtgttcactacaacaggatagggacatcagacagccccagaaaccccttccagatctgatatgggactattaatttttatgctgttaattggtattcattcacaatgcagttgaagggggaaggctccactgcattctttggctaaggcctgaatgcttgctcatctgtaagatctatactcgaggttttgttttccttttaaaattctttagggagagagggatggtttctgaggggttctgaaagtatgattcaatgtgcaacatacaggtaggtcttcagcataagctgaaatatatgcatgtaaaaactttgacatctttttttttaattttccactttcttcttaactttacttctctttttgtcccccccccatcttacagaagttgaggccaagggagaatggtaggcacagaagaaacatggcaaactgctctgtgctttcaaaccaaagtgttccccccaaccccaaatttgtctaagcactggccagtctgttgtgggcattgttttctacaaccaaattctgggtttttttcttctttctttaaacatagaggtaccaccacaagggatgccctactctctcgcagctcttgaaagcatctgtttgagggaaaggtctctgggcaagcaagtggttatttggattgcttgcttccctttttccacctgggacattgtaatcataaaataacagtaaattccaaacctcaaaaactattatggcctgagcacagctgaaatctagcagagtttaactcttctgcctccatgtctgtcacttataattcaggttctgctgttggcttcagaacatgagcagaagaatcgttttatgctagttattgcattcatggttgaaactcaacttagggaaagggttccaatgtattaagcaatgggctgcttctccccaatcctccctaacaattcgttgtgtggacttctcatctaaaaggttagtggcttttgcttgggatcagtgctctctattgatgttcttgctggtctccagacacattcctgttgcattaagacttgaaagacttgtagatgtgtgatgttcaggcacaggatgctgaaagctatgttactattcttagtttgtaaattgtccttttgataccatcatcttgttttctttttgtaggtataaataaaaacactgttgacaataaggtgtgagcttttattgcttaattctctgaataattcaacgtagacgtcttaaaacagtttttgtttcaagacaaagatgggggatattggattgactgattactttcgcacctaaaactgaaaggaaaaaacttaatacaagaattggaattgaaaaccctagcaggatacctagtaggtaagggtttggatatatctgtatctgctcataagtaaaacagtgattgtgcaaatggtactcgcctaagtaccattaggttattggtattaaggtactaagtacaaggcaggtatcagccactggtttgaaaaaattcaaaccagtaaaagatgagtcacaaaactcctccagccaaacctg

SEQ ID NO: 13105 - DNA, 1190 bp, Homo sapiens
ttgttggtagattttgccaggcttctcccaacagagtagaagtgatttggcctcataacttcacagtggtttaccactttgttctatgttctggttttgtaaaggatagtactggaatttgcgtctgaagaccaatattggtgtaactcctgtcagtatattggtaaaatgtagcagaggcaggagtttggatgtttggatgggattcccttaggattctacagccaataaagatcctatttcctatgcatgtcccaggaatcagtaatcctcttttactctgttgggatgagtctttttttgtttctgttcagagtggttactaacttcaccttctttcctcttgctgtcatctgcattcgtgcttcccacctgttgttggcatgtcctttaccttctctttccctgccacatcaacctacacactgactcatcattgacgtggaagatgtggaagatgtcaagtttgtgatcaactatgactatccaaacagctcagaggattatgtgcaccgtattggccgaacagcccgtagcaccaacaagggtaccgcctataccttcttcaccccagggaacctaaaacaggccagagagcttatcaaagtgctggaagaggccaatcaggctatcaatccaaaactgatgcagcttgtggaccacagaggaggcggcggaggcgggggtaagggtaagtcctggagttttccaggtactgccaaggtatctctttacgccttctgtgacttgcttttagttgctgtttttaagaaggctgtaagtatgttgcttaatagcaaaggacactgcctaatgctttttataacctttttcaactaagaaaacgtgaagtttgttgtgatagtcctattagttaagctaaattgtgaatttttttttcttagagactggtctgaggtttggttttgtttgtttgtttgttttgagacggagtcttgctctgtcgcccaggctgaagtgcaatggcgcgatctcagctcattgcaacctctgcctcccaggttcaagtgattctcctgcctcagcctcccaagtagctgggattacaggcacccgccagcacaccctgctaatttttgtatttttagtagaggtggagtttcaccatgttggcctggctggtctcgaactcctgacctctggtgatccacctgtcttggcctcccaaa

SEQ ID NO: 13106 - DNA, 1182 bp, Homo sapiens
gtacctaataactatttgttgaatgaaatgatgctaacttgtactgagtgctggctatgccagatacttttatagtacattacacattattaggtcattttctcagcagcctctgaaataagtggtattatttctactttgcataggaaactaaggtgtgtggaagttaaataattctcttcaaattatacagtaagtggcagaataaaaactcaaaccatgtctggatccagaatctgtgattgtaatccctaggatgtatttctctcaataaagggatttttaattttttgcctattgtagctatattcataaacagtatttattgttgggtagtaagggaggttttacacatttctccatacctttaaatcacagcaaataaaatggtctttttggaggtaggctggtagtatccctagaactccatcctttttgaatattcttatggcatgtacgatacgttgctttaaaaatactgatgaactaactaaaaattctgttcctagatttggagcaagaggtggtggtggccttcccccgaagaaatttggtaatcctggggagcgtttgcgtaaaaaaaagtgggatttgagtgagctccccaagtttgagaaaaatttttatgtggaacatccggaagtagcaaggctgacaccagtaagtttacatgtgtgttttaatgtacagattattgaaccaagtagatatattggttagagtttattcatacgctactgttgccgttttacattttattctagtgtggtgatatttttcttaaaaaattttttggttaatttttttttttttttcctttttgtagagaccgggtttcgccatattccccaggctggtcttgaactccctagctcaagcaaactacctgcctcagcttttcaaagtgctaggattacaggcgtgagccactgcacccagctgatttttttttttttttttttttttttttttgagacggagttttgctcttgttgcccaggctagagtgcaatggtgtgatcttggctcactgcaacctccgcctcctgggttcaagcgattctactgcctcagcctcccaggtagctgggatcacaggcacccgccaccatgcccggctaattttttgtatttttagcagagatggagtttcactatgttgggcaggctggtctcaaactc

SEQ ID NO: 13107 - DNA, 1521 bp, Homo sapiens
agaatctaacactgctgctgatctgacaggaggtggagctcaggcagtaatgtgagcgatggtgaacagcagtaaacacagatgaagcttctctcacttgcctgctgctgatctactgctgtgtggctcagctcctaacaggccatgggccagtgccagtccacagcccaggggttgagggctcctgttgtagcacctgagttgaccaacagttaatgtgtgggtggggattgggatcgggcccatgctcttttagttgtctgactgtgctttcagtattatttttgtagacgttggccccatcaggtatggtgagaataagctctctaggcctgtatgatgccttacacccctccttttcttttccagatacttctaggacctaacacagggctctcaggaggaatgccaggggctctaccctcacttcctggaaagatctagattgttattgctgtttgagctgtctcagtgggataagtttgaaattcaagtgtttgaactgctgataatttggatttttttttttttttaactttggcacattgatctatctaaacctggtggggagaattatccccacattgtctcatggaaagactcaacttgcaactgtgccctccacactatccttacttctgtctccactctgataccagagtgcagccatgcagatggttattccagctctggtcacccgactcctttcaccaaattgctcctaactggaagatctcactttccccttgtggggtaggaaccgatgccagtgggagggatgtgcccctgaccattaacgactgttttttttttttttttttaaagaatggagttgttggggcaggacatgcacacaatgtgaaacagacaaaatgcattacacctgtagtgtaaagtggccactatgaatccctatgtatgagaggagggaggcaggctgcagcttcagccacagaatggggactatggaagacagcaggagctcatttcctctgcacattttggctgttagacctgtgtgtgtgtttaaaaaaagagaagtcagtgctcactttttgtatttaaatattaaaaatgattccaactgaaagtgtcatcctaagtaccttgaaatgagaccacgtcagagacatgtactgcccctcacattttctcacctaaaccagcagcacctccatcttaacagccataggcccaaattgtttccaagtgaaaattcatttttagccaagtacttcatagcaatctttgccctgaatttaggcagtcactttgagatccatcagcctaaaacaaaggattgggtctatgtacttctttagtctataatgacactgtgtaattataaagtatttgtagggaataacatagtactgatttctggggaataggggagggggacagaatttttttttttttttttttgcctgagatcaggtctcactggagtacagtggtgtcgtttgggttcactgcaacctcttacctcccctccaacttggcctcctgggtagctaagac

SEQ ID NO: 13108 - DNA, 1842 bp, Homo sapiens
ggtttatggccatacgtggaggttttttgttgttgtttttgagactgagtttcactcttgttgcccaggctggagtgcaatggcaccatctcggctcactgcaacctccacctcctggttcaagcgattctcaggcctcagcttcccaagtagttgggattacaggcgcctgccaccacacctggctaattttgtatttttagtagagatggggtttctccatgttggtcaggctggtctcaaactcccgacctcaagtgatctgcccgccttggcctcccaaagtgctgggattacaggcgtgagccaccgcacccggcagagttttataatgaaaaattaactaatattctagtatgaagtgaggaggatactgaacaggatgtggctaaagccaacctgggacagccatggggtggcttggtttcttcactccagtgttgtccctaccatttcgcagcattgatttaggaggctctgggacaaaagagaagccaaagagcagttttcccagttcactcactctggcaaaatcaggaaaaaaaagtctgcttttgacatcaaattccactaatttggggcagcgttgggtgaggaaagtattgtgaagacaggcttcttggagtaggggcagccacaattcagtagacactctaggctcggaggctgccactgtagttgccaagctcaggttgggtggttctgtgctgtatggatggaataggacctgggctggtcatcttcatgtcgtttcctctctgtatcaatggaagttcaacccgcccctacctcttcagatagttgtaggccacttttctcttgtaactttggaaaacaaaagaggagaaataagtatcataccatatgcgtgtctccaaagtggatgtggttgcctcaaggcaggtggcaggcaggggtgacctgctggccctcagatcaatggtcgtggcaggtctgagagctgtcccactggccagacttctctccagcagcaaagccagcctggggcttgcatgttgatcctgagcaagcttaacggggtgaagctgggctttctcccccctgtgactggagtgcatgttgacaccagcactttttctgcacatgtatcttcaatccaacaaggccgtttttttaatgctgagtaacaggccaccaagcggctactgcgttatatcttctcagcaactggccgcagtctcttctgcaccattttctacaccagacctgcttggcaccacagggagctcttttcctgccctgcacaatgacattccaaccaccaccagccagacattacagccaaccttgctgattgtcacaagcaggaccttggggccactggcactgtcagatagtaagccatttcttgggtagaggaggaaactcctctccacaaatccacttgggcctgtgcaaatggcacttgaaagagtccccatgcacttggagtccatgagccaatgggatatgcaaagacgcttaaacatttcagggctggtttctctgttcatatccaattctggtgcttaggaacagggacccatgctgatgcccaagggcaaaaagccccacttcctttaaggaagtgaacaggcctgaccctgatgcccaataacgggcaaccctaggctttttgtttttcttgcttttattcctttttgttgttggccttgtgctgcgtttgtttacaaaagatgtattttgtttaaccaaatattaaaaatggaaaactccatatatgtctccttgtctgcctgaattctataattgtgtaaagaaaaataaactttagtatgacgctgttttaaaaggagttcattgccagcgtaagtcatcttt

SEQ ID NO: 13109 - DNA, 1103 bp, Homo sapiens
ccgttccttctgttctacccatgagccgcagtgttgattccttcccacaaacactgagggctgggctcttgagacccagacctgtcctcagggacctcacatgcaatccttcagcaaggtctgctgaacgctgctatgtgcccagcggtgttgctaaggtgctgggaacaaagatgaagtagatgggcaaggatccttccccgcagaagcccacagtccagcgaggaggtgcatgtgcagtgtgctgtaatcccaggaactgggacccttgtctgcccagggcctgggggtgggggatgacgggtgggcattagctggaggaaaaggtgggagatggtaaggcaggatcagagccaagaacaggcttcacgggggtctgtagccccagagataagcccccacccttccacagcttaagcgtatttcatgctttcactcactgcctcccgttgtcctgaagccaccaggtggctccagcctatcctgacctctggcttccttgacagtgcactgtgggagcatcaggcagacagccaccattctgagcatggacaaggactgtctgcgcactggggacaaggccactgtacacttccgcttcatcaagacccctgagtacctgcacatagaccagcggctggtgttccgggaaggccgcaccaaggctgtcggcaccatcaccaaggtatggccaggacagaccttgcctgcctccaggaagcaccaggggccactcctgttctgtgaccctgagtgcagggcagaggtttagtcactgccatgggagagctggacccactgaggtgtggcctcggtgccatctctctactcccttagaggtatcctgtggcctcctgtcctgggcagtggtggtgaccatggagaggagaaggtagggttagggtatgatcttcctccatagaaaactggtgacagaatgtctgggcccagccaggctcagcctccagggtgctgtcacaggttcctatggcctcactgggaccatgtctaaggtctcctctcagagcagaggtctggttggagtaagtgcagggggttatgggcgtgagttctcttggggcttaagctgttggtgtatcctg

SEQ ID NO: 13110 - DNA, 1467 bp, Homo sapiens
agtggaggccggcgacgagggggccagcgccacaaggtgaagtcccagggggcctgtgtgactcctgccagcggctgctgaaccttcccctggcccaccctcaccacccaaggggtcatcatctctggccaccactccaccagatgggcagagcagctatgaccgccacccagccctcccgctcaggccacagccggagcctccgcattgcccccacccccattttccaggggggttgtaatttataagctgacgaaggtagccagacttccggaggactgaccatctctcactgtcctccccaccttcttcctcactcacacattttttgtacatctgggcccttagtttttattctgtttattatatgtctctgtctctctctattgtgtgtgtgtgtgtgtgtgtgtgtgtgtgtgtgtgtgtggtgcaggagtgccacccccagggccctgtcaacctctcttttctcctccatggctgtctgcctgcgtatctgtctctgagaatcctcggggcggtcaggggatgtcaggaggggaaggagccgccctccctatcttgctgctcctcttggcactcaggggcaccttccatggagccagaccgggtggaggggcttctgggatttggtgtctgctgctgccagagcaggaacccccagtctaggacttgggcattttaacagggagaaagtagtggcttcccttttctctctctcctcctttttccctttaagcccacagattcaggtcatgccaaaagctctctggttgtaacctggagacatgtggaggggaatggcgatgggattataggactctccccatctcgggccctgaccctgacccttgccaccaacccaaagacagctggtgggtttccccttggagacaatcctgcgtttgcctgggccggccctggctgccctcagctttcgctgatctgcccggcctggagcctcccatcaccccgcttcttgttgggcctcaggcactggttaccagaagggggtctgggtctgctcaggatcatgttttgtagcacctcctgttggaggggtggagggatgttcccctgagccaggctgagactagaaccccatcttccctgagccaggctgagactagaaccccatcttccccaccacgccacccctgtggctgctacaggagcacagtagtgaaggcctgagctccaggtttgaaagacccaactggagcgtggggcgggcaggcaggggttagtgaaaggacacttccagggttaggacagagcatttagccttctggaagaacccctgcctggggtgggactgtgcaggccagagaaggtggcatgggcctgaacccacctggactgacttctgcactgaagccacagatggagggtaggctggtgggtgggggtggttcgttctctagccggggcagacacccagctggctgggtccttcctcagccttgc

SEQ ID NO: 13111 - DNA, 1184 bp, Homo sapiens
atattcaccagatttctccaaaggccccgcagagagcttcaaagctggctgtccccgcggcagcacgctcccttccacaggcgacacaaggcctcgtgaccaagccctcaccctccaccttctcacactgactgcctcggcacctcttgctccccactcttgggaggcctgtggttctggagtcccagcaaggggacctatggttcactctctctgatctggcggggcactcactgctctcccaggcagagggacaggccctggggttggggcctgtgactccctttagacatgtccagacaaggtttccgatttttgccccacactgactctggctgggcccagcagagcggactggggtgttagtggggggaggccctcctccccatactgcagatggcagcgaagaggcggggttggtggcaggcctgtggtcactgcctccactataaatgctgcaactgccgtggagggtgcaggggaggcctggcgatggtgagggaagcagctaggagatggacggcccaaggcgtggccaggccgcggggagcccagctgtctgtgggggacggggcaggagggaagtggacggaaggtctgagaatgcagcgtgtgtggaagagcagggactatccaggcaggcagcccaggttcaagtcccggctacagctgctccctagctggaccctgggtcagacactccatcctccaaacctgagtttctccatttgtaaatagcaacagcaacccctaatttggaggtctgctgagagttacacatcagggtaagcccagtgcctgccaagtgggggaagcctccttcctcctgagccccagcaaaccctttcaccttcagcccgtcctctctccccacccccatatcctctcccatccacggccactgcccggcttccctgaacccattgtgagcttcctggagcccccactctgcacgggcggctggtccctcaaacaatggtgacttccccctccccacccccatctcaccccttcctgggaaaatgccaaggcccagttcaatgccacctcctctgtgaagtcctccccagccccctagtgagagtcactctcttctctgaactccagattccctgaaccccgtcttctctcttctggcaaatgaacctgtcttgcttttctgttcctgggtctggccctcagta

SEQ ID NO: 13112 - DNA, 2038 bp, Homo sapiens
ctaaaaatacaaaacttagctggttaggtggtgcatgcctgtagtcccagctactcgggaggccgaggcagaagaatctcttgaactgaggaggtggaggttgcagtgagccgagatcacgccattgcactccagcctgggcaacagagcaagactccatctcaaaaaaataataataatcttaaagatgagaaaagccaccccatctggcaccacagctgcatcttgcttgtgagaaatggggaagagttcagggaggacacgtgacctgcacaggatcacagagcatggggcagagccaggactagagctcagggcatctgactccctcttcagtgttcttccccctccatgttgcctgcccctgaagacctttgagttcagtctacacctaagcaggtagacatccgcgaggtcagatgctttccaacatgacacctgaacatcttcctttatgcaacacccaaacatcttggcatccccaccccaggaagtgcggggaggaggttatgatccctgggcgcttcggcagaatggagagctgaggtgtccctcccctgctagtcacctaccaggtgtctgagcagctgcatgctccctggctcaagtgggcactgtaccttttgcctgcctttttgttccctatctccactccctgaggccacttagcctgagacatgatgcaagagctgcaggccggggggctcagtgccatggaagctactccaagttgcattgcctcccgcgcccagatcctgctttccatttcgagaacataaatagattgcccagcccctccagtacaatcccactggaagaaaaggcaatggcgggcttcagccagacctgctgagacctaggttgccacggtaacagccaaagacatcaacccaagtgctgggtcaagtgtctcatcatactggcactgttgctggggtgacggcagaattcagaacttcaatttcagtgacgccaagcttgatgtgtttctgttattgttttgaagaaggtagctcttgtggaggacttgggagaaggatggggtcttaggaaggaggtgacagcacttgcatggtcacttgagcccacacacacgctcaaccccaagtcctttatgctttgtcacagtgaagatgagacctctgacgtccaagccttgttcctgtgctgcatcacccactcagccttccaaagggaacaggaacaaatttccccagcaccactgtttgggtcccgcttttcctatcttctgctgcccctgagcacatccaagcagacagggaaagaggagtcagacatggcccagtcacatcctgagctgctcctggctgataaccacgatggagcccgtgtttgtcctgccatctggcactgcactgagtgtggcacaggcaccgtcctgttgatctcacaacacagttctaagttaggacgttcttggctccgttagacaggtgaggaaactggggcacagagaggtgatgtcatctgcctggtgtcaatcagctagcaagtgatggagcccagatttcaaaccaaagggggttacgtccaggggctgagttcccactcacctgtgtagagtgccatctgggcaccattgctccagacgtgttccgacccctttcccagcccacagggcttgaagtgaaggaacagaggcagggggtgggccagccccagggccagggtccccttggtgaagccgtgccagggggctcagctgcttcagggaatgtgtccctcccaccatgggccagagcttcagcccttctttagctcagctagagttcacaggagagccaaaaaagaaaaggaagctgagcatctcccgagtcctgggcagggaaggggagggaaattgctgcttctccaactcttgcttggggccaagccctgcaccagttgcttcccagctgttatctgccagatcttcccatcttgtggcatgtggtgcccccaccaacatcccaaggggaccaatccccttgccaccactttgcatcacctgggaccacagatttggacaggaagggct

SEQ ID NO: 13113 - DNA, 1194 bp, Homo sapiens
ctatggtctgcctaccaggacggggagctgcagggctccggtgagaacctggctgcctggcaccccatcaagcctcatgggatccttatcttgggccaggagcaggtaaggctcaggctgatattggggctggacctcctaattgtgcagatgggcagactgagggccagagagatcagagacctgcccaaggaactagaatcttgaaggtggggctagagcgttggcggtggggcttcagtggggttgaaggtggggctgcctcggggacaagagcctgactgagccagcctgcctgtcttttctgctccctcactccatgcctctcctttctctgctgctgtcttggcccaggataccctgggtggccggtttgatgccacccaggcctttgtcggtgacattgcccagtttaacctgtgggaccacgccctgacaccagcccaggtcctgggcattgccaactgcactgcgccactgctgggcaacgtccttccctgggaagacaagttggtggaggcctttgggggtgcaacaaaggctgccttcgatgtctgcaaggggagggccaaggcatgaggggccacctcatccagggcccctcccttgcctgccactttggggacttgaggggggtcatattccctcctcagcctgcccacgcactggccttccctcctgccccactcctggctgtgcctcccatttcccctcacctgtacccacacctccagaatgccctgccctgcgagtgtgtcccctgtccccacctgagtggggaggagcgtctcaagtgaacagtgggagcctgcccacctggcactgcactggagttgtctcttaccccaccctccctgcccatcaactgtatctgatttcactaattttgacagcacccccagtagggtaggattgtgtatgagggggaccccactatctcagtggtgggggtggccgcccgcccccttgtcccccatgcaacaggcccagtggcttccccttcagggccacaacaggctgtagaaggggatgacgaggacatcagaggttagacttaccctcctccctctttccaccagctgccagtcaagggcagtgggatctcgatggagcctccccccccccccacccatgcctccctcttcctcctctttcctcctctctttgtgtgtagcggtttgaatgttggttcca

SEQ ID NO: 13114 - DNA, 2401 bp, Homo sapiens
gtgaaataacccccaaagcccaatctcctcctacgttcaatattggttggggcatccgtcatctccccttaagtgcgccccctccccacccaagtatcataggaaaccggtgaggtctggtgtctctggtttgagacggtaagttgggacccatccctgtctgggtgcccactctgacctttagtttgcccttctgtgaaatgggtgtattgggtagcaagccctcttcagaaagcgctgctggtgtcagagcagctgcccagtaccaggtggggggtcaaggttgctggtactggggcccccagctgcccacaacccctctttgttctcaccctgcaaaggggtcaaggtcaaaatgagcctcatccttcctatgatctgggaagaggtgatgatcaagtccccaacttcagtgtgaggtggacagagttggggggatggcccctttttgaagaggtgaaaatggttttggagaagcgcagctgcttcactgggggaatgcggcagggactggggcccaggatgctttggcctatggggaaaagccctttaaaaggcagggcccaggccctggagccagcacaagactggcctcgagcccctgagccaggaggtcctggaggagagccaggccggtgggcccgcccaaggctggagggtcagccccaacagggagctgggttggccagggggctggactgctaccagcctctctggcctatggggacccaagaggacacatcccccttttgcccactcttctgtgtcattttgttgttttggtttgtggtggtttttcttttttcttttgtttttcttttttctttctttctttttttttttttttttttttttttttgcacttcgcccacacaggacagtggagccccacctggtcagttccacttccgggctcccatgcacttgcccaaggcggcctctttgggacggggatggtttgaggaaacacttttaaagaaaaaaggaagacattgaaaggttttagtttcttccctatctgcatgtcctctcatatagaaagcccagaattaggggctagaactccaggagagggtctccccgactcatctcttgctgacggtcaccaggatgcagaaatagggagatggttagtgggggccaaagatgccccctcccaggccttcgtggttccctcctccgccccctgcaatctttggaggagtcagtgcctcactccagcagtgagtgcctactgtatgcaggtagtcagccaggcaaagagagactaacggtctcatgggggaaccctcttgcgggaggccgggtagctggagcgaagcgttccggctgcccttgctgctgggtggagtggagagggagacttctttttgttggttttaatttaaaaacacaaaggcctaaagaaatacgtatcttataatttttttaatttttgagacgttcatttaatgaattgtgcacgaatgaattctatatatataaaatatacatatatagctctatatttggggaggggcactgtctcttttttctctcatttttaaaatgaagtgttgttgcctttgtatgtggttcaaccatccagctcccagctggctaaactttgcctccagtggtcaaagatgggaaaagagtggggttggcaggagatggaaaacggaggtgccgccccagcatggggggcaggtcccccagtccaccctgcccctccccctgtggagaagacgcttagttgggggtgtgggtttgggctccattctggattcggcggttccgggggaggggtgggtctgtgccgattactctgtcttgtacgtttgttctgctgctcttcaatattgtatcaacgccaggaaaggggggtgaaaagcctcttttaccccccaaataaattgtcacattccgaagctgaggcctagcccctaggttggggtgtgtctgtgtcttcttccagctgtgactggcttttcaaaagtagcaggcccatgtccctccagtgacaggtgaagagggggaagccctgtcccaccgctggcactcacttgcttcccggttcctatctcccacactcccccagctcacatgtgcctcagtgggaaaaagagatgcctgctgcttcttggacccttgagaataacgggtaggtgagagtgggaggatggaggtctcatcactgcctgtccctcagtgggaatcacagcacccgcagagaggaaggggcctctggggttgtggccccaaagcccagaagggagcaggccggaatggggcaccagctgctcttgccattgggtcctacagtttggcacccaaccgtgccataaagtccgatatcacattcggataatgagaatggtggtcttcgagtttgttttctgggtgccatgtgccttctctc

SEQ ID NO: 13115 - DNA, 1455 bp, Homo sapiens
atggctcggtgttgacccagggatggggctgggtagttggggtcccagaaagccgggggtaggggccaccctggaatggggcaggggaagggcacaccccctgcccatgcatggtagcccactgggtggtttctggaaagccctagaaactagggttcctctgccccttccacatcccacctgtctctctagcttgcttcctgctctcctgtgcggcgtctgatttctcggtgctaacctggcagctgtggggcccttaggagccccccaccgagggtggacacagtccctttccttcctgcagatgcctaggcaggaggagggcttcctgcctgtttggcaaagtcccaggcagaggccaaggatgaggcctgactcggctcctccctccacatcagccagggcatcagaagttgggccagggcggggtcttccctgctcgattttggacgaggcctaagtagaccccctatgccctgccccagccctggctctttcctaaccccctcaacggtgggaggaactggcagagggtgcgcctggccacagcctccccgcatctaaaggccccttcagttcttgaccaaaggtgctacgagaacctgccgtggaaacttccagttgtgcgtctgccccactcgctgtgtttgtccgtgggttcatacatgcattgggtgctaggccccaggctgccgggtggcaccctttacagttcctttgaacaggggcattgaaggcctggactgcctctcgcctcagtaggcctggggaccaggcttgggtctggaggtttgctgtggaagtcaccaggcctcccctcctggcccaggtgtgctgggggcaccgtgccccccacccccctgccctcctcagggtggtcagcccaacctgtcggaccttcacttcacatcatggtggggaccgagatagagagggagaccccattccaagctccctcttcctccgggtgtttggggaggatgctgaagaatccattcccgagggcctcccggcttgtcccagcccctcttttgcttctgaccacggaggctttctcacagcccagcctgcctgaagcaaaggaggctcccgtgtcctgggcagcttctgtttccctctgctgcctgggagctgaggcacccgtgccagtggcagaggccacagccccagccttaggccaggccctgggagggcaggcaggcaaaggggagaccagagggtctgtgttctccaggagaatgagggtgttggtcccagaattgggaccggggccccgctggccagccctgggccacttcccgggtctccattgtgcgtgggtggcgtgttccaggcgtggctggagctggcttcctggctgtgctgccatgggcccctccctcagaagcacgttggcaggaggccgatcagaaccctagcgcctttggtcctaagaatgggaggctgccttccttc

SEQ ID NO: 13116 - DNA, 3462 bp, Homo sapiens
gggacgtttaccacgaggcctcaggctggggatggagagagttgctctgggagttggggtaccacccccagggcaggatggggacaggatcacctgcccgggacaccaccattatcattctcctctagtgacgcagcagctggttctgggagttaaaggagcattggaaggcccaaaccctctcccttgagtggccaccccagcctggttggctggttttccccttttctcttgtttcaattgggtctttaccttgaactctcctctctggctttgcggtgggctgtggaggctggttttgaccaaaagtgagtggggcgggaggaaggggcaggaggaagggttgaggttacttggggcgagtcccttccccttcagagaggcttctatccttcccagggaggaggcgccgctgagacccttctgctgagagctctgccctcccctcatcacctggcctgtgcagaaacgctcatgcacacctggctgcacaggtgtgcacgcattacccttcgcgtgtacgttcccatgtgccccgtgaaagcatgtgtggctgcagacgtgtccacatgggccttgcgaacctgggttagaaaccctggccaggcgaacgtggggtgattcacagcacaaaagacctcaccaccacacctgcactcaccccaccttgcatgcaccttgctacctgcttgcggctttcagtggagggcaggggtctggcacaggtgcgatggcaccccatgctccaggcatacagatgtggtttctcggctgcaccgggccaggctgcgggtgtgcaggcgtctgctaagttgtgtgatgtatcagcacaggctttgagacgtctggaccctgtccttcctcccgtgaggggttcttgttctttctgactcaggtgacttttcagcccttccaattcccctctttttctgccctcccctccaactcagccaacccaggtgtgggcagtcagggagggagggagtgtcccaccacgttctcagggcagcccttgactcctaagccccttcctccttccattctgcatcccctccccatccaacctaaatgccacagctggggctgagctgtattcctgtggagggacctctgccgtgcctctctgaggtcaggctgtgctgtgtgatgggcaggctttgccccagcccacccctggcaaggtgcacttgttttctggtttgtacaaggtgtcctgggggcccgtggcttccctgccagtgaggagtgacttctccctctcttccagtcctgtaggggagacaaaaccagattggggggcccaaggggagcatggaaaaggccggctcccctgtctttccttggctgtcagagtcagggtaacacacaccaagagtggagtgcggccagcaagtttgagacctgcccgccctcctcgcagctctgctctgtgtcctcaggaagtcacagagtctactgaggcaaggagagggtgattctttccccaaatcccttcttccctggttcccaaaccaaagacagcctgcagccctttctgcatggggtgctctgttgacaggcttcccagatccctgagtctctctttccttcctcctcgatctttagttgtccacggtcaattcagtgcttccattgggggacagtcccctccgggatgacctgattcacctccagcccagggaatggaatctagaggaatacgtggggtgggtctggacaaggagcggcaggaatcaccacccatctccagctgtggagccctgtggaggggaaggggaagcttggggttcagaggggactcttccaggagaggggtgcccagcggaggtaaagatgatagagggttgtggggggtctctagttgaatgttttggcccatgactttggaacatggctggcagcttccagcagaagtcacgctccccatcccccaggggacataggacctttttcctgcttcctggtcactttcaaagaactatttgcgcaatctgtgggtctgtggattcacggggctttctgtgtgggtgctgcagttgcttttgtctgcagcagcaggacacatctttcctcttactcagccctttatggcccatggggaactccgtggctcagggagagctgaactccaggggtgtgacctgggacgggtgggcctgaggtgcccagctcagggcagccaggtggctcatgggctgtagtgagccagctccctgggggaaaaggctgtgggccgttaggaccatcctccaggacaggtgacctctatgaggtcacctacggctgtggccgtgcaggcctccttccagcccagagtggcccagtagagcaaggcagacagtgacctccacccccgcagccctcttaaaaggccagtactcttgggggtggggggagggtttagaaagcatttgcccatctgcctttctttcccccagcccccacccgctttgaatgtagagacccgtgggcacttttccttttgtggtggggggtgcggaggaggtacccccacccctggcacagccgcctggaatgcaggactgtcactgctgttcgggtgatgacctcgttgccaagctcctcctgtccccttgttctgggggcaggcgctgtgcttctgtgaggtggtttagcttttgctttcgaagtggccagctgcggccaccaggtctcagcacaagagcgcttcctttgcacagaatgagcttcgagctttgttcagactaaatgaatgtatctgggaggggtcgggggcacgagttgattccaagcacatgcctttgctgagtgtgtgtgtgctgggagagtcagagtggatgtagagcgcggttttatttttgtactgacattggtaagagactgtatagcatctatttatttagatgatttatctggtaaatgaggcaaaaaaattattaaaaatacattaaagatgatttaaaaaaaagaaaattcctgggcatttgattattccttctggtggttgtcaagtgcatccgtccaccaacagactttgtgcgagcaacaaggctgtttatttcacttgggtgcaagtgggctgagtccaaaaagagtcagccaagggagataggggtggggcagttttataggactggggtaagcagtggaaagttacagtgaaaggtggttagctattgtcagcaggggagggggtcacaaggtgcctgttggggagatcataatactcattgtccggaagaaggtcaccaggtcgatcagttggggcagggcaggaacaagccataatggacctgcaggccatctggatgtatatgtgcaggtcacaggggttacaatggctgagctgcagctcagaggccagacagtggtgtccccactgtgctgaagaaagagcttcagcccctggcaatgcctggggtttaggtcccaggtctgctggtcaccggccataatctcggacaagtctttcccttcgct

SEQ ID NO: 13117 - DNA, 1134 bp, Homo sapiens
tcacctcacttgaggggagcgcaggtgtccagggagggggcccctcggccaggtcggcatctgctgcagcgtcagacacacagatgggggcagcgttgacaaggtgggaagccatgcagaccacccaacccgaccccaactccagctcctcctctctgtgtcttcagtcagctcagggcctcacacagggctggacacttgggaggagggcactgggtgcatcctccccacctagacaagagctcagccagagcgggacgacaggaggagccctgggctagtgttgggccctgagcccagacccgactggccccacaaagcactacaggccctctttggacattgaaccagctggaccttatgacccatagggccctttccagctctgagggtctctgggctggggccgccttaccctcctcttcagggggctgcgcagcaggctcccactcgccagccgcctgcaggacgtctggggccggtggctcctgcaggaagagctcccgtcgatggctgtggctctccaggttgggcccgcggggcgggaacttcttgcgcgagagccgcaggtacttgtgggcctttcggggcttgcggagcgggaagggcagggtgggcaccaaggggcccttgtccaccagctcaggtgcccccgccttgaccaccccctcagggctcccgctgccgagtgggcacgtcagggagaagcagagcttctccttgcccttggccttgtgggagctccgcaggtccatgctgtacagccgctgcgggggcaagccagggcagcgcgggtcagccccaccctcccacccgccacacctttgctcatgctgttcctcccacccggaatgcccttcccatgccatgtctacccactcaactccttcccatgccacggctggccatcaccccaccccaccccagcccagagagtgcgccccgggcaaccccagggtcggccagctcagccctgcctctgggccccacagagcactcgcgtcccagcgtttactcctttgatacccagcagagaagcatacaagaaggacaaactgaaaactggccaagagaaacaaatctggatgcattaaggagttagccttcgttttaggaaaggcatctttgcttgcc

SEQ ID NO: 13118 - DNA, 1179 bp, Homo sapiens
gtgcaaacctgggggagaagtggtttcaggcccagctgttcgttgatgaggctcagagtgagcgctgggtacagcgcccgaatcggacagtgtagaaccattctctactgccttccttctgagaacagccttgtggtcagaagtggctgggatagcggagggccaggggacaacttcttaacacgttcctggaccctttgctctttgtagcctactgataactgcaaaggggagcttggaattatgttagtcagtccctgtgaatgggggagcttaaactaatggatgccttaaaaagcacccattcagaattgagttcagggtgacacccccagagcctatccagcttgacaggggagacctgtgggtaatgcacatgaaataatcttatcactccctcagatgacccagccatggttggtaattgctgagtagcaggaaggggtcagtgggaggtgctgggcgctgaggtgaagtaatgtgtatccattccaggggtcaccagtcgttggcacaccaagaagctgccccgcaagacccaccgaggcctgcgcaaggtggcctgtattggggcatggcatcctgctcgtgtagccttctctgtggcacgcgctgggcagaaaggctaccatcaccgcactgagatcaacaagaaggtgaggttctgagagtggctccctgggggtgggaagaggcccccgtgatggggagtggggtttctgtgcctgtcagtgctgcttcactgactgtagcttatgcatcacgtggacatcagtggcttgcttctcatggtcagttctggcccatcttgatgatttgtaaggtgccatcctgtagagtggctgtggtggggctgactggtgtggctggggatactagtcttattggtccctgatgccaccaccaggggggtgacaggcctgtgttgtacagcaggatctttagttttagcccagccgccttacagaaaggaacctggagggccagccagctttttgctctgaccttgggatacgctgtgactgggactgaggcctcagctgccttctagcgtgctttgcaggtcagcacactggcatgtctgggttatttgtccctaatgccccagccttacacccttcttgttcattcagatttataagattggccagggctaccttatcaaggacggcaagctga

SEQ ID NO: 13119 - DNA, 1179 bp, Homo sapiens; identical to SEQ ID NO: 13118

SEQ ID NO: 13120 - DNA, 1215 bp, Homo sapiens
acgtctttttctttttgagggcccctggatatccatttttgaggggtacacccatctccccaacaatattagaagatagcatttggagggggagacccgtggttcaggccctagtgggccagccttggctgctccacccctcagtgtcctcaagactgggtaggaagaaccaggtgaccccaggggatctcagtccagagaaggtgccccagaagtggggaccacccagcctacagggaggagtttaggggcggggctcacagaggagtagtggatgatttctagccatgggtctgaagtacctgaccaacaggtgcctgcccggccccctgaagccagcctccctcctggcacctctgcagctcttccccactggcctcacccctactctctcctggcagagcctgaccgcagccctggccgtgcggagattcaaggacctaagcttccaggaggagtacagcacactgttccctgcctcggcacagccgtaggcctccccggcttgcagaggccggcagccctgtatcacccctggcagtgaggtggcaggagcagcctagtgccagaaatgtccaagatgccagggcatgcagggcagtggaaggctggcttgaggaaccaattcaggttctccactgactcattcattccttcaccgcctccttcattgattcttcatgcgttcattcattcagtaaacatttattgagcagctgttttgtgcctagtgatgaattaggtggggtccttggctccaggagcccacaggctggggaggagaaaacaaacacatcaatatctcttccaaatggacagccgtggacagttaccaggtaggtagcggccccatacatgggctgcctagaggcgttcatggtccccattgctgagctgtgggtgcagagcaatagcctctcccttcacagcggtgtgaagagtgacctcactgtccttagggttagcatcctggccgaggatgtcacagggctcctggtctggctctgtcctcatgtgctatgtgaccctgacaaacccgtgcacctctctcagcctcagtccacttacctgaactgaggggtgataatggaccaacctctcaaggctgttgtgccaatgaaacaaaggccagcccagggcttagcacaagcatgctcaataaatgtaagctcttttgttcattcattcattcattcattcattcttctctccaga

SEQ ID NO: 13121 - DNA, 1203 bp, Homo sapiens
tcagggagcagagcagagcaggtggtggacgggcccagtgctgggtgttttcaccaccatccccccatcccccatctaagaatcctaagaggcaggcgatccctcacctgcttactcactcagcagttacccggcccctgtgctggagataccaagggcatgggtggtccctgcttcgatggccccaaagctgggccagagttaagggaaagaggaggaagtcctaagcagagaagtagcaccattatccccatttaacagaagggaaactgaggctcggcaagcataggcgagttggcagtggaacacggatctaaactcaggtgtgtccaagtcctcccaaaggacagcagtgatggagaggaccccagccagctgtgtgacagctggttgttgctgacttcattttccaatccggagaaggggctctgtccacagtcccccgccgccaggtggcccacatgggaccagcatgggggcaggttatctgttggcctgaagagtgaaacctgtaccaggccaaaggtgagggcgtgagtgagggcaggagtgtttatggcagagtgaagttctgtgcccaccacaagaggctgtgagatgttctgaccctcacccactgtccaccaaaagcctctcctgctgatgggcactaggagacctcagggtactgcccatctgtttctcctcgggtgccagccagctgctggtgatcctcagccggagggcagggtaccaggtaagcttaactccatcttgggtgtttgtgacaggccctgcctgccaccctaggcagggaaagctgtcaagactcctgccaggaatggggggtgctgagtcatctcacgaagaatccctcactcttcccgggttcagcccagaagcccttccaggcatgatcttccccatcaggctgggctctggcagggacctgcccaggatggagatgagagagggtgagagatggagggcgagatttggatgggacccagggctcctgactctgccctggaaggttcatggggaaactcgctccttctgttggcagaggacagcccctggggaaccccaggcccaactctgtccggtatcccttttcctcccagctgccctcccctacttctcccttgctcccaaagctttccttggagaagggccctcctgcagctggaccctgcagggtggctccctcctccccatcaagca

SEQ ID NO: 13122 - DNA, 2097 bp, Homo sapiens
attgctgtcttgtggactgtgcactcagtccttgcaaggccaagagtccagttgtaggtgtggccttgagggggaagtggggaggagaagactgacatgagtcctctgcacggatccgtctctccctccccatcaccccttccttctgacacccagtcccagctgtccactgtcccaggtgcagtcactgttgtgcccttccttggggcaggctggctgggggccagaaaggggccatgaggctgtcttgggcccaaaaagggacaataaggccagttgtatgcttcctgttcctcatagcttgccttggtggggatgtctttgttggagttgattctgagctgctgtgattaggagaccctgaaatacagtggtttaagcaagatggaagcttgtttctaattagtctagattgagatggcccagagctggtagggcagctctgcgtttcttcatacgcaccttccaattctgggtacacagcggctgctccagcgcccaccctcctgtgtgcatccaagcctgggggaagcagaaatagacaagagggcacacccactttttgctaaaggcatgagccagaattggcaggctcacctctgctggcctctcattggctgggactcagtcacatggccacaagcagctgctagggaacctgggaagtgtagtcttcagcggggccgccatgtgcctggcctcaccttgggagttatcttattgatggaggagaagagaatggatatgggggaccagtagcatctctgggagagggggagggagcagcaataactcagtcgtcggatccagctctcattgtcagagtttccggaacagcttgctcctgtttccctcactgtgcagcccagggctgggggcagtgaggagcttgcagctctgtgggaaggggaaacaccccctcccctcggcccctcagacgctacccaatgatgccggtttgcagagttggcctgtggaatggctcatgtttgtgcgtgtgtgtgtgtatatttatgggcatgggtgcatgcttggtgtgtatttgtacatgtctgtattgctgtgtccctgtaaatacatgcttgtgtatggatggaagaggccaggcccaggcctggcctcttcctcgggcctgtggccacacctcctgcagctccccaaaatgactgaggcagaaagcccttggggagcctagaaagcaaagctaaaggggatgcagggtctgtctgtctgtctgtctttcagtctgaggaatgagaatcctgacctgagggctgtgcagctgagagcccactacctccccagcccctctcggccccagccgcatcatcccacctgtcccctcccccccacctccagtggggctttctccagatgtcttatggttgggggtttcctgatgggccaggagaggagggcatcttcttgcgacagcactgtctgggttaagtgcccagtgagggcatggtgtggggagctggcctcagaggagccgctggtgggcaagcgtgaagtgggctgaggggctctgagccactttgctcccatctaggggactgccccccatggaactcctttgaagtcacagcagccttcctttctgtttgctcttggggctgagaggtggctcaaacactcggggtccctatggctctgggtcaatctaggccaggctgcaccccatggacagggagtctcagggctcctgatcatgcccaggccctggcctggggcctccctccttggcagctttcccacccccacgcccctggcatcctcagttgctatgggatgcccctccagggcaccagctcagggctaagcgaaggaagataggagcagctcagagctgccaggctctgccttcctcacagacctggtggggcaggtcctgttcacagcagcaggagtgaaggcctggccatcggtggagagggcagctgtcagagggctgggggccagggcacaggattgaagagtttcacatatcatcacagcatacactgggaatttggtgggggcagaagaacccagggccactccctcaatatgaagggaaaccaagctgaatgtgaccaccggcacactgctgccatg

SEQ ID NO: 13123 - DNA, 2426 bp, Homo sapiens
ggacaaggccttgaaggaacgcagccttagacatcaggtgaggatgatggaggtagacagtcgactgaatgtcagctggaaaatccagtcactagttggggtttggtggccatgttttctacccagacaggccctgcttttctaggatgtggccttagagcaagaacagacccaacagccagcccttcatcctccagcgtctgccataggaatgtgagaggggtgtttgctgagcgctccgggcacggccagagggcaagtgagcatgcacggacctcttccccctgtcctgtttctcacccagcacctggggagatcggtgctaccaaggaagagagcacacagataagacagaggggaggaggtgggcatttcctacattcctccttgtttgccgctgctgagattgcagtatttattgcaatgtaaatgtatcctgaaggtggggaggaatgtttaatctaccatgtccgtgtgtcatcttggtttgtgtttttccctgtttgtagcaagactctgatgataattctgtttctcatctgcccattcagtattttgttttccttccgtcaagttgtcttattttttcaatgactacctctccatcattgaggttctggtgaagctctctgcagctgtctcattccttcccaacgatagtaacaggaaatgactctttagcatcgatacctcaacatcaatttagggtagagattcctgcccctcttttgtcacagattaggaaattgagaactagggttaaccttgactatatttagaggtctttttgcctcttttccccttaacaaggatttcttatggtggtttcagtttcatttgcataaaggtattgagagggaacaaaaaacataaagctgagaatcttgagagagctcatctaccctgtctgttggtcagactcaaatgagagttaaaaaaaaaaaaaaaaatctgtatgcctgagtaccatcctggatgaatctagaaggtatggggtagagcttgacagggttcctgtgtacccactgggtatccgttagaggtaagggagaggagaggattgatagagtgttgcaaaagtatagattattcattgagataaaggatttggtttccctgccatgagtattaaaaaaatttaagttttcccaagcttgcatctctgaccaaatttcacataaaacattggaaggaggctgggtgcggtggctcatgcttgtaatcccagcactgggaagctaaggcgggtggatcacttgaggtcaggagttcgagaccagcctggccaacatggtgaaaccccgtctccacgaaaaagataaaaataagctgggcgtggtggcaggcgcctataatcccagctactcgggaggctgaggcaggagaataacttaaacccgggaggcggaggttacagtgagctgagatcgtgccactgcactccagcctgggtgacagagtgagaccctatttcaaaaaaataaaaattggaagaagagcttaaaaaagataagattttaaagagtcccaagttatttaagttgagtgtaattgtcatttaaggaaggcaaatgagtttatcatccttcttaaagagcatctcttttaactgttggacaaaaccataactttgtcattttacaaggaagaacctcttaagaagtcctcagaaccagaagcaatgtgaactctcagcgctggtcctggtgggtttgctgaccatgactgggcaagccgttctttttgctgccatcttcctcatcataaagtgtggaacataggcaattgctttgagattcttggatagaagaggacaacattctgcacctgcccccttttttaaatctttggggaaagatgagtaactttccccactactctgccttcctgttcagtaactcttacttttgcctgaagtaacagcatcttctacttctccatctagagatttttgtgtgtgtgccatcaaggttagcaaactttatacgtagcctaacacttaaaaaatgcactcattatcttaaacctaataaattccagagtttattttggttctcctctgttgcccttcctaaaaaatgagctgaagatgacagtatttttctttacatgcttggttatgacttttaaagttttatttaaataaatgttgaagctcaagtttaaagaagcgttgcagaggcccacggtctcctgggtcccggccacctgtccatattccacatttgctgactgtgctccctgcactccactcaagttgagagttcaaatagtcttgaaggggaatcagcttcaggatggaaggacccaggagaggccccgaggtgggagggttctgtaaatacagactactgcgagtgtccagagctctctgccatgatacttccttgggactgacttggctgagaacgtgttctgtcagagga

SEQ ID NO: 13124 - DNA, 1266 bp, Homo sapiens
ggttcgggagtctggaactccatggctgaggatactaacaaggatgggaaactggcgagggtctcactgtgcacctgcctagtgctcagtggtgctaccctagcttgtcggcacagcagccctgccatggtgcggtcgtctcctcattttatagacagggtagctgtgggcacctgccaggctgagttgtgtgccaaggtggattggtgtcgggacctgaatacaggtctcagcttccactgcccgtgatttgaaacccacactatggattcagggtgactgtagttaatattttgggcctctaaagttctgggtgattctaagatagtctgaaattcctggattctagtatttcctgaacgaatttgttgcttgttcttctagcagtgtgtggttattgacaaaaggataaacaaagttgcctccctgtatgaaaacacacatgtgcacacacacacatacacatgcacacacacacatgaggcgaccagggcaggcctcaggtcttcctccaccagggctctgagctctgaagatacaggacatcctgacactgcactcccagggctctagagtgctggctggaagattctgggaggcagatttccccactgccttgggaagacttgggcaacttgcttgggcatcttggctggaccagcagctgtattgccactgtctgatgcctcagcttggggaggcctggttccagggcaccattcccatcccaggttggtgcctggaatggttcagtgcttgggctcgggagtaagcagaccagaactgggacactaactgcccggtaccagctggctgactatggtcatggctgttcccctgtctccctctccatgaagtaagaatgagaatggtctgtatgccatggagttgtggtaaaaatggacacagatgatgcatagggaacctgttggccattgcttgatggggtcatggtggtgatagtggtgatgatggtgatggtgctggtgatgatggaagtgatggtgttagtgatggcgatggtggtgatgatgatggtgttggtggtggtggtgatgatgttggtgttagtgatggcgatggtggtgatgatgatggtgttggtggtggtggtgatgatgttggtgttggtgatggtgatggtgatgatgatgctgttggtggtggtggtgatgatgttggcgttagtgatggtggtggtgatggtgttgatggtcattgtggtggtaagggtaatggtgatagtgatgatggtggtgatggtga

SEQ ID NO: 13125 - DNA, 1069 bp, Homo sapiens
cataagcttaaagggaaaaaaactaaaaactttaaaaaaaaaagaccaaaaagtgcgtatatatatacatataaatatatattttagatgaagactaactctgggagcatttaacagtgttttttgtttctgtttttaacatttgttttcctgctttaaaatttgcaagcattctcaggaattctagggtaggaagccagttttttgaagatggtttatttaaccatatcttatcctagagagatggctgtttctttcctgttaataaacttttacaagttcctgaaacttcagaaagtttaaacaatttttacttaaaaaaatgtaaaaagaaaagtctccaaacattattgtcatactggggatcacacattttaaaacacatagaaatattttttaaaaattatcaatttagcagcaacaggtaaattcattatcttaaaaatatgggagaaggattaagctttgtaagagctcgatcatggattcttttgaaattgtgtgtagtttaatgggagagtgtttggtgtatatagatgagaatgccatcactttgttcctttccatttgagactgaactgaaatctcccctagtaatttttatttttttaaaggaacccttctccttgtccccacaaccccagcaacaaaagaaaggaaggaaggaagaaacaacagcttaaaaaaaaaagtaatctgtaaaatagtacagttggattgctgagaatctatgtaaagagttaggaaatataggttaataatttttggaacaaattttaaatataggcattactagaggaaaattatctatggactgtcctattaatgaagaatgtctgtcttacctccgtttgttttgggaggaggagaaaatatagaagaatctaataaggaacaagtgattttacttttttagctcccagctactgttgtgctcgttttaattgctgttttgaagatctgctgcttaattatccccatcccttagccggagatgtggagtgtttcctttcagtttttggtgatgttgaattcttttgtattccctcctggggccaggggtcagaat

SEQ ID NO: 13126 - DNA, 1358 bp, Homo sapiens
ccaatatcaacaagttgggatggtttttgtttttttcttttttttcaaaaagggaaattcctctttactgctcacagtaagctgcaaaagaaagttgtcaaggtggcttatgatgctgttgtagcagagctgtgaaaggaagtgctttgctttctctcccgccttccggaatctggcgttccttccccttcggctactgaaaggtgtgtacaactcccagaggggtggctgtaaaagttgactggaggcaaagtggagtggccttattgccaggactagccctacagaagagctttacagagaggaggacagtacatcctatgtgtgttcgccaaaaatgggaaaggtgggtatttaggcaaaacaaaataaaaacctttggaaccctttaagaagttacataccttttaaaggtagtatagtttctcaccaagtgatgcattttagcatgacacttcttgccagaaattttgggataagttggaataaatgtgtttaaaacatcatccaccgccctttttaaattttgtctaaggaattacttaagtatagtatttctgaatgtgcctttgtgagtacagagaccgtccgttctaggaagaagctatccgttggatacaaacaaacagacggtcagctttagtcattagggaagtcaaagttcctcctggaagtcccaggagcagctgttgagatttcattagcatcaatattgcacagtgtagagttgagtggaagagattctgggacttgggagaggagacaggggaaggtacccaggcgacgcagacccacgttagtccaagagcgcaggtttacacatctgcattccctagttttctccgtctgtatgtttgtgctcatgtggctttggctgttttgttttttgtttttctgtaagcactggagaattggaatatggtgatacttgtgacacattcatgcatgtaaacaaggcattttccagcttctgccgtgtgcagagcgggcagcacgcttttaccctttgagtctgtgtcctgaggcggccattacattcccacatgggcgtcacatcacgttgctgttgatgcaaacagggtattacacacaaggaaaaggggttttgaagagttaagattgaagtgtttgagaaagaaaagagaaaaatctgaaatcatattttatttcttcagagctattatagttgaacacagaaatctgcagtgtctttatttgtttttatgttttaaacaatttcacctcttctccccactcctatcttctaaagaaatatcaagcaaatgctaagggccatttccatgattcctcagagctcccccaaagaggagaacagtccctcccactcgattccttca

SEQ ID NO: 13127 - DNA, 2213 bp, Homo sapiens
atacctggagctctcaacctttcttggttcagacacacacatacacaccccttgagtaactcagtatcattttgtagttcacagaaggatgtagtccctggcattttggtttgcactgtagaatccatagccttgtcactttgttatgctctggaaatgtactgatttcttacttgggaggaaacttgtgtaaggagatgtgcaaaccaccctgaaagccatgtgcatcctcacctcttccattaccccctccatgagctcgaagcgacattaagtagagggaaatgcttttaacaaatgctgctcatgtggatctgtcagctattgcttgcctagatttgggcacccatgaagcagggttggaatggatcattttgaattgcttctttgcagacacccccttcgcccccatctttaagataaaccctttactagtcaagaagcccttttcagttggatctcactgatcttgtatagtgacgacttcctttgaaggaagaagcttgattataagtgcatgcatattatccacccaccttctgatttgggcactgttcaccttggaattttatttattttgtttatctggaggccctttttctatcagtctctgatccctcatgggttctgcctgcccttgtatctcttgtacaatgctcccaaagggctttgctgatctctgcacttctttcctgggacactccccccaccaccaccctttgcacacaccagtgaccaaagtgtatgcagtgatctcacagaagacatcaaaaatggtgcatgcaccgtgaatgtgctcacagagacacgtgcacaagattctgcacccttggccttaatctcagtatgacttaaggtgcaggaacatttttaacaggttttaaaaaaacaaaaaacccttctgggaggaaaaaaataaaaagcagatacaacagctcaactgttcccactcctaactctccactatgtgcttataacttcacattctatgccctccccgccacccacctcatccctgttctgcgtaaccaaaaaacagacaacaaaagcaacctgaggagaggtttctggactattttatctgtctccatttagatggagatataaatgctgctttgggttccataatcctagggggctatgtttacatagtaaaatacatcctaccaaatcaggaaacagtgaataatgggagtcacttcacagagacgcaggaggacctggggggcgtagcagaggaggataggtagagaagtaccattttaattatttgtgacttgtggcttccttcctcctctcctcctccctccacgtctctctttgccccctttagacagaaggtgcagaaaagggcatcaaaaagaggctggattttttaaaaggcagctttccaactttgcacacaaacaggtaacaggaaggtacagcaaaaatcctctcatctgaaacactgtcagcagaaacaaaacctgtaaaaatgactaatcagctgcacatattgatgctctctgcaagttacctttaagtgttttttttttcttatacttgaagttgcttttacgatattattttggtggctttcttttctctctttgatgggcaatagaggaagtagataatgggatttaaggacgcctgggggagaaaagggaggatgtggcattgtctttttttttttttttttttttttttttagcatagaggtttaatcaaactcccatatgttgaaattgctcctcatattactggttttacatggacacagaaactaggcactttagaggtgcacttgcatggcaggctgggcccccttttctatattttattttcctttttagtatagtggtacttaaaatcactggttcacttaaaaaaacaaacaataaaatgttaaactctactaatgtacaaataagctgaaaagttgcattttatgtgtattttttgccatagcaggtactgtatttctcatgctggatttcaaaaaaaaaaaaaaaagtatcaaaaacaaaaaaaactaaagggtggtgttttattggattgtgacaggttgagtaataaggaattaagtcgtcgtcatttcattaaaactgagagatgatgtaatgcatatataagagttttctgaagggttttttttgggcttttaaacagcttatttttgtttttgtttagtttttttattttattttattttggaaagatatgattgt

SEQ ID NO: 13128 - DNA, 1237 bp, Homo sapiens
gaataatgggactctacaaaggccttgaagccaaactgctgcagacagtcctcactgctgctctcatgttccttgtttatgagaaactgacagctgccaccttcacagttatggggctgaagcgtgcacaccaacactgagacgccttcccatgaaaaattccgaagatgctcaagagggaggtttcctcctgagtgaagagaagtgattctcccttgactctggctcctgccaccacaaatgttaccctcattggcttgaaaagcatccaagggtgcacagggagtatggccaactggacctgttgtcaccttaattgtcatgctggctggttggattttggggtggcagttggactaatgtgaaaaaaacattgctgaaaacctaaaaatgaaagtttgtgagtgtttattggttttcttaagagaaatggactattttgctctcatgtgtaatgttttctatttaaatctttcttaaatataccagctgttctctttccctgaactctcccccaggttctaggacaaatttaataacatgtaattctcctcaaatacttttgtatgtctcagtgttggtgttttcctccctaaaactaacattagggctgtgccacgggcatgactttatttttgttgggcttttttttccctgcttaaggagaggtgtcttttttggatatgagctatttattttgtgaaatgaaaattgttcacccaaatgattctcttataaactatttgtaaatgtcacttattcattagtgtttgacataatttttagaatatttattttgaatcaatcctttcattacgaaagacttgaagttttgtgtccattcttacaagccctggtcagtcaagtcccaataaatggtcagcacaaaaaagatattcttgaaaattgctctttattaaggtattacgttgagtttgcaaccagatgggaaaaatcacaaaaatgagaaggggagcagatatcttgttgaggtctggatattatctccctttataaacttggtgtaggccgtatattttgaaaataaacatctggttgaggttatttcatttggaaaccttccttagagtcctgttgctcagtgtggtccatcagacggtagtactgccacaagctgagagcttgctgggcacgcaacccagagtttctgaatcctgttccgtattttaacattcccaggtgattcacagccacattaaagttcaggagaccatag

SEQ ID NO: 13129 - DNA, 2198 bp, Homo sapiens
actaggaattacaaactttaaacactttttaaatcttcaaaatatttaaaacaaatttaaagggcctgttaattcttatatttttctttactaatcattttggatttttttctttgaattattggcagggaatatacttatgtatggaagattactgctctgagtgaaataaaagttattagtgcgaggcaaacataactcatttgaggataaagtttgtgttggatatgtggttcctgatgcattttgacttgtctttttaaatgctttatctttttctttaaagatttatttcaataaaactaattgggaccacccgtatttcagtaggacctgggtagggattggaagtacttggcagggcagcagcaatcttgctgtgtttgatataacatgcatccttgggcaggttgcccttaaatcttacactgtggtgaagggatgttttttttgtaatgctgcagtagagttggagtacttagttctcttgttgtccagtatatctaataagtgtttttcatattatttccacgtaagggaaataaggtagtacttttctttttatatttctatgcttaaaattctctttcctagtcaaaaattgcccaaatctgtgtttgctttctgcttgctacatttgtctcccttacttttcttgagctaaagacaggctttttccaccggcatcatcactgctatcatcattaacagcgtaattatacaagcatatttaatgctgagtttaatttaatatgtaatacatatggtaattgtagggtaatacccacaacaactgtagtttcttacttggccaagagaatgcttatttaagtgttagacttccattctggcaaaatcttgccttatcagaagacattggaaagagggattccctttggtgtttggtcttctacttagaaaaacctattgcagttagtttatcttgtagtattcatctttgtattctgaagataaggtttgaattaaattgatacacacagaggggaaccgattttttttatccaatgtgaattataaatgagataatccacagttattcattgtggagttgttgagactatgaaagactcattgtctttgtattcagctcttaaatagtgtaactatatccccacctctgcttgctttctttccctcccctccaatgataaagaaaatgataaattttctgttgtgcattcaattcttattttaaataagactaagtataggcattgtacctgacattgctacgtttctaccagtgtttcaatttaaagtgctagtgtttaaaaacattttcaagggataaggccttctgtactttgcttatttgaagaatcagtggtaggagcagtgaagtaaattctatggagtacatttctaaaataccacatttctgaaatcataaataagtttattcaggttctaaccctttgctgtacacaagcagacagaaatgcatctgttacataaatgagaaaaagctattatgctgatggagcatgctttttaaatcctttaaaaacactcaccatataaacttgcatttgagcttgtgtgttcttttgttaatgtgtagagttctcctttctcgaaattgccagtgtgtacttggcttaactcaagaacagtttcttctggattccttatttgatttatttaacctaattatattctaatattgcaaatattaccataagtgggtaaaagtaaaattcctcttctgaaaatgtgtcctgtgcttttagatttttaaattccataatatacattcttaattttcaactcaatattctaaaccagaaatgttttcttgtactgatgctatcagaaggaagttttttctgcttaaaaatatagttatatttctagctgtctttaaaatacggtttcaaactagatattgggcaggtgcggtggctcacgcctgtaataccaacacttttgggaggccgaggcgggcagatcgtctgaggtgaggagttcaagaccagcctggccaacatggcgaaatcccgtctctactaaaaatacaaaaactagccaggcatggtgttgggcacctgtaattccagctactcgggaggctgagtcaggagaatcacttgaacctgggaggcagaggttgcagtgagctgagatcacgaaacacagtctcaaaaaacaaaaactagtttttaatttccccccccacc

SEQ ID NO: 13130 - DNA, 1197 bp, Homo sapiens
aatgtattttattctctgaggaaataacatccagagcatttatttgatactagtgtctggtatacatatttacatttttccctcttaatccctatagcaatttgataatattaaatatttcttcctctcccattttatggatacagaaacttaaatatactgtggcatatacttggggtatgagttcccagtctctgccttcccacggcagacatccgtaataatactcttcctactgaattcagctgtccgtctgaaacctaaacactgtgtatctgatagaaactagcaggcaagaattgtcatgcacttagaaacctgtttgttaatctttgagcttaattgtttgagattataacatttctaacttcaaatcccaggcccctttactctgttttacagtgcctcatgcagttgaggttggttttcttaaaggcttagcttgtgttaggtctttttgtacaagacaaatctgtcatttttctgaactgcatgttgaattaaacatctctctacaaagaatatttgtgttgatgttattcagcttttggagcaagcttattttgctatggctcttttttctaggcacagaaaattgcagaacatcggagaaagtatgagcgaaaacgtgaagagcgagagatcaaagaaagaatagaacgagttaagaaggctcgagaagagcatgagagagcccagagggtaaatttcctatagctaagccatgaaaggaaaatacggcaaattatgtagaggcattaggacactaaaattttaattcctggctcttttatttaatgctggctacagttctatagagtaatgatattacttatggggagtctcctttcactgtatctaatttgggggacatttttagtcttaaattattcagtgagcttttatttcaccattttatattcttgtttgtgtttttataaaatcagttgtttttccaggtcaagtaattgaaatgtgacagtattattgtttgatcttttgaggatgcttcgccagattaattaaatttatgattcctcctctcttccaacagtggatgtgttgctatttaaaaatgattctagcagggcaaggtggcaagtgcctatagtcccagctcttgggaggctgtggtgggaggttcacttgagcccaggagttcgagactagcctgggcaacatagtgtgatgctacaa

SEQ ID NO: 13131 - DNA, 1288 bp, Homo sapiens
caccacctgggttcaggcaattctcctgcctcagcctcccaagtaactgggactacaggtgcacgctgccatgcccagctaattttttgtattttagtagagacagggtttcaccctgttgcccaggccggtctcaaactcctgagctccggcaatccgcccacctcagcctcccaaagtgctaggattacaggcatgagccactgcgcccggtgtaagagtcatatttttttaaacacaaacattggatacaattatacagcaactcagtttgcaagatgaacagggctagattaccacagatagcttatttaggagcgtctgtgatagagggaagctttaagaaccagtgtgttcacctcctttaaacctggatatgaggtcaagatgtataaaacatgccaattgttagaacacaaatttgagggtttcttaaaaaaacaatttgtattagggaagcacaagctaggggattaacaatctctgtaatgctggaagtttgcctatcttatcagggaaacccagggtacagagtgaaaagcagacaggcagtgacttcctcaagagacagataatgtgaaaacaaaagtgatacaaatcatatcctgacagtgctagcctaggaatgcctggctttgcgcaccttatctaagcagctctcagaatggaggctgcacagctggagtctccatcccccatacccaccttcccacctccctccaatttctcaatccagagctttttaaaaaaaggggagggaaataactccacagctctggctgctcacttcccaggctctgtgcccccaacagccctttccttggattgtgtttcctttgttcatttgtaatccaggaataaggaatttccttttcttcttgtatcattttcttttcttttctttttttttttttttttgagacggagtctcacactgtcaccggggctggtgtgcaatagcgagacctcagctccctgcaacctccatctcccaggttcaagcgattctcctgcctcagcctcccgaatagctaggaatacaggcgcctgccaccacacccggctatttttttgtattttaaatagagacgaggtttcactgtgttggccaggctggtctcgaactcctgacctcatgatctgcccgcctcggcctccctaagtgctgcgattacagacgtgagccaccgcacctcctgtatcattttctatggtctaaacttttctagctaaaagcctaggtagcttgtatgtatagcagcatacttggacatgaaacacacttctg

SEQ ID NO: 13132 - DNA, 1262 bp, Homo sapiens
aggctaatctccgtttgcaaccaatttatcatgtttcatatcagtatttctacctgcttagtgaataatagggttagaaagattttggttaaaggatataaaatttcagttagacagcagcacacagtacaagagatctattgtaaaacatgtaactatagttaataacaatatgttgtatacttgaaaattgtgaagagtagattttaaatgttcttttcacaaaaaagatgtgtgtgagttaatggatatgttaattagcttaacgagcttgatttagccattccacaatgtatgcatatatcaaaacatgggcccggctcagtggctcatgcttgtaatcccagcactttgcggggccgaggcagaaggatcacttgagcccaggagtttgaaatcagcctgggcaaccaagtaagaccctgtaactataaaaaatttaaaaattgctctttctcagtgaccgggttctaggcttaggcgcagacgggttaggggagccaacatgccagtggcccggagctgggtttgtcgcaaaacttacgtgaccccgcggagatcctttgagaaatctcgtctcgaccaagagctgaagctgatcgaagagtatgggctccggaataaacgtgaggtctggagggtcaaatttaccctggccaagatccgcaaggccgcccgggaactgctgacgcttgatcagaaggacccacggcgtctgttcgaaggcaatgccctgctgtggcggctggtctgcattggggtgctggatgagggcaagatgaagctggattacatcctgggcctgaagatagaggatttcttagagagacgcctacagacccaggtcttcaagctgggcttggccaagtccatccaccacgctcgcgtgctgatccgccagcgccatttcagggtccgcaagcaggtggtgaacatcccgtccttcattgtccgcctggattcccagaagcacatcgacttctctctgtgctctccctatgggggtggccgcccgggccgcgtgaagaggaagaatgccaagaagggccagggtggggctggggctggagaccacaaggaggaggattaagcccacctgtccctcctgggctgctgcattgtctagttttcctgccaaataaacaggatcagcgctttaaaaaaaaaaaaatttttttttttttttttttttttgagacggagtcttgctctgtcgcccaggctggagtgcagtggcgcgatctcggctcactgcaagctcc

SEQ ID NO: 13133 - DNA, 1287 bp, Homo sapiens
tgcaacaaggaaatatgggacagataggccagcttccccaggccttgggagcagaggcaggtgccagtctacaggcctatcagcagcgactccttcagcaacagatggggtcccctgttcagcccaaccccatgagcccccagcagcatatgctcccaaatcaggcccagtccccacacctacaaggccagcagatccctaattctctctccaatcaagtgcgctctccccagcctgtcccttctccacggccacagtcccagcccccccactccagtccttccccaaggatgcagcctcagccttctccacaccacgtttccccacagacaagttccccacatcctggactggtagctgcccaggccaaccccatggaacaagggcattttgccagcccggaccagaattcaatgctttctcagcttgctagcaatccaggcatggcaaacctccatggtgcaagcgccacggacctgggactcagcaccgataactcagacttgaattcaaacctctcacagagtacactagacatacactagagacaccttgtagtattttgggagcaaaaaaattattttctcttaacaagactttttgtactgaaaacaatttttttgaatctttcgtagcctaaaagacaattttccttggaacacataagaactgtgcagtagccgtttgtggtttaaagcaaacatgcaagatgaacctgagggatgatagaatacaaagaatatatttttgttatggctggttaccaccagcctttcttcccctttgtgtgtgtggttcaagtgtgcactgggaggaggctgaggcctgtgaagccaaacaatatgctcctgccttgcacctccaataggttttattattttttttaaattaatgaacatatgtaatattaatagttattatttactggtgcagatggttgacatttttccctattttcctcactttatggaagagttaaaacatttctaaaccagaggacaaaaggggttaatgttactttaaaattacattctatatatatataaatatatataaatatatattaaaataccagttttttttctctgggtgcaaagatgttcattcttttaaaaaatgtttaaaaaaaaaaaaaaactgcctttcttcccctcaagtcaacttttgtgctccagaaaattttctattctgtaagtctgagcgtaaaacttcaagtattaaaataatttgtacatgtagagagaaaaatgactttttcaaaaatatacaggggcagctgccaaattg

SEQ ID NO: 13134 - DNA, 1528 bp, Homo sapiens
aaaaaaaagaaaaagaaaaagaaaaaaagcaaccaaaaaaacaatggctagccatttacttatgatccagattggactctagtgggccagtcctatgtggccactggcagccagtaaggattccctggcctatgtctgctggaagggcccttggagagcctggctgagggggccttcattctggccagctctgggctgtgtggcgttgggtgcctggctctctgagcctctcgcacctcccatccccacccacggtgtgcagaaggcagagggctaatgtctctcttgctgagtcgttgtgcaaattaacaaaaatgagtctggcaccaaaatggcccccacacttggaaaacaggccaagaggcatccaccgacctgctgacccctctttccccgcaggcccaacagcgccctggaatcctgctccttcgcccgccacagtctgctgcagacgctgtacaaggtctagactcaaagcctctcccatcccttggcctggaccagtgagctggggagggactcggatgaactgaggcgcagcctacgccattgccttggacaggactctggccacaggcagggcgggtctgtgtcccatgtgtcctgtcagtcccctgagtatgtgtgtgggtgtggcgcatgtgcaggtctgtgcctcctgtcgggatttgggttttaacgtcttctgctggcccagccctgctctgttgtggggagttggcccccaggggaaagggctgtgagctgctccgccattaaactcacctccacctgagggcgctctgctgatctccgcctgggccctgatggccgtccccacccacctgccttccggcccggctccctggcggagccagaacccagggagttgcccgcgtgctgtccttcccctctgtgttgtgattgggttgtttcctgccctgcctggggctgcttctcgtcaccaagccctggtcctgcggcagctgtcacccctaccatccataccactgtgctgaccgctcagcctgaagagcagagaatgccatgggtgggactgtgggggtcggatcgtggggttgttggcagagggcaaccctgggccccacaccgtgtggacaggcagacaccagattgtccaggagcaggagctgctgggactgcgctggccccggacctagtgggccttctcctggctgctgagatgtcgtctgtgactggcctggctggagggggagtgttgacaacccaaagctgttctccagtctggggagggagaggcagggtccccaatgtccgagctgcatctggacgctgctcttaaaggacctcctggggcaggggagcggtagggtctggactgggcagatgctgtatgacctccctgagcacccgtgactgccccatgctttcccctttgtgctctgtgtgtgtctgggctgtgcccgggggcttcacaaataaagtcgtgtggcagcttcagagactcagaaactctcactgaaagcgggatagtctcgggggccgttgtacgtggagtcccacctcg

SEQ ID NO: 13135 - DNA, 1173 bp, Homo sapiens
gaccttgcggcaggtggaggtgattaattttggggactgcctggtgcgctccaagggtgcagttgccattgcagatgccatccgcggcggcctgcccaagctaaaggtgccagcctggacgcctgacgtcctccctctggggtctgtgggtggtggggcggctgggggcacaggggtctggtctgaaggcaggtgggcctgtgtccatatcccagctcctccacttcgggccctgtgatgctgtgtgagcctccacacccctctgagccatggtttcttcatttctaaagcgggaggcagggagtggtgtacatcactgtcttgtgatttaagtaaacacagtacgtgactcatcgttggctgcagggcattatttttgttgttggtgttattcttcctgcccactttgccccacctggaggacagagcctgccatatcctcacttggggaaactgaggcttagagtagaacctggtgtcctggcccgggtttctgcctgcctccaacccttcctcttattttcaggagctgaacttgtcattctgtgaaatcaagagggatgctgccctggctgttgctgaggccatggcagacaaagctgagctggagaagctggacctgaatggtagtcggatgggggaggcctctgcacaggtctgctaggctggccctggcaccccggctgactgctcttccctccccttgagcaggcaacaccctgggagaagaaggctgtgaacagcttcaggaggtgctggagggcttcaacatggccaaggtgctggcgtccctcaggtagggaactcggggtggccccagaggtcggggtcaggccattcctttctttctttcttttgttcttgagatggagtcttgctctgttccccaggctaaagtacagtggcgtgatctcggctcactgcagcttccacctcctgggttcaagtgattcccctgcctcagcctcccaagtagctgggattacaggcacccaccaccacacctggcccctttatttgtttctacttgtatttattcagaaacgttgggtgcactcctgttacgtactaggtcatacactaggcatcagggctataaggatgggacagtcagggcttctgtctcgtggggtggagacagaatgagttgtccgttcaacagaggagctcgta

SEQ ID NO: 13136 - DNA, 1264 bp, Homo sapiens
tccgccgcggtgcggagagcaggtggtgctggaagcgcgtgaggccgggagctcgagagagctaacagactagccggctggacatctggaccgctggatccggaggtggcgaccccggcctgacccggaccctaaatccgtccccgccccagagggcggaggcgcgcgctcgattccccccacgcggcggcgccgcctgtttacggtagagtcagggtccctttcctttccccgtcacctgcctggaacaggggtgcggggcgaggagggcgtggcgcccgtgtgcgccttctgcctgccccctcggccttcttcacttagccttcgacggccgagcgccccaggggtggcggtgggagtggggttgttgagcggcgctggctcctttcacaaatggggaaactgaggcttaaagggcgtctgactcgccagagcagctcagcctgcagctgctagcagtggcgtctcatattagcattgttgtcaaccggaggcggtgcgagtccgccggggattccagatggggctcctgcgccgcccgcctatcatttgcggcctgtattcgcgcgtcgctcccgcagagccacctcccagcaggcccacgcccgcgggggccccgggctggcgccgctgtccctggaatcgatgtgagtcactgctgacgctttgcaggagcatgcatctcacctcagaaagtctctgacgttgctgcggagcggggagaggatgtttctctattagccctttgcttttgctctggcgctgatcctttgctgaccttggacaaatcaatttacgtttctgtgctccagtttcttggtttataaagtgagtgtggaggggtgcatctctgtctcgctctctcttggactgaggaatgggcccccgttcagctgagaagttctgtccctattctatctggaggcttcaccaccaccttttaccctcaaattgtcccatctcagaactgcaagagatgctggggtttcaggttaatttttttgttggtttttctttaaatttttttatctttttagagacggtctccttctgtcacccaggctggagtgtagtggaacgatcaccgctgaactgcagcgtcggcttcctgggctcaagcgatcctcccacctcaacctcccaagtcatggggactacagatgccatcacacctggctaatttttaaatttttctgtggagacagggtctcattctgttgcccaggcttgtctcgaaccctggtctaaagtgatcttcccgcct

SEQ ID NO: 13137 - DNA, 1257 bp, Homo sapiens
gttgccaaacagatgtcaccagaaggagtgccatgcagaagggcaggaacagtgagcctggcaggctggggtgatggcatgggcaggagggctgagaaggtgactttgtcctgcgtggcctgggagccatgggcaggatctagcagggagaatcaccgctttccctagagatgttcatctggtacctctctttccctcaaagactttatgtacttaccatgaggatagcagctctgtgatccagcgtggcggccttggtttggcagccaatctatggtgggcagacactccggagactgaagtgcacacatttgccatgtgctctatggcaggctcaggtgtgggaaggaggtgcagggtgttggtgcaggtatggatgggggagtgtacagttccaggggacagagtcaggacaggctcttgggtcagacagccctgctctgatctgtgcatagcagctttctgggctgacatttccatgccgtgggatgatacctcgcagggcgcctggaccgagggctaaaccccacagtgggtgtgagatgctggcctgggctggcgtgaggcaggatgctggatgagtctagctgctggtcctgtggctgctggtcctgggaaaggaaggctagtggtggagtctggtcctccatccggctctccgtggggacacagaaagggtggggccacccagggcctcaccagggaagcaggacttgagctggactgtgaaggactcagagaaaaaggggagggtgttcaggacagggaaggatgcaccacagcctggaggttggagtgtgggaactgttgaacgaaacagcagctctcccagcccaacttccagaaactgtgcatctaatcaacacaggccgggcacggtggctcacgccagtaatcccagcacattgggaggccaaggcgggtggatcatttgaagtcaggagtttgagatcaacctggctaacatggtgaaaccccatctctactaaaaaattcaaaaattagctgggcgcggtggctcacacctataatcccagcactctgggaggccgaggcgggtggatcacgaggtcaggatatcgagaccatcctggctaacacggtgaaaccccatctctactaaaaatacaaaaaattagccaggcgtggtggcgggtgcctgtagtcccagctagtctggaggctgaggcaggagaatggcatgaacccaggaggcggagcttacagtgagctgagatcgtgccactgcactccagc

SEQ ID NO: 13138 - DNA, 1099 bp, Homo sapiens
gcagcccccagccccctgaggccctgtccatcttctccccaccaccgccccggtgtgcgtacccaggcgcacgtgctgcagcccccggaggccccgctgaaacctgggctgcccttcccccacccccacggctctcctggttgaggagggaggggcctggctgacccctccagcttcagcctccagctttaacttctgtctgctcctaatgggggcccaaagctcagggctggggagcctggggtccccacttgaatctccagcaggagggtccttctctccctggcccgtcctcctcccaccccctccccctgggggcaaatcaggacacaacagagggcagaggccccattagctttaaaatgtagccccaggttggagctgggaacactgtactggccacttaccctctggggcctcagctttccctccggaaggctgggaggaggtgggctagatgatctttggagcttaaggagtcccagccctttctctgatgccaccacctgaaccctgctccctcgtgggccagtgaaaatagactgtaggtcctcagagccttcagagatgatccagcccaaaccccattttgcagagaggaaaactgaggcctagaagggaggagtggtccacccacggtcccagcacaaggcagagctgggatgaaaacagggctgaaaagactcagggccaattattggctgagcccacggtcccctcagcagggatgcgatggtctctgaatcagtgtgcagctggggtcccaggcagcgctgcctgggggctggggaggggaggcccagaggagggctggccatgtgagcaccccatgaagggaccgccccctcccaaggatggtccctttgggtgcagcagcagaggtcacctcctgacatgcgctctgggaaaggtggcagagggcaggacaccatgagctcaggatctgtgtgaggtgtgggaggtgggaagggtgagggtctgggggaatgcggagaaaagggaggcttgaccccgggcaccatgggccactccaggatgggacacggcccctctttcttggggacccagtatgtcctctcctctagacccagacatacag

SEQ ID NO: 13139 - DNA, 1253 bp, Homo sapiens
ccgtgatgtcgatgatactcgttttccctgatccgtggtgttgcagtccgttgtcaccagccttgtttctagtgtgtatatatgtcgcccccgtgatgcatatatacacaggtattaaatatatcgctctatataatattatatatgtgtgtggtatccaaggaatcacttttatgagggctaaagataaagaatttggccagaaaatgcagccatccttgtgtgattaggagggtttcaggggccactggactatttgcaaggtgacagggactggagccatggctcagaggtgattcgggcagccagggacaggagccaccctccccaggcccaactctgctagcttcccagaccacccccatcgagtgcggagagagtgggagtgctcagggaaagaaggtgatttgtatttgtctccccgctgaaaagaacaggattcaagtccagagttttcatcttcagcctgtgatctgtccagggacccttgggatctggggcttcctggcctggccagagctggagcccccacagggtaaggaagagagagtgggaggcagagtgtgatggggaggagggacaggaagacccttttaatgatgagggtaactatttcagttgtgagccttctagggccccaggctgggaggctcagaggactgaatctgggacctgtgttccccccggcaggcagggacaagatggcatggcaagcatgggggcggggtgggtggggagggatgctgcatttctcagctgggcagtaatcaatttaatggtcctttaaaatgtctgtgtattaaaaatttaagaataccacactttaatattaaatattcataaggtctagtatcttgataataatgtagatgttttaataacaatttttgtccttcttaaaataaaatgaaagaaacttgcttcccttagcctttgttctagaaaataaacttgtgcactttgacctctgtccccgagatgtcactcctgttcctccccacctggtacttatatccaggggccttagctgctctgtcctcatgggacagacctggccggtactagctactctgaggaatgctaagcattccgaggggtgaggggcaggtctgtgtccctgtgtacacacggaggccagccgaccctggctccggcagcatctcactggcagcgacacgctgccacttgccacccttccctggctcatctgcagcttgcctgctctcagccttccacgtggggctgccagcggt

SEQ ID NO: 13140 - DNA, 2637 bp, Homo sapiens
cgagctgcccggagggtgtcagcagggcaagacacctagtctagagtcaccaaggtcacagtgccactttcacgggatagcaggctcttgggacttttacacaggcctagggtcccctcagtcttggtcccaggagatgggggccactcgtgaggctggccatgctgtggcttctcacagctgtggtctcccctgcctcacaacgactcctttctcttgtgtggcgggactcgcccttttgctgtgctcagaagattcactgaggaaactcatggaagcctctgctcatttgggtcactgggacacccctgagatgggtgtgtttatttgctcagggcgggcagcctatggtgaagaggagacagaggcgatgggcgtgcttcgtcctccgtaacactggctttatttaccgtggtggttcagagtcccaggccctgacctctaaagacttttcataacagacgttaagaccaagccgtggacctcaccccaggggaatgccacggccctttggggacctgcacacccacctctccgggggacttgacaaggggccctgaggccaagggaggtcactcctccctccaggcccctgacttttactttgtggttctctaaaaaccatgtacacactttcactctattgtaaccacacagggcaggcgcatccagcatgtcagtgtcctgccccgggcagctctccctcccgggcacgctccctctggcctggtggatcaccaagagggcggttctcattttgttattagtggaagagccttgagcttaaaagctcttcattttctttgccggaaagtatatggtttgtgtttttgcagttttatttttttaaggatggacactaaatctctggtgtccatgttccgagcccggtggctgggatggtggctcgatgtgtctcctctttatcccgccctctgcctgtttggtgccctcccttctttcccccaggcagtgggtatcgggttctttcccaaagtgcttacttggaaagagtgtggctgctggactcttttcgaaatgcccctctgagtcaggagcctggtggggacaagatggaggatgtccacagaggctgacctgtgggggaaaagaagtgctcaggtaaggttgtctcctctcctgtcctaaaaaaatccatgcttgcaggagagggttggtgcctgctcagtttctgtcgagggaatgggagtctcctcggctccctcctgggccctctgcttcttggaggccgaccgctggagactgcggctcctgtgcttggatctttgacatctgtcagtcactggaggctagagaagttgactttaccttggctttctgtgggttcccgatgggcttggaagtgccgtctacttcctaagcatcctgtctaaagctttgtggcaccctcagtgcaacctcagaacagacaaatcatgaatgagctggaactttgcaagaatattcatattataaatgtctcatctgatggaggaacgtgtgcatttagagagagggagagttttcaaggtttatggcaactttgtggaggacctgggtaactcttacccttggccaaaggaagaggttttcctgtctggcttctgaggttggagggggcacttagcagtgaaccttaagtctgggtacatgtaaccctgctgaggggctgtgcaggccgctcctacggtcctttggcctgaggcagggcgggaggcatgcaagccagtgggggaaaacccctctgaagctgggcagccctctacctgggccccgggagccgtgctccttggaacgcaaagggccgaggagcatctggttttcatggcaaagctctactccagagctcctttaacatctgctaattaagtgcaataaatttttctagaaaatggcaaagatgacttccaggtggatattgctctcttacggtgttggggatgccagaacaccacttggttttatttttctaagtgcatgtgatgtgatagagtgtgtggggctctgtgtccttccctgggagctggcattccagcgggcccctctctttacctttgttgggggaaggaggcaagagagaaattccttcttcccagccagagagggcagaagcagaccgtagcccattggccttatgtgcgtgtgtgcgtgcgagtgtgtcactgctggtgggccggagtgatgtggtgggagggaagccgggaatgtatccttttcagacaaaattaaatattttgaaatgagaatgttgggattgtcttttctgtccttctccccacccccaaccctgagtttcctctcttgagtgttggcctaggagctggagagtcaagctggaaaacttttatctcattagaatccaccccagacacccccttcatcacagtccagacactcttagcatctgaccccaaccactctgcctcagtttcctcatctatcagatggaagtgattctcgccttgcttatattgaggagggacaaatattagaccaaaagcagtttgaacaggtaaaggtgctacacaactagaagacagggaactgcttatgacaagtgttctcgaatagagaatgcgtgatggcagctctgtaaagaaaagaaagggctgggcgcggtggctcacgcctgtaatc

SEQ ID NO: 13141 - DNA, 1099 bp, Homo sapiens
ggcgggcgcctgtagtcccagctactcgggaggctgaggcagaagaatggtgtgaacccgagaggcggaggctgccgtgagccaagatcgtgccactgcactccagcctgggcagcagagcgagactccatctcaaaaaaaaaaaaaagattccaaaagcaacatcgaatgggagataatgaacttaggaagctgacagccttgatccattccatgcctctgctgtctcctagctatgtgacttcaagcacagcatgtcacttctgagcttcagttccttcatctgcagagctgagcccagccttgcagggctggagggagcccgggagcgggtgtgtgcagagccaactgctcagttcttccctgtgatgaggtttcagtcaagagaaagtcgttggcctctctgtggggacgtggtgaggcagtgaaagaggctgtccccgcttcaaggtttcttccctcctctctttcttctccttgcatgtttgtttcttcagctgaagccacacatcaatgggcccttcacccctgacctggctcaccctgtggcagaagtgggcaaggtggcagagaaggaaggatggcctctggacatccgagtgggtgagcaccttccaccccatctgtttagcaggtctcagggccagtggctctgcccagggctgtagacaatcacctatgcctactgtgtggcactttctaaggtgggcagtttctgaaatgggtttattattgaaaaattactttttcggccagaagtggtggctcatgcttgaaatcccagcatttcaggaggccaatgcaggtggattacttgagtctaggggttcaagaccagcctgggcaacatggaaaaaccccgtctcttaaaagaaaatgcaaaaattggccaggggcagtggctcacacctgtaatcccagcactttgggaggccgagatgggtggatcatgaggtcaggagatcgagaccatcctggctaacacggtgaaaccccatctctactaaaaatacaaaaaattagccaggggtggtggcaggcacctgtagccccagctacttgggaggctgaggcaggagaatcgcttgaacccaggagg

SEQ ID NO: 13142 - DNA, 1178 bp, Homo sapiens
ggtctctgttaaaaaagtctctggcccagcccagatggtgaactcttttggccaagtctggataatttgaagtcaggtggagacctctgctcactgtctcctcctgacccttaaccccaccacccacaatgcaccaggtctaattggtagctgcaccaattcaagctatgaagatatggggcgctcagcagctgtggccaagcaggcactggcccatggcctcaagtgcaagtcccagttcaccatcactccaggttccgagcagatccgcgccaccattgagcgggacggctatgtgagtgcccatatccccctgcccatctcccccaccccatgctgagtaatgcctccaggcggcacaagcccagaggcctgttgggccggggctggggcaggtcccagtggctgccctggggttccagtacagcacttcgtcctgcagccaccacatcaccccttcccatcagactctcacccacccttgacattctgtcttcctctctccctggcaggcacagatcttgagggatctgggtggcattgtcctggccaatgcttgtggcccctgcattggccagtgggacaggtaagaggcgtatcttttgacaagacagccccttgtgcacagggtacagagccccagaagttggagggggaattattggggtggagagaagagactccagccaaggtctctagctccagggactcttgcccattagaagcctctggcagacatgcctgggaagaggggctgggtgaggaagggccctgcagaggcactggggggcaacttggctgaagcctgggctggcaggaggaagccagcgcggcctcaccctgacggacacagcaggagccgtttgggaggaggcagtgccccaggtcaggaaactcaggccttgaccaaggccttgcctctggcttacgtgtggttgcaggctgggcccagtgatcctgaggttcccttctgctctgcgcgtggccccaggaggaggcaaccctggcagggcctcttcattttccctcggtaggagctaggctgggctgcgccacaggaacccagcttatctgtcctcgggacaggccaggtgacaaggccagatatccctaaccctgatccctctgacctggcaggaaggacatcaagaagggggagaagaacacaatcgtcacct

SEQ ID NO: 13143 - DNA, 1213 bp, Homo sapiens
gtcagaggccaaaagctcagagagggggctacacggggcctcacagtgagcaggcagagagggtctgaggtgattggactttttctgctttgagaaacaaacagaaccagggctgaacccaagtcctggcccagccgggtgaaaggactctggcaccccctggtggctgggtggggcagagggtgctcccaggaagggggcgccttgagcttcacagatgcatcttgtgtggggcccggaggccgtccctgtctcacccaacctccctccacacacacctgcctctgccaagcaccaatgggtggcttctgtcttctttgccactgcaaacaaccacgtgcctctgtcccctcggggcctcgtttgggtctcattcacgcaggcttcacttgcccttaggcagcaggcgaggaagggcccctccagcccctttaccgggagcctcaggatgcccaggcgccaggtgggtgaggccaggcaggtagggccagacaggtgaggacggtgccctcctctgccttataaccttacccccgcttgcctgacagaaacatggcatcaggtgggtggtgatcggagacgagaactacggcgagggctcgagccgggagcatgcagctctggagcctcgccaccttgggggccgggccatcatcaccaagagctttgccaggatccacggtgagctggagtctgtacccaggccatcctcatcccatccctagtgatcaaggtcactctccctgcccgtggctgagttgggcctggttctaggctgtgtccactgcagcccacaggcccgtcagcctcttgccccttcttaggctcacacagtgcacatccgacgctcagcttcccggcttcccgcaggccctgcttccaggcttgtagatctgagccgctgagatctaggacatgtgccagggggttctttctgatcatgaatgtgcagcaggaaggcctcgcagacctcagcaccagcgcacacttgctaggggcacccctagtgaaagggagcagaccagggccccatagtcactgcccgggcattgtcccaggcagcaggattaggggcatctcccagagccccagatgggttcagaaaatgaagctctccaggctagtcaggcccccgatgaccgaatgccgcctgctttccagagaccaacctgaagaaacagggcctgctgcctctgaccttcgctgacccggc

SEQ ID NO: 13144 - DNA, 1228 bp, Homo sapiens
gggtgaggaagggtccctgaccctatcagggcctggagtccctggagaagggtctgcgccctgcgtgctgcgtgcccgttgggagcactgctgtggctcccacatctctccagagcctcttggctgccgtgtgccccgcctcttctttgcctgtgctgggcctgctgggctcccttcacctcctgtccaggttggttcaagccagcatgtcagtgaaatgtgcgtgttctttatccctggcagggatccatcagtgagccaggcctgggccttctctcctggtggaccagcaactagccctggggctggacagtggaccctaccagcctgcgggaaggtggtatggccggctgtgaagacaacagcagctgaggccgatgctaaggagatagtgtctcgagctggacagtgaggcaaggccaggagtgcccaccagcttgccccgctcctccaccatctaggccctgctcctccttcactgcagtgatggatccatctgtggctgtggctgttgggcctccactgaccttgactgaaaagacccttcctggaccctggacttgacaacaaacggcacagacaccaatcactcacagaacagtcactggttttggattcttgttttccttgcaagaacaaaaggttctctagaatccttcagccaccaatgaaatgatcaggcaggagaaaaactttagatgggagtcttgtcatcaaaaataaatacagttgcatggagctgcttaagatctgaaccaaactcaaaataggaagacgggggctaaaaagttattttaagaacccccccaccacaaccacagtcactccgtgggctaagcggggagcaggaagcatgtctggtcacaccatcttggaataggaagccatggctggacggatcggatccactgatggcacacgtggagctgaacttgacgccagcggcggggcggggaggcactgccctcactgttgcagttccttcattctgttgagggcactgccagcgcggaaccactcaatctgcgtctcgttgaaggtgtggttcaggaggatggtctcctgggtcccgttggggtgcttgatgatgcacttcaggggctgcaaggagaaggtgggtgtgggtggaagtggtgggtactgtgtgcccttggccccgcaggggggtcagggagacagggcactgcctggggacctaagaggtcagcaggcaaaccaaatcctaggc

SEQ ID NO: 13145 - DNA, 1098 bp, Homo sapiens
ttgcctgctgacctcttaggtccccaggcagtgccctgtctccctgacccccctgcggggccaagggcacacagtacccaccacttccacccacacccaccttctccttgcagcccctgaagtgcatcatcaagcaccccaacgggacccaggagaccatcctcctgaaccacaccttcaacgagacgcagattgagtggttccgcgctggcagtgccctcaacagaatgaaggaactgcaacagtgagggcagtgcctccccgccccgccgctggcgtcaagttcagctccacgtgtgccatcagtggatccgatccgtccagccatggcttcctattccaagatggtgtgaccagacatgcttcctgctccccgcttagcccacggagtgactgtggttgtggtgggggggttcttaaaataactttttagcccccgtcttcctattttgagtttggttcagatcttaagcagctccatgcaactgtatttatttttgatgacaagactcccatctaaagtttttctcctgcctgatcatttcattggtggctgaaggattctagagaaccttttgttcttgcaaggaaaacaagaatccaaaaccagtgactgttctgtgagtgattggtgtctgtgccgtttgttgtcaagtccagggtccaggaagggtcttttcagtcaaggtcagtggaggcccaacagccacagccacagatggatccatcactgcagtgaaggaggagcagggcctagatggtggaggagcggggcaagctggtgggcactcctggccttgcctcactgtccagctcgagacactatctccttagcatcggcctcagctgctgttgtcttcacagccggccataccaccttcccgcaggctggtagggtccactgtccagccccagggctagttgctggtccaccaggagagaaggcccaggcctggctcactgatggatccctgccagggataaagaacacgcacatttcactgacatgctggcttgaaccaacctggacaggaggtgaagggagcccagcaggcccagcacaggcaaagaagaggcggggcacacggcagccaagag

SEQ ID NO: 13146 - DNA, 1236 bp, Homo sapiens
caaccattgctcaccagccccgttacacagattggaaagctggggccccaagaggctgggcacttgttctacatcacacagcaagtcagggcaggtctgacaaggggtgagaaggtgggcttcctggcagttctgaaggggcaggaggaggggcaggtccgtagcagccaatgtggagagggactccacctaaatatccctcctctgcccatcctctgtgtgcagggtgggaacgactttgagatctttgccgacccccggactgttggccacagcgtggtgtctcctcaggacacggtgcagcgatgccgggagattttcttcccagagacagctcatgaggcgtgaccggggcccacatctgtgtgtcgtgacttctgaagagtttggcctaggcctaaagagaggtcctggtgttggatagatgccagggcccctcctctggcccaggacgcctgctgcaagcccacccagatggggccagagtctgtgtggacaaccgtccccagccagtctgctcctagtggcactggcttcgtcctcccagggcccagagtgttccccatgctccacctggtggcccaggccacagctgctgcttgtatttcggtacagaagaggtttctttctgcaccaggaggaggcgtgctcaagtatcggtacgagatctagcctgccctgcctgcctgccctgggcgatgaggtacggtggggaaggtgcctattttagagaactttgtcacagtattaaagttcccagaacaaagtaggtgtcagctgtgtctgaatggataattggccccagtcacatgctgtcacagccactactttgccgacaagtaaacagcacagagagggcagggacttggcccaggtcacaaaggaagtctgatgcagtcgaggagggggccattgaatccccaaagaagagctggtttggtgtgtccacccccagccccttccttggggaccctgacacagaggcagcttcaggccacggtgggtcacagttgagggtttattgccagtgttaggaagaatggggggtctgggtggccaggggtcttgggaggaattccaaatgagcactgcagggcctgtgagtggggaggagagctgctgcccccctgccacccaggaggccccagggctgatgccaccatatcctgactgctagtggtgccttaaaaggtggcctccccacaggaggggagccttgggggcccccaggagtca

SEQ ID NO: 13147 - DNA, 1664 bp, Homo sapiens
tattttcagtagagacagggttttgccatgttggccaggctggtctggaactcctgacctcgggtgatccacctcccttggcctcccaaagtgctgggattacaggcgtgagccaccgctgcctggccagaaaatacctttgatatggaaagaataatgatgtgaggcctggcgcggtggctcacgcctgtaatcccagcactttgggaggccgaggcaggcagatcacttgaggtcaggacttcaagaccagcctggccaacatggtgaaaccccgtctctactaaaaatacaaaattagccgggcatggtggcgcatgcctgtagtcccagctactcgggaggctgaggcaggagaatcgcttgaacccgggaggcagagattgcgatgagccgagatcgtaccagtgcactccagcctgggcgacagagtgagactccatctcaaaaaaataaaataatgaagtggaatcaaggtggcaagaaaatttagaatcgtttctgatagggactttcccttatcctaaatgtgttttgaaggcacacgttatttccattgtcattctgactttagaaaggcaggttggggcatgagtgggcattttcctaatgacttgctgctaggaggttataggcagggaacagtctgggagtctctaatccagagagactttcagattccctctcttcacatgaacctccattagttagattttgggaaagtgagcatgaagaagggactcagagctgccaggtacccgagtctcaggtctgacatccttgggccccttctgccacaacttcttgccacttcacggacttgaattatgttgcttcttcctggaagtctggcctgcagcacaggcctttcctctccaaaaagctgctgctcatttctggccccatctgctgctatctttgccatcagccatcacagtttggcatcatcagagtctcagctagaggagctgtcattctgccttagtgtttgcctgcgacctgaccaggggcatgaccagctgggatgtcaagtgacatttgggaacttgtagaggccaaatgattgaaagtttaattcttctcaagacccactgatttgccagtgtgcatggaaataatagattagagcagaaactagcagggactgttgtataatcgtgatctactagcagaattgggcccaaagagaaagaatttctgaggctgggtttcttctgggagggtagcaggttggtcttggccagtgctctgtttcccaccagtgttgttcccttttccagcttgcctggcccggctctgtcttccagggtcctgctccagacccctctgcctggggtctcccctccatccagggggttctgggcatcacagctcctttttttcctttctcctcttccagatccagtttcagctggtttgcttcttccagcaggcacccttaggcccaggagcagctcccctgagagaatttgagtcactcatttccttgaacagcacccccctttatactagcagccatttgtgccattgcctgtgccctagggtttgtggggagagagcgagggatcactgagcagttttcccagagctccatgggaaggcaagctctccctcccaatgggagccccactgtcactaactgtaaactcaggctcaggcttcaa

SEQ ID NO: 13148 - DNA, 1828 bp, Homo sapiens
ctcaaaaaaaaaaaagaagaagaagaagtggtcagattcaggacgtgttttgaggataagtggtggatttaatgtagggcttgagaaaatgccattgtgtatgactgactggtgtttgaatcctttatcatatcccagggccggtctaggacacataattgtgtgtgcctaggcattcttcccagtttgttgtggctgccctgcccaagcccacatcacctattagcttcacgtccttctctccgcagccaccaaaaccctcaacaggggcatctctgagttcatcgtgatggctgcagacgccgagccactggagatcattctgcacctgccgctgctgtgtgaagacaagaatgtgccctacgtgtttgtgcgctccaagcaggccctggggagagcctgtggggtctccaggcctgtcatcgcctgttctgtcaccatcaaagaaggctcgcagctgaaacagcagatccaatccattcagcagtccattgaaaggctcttagtctaaacctgtggcctctgccacgtgctccctgccagcttcccccctgaggttgtgtatcatattatctgtgttagcatgtagtattttcagctactctctattgttataaaatgtagtactaaatctggtttctggatttttgtgttgtttttgttctgttttacagggttgctatcccccttcctttcctccctccctctgccatccttcatccttttatcctccctttttggaacaagtgttcagagcagacagaagcagggtggtggcaccgttgaaaggcagaaagagccaggagaaagctgatggagccaggacagagatctggttccagctttcagccactagcttcctgttgtgtgcggggtgtggtggaattaaacagcattcattgtgtgtccctgtgcctggcacacagaatcattcatacgtgttcaagtgatcaaggggtttcatttgctcttgggggattaggtatcatttggggaggaagcatgtgttctgtgaggttgttcggctatgtccaagtgtcgtttactaatgtacccctgctgtttgcttttggtaatgtgatgttgatgttctccccctacccacaaccatgcccttgagggtagcagggcagcagcataccaaagagatgtgctgcaggactccggaggcagcctgggtgggtgagccatggggcagttgacctgggtcttgaaagagtcgggagtgacaagctcagagagcatgaactgatgctggcatgaaggattccaggaagatcatggagacctggctggtagctgtaacagagatggtggagtccaaggaaacagcctgtctctggtgaatgggactttctttggtggacacttggcaccagctctgagagcccttcccctgtgtcctgccaccatgtgggtcagatgtactctctgtcacatgaggagagtgctagttcatgtgttctccattcttgtgagcatcctaataaatctgttccattttgatgacagaatggcagtgcctgattcttagtaagtatccggctaaaattggaatgaagacatacttagctttactagagtggtgatagctgcttaagactttttttttcttctttgtgaaagagtttcactcttgttgcctaggctggagtgcaatggcacgatctcggctcactgcagcctctgcctcctgggttcaagtgatgctcctgcctcagcccccaaagtagctgggattacaggcgtgcgtcaccacgcccagctaattttgtatttttagtagagacagggtttcaccatgttggccaggctggtcttgaactcc

SEQ ID NO: 13149 - DNA, 1111 bp, Homo sapiens
caacatggtgaaaccctgtctctacaaaaaaatacaaacaattagccaggcatggtggcacacacctgtagtcccagctactcaggaggctgaggcagcaggatcacttgagcccgggaggtcaaggctgcagtgagctgagattgcaccactgcactccagcctgggcaacagagagcaaccctgtctcagcaaaaaaaaaaaaaaaaaaaaaaagccaggaccctcattagctagcccctctttctccacctgaacccggtattcaggctgtacaaaatagccggcttttgaaatggcctctatgaaatttcctgttcatttttttattctcaatttcataaaaattatatcatttctcattctttcttggaaggtctatgcagtaagaaaggaatgcataacagaaggataatgctatcatccttttacttttcttccttcttcatccaggtcctggtccagcctcagatcatcaagacagattcccttgttttgaccacactgaagacagatggcagccctgttatggctgcggtccagaacccggccctcaccgccctcaccacccctatccagacggctgcccttcaagtaccagtaagagctgccttctcccccaccctcctccctccccctttattcctggaggtgttagtcttcagagatgttaaatctctatatgctgagtaggtatgggagggtctatagcacaaatcagtcaaattgtaaatgtcacccctcttagttgtttttcgctcgaaaaagtattagcaatgtgtgttcgatgtgggagtactggagtctacaaggaggtagaaaagaatagcagaaggaccctctattcttggctaatagctccacacaagaccattcacctcttagatcctgctgatgacttctgaaggaccctagggccaccaggcagggaagggctccaaggtgaagaacatggaaggtaccccatccttcagttgtaggttcttagccactttcagcatcctatagcatgagaatctgatagagtaaatggtgattaaaatttagaagcactagctttattcataaaatccaagaactggaagcaactcaaatgtccatccacaggaaa

SEQ ID NO: 13150 - DNA, 1208 bp, Homo sapiens
gctaattttttctatttttagtagagatggggtttcactgtgtttgccaggctggtctcgaactcctgatcttaagtgatccgccggccttggcctcccaaagtgctgggattacaggtgtgagccactggcacccagccacattgtgaaggttttttaatgaaaataaattcaaatcagttcatctaaaaaaaatttcattacctctgttgaatgtttggaaacacacagtgtggctgtgctgctgacattgttatgttgcactgtgcgcctctgagtcctatacaacaacctgcaattgtgacagctctgggtgtgacagaaatgggtgccatgttcccagctaccctgtgaggtagacaggaacacacagccagtatatcacagagcctggcatcccatcctgtgatcaggcctgtctgatcacaaagttcacctcgcttctcccctggttcctctcttactttgatcgtgctggagagagcaggaaaaagtttggttttggggctccatcaacaatagtgtctgtttctgcccaccctagggaagcttcctgcaggatccgcctgttccgatgtacacatggcgttgtgtgccgtgaacctggctgaatgtgcagaggagaagatcccaccgagcacactggttgagatccatctgactgctgccatggggctcaagacccggtgtggaggcaagctgggcttcctggccgtgagtacccttcggttcccttctgtaaacctcccctgagcacttacctagccaggagttaagatgcagaagcagttatgaacccccttccccatcaggtgctgcccacctggaggggtaggcaggcattcattcagtcgctcatttcaccaggactcccagcaaccgataaaacagaccaaaattcctccccttgtggccttaataccataagccttgtaggcaggacattttggtcccctgaggtaatatgaggtaatatgaagattggttcagcaatagcagagctactgtacttgggggttaatatgcaacttttctgttcttcaagtggtcataaaaattcttagaatcccctggttatgtctcatggttctttcatttactcagaaggtatttattgggcatcttgtattgatcacagcactgtgaatccagaaataaaagccagtgcctttgccaagctacagagttaaagaaaagaaaaatgaaat

SEQ ID NO: 13151 - DNA, 1208 bp, Homo sapiens
agacacccctgcaggcactgctgcctgctggattcacttacccctgggtccctctgcttttcagggactaggatgctatgagaaccctcccccatccctagcctccccttccactcccagtctcctctacagaaagaagctaactaagtatctccagagagtttaataccacatctctgggggggtggtcccttaaagaacgggtacaacaccttattgtggccactttataggtaaggaaactgaggcacacgttggaatgactatcttgggtggcttcttagcagcagacgtgatggtgaagcctgtgtctctgacttccagcattgaatgaaggtgctaaagggtggggcgctaaccctagctcagggctggcatttcagatctggagctggtggcatggtgccatagtggcagcattggagtcaacagatgcacatgtcatatcagtgtggggcgtggcagtcactggcttgggcccctctgcctgtcacgcaggtgacacatagtgacctgcctctcgactccctgtcactgctgcaggagccccctggtgaaggccatcttccatgcctgcagagccatgcatgcctcactccctgggaaagcagatgggcagcagagttccttctgccattgcgagagggccagtggccacctatggagcagcctcaacgtcagtggggccacctctgaccctgccctcaaccacgtgagtgggagctgagttggcccctgggggaggtgctctgcactggtttacgagaacactcccactcacctcatgctgaccctgcgggtggggccatccgaaagacagagaaaccaggacagcagccccctttcaaaaaagttacggcttattggcctaggtggactcctttttcatcccttttcagcctctgaggcaagtgtgtttctacctgcacctttcttaggctcccagagtcccaggtcctgctggcccatagcctctgtaagcccaggtgcaccccagctggccaggggttcacctgcatttgctccagcggtttgcgtgacttcccaggcctctgcaggcagccttggagtgggttcctgccccctcgggcacacaaacagagctgaagaccaccctgggcacctccttggctggccgcatacctcctggcgggcagctgtggtgcattgtagttgcattgcatgttctggtggtacccatgcaatgt

SEQ ID NO: 13152 - DNA, 1208 bp, Homo sapiens; identical to SEQ ID NO: 13151

SEQ ID NO: 13153 - DNA, 1144 bp, Homo sapiens
aggatggatgtgagcgttcagtgaatgagtccaggtaacgccaaggaactgcaccaacttcatggtagattctcggttgtgacacacatctccttcccacaggagaggtggatgcctggcccggccagcgagagcgggccaccgccatcctgctggcctgccgccacctgcccctctccttcctctcctccccgggccagcgggcagtgctgctggccgaagctgcccgcaccctggagaaggtgggcgaccggcgctcctgcaacgactgccagcagatgattgttaagctgggtggtggcactgccattgccgcctcctgaccaccaggctcagcccacccctccacctctctctcgatttctctctctccccctcagcatcttcccgctgagagtggtggggaagagccttgtcttcttagctgtcacctgccgaggcttctgggccactcaggccagtgcacccctgggcagagccccttaaagctgctgtcactagatgcccatggtccagggcctggtgggcgtgagaggataggtggcagggcagaaactgggcagccctgacttgatagcagcagggggagctcccaagctgccaagcccctgcctccagccttcctgagtttctctctcctgaaccctactctctcctttttgcttcctcagtttttatcaggctttctctgggggacagcagtctctgagcaccagggagcagttgccctcaggcctgtgcccagcatgccctcccctttttatacgaatgttttctaccagtgtgcttgggtttgccatgatgcgaggctgagttgctgtagcgtcttgattctctccctgggtctgcgttccctcccctgggcctgactgagcctgctcattgtttttccctttattacacaggacagccaggggaggaggggggcccagccctgggaggctggtgggaggcagggggcaggcctgcggatgcatgaaataatgttggcattattttttaattttttaaaaaataaatggtatcttatttaattgtcctgttccttcccactccccgcctcctaggatgttagcccaagctcagggtaggcccagggggctgggagaaatgaagccacccatggggactggggaccaggggc

SEQ ID NO: 13154 - DNA, 1149 bp, Homo sapiens
gggaggctgaagcaggagaatcacttgaacctgggaggcggaggtggtgttgaaccgagattacaccactgcactccagcctgggcaacagagcgagactccgtctcaaaaaaaaaaaaaaaaaatgctgggcgcggtggttcccacctataattccagcactttgggaggccgaggcgggcagatcacaaggtcaggagatcgagaccatcctggctaacagtgaaactctgcctctactaaaaatacaaacaaattagccaggcatggtggcgggcatctgtagtcctagctacttgggaggctgaggcagaagaccggcatgaacctgggaggcggagcttgcagtaagctgagatcgcgccactgcactccagcctgggcgacagagcgagactctgtctcaaagaaaaaaaaaggagtggggcggggtaaggggagcttggactcgttatgccagtcagactccacatcctggccctgctattatagaacctggttgttgcctcttggagcttgttttctcagatgtgaatggagatgaggttctgctcaccttgtcacgttgggaggattgaatgagacgatggacatgcctgggactgtgtgaccccccatgcctgcgagtaggttgctgtgttcataacatgtgttaatgccttgcaccttgctaggtaggcactcagtgaacagtaactatttgaaatcacatggaaagccgaggcgggcggattgcctgagctcaggagtttgtggctggcctggcaacacggtgaaaccccgtctccactaaaatacagaaaattagccgggcatggcagtctgtgcctatagtcccagctacttgggaggctgaggcaggaaaattgcttgaacccaggaggcggaggttgcagtgagctgagatcgtaccactgcacttcagcccaggcagcggagcgagactctatctccaaaaaagaaatcacacagcggagttcaaaaactggtgcaaattaggaattacaccactgtcagaagtttgcaagaagtgagaaaagctggctggaggtctcattttggggttgatggcgagagattgtacagtgccagttgctttccttctcccttgggtctaattggagattgtagaggcatcagaagtggact

SEQ ID NO: 13155 - DNA, 3437 bp, Homo sapiens
ctaaatgcctccgtgacccaaacagaagctcacctcctgggtgttgctgtattaatgaactgactacctgttttgctttgttttgttttgttcatagtggaaaacctcaaccactgtgagtttgccctgcttcgagactttgtcatcaggtaagatgtctcccctccagctgtccagacagcaggttgaattatttggggtcagggtctatctgttcagattcacctcctgcatctccaggtctctctgacagagctttctgccccagttccagctcctgttgcaaaatggaaggtgctgtagaagaatccttagctcctgggagtggttcccattcactgggtccagtccctcgaagtgatgtgtgtcaccgcctcctcttcctgcccctaattgcagccctcttcttctcaccctgtgtcctctaggacccacctccaggacctcaaggaagtgacacacaacatccactatgagacttacagggccaagcggctcaatgacaatggaggcctccctccggtgagcgtggacacagaggaaagccacgacagtaacccatgacgaccacttctctgtgtcatcacacatacccacttcacacacacacatcccaaataccaccaccaaccaccttcttcctctcaactctgtcccacaggcctgtctggtatttgtggagcatcttgtctgtgtgtgtgtgtgtgtgtgtgtgtgtgtgtgtgtgtgtgacagagagagagcgagagagcctgtgtgtgtgcatgcaggggtgaggtattttcactgccctccctggagagtcccttgtaagtttggctcctccatgcctgtccattatctgtctcctttccttgtgtcccaaaacaaagctgtttgcctcactcaggagatctgggggaggtttcatttaaaagtgctgggagcaggtgagccacaggcaactcttctctcggaacctgcacacaaactggggctatagagattctccaaggacagatggcagtggagctagacctgagtagggggcagggagttcaggacaaccctcctgtaagttgggggtggtctgggggtaaggctggggcttcctgggaaaaggaaggccatgagaaggcagagaagtaggccagagctgggttcttgcagaaagcatcagtgcctacaaatggagctccacccttcagtctgtgtcgtgttcagtgtcacaaagctaccacctgtcaccagagcctactgctgctctccactcaactggcctctgctgccaggccactgcctgtctctgcttccgactttgtcttctttctccctttccctccttccctcatacattgctttctctccctctcctgcgtgtctctgacatctctcacttccttttagatgaatctactttaggttcattcctatatttagcatttatgcccagtctacttccagaaatgactttagactgcctttcacataaaatcacaaaactacaggacagtacaaacagattgccagagaaatctgggtcaaagaaaggaataggaaagaaagtttctgtagtcaagcacctgaacaggccctgagctcacaggcagccaatgtaaagagggaaacacagtgagttatgcagttcccagtgtccagttaaaggaagcacacatgctagtcatgtgagacaaccttttattgggacatcaggttctagaactaattctaaagaagtatcagaaacaatatacataatttgtctttcttagtaatttggcttcaaagacaaatttttgaccacacctccgttttctccgtcagacttctctcccttctaagcaggcttctctgttgctccatttgcttcatacatacttgacctctcttttctattccccatcacttttgtgctgaagctaatcatatttatgtctgtctttctctacttttccctaattccctctcctcctgactcctgtagacattcccaatgatacccaccgtcatacatttaggcttttcttgcctttccctgaagccctgtatttattaatgcatatatttcccctgcttgttgtacaagtaagttactcttttcctttaatctgtaagattcatgaaattcggggccagggaaacagtttagccttagggaagggaaaacactaagtgaaactgtttacaataacctcatacaaccttctgtcccatctcctggttcagcctaggtgtttcactggtcctctatgaatcccagcacttataatcccagtcttttatcactcaggtgctaggaaaaaaaacatagactcaagacccaagattcaatggaccaggagaaaggggggcggtgatcaggtcaccagtgaccccaacctatgctctcggtctttcctggaggctgccaacccagccctcatcctcccttgctcacaaagttacagggtaggcacctgtcaggacagaacagcagcagcgctacagcccagaggttatacatttcaacagaacagggatccttggctactgtagaagcagtcctgtatggagaccttggaccagcaggggaagatctatgggcatgggaggtgggcgttggaaaggctgagtaggaatggtgcctggcacccctgaaccatgatctgagcctccctggagaaggtattttatatgtctgctgccagctgctggtctccacaccctcaaccgttctcaacccccctgcagggagaaggcctcctgggcactgtccttccacctgtgccagccaccccctgccccactgctgaatgaaggccatttcaagcgctgcttctcactccattcctctcagctgttattgctgcagggccaagccctttttagtgctgtgctcgtccagctcaccaccacagcccctctcagccctcagtaggtgggaggggccagctgcctctttaggccagttgcatcctccatttatccaaaccactcctctcctcccagtggagtggggttctgccagtacagccctactgcatcatctgcgtcagccggtcctagcccatctgcagggtgaaagaactcatcaagagctccttctgcccttgtaagcccatcccagctacttgtaaccatctctaagggcaatggcattgctccctacccattcatctgcatgagctactcttggcttccttaaagggtcaagaaagcaatttttctgcttactagattcattgagatcagctgtgtgagccccaaagtgggacaagggtgtctccttcattacttaaagatattcatgagggtgggtcactacagatgttggggagcaagggctaggatcactttttaaaaaatcaccacttgtggctgtcccagagtgcggttgtacatcctccccacctcataacgcagccactgaggaagagtggttttcctaagaagacattgctggagttgactttcttctg

SEQ ID NO: 13156 - DNA, 1131 bp, Homo sapiens
tattccagtctcatcttccatatttccagccacacaccgattcccagtattcaccatttcttgagttttcacactcatacccacccccaaacattggctcattgttcctcccacatggaaggctccttcccagagctctgggtcttaattccacccattctacagtgtctttgaagtcttcgttcctcctttcatttgaaagttgacggctccttcctctaagcaaccagtacctctcttcaaatactcggtattatgtggctaaacacacacaaagcaaaattttactagactctgagcttcttgctggcaggggacgttttttatacattgcggcccccagtgcctggcctgtggtgaatgcccagttaacgtgcgcatgaacaaccaaacgtgctcaaagctgcctttctcctgccatgtttgatagaagcactttgtggaattctttcagtctgcggatggaagactacgctgttgcccagttcactgctgctttcctttcttacaggaattacagaaaggagaaagcactaactgaagaaatggtgatgctctcagtttctctgccttccctatcagcagaaaggctcggggaaggccctcagcctcccagtctggtgaagcttcctgtatggtccatgaccgtattccaccccaggctctgggaggctccctgagatgtgctgtccactaagcactgcacaaacaagcaatcaaattatgaataaacataataaatatcagccgtgcgtgactgagtgatggctgcagtttctcagtatccctaggttctagttggtgcagttgtctctgctgtcctttatttatgggagaaacataggcccaggctatccaggctgcagtggagcctggtgaactattctgggggccctgggaactattttcattgtttacaaaagcccaacagaaactgtgcattttcccttaagaaagcttcatgggctaactaaagcctcatgccattctgtgttcagtgccagtcatgacagctctgcttgttagcatactacttaaatataactagaatgattcaaaactcgggttctgtgatatgaggatatagataggttttcatctatttcctggcttataactcccaaaaccctt

SEQ ID NO: 13157 - DNA, 1587 bp, Homo sapiens
gactgtggagatgagaaggtggtggacactcgtgatggaatggaaatcgtcctaccgtgcagccacaccctgccctgccccgccccgccccgcccgcgtgcctgcccatgccagcacttccttaagttctcacatcacactcaaaccagtgacaccacaggaaagaaagacccaagacgttggaatggctgtttccatggacacaatctccatagtgacaatgtggggggaggggggaggggtgggatgatggggaaagggtggggggaattaaaagggagggataaatatatatatataaatctatttttagtctggaaagactttgtttaaatgaaaggtgcgctatcccttttgattctgttttaaaattatctcgttaaagatctccaaatttgttccgatgacaagtgaaatttaaatgtgagattgaactgaacaaaccctcatctcatgaaggacggggtgtgtgtgtggcgttgatctttagcctgtctcacaccagttcagaaaacactagacccaggattgaaaaagcaaaccacagcagaaccatccttttgtcattaatttgtctcaaagtgggaaggttttgggggagggggaaatacagggatggtccatgttttcaagagtaggggaatgatgtttaaacacaaaaataaattttttttcatttccagaaacactatttatttatggttttttttttttaattttttctttttgggggtgaaattggcagatgcctgaggtcatagctgtgtcctgggtcactgtggctggtgaggacctcaaggaccccatcaagtgtacacagcagcagcaaaatcaagggatgaccctcctctggggccccctgtcctcagcacattccaggcagctgtgccctgacccacagggacccgtggggatgggaggaggtccaggcctgtgttgccagagctggcagtgtgagctgtaggcagggacggggagggactgtcgctgtgatcagagtgggttaagctgaccaggaacacccatttaacccctttttctttttgctttcatttttataaaggaaaagaggacctgtcagataggcagccccatgctacgtgattctttatgttgtgttgttttgttttgtaaattgtataatttttaaatatctgagttttaaaaaaagaaaaaagtacaaaaaaatcttgttatggccttaagaaggggttagtgcatctttcaggggtcactctgccatggggataaaatagctgtttcacaaacagttttatttaaaaaaacaaaaaacaaaaaaaatcaaaaaatcaaaaaaataataaacttcattttaaccttgtttcctcttctgtttactttaaagtgaatgcgtctcttccttctcccattctaacccccaaagggtagctctggttctccagaggaggccatgatcagaacctgtctgtcccattcctggcctctcgatggccacgcagccgggaagcaaacaaaatatagggttcttctgccactcctctgggcaggtggagtgtggccagtgtatggggacagtcagatttactcaagttgatatgaagacat

SEQ ID NO: 13158 - DNA, 1162 bp, Homo sapiens
gtcaccgtccttcatttgtggtagaagccctggtgactggggatagaatcacacctctgactaaaggaggactcatcttgggccccatgctggggacagagagccaccattattgggtgccctgacaaggcagggaacagacagcgaatgtgcgtgtgtgtctgcctcctagtgcgccatgttctgacagagtgatatgataggtgctgtgtgactaagatcagactactccatgtctctgtacttcggtttcttctgtaaaaacaggaatagcagtgccaaccttttgagattccattgggaaatgtctctaagtgccagcacagcacactggctctcagcccgttgatctgccatgcctagctgtgggtttctcttgggagttggaggggtcaaggcagcagattggaccctgcagctgtctcttatagcaaaaaatacccaaggcttggggttaaaagatgccgcccctgcctcccagcctgtgaggtatctggtacctgaccctcgccaggagtgcggaggggaaaagtccttctgcaggcccgtggttgcccactgtctctttgtgccaagggggttgccttgctggcttgtgtcattggttggcagggcttttgacagtggagtccctatacccagctcttcctcctgtcgtgaattaaacaaggaggccccagcttgccctaacaggccctgtggtccagcacatgggaagcataaccttgatcagggctaatgctgcatcctggatgctatgtaccctgcacagaacagccatggatggacgctgagcaaggcagggaacggggcgtggcccccctgcccctggagctggacatcacacagtccatttgtgtgtatgcatgaatgtcacattctagagttcccctttccccaaactggtccagaggcagtccagggttacacctccagaggagagcctgagtctgtccactttccttccccaccagccccagcccaggcattgtggctgctatagtgcccgcctccctgccactgctcagcagccaagtgcaatcttcattaggcctccctccagtcctgtcccttctctacgtcagagattcttgtcatcttccacacaaagcccagacatctcaccttgccttccagagccctatggaagtctcaggtgact

SEQ ID NO: 13159 - DNA, 1194 bp, Homo sapiens
ctgaaaagggaaatgtattgggcatttggggtaagtagatcaaaaataaaaataaaatcttcttacaaatacaagaactagaaaccaaattccacttctaattctaaaaggtttatatataactctactaccttaccctctcttaccccagattttcacagcagaagtaaacagggaagatctgcaggccgctcacgatagcagcaaggaaatgcctggcatagtgtgtgggtgggtggatggcgggggtaccagaggcagggctggggaccccactctggcatgtcctttatgacatggattgctcatctcaccctgctgtattgttgatttgagaacatttgtgaggcttggtctaaaacattattgctggatcccttcccatggtgtggtcagtgaatggcatttagaaattgaccagctcatcctgccaccacggactcctctaaccacagagacacgtgctgaggtctaacagatggggaccagggaaggcctggaggagagggccaaatctgggatactgacatgcctgacttttcccttcctttcagaaatgttcccactgccaggaggcaggcgccaccttgggctgctacaacaaaggctgctccttccgataccattacccgtgtgccattgatgcaggtaagaggagaccacagacccttgtccagagcatccaaaggattaggacatacagtttgattctctctgttgtcgttgttttttttcttttcttttctttttttttttttttttttttgtcacttcataaaaaaacttcccacccattagcagcactcatctcccttcccttccctccagtccctggcaaccactattctgttttcttttttaaatttttatgatttttttttccctttaagctctgttggactcaatcctttctatctctgtgggctttgctgtacatttgggttacttccactttttgactgttatgaataatgctgctatagaacattcacatgcaagcatttgtgtgaacatgttttcagttctcttggatgtgtacctgggagtagaattgctggatcatatggtaactctgtttaaccttttaaggaactgtcagactgttttccaaaatggctgccccattttacgttctcagtggcagtgcatgagtgttctcctttccccaggtcctccctgacacttgctgtcata

SEQ ID NO: 13160 - DNA, 1171 bp, Homo sapiens
catcaatgctgaggaagaagaacagaccaaattagtgaggggcaggaagggtcagaggtcactgacccctccacctagcagcactgaaagcaaggcgctcccggcctcgtcctttatgctgcagggacctgttgtgacagagtcttcggttatggggcacctggtttgctgtctgtgtggcaagtgggccagttaccggaacatgggtgacctctttggacctttttatccccaagattatgcagccactctcccgaagaatccacctcctaagagggccacagaaatgcagagcaaagttaaggtacggcacaaaagtgcttctaatggctccaagacggacactgaggaggaggaagagcagcagcagcagcagaaggagcagagaagcctggccgcacaccccaggtttaagcggcgccaccgctcggaagactgtggtggaggccctcggtccctgtccagggggctcccttgtaaaaaagcagccactgagggcagcagtgaaaagactgttttggactcgaagccctccgtgcccaccacttcagaaggtggccctgagctggagttacaaatccctgaactacctcttgacagcaatgaattttgggtccatgagggttgtattctctgggccaatggaatctacctggtttgtggcaggctctatggcctgcaggaagcgctggaaatagccagagagatggtgagtatgagaaatctcttaccagcttgggatttttatttcatttggttccttttcttgcatgtttttgttcttacatgtcacatgattattcctccaaattaaagtgcctatgcccatgtgatggacagaaaatgaaataggtaatttggaagatttgtatagacttctaaaatcgtttttcattttttgaaatgtataatgcttatgaagcatattattatatttcaagtttcttgggccacatcttttctaacgcacactttccagttaggatatttattctttggatctgtttcataacttatcctggggcagatcatcaacatcatcatcttcatttctttctctcctctattgaatgttctgtttcctgaatcccatttcttcctcattcttaaagtgagccttcatttaagggcgtgcatcatcctttagtagttttgtgagaaagggtgtgtg

SEQ ID NO: 13161 - DNA, 1267 bp, Homo sapiens
agccaagactgaggagcactgactgcgagatttgcaggctgtgttctagttgcctaactatgtattagcttaatagtctctccccaccctgagccacatgtaggggcagagcaggggccagggcagcctagaaactaaaagtgtgcagggaaaagccccagagatttggtagtttctgggtgaagctaaaccagtccccttgcttagcaaaggcaagaacagagggaagtggatggctggagtgtgaggcatggagaccacaaaggcccacccaccactgtaaatgagctgcctggggctggacgcccctcatacgtggcggagtcacctacacaccgtggggccttgagcgagttgtgaccaccatcctggacttcgatttccctagctgtgtgaggcggacttgggtctgttcacctctcaggcccgccactgctctaaggggctgtgattctcttgttgctttggttttcttggaaggtttccatgtaggtagtgacttgggcggtatcatctgcccattgatttttccagaaaggatgctttcttccctcccattctgcactcagcccacagatgagtgacctcttgcctagctttcccatttctcctcctgtccctgctagtaactcacctggtctaggctcagggaccgagagggcccagcccagtagcagctccccagaggcccccagagggcacaagagccccatagacaacacaccccatcacctgtgaggagcacctggggtggtgtctacggggctggggagccacatccagcccacacatggctttgtgagcccgattgccacggaggcccccagtggctcattcactctccctcctcccctcagcagaagctttgggatccaacaggtgtggcttcctccttgctccgctgtgtctgctgggtgactgtaggcaccacacctccctgagcctgtttgctcatggggtgaatcgtcccacctcacggagcacctgaggctggaatgatggcaacagcacttgtggcactgagaagcgcagtcactgtgtgcctgcagccctcactcgggggtgatgttaatgtccctgttctacgggtgaaaaggctgaggcttcaggagcttagggagcttgccgaaggtcacattgccctctgtccttccttattttattttatttattgagagggagtcgctctgttgcccagactggagtgcagtggcgcaatctctgctcactgcaacctctgcctcccaggttcaagtgattctccagc

SEQ ID NO: 13162 - DNA, 1268 bp, Homo sapiens
ggttgatgctgctctggtggagccccctaagaggggacatggcagctctttgccaatgtaaaggttctgtccagactacagttatggttttacagatgaggaaactgaggcccagaggggtgatgtgctggccttgggtggcctggctaaacggcagggctgagcctgtacctggctccctgaggctttgagtccagggctctcgctggtggcccccatccttacccagaacctggcatctgtcagctgggcacaaatgcctgccctagattgaagagcggagagttggaagcatgtcacagggtctgtccaaggtgctgctggcagcatagcaggcgacggtgctatgtctcatttctatgagggatttggtgcacggctcttgggccccagccgagatgggaaggggcattgtcacagggcggcttcaccagaatcagaatccagggtgaccctggagaggtttactggggaacactcttaataacaactcctgtggggggcagagggtgaggttgggctgcagtgcaatagaaacagaggcctcaggtgatctcacgggcacttgggagcaggggtggtcccgcttggttccagaccaaggcaggggctcagccattacatcctgcgttgactggtcagtggttagctgtccccaggagaggatggctccttcctctcctggggggagttggctccttcaccaaagggaccctcagcagctggcacccctggcagccagagaagcctgtattttggtcttgaaagggggccttaggtggtgcacaggccagatgtcctgtgacaacaaccagagcaagacagatgctggtgcctgggagaaaccatgtcttactcacctgaggacggcaataatagcagtacctgtgcctctgaaccctgctaatcctgcaagctagggccctgacccccacttttgacatgagaggctgaacctcagagaggcgcgctggctccaggcaagtcggctgcagaattggggctcggaaatgcagtgccttgctccccacggcctccacttcccagctctggcaggtgatggttccctgtcctgcgtagcctcagggtgccgtccttgggtgcggcccagcttctaccctgttttggactgtgagctccttgagggcctccctttgtcctgcctacctgggatgcctggcacaatgcccaggccgaagggctcactacacagacgtggccagaattgaatgaagtctcatgccctcccctccccccgagctggtgtg

SEQ ID NO: 13163 - DNA, 1148 bp, Homo sapiens
gggacgaaacttcagagcccaggcagtccctgaatgaccaggccagtgttgtcactgagtggtcccctgctggttgggagtgaagagaatccaggctggcagagctggagccagttggggagcacggttctgggagctctgcaaaatcagtagcaagtgctggaaaaggcacatgccgaagatactcaagagctcccaagatttgcttgaggctagcccagtgaaaaaaaccagagactcatgtttccaggggtcagtctgtcaggcaggaaggacccaggatttgaacccagcttcagtgtgcaggctctgaggctgcccaggacgggaaagtccaaggaaggggcctggtggtgctccacttgcagttctttaaagaatgctgctttttattctcctaaccctttcaagtgggtgcagacttctcgttagcagctggaagacattcctcccacacttttcccttcctggcccaagagagcatccagaaggcagtaggacctggtttttcaggtactgggagccgggggctcactgcttgcactgtgcttagggtagggatggtaaatatcctccctgcatggctttatcctccctctcatcccaaagcaggtatcttctggttgtcacagagtttcattgagtccagctgcagccacgtggccatctggagctggtgctataggtgaccatctggtacattgaggggacctgtttgcctcctccactctataagcagtcatcttgggagaccgggaggagaaggtggtgggctagtcctgtgtcctcctccacttcccatgcctctatgttacccatctgtgtctcctgtgcagaaggagaggaaggggcattaagagatgaagggtgattatgtattacttatccatttctgaataaacatttgttattcctacctttgagttatcttttttttttttttttttttttttttgagacaaagtctcactctgttgccaaggctggagtgcagtggcactatctcagctcactgcaacctccgcagccagactcaagtaatcctcccacctcagcctcccaattagctgggactgcaggcgtgcatcaccatgtctggctaatttttgtagagatgaggtttcaccatgttgcacaagctggtcttg

SEQ ID NO: 13164 - DNA, 1139 bp, Homo sapiens
tgggctttgtacactggtttcaggctgcagggcctgaggccataggcttgagtcagggttgggggcagggggtcctggtgacagtttgctgggatcagcctctccattcttcagcatttaaggaattcaccgcctagggttggtcggtcagcaggttggtgaccacacagccacacgtcagcttacctggtctctcaccccacagcctgggactacggccagggcttcgtgaatgaggagatgatccgggaccaccttccacccccagaggaggagccgctggtgctgatgtgtggccccccacccatgatccagtacgcctgccttcccaacctggaccacgtgggccaccccacggagcgctgcttcgtcttctgagggccgggcacggtcacacggccacccgccccgcgcaccccacgccctgttcacgctcacccagtcacctccccacatcgcacactggggccccgggttcagcctggcctgcccgtgccctggtgaatcacctggctgagcagttcccctggagccccttcgggagcagggctgtgtcccagatgggccacggctgagccttcagagtacgtcctgcctggcacttactggtccttaccagagacgcccagccccatccctgtcctcatgacccctcgtccaccccccacacacactataaggctgagggctgccagcagccccgtctgcccaccattcccggccgtggaccatagtcgggatgtcagcagacacacatgggcagcccaaagctgcaggtgccagggcccaccccagcctcgcctgtcacccccactcccgcctcagggccaggcccaggcctcaccacctgacgctgcatgagacattgacaccagaaagccctcttgggggcactgctccctaccccagggccctggccagccgggagcttggctctcctctggctagagtgggaagagggggctggccatggggccctcccagaacctcagcatttccttccagcccatccaaacactgaggcagccttggggaaccccgagctggggggttggcagcccactgcaccgcctcagggttttggggtcctgggctggggccaccatccctgatggcagaactcccacaaccacatgtat

SEQ ID NO: 13165 - DNA, 1480 bp, Homo sapiens
tgcccagactggagtgcaatggcacgatctcggctcactgcaacctctgcctcccaggttcaagcgattctcctgcctcagcctcccaagtagctgggattacaagcatgagccaccacaagcggcttatttttgtatttttagtacagacggggtttcactatgctggtcaggctggtctcgaacttctgacctcaggtgatccacctgccttggcctcccaaagtgctgggattacaggcatgagccaccatgcccggtcagaaattgctcttaaagaagacagattttctattttggctttagaagaaatatgtcatttttatggataacttaactattgactaaaatatagaatgacccacaactagagttgaaaagaatttcagagacaaaggattctgatcccatcatataacaaattcaggcttttgggctcaaaaaagccaagtagcctcttcccctccctggcaccgctgggcctgcaggtctctgtcgagccgcggacgcgggtctctgttccgctggatggggtttgttaaagttgttaagaataaggcctactttaacagataccaagtgaaatttagaagacgacgagagggtaaaactgattactatgctcggaaacgcttggtgatacaggataaaaataaatacaacacacccaagtataggatgattgttcgtgtaactgacagagatatcatttgtcagattgcttatgcccgtatagagggggatatgatagtctgcgcggcatatgcacacgaactgccaaaatacggtgtgaaggttggcccgacaaattatgctgctgcatattgtactggcctgctgctggcccgcaggcttcttgataggtttggcatggacaagatctatgacggccaagtggaggtgactggcgataaatacaatgtggaaagtactgatggtcagccaggtgccttcacctgctgtatggatgcaggtcttgccagaactaccactggcaataaagtttttggcgccctgaagggagttgtggatggaggcttgtctgtccctcacagcaccaaatgattccctggttatgattctgaaagcaaggaatttaatgcaggagtacaccagaagcacttcatgggccagaatgttgcagattacatgcgctacttaatggaagaagatgacgatgcttacaagaaacagttctctcaatacataaagaacagcgtaactccagacatgatggaggagatgtataagaaagctcatgctgctatacgagagaatccagtctatgaaaagaagcccaagaaagaagttaaaaaggagaggtggaaccttcccaaaatgccccttgctcagaagaaggatcaggtagctcaaaagaaggcaagcttcctcagagctcaggagcgggctgctgagagctaaaccaaacaattttctatgatgatttttcagatacagacaataaacttagggccagcaa

SEQ ID NO: 13166 - DNA, 1237 bp, Homo sapiens
aagtttaggctgggcatggtggctcacacttataatcccagcactttgggaagccaaggcaggaggatcactcgagcccaggaattcaggaccagactgggaaatatagtgagacctcatctttacaaaaaatttcaaaaatattagcctagcatggtggacatgcctgtagtcccagctgcttgggaggctgaggtggaggatcacttgagcctgggaggcagaggttacagtgagattagattgcaccactgcactccagcctgggcaacagagcaagaccctctctcaaaaaaaagagaaagtttcagttaaatcagtactgttgcttggtagccgggttggtaagaaagctctaagtgaggttgcctaatgggaacttcagagaccctcactggctccaggtcactgacaggcccctgtggggcctttctgccttgtaaaggcttcagggatctttcagacttccccttcttcaaaggcttaatcaaaagagttagacccagaagccactgttgctatgaaactgttacttatggtttgaaacctgggagcagatggcatatttatatagaccacacctcctggactctttccagagagaccttggtgtattgtttatcacgacctgcagattgtctaataggaacataaatgccttctctagtcctccttggcatggtgaccaccactagtagaatgaggatactattaggtactttggcaactgaggtaaaataaacatggactctgaaagcaaatatattagttcgatgaagagctcttattgctttcaaattattcattagcccattagaacttgaacattatgaattatgaaagagttctgtttctgttaaaaataagataaaacctgtccttgtttttttttattattgagttccattatttctaggatataaacagtataattatatattgagtacaagataatgaaactagaacaatttgctcagccttataaagccagcatggccttaattagaatagacaactgtctatagctctaaatcagagcaaatgtgatattagggtgctcttatcaagggattttaaggaatgttttcaagattgggtaaagacagagtgggaggggaaaaataaaagtaaaaaagcattgagagctatacaatcaaaacattagaaagccaataaaggtttggagatgaggaaggaaagtctgtgtgtttctgagcagggactagtggccgttagt

SEQ ID NO: 13167 - DNA, 1104 bp, Homo sapiens
tcggcctgcccgccacagaatgcctggccctccaccctctgtgggctcaaagctcgtgaatgcggctctgtagcccaccgtcggtgtcatacctctcatggagacggctccctctttgtcttgcaggggatgagctgaccaagatggaggacgaggatgagcagggctggtgcaagggacgcttggacaacgggcaagttggcctatacccggcaaattatgtggaggcgatccagtgatgagtcggggacaggccagcggggggacggaggcggcgggcccaggagcctcagccagccacgtgggcatccactccttttcctgcaagagatgatggttccattgctcttggcttcatggtgttcctggaaggcagatgagctggtcatttcgcctgggactcggcacctttccgagtgcagctggagggatctgagcgcaggaagacgcagaacaacagaaatagccgcccctccccgcccactgtgcctgttggcctatcatagatctctatgttcttgactttgtctctcctttccgagtcaatggtgggttacactgatcttgttccactgattactctctctgacgagtccatcacctgcaacttaaatgaacaagcttacatcccattttgagtgaagattttgaggtttttaatttaaaggctgtgtacagttatacttttttatacacctgttcatttctacttaaattatggcacagattgatgcgcaccagtcttgaggaaacgatctccctattcccttaccctgttactcagccacgccgtgtgtaggcttagcctcaggtggcagatgtttgaggaaaggaattatgccaggaaggtgggaccgggttatggtcgggtttctattgggaatgctctttgtgcttttgggcatctgaatggaagctttacatagaaccttaggtagaactcccccaaatcgccatatttaaaaattattttcactctattcttgcttaaaactgtactcttttgcaaattaacaattttatcactgattcagagttaaaaagaagactaacttttcaagcaaatgcatctgtaaagatgctttagattagactgtcatgtct

SEQ ID NO: 13168 - DNA, 1170 bp, Homo sapiens
gctgtggggccccacactgcacccacagggctctatgcgacaggggcccaggaacagcctgaggccaccacccagcaagcccgccttatcacccattccagctcacccagaaccttcaccagcaaacctcctgctgaggtcctggcaggaggccaccgtcttgttaccgtttccttttcgtttgctgagggtcacagaccccaacagggaaatcagtatctgtcttcccagtggttgccctgctcgccgggcactccacggggtcccgcccttgtgtgagatgggccaggatccttcggcaaggggcgcctggggctggggctgattgtgggcggtggagcgccagacagaaaaggattccaatgagaacttcaggttaaagtcagatgccacctaccagggtctacagtcaaaatgttggctttttcttattttttaatgtatgggagaaaaatgtaaaattccagttcttttctaattgtgtttctgaaattaggagtcagctgccagcgtttttgtgtggctgcagtgtgcctgggcccagctcacgggcagtgggtggacctaactgcccaggcaggcgagagctacttccagagccttccagtgcatgggagggcagggctaggtgtagcggtgtctcctctttgaaattaagaactatctttcttgtagcaaagctgcacctgatgatgctgcctctcctctctgtgttgtctgggcccttgtttacaagcacgcgttacccttcctgaggggagccatgctctagcccctggagggcctgttgcaggggcagggcgggcccgtcgcctttggcagctcctggagagctgtggacatgcagtccccctcagttcgtgctgcaataaaggccatcttctcttatttctgccctcctttctctttggaccctggagccacaggctcagcctggcctgtcgccccggctgtcactgaaaagccccggataccaagaagtcacccacaaaaagtgggagaagaaataagatggcctttatatcgcaggcctccaccccacagtctgatttccatgtgctggatctgtttccaagccggccgggagcctcggtcctcgagtggccccacagctctagtggccctggagatagcagcctccccacacttgcctccttgtcctggggtggg

SEQ ID NO: 13169 - DNA, 1163 bp, Homo sapiens
gaactagcacataataaacacccaaattatgccatttaattttaatgacaaatgtgaggtggacggtgtggtccagtcctgcggatggggaaccaggggtcacaagggtacaggttgcgcccctccctcagcagattggagggagcggggtctgaacccgggctgtccagcatcatgactcgaacccaggacttgcctctgcctcattagcttcaaaacagggaagggagtccctgagccagggctagtgctggagtcccgcttggacacttgggagccgggatcacccagctcgggctctccccacagggtctacacggacgtgcagcaggtggccagcagcctcacccacccgcgcttcaccctcacccagagtgaggcggacgccgacatcctcttcaacttctcacacttcaaggactacaggtgagggcacctctggccgcaggggccctcccagtcagggcttctaggcactgccggcctccccttgagctggcgcacctgcctccgccctgcaggaaactcagccaggagaggccaggcgtgctgctgaaccagttcccctgcgagaacctgctgactgtcaaggactgcctggcctccatcgcgcgccgggcaggtggccccgagggcccaccctggctgccccgaaccttcaacctgcgcactgagctgccccagtttgtcagctacttccagcagcgggaaaggtggtaagtcccagacacggcatcggtgtgctccatggcccttttccccggcccagcgtctgtgtccgcctgctcctccatgagcacccactgtggaaaccgtggtgcaggagccgagctgtgggccccgaacgtcacggccgtcttcacggaccgcaggacctctccaggtttttgctggggctgtcctctccaccgcagcgcagctgcctggcctctggcaaacccctccttgtttcccatgcccctgcctctgacagctctctggtgccccctcagctcccaaggagaagtgggctgccctcttctgcctctgggtcctggggtggcaccatctgggaacacaggccccaggcgccccccagacagcccttctgctccccaggggcgaggacaaccactggatctgcaagccctggaacctggcgcgcagcctggacacccacgtca

SEQ ID NO: 13170 - DNA, 1195 bp, Homo sapiens
tggggctgggctggaggaggcttctctgtgagttgactcagctgtcctagtgttgaggggttcttctggtgaggggggcattggggtgtgcccccagccaccaagatcctgactcttccattgacctccagtgtaattggagccaccctctctgcctttggggcctctctttctgtgtaatgtgagtggggtggactacagatacctccagcaagtcctcaaggtcccatctccatgcacagcatcctgtgggacgaggctctggatgacagctcaggtgacggtggggtacattaggtccctgttccgagcctgaaatctccaggagcttcagtctccccgcccgtaagactgtgtggttgcattaaacaggtcccacacctctgaaggagacaagtttgtccttgaggcctgggtgtggcacctcgggtggctttctggagtggtgaaggcattggggtggggtctcctgcccacacccctgctgacgggaactctggcccccaggttttcgacgctggggaagtgtttgggatcatgcaagtggaggaggtagaagaggaggaggacgaggcagcccgggaggtgcggaagcagcagcccaacccggggaacgagctgtgctacaaggtcatcgtgaccagggagagcgggctccaggcagcccaccccaacaggtaggagcctggccagagacaccaccacaaccttcacttggtgaaaggtgggagatgcagtaatgcagattctcctgggccctgcaccgccgctggacatcttccttaggacagctttgtggcaagcacgtgtggccagcggtgtgtccatcagggcttcagagtactgtccgtggcaacacagcgttcctggggtgaccggatggaccgcggcctgagagcctctcccagcggtctcattgtcacagtggtcctgctacaggggattagaagttccagttttgctcgaggtcaccctccaggttaagggtgcaggtcagccttactcctccccagtcacagcccctctctggtcctgctaaattggaatctggggtgggccctggaacacctgaggacctgagacccagagcaggcctggccttgccaaggaccacggtgtagttagggcagagctgagactgtaccccaggcttcctgcccccagggaccaagagtggctatccctaggtcaggcc

SEQ ID NO: 13171 - DNA, 1193 bp, Homo sapiens
aatgcagtcaggagcatttgcatgcagtgggtggagagtcggccaccaaaggaccgagttgcgctcggaatttgagctgaattccacagccttactttgtttcctgaagtgatagcctactaatgctggcaagcagatgcttaatagtaaatttctaaaatccccgggtctttatcattcagtttgttctgtgcacctgaggcgctcagccgtgggaggaccattttgcgagtgtagccctgtttcactcggatcaggttggcacggccgcctgcgtgtctgtccacctcatccctccgtgtatctgagggagtaaaggtgaggtctttattgcttcactgcctaattttctcacccacattcgctgaagcgatggagagtcgggggccagtagccagccaaccccgtggggaccggggttgtctgtcatttatgtggctggaaagcacccaaagtggtggtcaggagggtcgctgctgtggaaggggtctccgttcttggtgctgtatttgaaacgggtgtagagagaagcttgtgtttttgtttgtaatggggagaagcgtggccaggcaggtggcacgtggcatcgcatggtgggctcggcagcaccttgcctgtgtttctgtgagggaggctgctttctgtgaaatttcatttatatttttctatttttagtactgtatggatgttactgagcactacacatgatccttctgtgcttgcttgcatctttaataaagacatgttcccggcgttgcgtcgagcgtttctgcttgtgggggtagaggggtccctgcagcggtgctgtcggtgcttgggacaatatgactgtgggccccgttgacaccccattccctggggttgacagcagagggaaacaggcccgtgttgggctttgatgaagcagaattcagactttccaggggttcacttctccccattatttcactcaaattcagactttccagggggtcagttcccccactatttcctcattcacctctgatcacttctataaatggggtggaggagaaagggtaaaagcatgggagatgcgggtgcacctgtgggtccaggtgtcgggacctcccagtctctgcctgggagccctgtgttcagcgttgcgcactgtggtgcccgaggccggcccctccaactgtgcttccccactgggaattccaaagcctgtcttc

SEQ ID NO: 13172 - DNA, 1096 bp, Homo sapiens
caaattctcccgaagccaatgacgccttggtggcactgttgagctgtgagtggataatggcgtgggaagggccagggctgcctgtgatgcccagagcagtgcactcccgcggcagatcatactcgctcctgggatgtttattaaacacctgccacgtgccaggtgccgttctaggtgctggggacccagcactgaacaggagtagagtctccctggtgggccccagcggggggtgtggaatggcaccaggaggtggttgtggctcactgtgccacagcctcagagggaagctggttcaggtcatgttctgccgcatccagtagtttcacaaatgttaggggaccacctggtctgtagctcagacggcccttcctgcccccataggccaagttcaaagggatccaggaatagatctggaatgttccagatccatttccaaggcttcctttagttcagtagctggccggacagcaagtggccccagcagttctcttgtttgcgtttcaggaagagttgggctgtggaaggacatcttcaccgtctccatgaatgagaagtttgacttggtgtataaacagaagatgggaaagtgtgacctcacgtttgacttttatttataataacagaaacaacaacctgcatgctcacaatacccagacagtctactagccaaaagtcctgtatgcattcatttattccttgctggacaaactctggaagcagcgtgtgaaacagcgggggaagggaagagcggcgtgagcggagggagtgtgatgattcccaaccgaaagcagctgtctcgcctttagaacgtgcagcctctccatgtctgattacaaacagtctccacattgcagttccaatggcctggaccgtaaggataaagcctgtaatatatgcaactagaatgtctgccttttcaaccccgtattattgtattttatagagcttttcactggaaatctacataaatgtcagtaaaccaaataaaagttcatttccaaggggaatcaggagcgagccacacccgaatggtagaaagatctcagggttaactctttatttttgtagttttattatctaaggcacagccatt

SEQ ID NO: 13173 - DNA, 1263 bp, Homo sapiens
aacaacaggagagcaaattattttccttttttcccctgataaatgcctttgtggcattttatttttaaatgattttttaatttccatcgggcctcagatgtccagaattaggttggtcataatccttcatccatgacatgtcatcatggatttgtgcgtgacccttttggttaatttttttttttttttttttttttttttttttttagagatggggtcttgccgtgttgtgcaggctagtctcaagctgctagcctcaagtgatcctttctccttggcctcccagagtgctgggattacaggcatgagccaccacactccccctgcccttccctgttaattagtttttatattttatttagtgaccaccagtgagttaaccaccaagccaagaacttgctcattagcaatagctgacggcacctttttactccctggtccctattcctgcccctacctctacttgaagggaacaactactgaattttctgcagcaccatctaaagacaaaactcaaaggtaagtgtgtgtatatatgtgacaaagtcatttatctgtggtcgctccctccctttcagagtttggagcctcttccatcaagtggacctgattttggaggattaggagaagaagctgaatttgttgaagttgagcctgaagctaaacaggaaattcttgaaaacaaagatgtgagttttctgttgaaggtcttgatagaattgttagtggaaacattcacttccatacaccactagggagatgtaaaggaattaacctgtttccgtgcctttatcaaagaagagtttgtaaccacctacaactagaaaaactgatgactcttagaaaaacagtttctatttttaaagaagtcgctcttccttggtgatttttatgtgggaggtttagacaaacacacttttgtatttatgacaaaaaccaaaaatatatcaaggacaaactcaaactatacttaaatttatatttccattccctactcccagaaaaaagactgtgggtctcaaatgaaacttttcctaaatttattacctttgaaatttgaatatgcttttccagttcttgaagagtttactctctagcgagactgagaggtgagggccagtttgagtcagcatttattgtgccacctgaaatccctgcggggtctttagaggatgcatacagttttgttttgttttttttatttttaaaattttttttgagatgaagtctcactctgtcacccaggctggagtgcagcggcac

SEQ ID NO: 13174 - DNA, 1127 bp, Homo sapiens
tgagtaggattgggtgccttcctcagggagttcaggtccagaagagactcccagcagatgcctgggtgctaggggtgcctggaaagcttcctagaaggcatggaagtctccaagctgagactcagagtggggcttcccaggtggtcaggggatggggaaaagtcattctaagcagagggaacagaatatgccaggcccaaagaattgagaaggcgtggctcattctggatgtgagtaagtgtggctccaagtcctctcttgacctgggtcctaatctcacttcatgcatcctccctaatctctaggcctggctttaaaaacaactgcagggcccagccagggggagccagggcttgtctgggagagctgggagagcttggaaggacgggcacgcactgttgctcacaggtctttctcttttcaggggagggccccaaagctcatattcgtaagctggctgagtgcatccgctggtcgtacggggccgggattgtcctcaggcttggcaacatcgctcggttggaacttaattactgcgtccccatgggagtacagacaggcgacaggtacgtgttgggaattattttccacaatcacatcccactctccagtaattttattttgttttggacgtggttaatttcattagtggcttttaagcttgaagattttaagagaattaaatagttgcaaaataatgaaaacacatgtattttcctcctttgcgtttttctccatctagctgggaggagcaggtgtgaagcgttcccaccccctccctcaggtgctttgtgcttattgttcccagggtagtgggagcccctgccagggtctggctggaggaattgacaggtgatttggttcctgtgtgctgaaaacagaaggcagtgttttgagcagttgactttgcaggccagggtctctaggaaagttggggtgagtgaagctttgttcctgaccacagaggacacgatcttgagaacccctctctctacagcagaggaacccaccttcttggcttttcttcaccccttattttattgaggaaagattccctaaatgttacatgggtgaatatggtatagggctagttacacagttatataaacaaattctatttcttacat

SEQ ID NO: 13175 - DNA, 1295 bp, Homo sapiens
tctgtgccctgtgcctttccagggagccaggcgccatgggcttctggtccaagctgtgttgactgtcatccccaccccacccctacctcacgcctgccccaccccctgcctcttttggttgttgttcttaatctcctctccatgtagttcccagtgggcaagagcctttgaaaatgcaggattctaaacactcgtgcttgcgtttgaagcctcgcgtcactcagtcgcgtgggatgatgagtccgttgttgtctgccttggccgaaagatgaaaaaaagcctgaaccccaacccccagctggttgagagcaccctgcattctgcctcatggtgcagttagcgatcacaggccttcagaagtacaacatcagctcagcaggaacgccggctccccgaggacccaggcttgacgattcaccggggatctcctgggctgggctctccttggaagtgaggccttttattaaaaataaaagggttttgcagtttgaaaaactttaaagtcccagaagcttagatgtgacatgggtgtcctccacccacattcctatcacttcttggtcactcgttttaatgtaggttttgcacaaacatccaagactcaggatggcccagctcccacagtccttgaaaggagctgtctgctggggacgtttcttaatttcttgctgtggttgaggggctgggtctggagatggctctaattgtgctgcttgagacagcttgggtcacagctttccccttcagaggccctttttgggaatgaatgcatctttggaaactttaaaatgaggggggtgcattggttcactggcactgtgtagtaaagtgccacaggggagtggctcagacatcagagaattacatcctcaggcctttcgccttggcttgtagatgccggcttctccccgtgtcttcacatggtctcccctctgtgtgtctgtgtcctcaccgcctcttttattttattttttatttttgtttttattttttgagacagagtctcgctctgtcaccaggctggagtgcagtggtgtgatctcagctcactgcaacctctgcctcccaggttcaagcgattctcctgcctcagcctcccaagtagctggcattacaggcaggtgccaccacacctggctaatttttgtatttttagtagagacggggtttcaccatgttggccaggatggtcttgatctcctgacctcatgatctgcctgcctcagcctcccaaagtgttgggattacaggcgtgagccactgtgcccagcctatttttttttttttttttgaga

SEQ ID NO: 13176 - DNA, 1354 bp, Homo sapiens
agaagggctgcggtcctattggattagggcccacttatatgacctcatttaatcttgattacctccataaagaccctgtctccaaataccatcacatcagaggtgctggggttaggacttcagcatgtggatttgtggggggcataatttgccttgtaccgggaggatatgaagtgttcatgttactctccctgtagccctgagagcatctcccttagagtatcctataaaaggagtcgctgctcactcagttatgggttgttcaccccctcgctcaccccagctctgcagagaactggggatcccatcggccatgctttctgggctggcctctggtcgcagtcagtccctcgctgtggcgcccccccctcccccagctccttcccagggtgatgacccgctgaccccctggggtgcacctgctgcaaagcagcccccttccttggcatctctcagcattctccgtagtgagcctggcctttctgatcttgttagctttttgtcttcctgccgcagatcagagctttggagtaagttttgatatgaaatcgaatgccaacaccgaagttttagaaaacagtttaatattccctctcagttccggctgttgctaggctggggatgggttcagaatagccattttgatggaggtgatttcccagcaggggaaagaaataattaaaacagcattacggtgtctcttgcgggatgcagtgacattcaaaagccacactgacaaaaagcctggggctggaacgttctgtgctgcctgcatggcatgtacaggaccgcggccccctggagctggtggagtggcccagccttgccctgctcacaggtggacctggagagggcactgtgccttcccagggattgggatttgaaaagaacagagcttggccaggtgcggtggctcacgcctgtaatcccagcactttgggaggctgaggcaggtggatcacttggggtcagaagttcgagaccagcctggccaacatggtgaaaccccatgtctactaaaaatacaaaaattagccatgcatggtatgtatgcctgtaatcccagctattcgggaggctgaggcaggagaattgcatgaacccaggaggtggaagttgcagtgagctgagatcatgccactgcactccagcctgagcaacagagtgagactctgtctcaaaaaaaaaaaagaaagaaaaaagaaaaagaaaagaacagagctgtgattttcagccaaaatgagcagccctggcccattctgtgtcatcagaggggagaggacggttactgtgggagggggcttcagcttctcagggaggtcctggcggcccccatctagtaaaccagtaaacc

SEQ ID NO: 13177 - DNA, 1212 bp, Homo sapiens
aatacaggctttaggttcccctggactccagccaaggctgttcaggtgggaccatggtgctctttaagcgtgatcggagggaagacacacagcagggccaccattccatgaatgggaggtgtacagatcactttctctttgtgctcagttctgttctgtctccagcagctatattggtaagactagtacctgccagggagaggtgcccccaagtgaaggggtacagtggcacctgggaaaaggcacctggaaggtttccatgtggcccagcccagcatggaagcagggtgggaactctgctgtgtcgccagcgctcactctactcgagtggctttttgaaagccctaccatgtctgtgtcaggcctgtgctgcttcacatcctacagctgcctaggaaaggccggccacgctccctgtccacacactccctgtccacacactccctgtccacacactccctgtccacaactgcagccgggccctctgcctatgggcacccaatccaagcagctgctccacctttgtttggcatggtgatttgtgttttttctcttggtgcttatgtgtgtgggcttgggacgagtgctggtatgcacttaggaccttcttgatagctccctgcactttggaacacggagcagatgagagagggtcggggcttgccctccaccttggacttggaagaagcccacattggagaggtgaggaccccatggtggctctagtggaagatacgttagtctccagctaaggaggatgaggcgcagccccagagggagacctcagtgataggggatcaggctaagaaagtgggggaagggagatgctttgtacatattttggggttataatttctctaaattttaggagaacgggtattgattgataaaagggacaggcagtagtgttcaacagtgcatgtgaaggaaagttctgttttccatggttttgacattctttggactgtattgtgactgctgtctggtccacatggtacccctttggtaagtaggcttcagtgcataccagggtatcactggagatgggagttagtgaaggggtgactccctggcctagtatagtgtgaccctgggactaacttaatgtcctaaagcattttggtgacttctagggaatagcaaagacctatttcattgtccccaggtaagtatgtgatgagcaatgaggaggagtggaaaacaaaacccaga

SEQ ID NO: 13178 - DNA, 1110 bp, Homo sapiens
gaaggacaagtctgactgttcataggctgattttctttaagaggattattctgttttacaatttcaattctagatcacattttatatatgctgcatgccaaaaaaaaaaaaaagagaaaactgccttttctggtgtggaggggaagaaaaactaatattctaccttactagtagagttcaaaacaagttttcactgagagccttttcagtaaaagttaaacaagtttgttttttgagcatttgtcagttattctatttcagaagagtcaaaattcaagcacgatacattttgaaggctttgcaaactcctaaacccctgatgagtcctctcattctggaagtgggaatttgagtagatactgatttgtcccgtagtatggcagatgacagggaggtcttttccaagcaggcactcagaacacaggtcaccgtatgttctcagccagtaacaatcatactgaggacgaaggactctccgtttgatgcagacacaattgtaatggagatgtaaaacttcttagcaatcagatggataaattgtttgctttttactttaaataggaaattgttttctaaaactaaaatacttgaattgtcagacaatataatctcagcttgtattagtttttgaatgctcccatcgaggaagtgtaacaatccatgaaatgtgaataaatgaaaagtaaacaaaatcccaatgtgtgagtcttatgttcctctgtgatgcacttggcattaatacaagtcagacagacctgaggaagaagaatcaacgcagaagctgcaaccggaaacttccttgaacaacaggaaggtcagcttggaggtgagtgagagaccagtttattatcagactccttgttgggggccgagactacttttaaaccattcagaccaagggtttctgttggattaaaatcttaacagattggaatgggaacaattgatccttaatgggctagtgtgcaaagcattggctaggtgctttatatgtattaccttggttagtcctcaaagcaaacctttgagacttattttttaacctttcctatgttactcagcatttatttggtttataaggggtattttctggtttaaaaaaataatatt

SEQ ID NO: 13179 - DNA, 1918 bp, Homo sapiens
catagcactcaccgctgttgagggttactgtttcacctgcttccctcctgccggccctagacatcctggaagttcggcagaagcccatcctgatgacctagccgcgtgcggagcctgcgcagagccccggccgggcccagccctcggagtgctgccaagtgcctacctgtccaccgccaccggggtctgcgatggcacgccagtgctggagccgcagccaggcgaggccactcgactcccggggccggggccgactccacgaacaccagcccaaactgaagtgcctcttccctcccctgctggcgctgctccgccctgtgccccccgcccatcgccccccacccatctctggagagccctctgcacccaaagaggactagagatgccgagcggccatgagagagagcggaaggagcagctgatgcccagagcggggccagagcggcgggtctatgttcacgtccccccagcagcaggcggaaccacccagccagggcactcagtgcattggactgtccacatgttcttgaggaaagccggtggaagattctggaatgccgtgcggatgaacttcagcacccgagtcagtcccagctcatcctccccagtttaccactttgttctaataggagatgggaacacgagaagtttgatggctttgccctgggctgggaatacctcacccacgcccagttccagaaaggcctccagctgagcagacggccccgatcccgccagaacggccttttgcttccagccaaagaacaccgccaacacgcacacctccaacctgggacatcccacgctgggcctcgcacggaggaacctgcagaatttggattctgagggtagtcgggaggcctcggtagccaggcagaacaggatatctgccaaagggtgtctgatgtggggtggggctggcatcctcccaggaaggttctaggtgggaccccgtcttctgggggcgggggtgtcttttcatcttccctggtttcctagaactcacttcctttgacggcgtgtgttggtcccatctctcagaccagctcactgaggcagaggagttgctcagaggctcacatgggcacccccattggttcgtgtgagcagctgcccagccccaggcctgccctcggcctggtccagcatgaaggcgtttccatctgcaaggatgcacggtaccctccccgagagcaggcctgtcccctacccaactgggaataaactggaagctgggtctctttgttgctatgtttttttgtttgaagttcccaggaatatttgaggggttccggtgatgtgtttagggatcttctctgtgggggaaaaggaagaggagggtcttgttctcccatctgtttattctttgggctctgggaacaggggactactttggggctttctccagacttttgtatgttgttattaaaagcgagctattgcatttcattctgcctcagtttgcccacctgtgaaatggggctgataccacctacctcactgaagtcccagggttcaagtgtgtggctgggtcagggcgtggtcacccgtcattctgcataggtcgggttggatgttagactcctgggatgccctcctccccctcgccctttgtaataacctaatctgagaccgtgcttggtggggggatgtgaactttctctctcccccagcagtgtctgctcaggcctgacagctcagctctgcacgatttcatgttcctaaacccatgtcttagggcagcacagagccaggtcatgtcatgccccaaagtgtggggacagagcctcagggagccccgagcatggtccagccccatttgagtgctctccggggatgccaaatgctgcttccaagtttgagtccatgtggctaaaatacacccatttcttcaggaactcttcccctggttgttctg

SEQ ID NO: 13180 - DNA, 1218 bp, Homo sapiens
atatgagctctttaaatcattatgacaactttgaggggaagatgcccttagtccattgtacagatgaagaaactgaggcttagtgaggagaatggatggcccctgggtcccatctcccgtcgctagagaactggggagcaagaattggagttctggccgggcatggtggctcacacctgtaatcccagtactttgggaggtcgaggcaggaggatcacctgagcccaggagttcaagaccagcctggacaacatggcgaaacgccacatctacaaaaagttttaaaaattagccgggtgtggtagcacgtgcctgtggtccctgttgcttgggaggctgaagtgagaggatcatttgagcccaggaggttgaggctacagtgagctgtcattgcaccactgctctctagcctgggcagcggtgtgagaccctgtctcaaaaaatagtaagaaaaaagaattggagtccttgtccatcgtaatgcctgcatagtagtcagggaagaagaagagcaccacagtgggccctgggcactcacttctgctctgggcctcgcaggcagctgagcctgaggtggaggtggaggtgtaccggcgggactccaagaagctgccaggcctgggagaccctgacatcgactgggaggagagcgtctgcctgaatctcatcctgcagaaggtatggggtgggatgggtggggctgcggattggccctgtgggatggctgacccctccctgcacgctgacccgtgctctcttccagctggactacatggtgacctgtgcggtgtgcacacgtgctgacggcggggacattcacatccataagaagaaatctcaggtgagccctggcacgagagcccccagcctcctaactgccagttcaggctgggcgtggcagagagagacaagtcctcctgcttgcttctctgccctggaggtgaggggtctgactccagaaatctgctcagctcctgggatcccgtatcccattcgaggagcacagaaccagcttatcccccacatctcctggtaggtctctggctttggactggctctgggccgggtggcctccctatactggcttggactggctctgggcctgtgtgccgggtggggcctcacttgtcctccaaatctgctttcttccagcaagtgttcgcgtcccccagtaaacaccccatggacagcaagggggaggagtccaagatcagctac

SEQ ID NO: 13181 - DNA, 1152 bp, Homo sapiens
ttgtttttgagacggagtctcactctgttgcctaggctggagtgcagtagcgcgatctcagctcactacaactactgtctcccaagttcaagcgagtctcctgcctcagcctcctgagtagctgggattacaggcatgtgccaccatgcctggctaatttttctgtatttttagtagaggcagggtttcaccatgttggccaggctggtctcgaactcctgacctcaagtgatctgcccacctcagcctcccaaaattctgggattacaggcgtgagcatcacgcctggctgggtacatactgttgatcttttgctgccatgcgtatatatgttttgtgagaaagaatataatgaacatttggtttttatttcagtgtatgtaacatgttaaatattttaaaaccctttagatcaagccaatcaatgaaagactaagggagcttaaaggctgtaaaatggtgattgatgtcataaagactcagtttcctcagctgaagaaagtgattcagtttgtgtgtggaaatggtcttgtttgtgagactatggaagaagcaaggcatattgcactcagtggacctgaaagacagaaagtaagaaaagaggcttggatcacacctttggataagttgaagtagtatttataagactagcatacacaaacacacacaaatatttacatatgcgttttatgtgttcttttttctaaagagaaccaacatagaacctaaggtggttatggcttcagtggtttttataatgttctgttgaatttagaaaaaaaactcttatagcatttctcaacatcataaattataattttggaaattagatttcttttaataatatcttaaagcagttagttgttgttgttgttgttgttgttttaaaccttatatggaccctggatatggtacctgtggttttgaataccaggaaagattttgggtatttattttacaatgtgggctaattcttccatactttagtggagatactaactgtccttttgcatattcaaggtttaacatatttgaatttctagaaaacacaattgaaatgagattactaaatacaagtatcttgagggaataattttggtcttaaaaataagtactattttactctcagtggaatagagagtatttagttat

SEQ ID NO: 13182 - DNA, 1164 bp, Homo sapiens
ccccattcaggggtggagagcagcccaggacgcgctttctcgtgttcgctggagtttgcagcgcagaggcccctgccgagacttccctccaagacaatataagcactggggttgggaaagaggatggagttggggtctaaccaggttccggatccaggatctgctgagtggccttgggcacatccttcagcctctcctggcccccgcgtctgtgagatgggggagatggagaagatgctgcccctccgtggggttcttgaggaccacataactacagtctcagaaaaagcagtagatatgaacgttagcaggggagagaaatcactgctttcgactccgtgcagtccacagcccggatgtgcacatggtggacctgagctcagtttgcgagggtgcagggaagcacttccaccgtggctttggcacattcctttctaggatgtattaggatgggtcgttcttgctggtcacccccgcactgcctcggtctctcctagatgtcaatgaatgcatcacgggcagccacagctgccggcttggagaatcctgcatcaacacagtgggctctttccgctgccagcgggacagcagctgcgggactggctatgagctcacagaggacaatagctgcaaaggtacagcatgcgctccgagtctgcaaacctggtcttccaggcgtagatacggcgcggtgggaagggcagctctggggtctgggctcccgcagtcctgcgccctctgtggctgcctgggcgactgcctgctcatctgcaggagggaggtggttatacccaccagggtgtctggacaggtgggatggaaggtgaaagtgcttgccaataatgttcagaacattgaaaaagttgacagtagtgcaccggtgccagctagttcagctgttaggaaagatttacgttcttatggtgcagagtaaacgatggcagatttgggtttctaaaaaggctcagtgcatgactatttaaaatcaagaccagggatgaatttcaggttctcacatgtactttctacaaaaaaaaaaaaaaaaaaaaaaaaaaaagcaaaaacaaaaatcccacaactgtttttgcacaacagctgccttccatccaaatccaggcttccttgaagttcaaagcatatccccttccactgcataaacacatg

SEQ ID NO: 13183 - DNA, 1124 bp, Homo sapiens
agggaagcatcagtactcaaaattggggaattataaattagcagtaaagtccgtgtttcacagtgtcacttggaagggcagctattttgaggtctctgtgtggtatagtaattgagaaagaaagttgagaatgtactgtgttttataattggtgatcctgatggggcgggcagtgtggcgctccagagctgctgtgctgtggtgggcggaaggaggtttctcttttaatgatatatgctaaataaagaagcaaaggggaagtgctgtacaaatgctgtgattaaataactattagaatggagccagcccctccaccatgtgctggatttcatcgccacttgcccacgcagaagcttttctcctgaaattatccccttgctctcaggcagcctctgtttttttcctctttactccatcattttcatcagcaagtaatatgccctcccatttttcatttaaaaatatcttcttttgactccatgtccccgtcagtccagtatctcgtttttctgctctatcccaaatgtgctacaaaagatgtatttagtttttacaatatatggtaaaagattatttcatccttcacaggattactttccactgaagcaggtagatgacctaagaaaaaatttaacggagcagatatctgaaactacttttatgaaccagtttgtcattgaggagtaaattggttatttggttgttagcttggctattcactcatattcactaggcagagagggcagattcttacagacctgttacatgttagctgtattaaatgttgttcttaatttaggtagttgcatttgtatgagtttaattgttttttattgatgtgagattcacatattgttaactattttaaagtgaacaatcgagtggcatttagtacatccacagtattatgcaactaccatctctacctaattaaaaaaaaaatttttttttttgagacggagtttgctctcgttgcccaggctggagtgcagtggcacaatctcggctcactacagtctccgcctcccaggttcaagcaattctcctgcctcagcctcttgagtagttgggattacaggcacccaccaccacgcctggctaatttttgtatttttagtagagat

SEQ ID NO: 13184 - DNA, 1181 bp, Homo sapiens
ctaccaagatattgcatagaagttcatatttacccagaaattatgcaagttcttaaagccagagttttttcaaccacagcattttacaggatttctgtggacaagaaattaatgtattttatgggatatttgtatctttaaagtggaatttgcatgctgggaatgctttaaaaagaaagtatttgcataaatgtcatgtacatagctagtaattttgaacatttattccactgttggaatgtctttttgcttgaataagaacttttctgactctttgctccaagaagacacataatgacacataatcttgcattcttgatggcagatgtctgctgttagtgaaaatgatgagtcgtgtacatatttcatacttctgttttgttcttcatagttttgtttttctctttgacttattacaagcacagactctttaaatttattgaaatattttattctcttacagttatttataacagttaaataatttctcttaaaatatgctaaaaagttatgttttcttttctttctaggaggcactggctacaattaggcttctcgacgtcctgtgcgaaatgactgtgaatactgagctgctcggctatctgcaggttttccctggcttgctggaaagagtgattggtgagtgaaatatcacacattgtatttttagctaagaaatctttggcttgtcatactgtaatataaatccaaatacaaatccttaattttcagtgtactttgggaattttgtgaatatatttttttgagaggaatcacagtgttgtaacagttcaggcaggccagataaacctgagcccatgtgtttgttcagccacttcccttctgttaactgaagattccttctcagtaatgtgaggataacaatgcctgttatgcatatagtagatgtttcatcaatataggatgtgatgaagaaggtggggcaggcaggtttgcgatgatgattgtggttttatattactatagctttgtaaaatgtggcagtaaatttttcccatttacatttagtgaacacatagaatggtgttttatacatattatatatacaaatcttatgagaaaaaggttttaaacaagaaaccattgttaaaagtattaccaaccttgctaaaaagctgtttgcaaaataattcaagtagaacctgttccttgtggctagc

SEQ ID NO: 13185 - DNA, 1175 bp, Homo sapiens
gctggagtgaagtatagagaacatatgctggcttctgatgatttggccagttggatgagggaaaaataagcactcttcttggtttctgtcatatgcatcattatggatagatattgtgttttagacttcattgactgaagttattagaaaagttctttcataaagaagttgagattggaaacctttttgtaagaaggatgctagcaaacttttagctaactttttttgtagataaatagaaactctgagttggggtagtcattatggcttatctccccaaaactagagtcaaaaaatttaaagcaaaggcagaagagccttctaatcattttttgaagcaaaggcagaagagccttgtaatcattatttaaataaagctttctgtgctctacctttagcctattacaataaattagatttgtctatggaaaactattagtacaacatactaaaagttacttttctgtggaaaatgaagtttactcttttggttatagatcttttgcgggtgattcatgtagctggaaaagaaaccacaaacatcttcagtaattgtggttgcgtgagagcagaaggtgacatctccaatgtggccaatgggtttaagtctcatctcattcgtctgattggaaatctgtgttacaagaataaagataaccaagacaaggtaagaggatttcttagtatgtattatacatgtatggcttcatttagaatatagtccttggaagacattcactcttttggagtgaaagcttgaggtgcttagaaagtagcttggatagagagatatatattttatatgaatacacacacacacacacacacacacacacacacacacacacatatatatacacacacacacgtgtgtgtgtgtgtgtatatatatatatgtatatgttaatatataggctctttggagcctagacaaatttctaacacacagtagatatttaataaacactagttattattgcctattatcttaaaaaacaaagcttagatctatatcctatgtttatggacgatagcatcataagccttttcttctagatgttttaaaatggatataaaaggaatataatatttaagtatgaagtctttgaggacctagtaggctgcttttagaaacctcttatgtgcagaagagcttaaaggtagttatattgaga

SEQ ID NO: 13186 - DNA, 1309 bp, Homo sapiens
ccattgcttcaagcacgaggctctttgtaagaatatggatgggagaattgtgccctctatagtggtttaccgaggaaagccctaaagatagctgcaaacggtttttttgttccggctttatgctgccattttcttaaaagagggacaatttcaaactcattctgggtgagaaatacaaaaggcatatcaaaagttatacatggtctaaaagtaagttactcataggaattagattttctttaaaagatagttaatgttcactatagtttaaaaaacagaactccttgaataatattgcatgaattgttttaggtttctctaagttatttgtcaccactgaccaaagttctgggttttttccccttttgtctgatgaatcttgtgaacagatttgctacatctgcaattttgtttctttcttcttctttagtgaatgaactacatccaaatacctgaatttttggaatctgtttcatggatttttcatcttctaccgtatgtgaaattgcaagtgtttgaagatttataagtacaaatttgggaacatacaaatcttttaggtagtagagtttaacgtgtataagctaaaagtgaaagtaactgagtgttctcttgtttctttgcattaatgtaactgtgtggtttgcctttgtccccctggatagaacgtgcatttaaagaatatattgtacttactgtgacagcagataataaaccagtctcttggagggcacaacccttatttgacaaaacttggatgttggcttgactgtgtttgtcccttcagatggcaagtcagcatcattctttatattcctcttctcattgggttttctgaactctggcaggcggttgaagtagtttctcactgtgattaattctagcaatctcttttcacccctctgcctttccaaaacattgacaagactcatttccagttaattaattcgagaaccctccctcttcattttgggtactgggctgtcttgtcactgagccctatccctttggaatgtggcagggagtgaggttggtgagagaacatgtgggcacttaactcttcatgttccagttcatcccagaagtagacatcccaggacccattctgtgtcaaggtgaatgcctgtgtcctccccagcttcatgcctctgtcatgggggaaggaatagcttatgttctgctctggtgcagtgccgtagattaaaggtacatttctatcttctttgatttaaaaagcaccagtctcataaaggtgccactcagttttagccatgtcttcactgaaattgcaaaagtacttttagggagc

SEQ ID NO: 13187 - DNA, 1165 bp, Homo sapiens
cctaaacccagggcacacgggggcagaggctcaggacactcaatgcatctgtgcacacacacctgtcctcacagactgcccacgctcccgcaggcacacacaggcacatgtaggcacatgcatgcacacacgcgcatacgttgccgagcacagccccccaagaggagcacaagcctccgcgcagttcccccggggagccgcccccacgtgcaccttctggagccaggccagagctgtgtggctccctaaaggtgggggtacgggtgtcccagccaaggcaacttgggcaagccctggaggcggctcccaccgcacgctccggtcagcctcccctttaaaaaaacccgccgggggaggaggcggatgtaggggcggcccgtccaatggcagctgcgcgcctcgggagacttggagaagtgagccagagcgagcgacagagccggttcgcaccgacagacggacggaggtccagaccgcagccaaggcgcgcccgctgcccccggccgggtccccgccccgcactccagccccagctcccgccgctgccccagacccagcgccatgcgcggccctagcggcggggcacgggcgacaactgcgcccgggcccacgagacccggcccctagcgcccagcgccgccgccctgcatcggggagctccgcggggaccccggcctcagctggcccaggcgcccggcccgcggagcctgttcagccccgccaggcacgccggcccaccatgcttctactgtcgccgcgcagcgcgctcgtctccgtctattgcccgcagatctttctcctcctgtccagcggcagctacttgtgagtgccgcgggcggcgtgcggggtgggcgggtgggctccccccgggcctccagcgctggaaccgggcgggcagggaacgcggcagcgaggcccctgggcggggcaccgggtgaccgtcgcgcgcgggagccgggggactttaggtcgcctcgccagcctaagctgccgaggtggagcacttggcgggcagctacggcagtgagaagtcctggctctggggtcaaagaaaggatggcctgagagcggctcgactgcgggagtagagcaggctgtgcacgcccagcgcgagggcccgcgggcacgcgagcggcgccgagattccctgcgcgtcccagcagag

SEQ ID NO: 13188 - DNA, 1140 bp, Homo sapiens
ctgcaagctctgcctcctgggttcacgccattctcctgcctcagcctcccgagtagctgggactacaggcgcccgccaccacacccagctaatttttttgtatttttagtagagacggggtttcaccatgctggccaggctggtctcgaactcttgacctcaggtaaaccacccacctcagcctcccaaagttctgggattacaggcgtgagccaccatgcccagcccagtacttcagtttcttagcgatgaaatccacccaatgtcaggcgatgactattattattttactgatttatactgtttgttctctattaatgtcttattttccccaaccgattttgaagttgagtaaggactatgttccgcgggtatcttgagtcctctgaggcactgagcttggtgatttggacgcaggagctgctcattagtgagctgatagctgggagcatagcgcatcccacatcacctgacttaccttggtgtcctcctttgtagccttttgtcatacatgatatggagacactgtgtatggctgagaagacgctggtggccaagctggtggccaatggcatccagaacaaggaggcggaggtccgcatctttcactgctgccagtgcacgtcagtggagaccgtcacggagctcacggaattcgccaaggccatcccaggcttcgcaaacttggacctgaacgatcaagtgacattgctaaaatacggagtttatgaggccatattcgccatgctgtcttctgtgatgaacaaagacgggatgctggtagcgtatggaaatgggtttataactcgtgaattcctaaaaagcctaaggaaaccgttctgtgatatcatggaacccaagtttgattttgccatgaagttcaatgcactggaactggatgacagtgatatctccctttttgtggctgctatcatttgctgtggaggtgagtggttgatttaatctgctggtatcatgtcactgacaggctcctgtcttgaaaaatttgacaatgggaaatccagtaccagcctgagctgttccagtggaggggacactcacatggtgggaagacgtctgacccccagtcactgctgagaattcagtgggaattataacaatattgtataatattatagt

SEQ ID NO: 13189 - DNA, 1166 bp, Homo sapiens
cgggcgcagtggctcacgtctgtaatcccagcactttgggaggctgaggcaggtagatcacgaggtcaggagatcaagaccatcctggctaacacggtgaaaccccatctctattaaaaatacaaaaaattagccgggcatggtggtgggcgcctgtagtcccagctactcgggaggctgaggcaggagaatggcgtgaacccgggaggcagagcttgcagtgagcggagatcgcgccactgcactccagcctgggcgacaaagcaagactccgtctcaaaaaaaaaaaaaaagaaagaaagaaaaggggtaattatagtagtatttccagagaggcgccttctctacccaagaactagggacacatcctaaggggagcctccttcccctctcctggttccaagcaagaagacatgacttggctgtgcaattgggaaccctggtccctcctccaggaagccttctacccgccaacccccactgcaggctggtgagggtgctgcctctgtgcccctcagcccttggcacttgcccttgctcttgcacccctgccatgacctctccaggtcagggacagcatctgtccccagcatcacctggcacatggcctgcactgagtagctgtcagtgaaagttggtgaatgaaggcataaataaatgaagtcaaactctgtattaggccttcttgcattgctatgaagaaatacctgacgctaggtaatttataaagaggtttaattggctcacagttctgcaggcttttcaggaagtatggtgctggcatctgcttctggtgcaacctcaggaagcttaagatcatgacataaggtgatggggagccagtatatcacatagtgagagcaggagtaagagagaaggggaggtcttagactcttaaataaccagatcttgtgtgaactaagcaagaactcatcaccaaggggatggtgctgaaccattcataagggatctgccctcacgacccaattacttcccaccaggccccacttccaacattgggatcacatttcaacatgagattttgaggggacacacatccaaactacagcaaatcctattgggggcagaaatgaatctgccatacataggccacacctactatgtgctgacatgatacagggagaggagtatcaggaatgactgtt

SEQ ID NO: 13190 - DNA, 1206 bp, Homo sapiens
gaggcagtgagtggcctggaaggccggatatgggggtgcacggggggtctggggccttgtcagttcctcgtcttcagtgccatccacgacctgtggaccttgcgggctctgtcacccggattcactccatcccctctgaaccctgggaggggatgcgcctttgtcttccccttgtacacatggggagactgaggcagagctcaggaagctgattgcagggtcacagctcaagggcaggtcctgggctcttcctcttgcctctccacagggtatctcacgggagctagtgcagccatgggcatggctcaggccccttggcctggtgtagtcctcacagctcctgttttctcatttgcttcctaatgtattccaccaccacccccactaacacgagctctgtctggttcccggatgagtccgtacctggctacgaggggaggaagggagcaaggtggatgatggctgggtggacaggtggacggacagatagatgggcggacgggcaggcaggtggacaggtggacgtgcagagagggagggaggaagggagcaggtggtggcgatgggcacaggcctgatcctgccctcccgcagctccctgctgaggaccgcattcctcctgctgctgctcatcagcgccacctggctgctggggctgctggctgtgaaccgcgatgcactgagctttcactacctcttcgccatcttcagcggcttacaggtaggtgacggccgagttgcccgcgggacccctgcctggccgccgtgacaccatcgctgtgatgcgaagcagtggaggcctctgcggtcccaaaccagccctgcctgggtcccgcgtgggggcctcctgtggctgtgaggactcagtcccttgtgcagccggcacgggggctggtgcctcctccccactgtgtctggggacgatgaccctagtgccaggccagcacaagtccacttgtgtctccagggaacagaagtggccatttctagtcataccaagggccacacagcaagtggacttacgacacagtggggaccccagaggggccccaaggactgtggaaggagtgcccagaagactggcctgagccggggccctcactgcctccagcacaccgggggtctggcccaggcatctcagtttctgagctcccccacctggcctccagatagcagcagtccctgaggaggggaggcctggccgtg

SEQ ID NO: 13191 - DNA, 1201 bp, Homo sapiens
caccaccaaagccatagctgaagagtgcggggcccttcctcctggggacagaaagatgtcgtcaaggagggacatgggggcctttcaccaaccaccgagaaacgggcctggcggccctccttcctcttacatgagaccctcctgtggcatttgcccttggtgccgggctggggccgggcgcagtgaccctgcctgcgctccacactcgctccacgggaacagagagggtgagaagggcccacccctcgcctgccctcagtgtctttggtggcaccttccttgctggcctccagggcgctcagcaccgcgtctgtaagggcctgcctgctgctctcggcctgacacgccggccaggaggtctgtagctggggaccagtaagggcacaggatggtgcaggtaaaagcacatctttctcacactttgctctttggaaggcccaggagaacatccgcgaaggctgttggaggtgctccgagcactgtggcatgtctggcacatggcccccaggctgcggttgcctgggttggttgggggaggaagtggggaggagtgttccgggaccatggtggcccaggctgcagccgcctttgggccatccgagaggctctggcagcccctgtgctttagggagcaaccgtgagccgagcccagaggcctgggcctgcactgcctgcagccgacatgcgacagcgttccctcccccgcgtgcctagccggtgccggtccgggcacagacccccccagcccccgccctgccccagggaagcctgggcttcccgggaacaaggtggcatttgtggagggagcgcccgcaggcctggtctgctggggccgcctgcgctgggctgaagggagggaaaggcggcttgggcctcctggaaggaggtggccaccccgcgggcctgcgtgtctgctggggcggatcccgcagctccctcagcttgtcctgagtcccttgggtgtcgttgagattgttgttttttgaagaaacagaagattctattttttacagcgagcaagctggttttcttatttttgtatcctttttcagatgtaatttttatctttgctccgatcctcatttgctggtgtgggtgagggatccggcggcatgggctggtttcacccccttcacgaggggccgcagagtcacacgctggtgccgggggtgctttggggggagctgcgccgatcaccaga

SEQ ID NO: 13192 - DNA, 1131 bp, Homo sapiens
cccgaatggggacagaacccgctctgagccgtgggtctggctcctgtaggggactggctctcttggtgcaccaggggagggggacatatcccagtgaaccccaccttggcgcctgaggcaacacagggtgggcactgacccacccccaggggcggctgcagaggcagtgcccgcagacaatggccacacctctctccccagggcccggcagtgcccaaggatgggtccggggcctcggggccaatgagcgcctcttcctaggtgctgggattcagtccccaaacacagcgggaggggtccctggggcagatggggctttaccagcgtcgggtggtttagttcgagtcccttttgtggagaaagggagatgaaaactgaccacgtgccaggtgtggccgaagcccccagggagggccacattcggggagcggggggtcgggggagggccaccgactggctctgctgccagcacaggcccctccctggaagtcctcgggagcggagcgcggatcggcacgggctctgggctccccgtggagagaagctgtagtttttaccaaattgtgtacatctgggcagatgtttaatttctgtgactaatcactgaactagacgaatgttaaattttttatgtctgaagcctgagtctattttggatctgtaaataatcattgccagtgtgacttttgttcaacaaaaggattgtactgtattaagaaccgatgaaaaaaattctcctgtaacatttttttaagaaaactttgtttgtttaaagaaaaagtattgtataaattataatttttatttaaataaacctaaaatgctttgtgctaaggctcagggctgtctgcctccttggcagggccacacgcattgtaggcggcctgagccagctgggccaccaaccccaggccctcagtgccgctgccagcccgccactccctggggccccacggctgccggcggcggggcgtttgggtactgatgcggcctgagtgacggctgtggggtgaggtggggctgagaagcagagtcctgttggacgtgggcattggaggctgggagcagggggcagggcctgagttccagaagacaggaggccaggtggcgagggacgcggcctgcagggag

SEQ ID NO: 13193 - DNA, 1152 bp, Homo sapiens
agcagccgtgtcctctcccaggccctaggacactgccagagactgtgggacatacaggcataagtgatgtgtgtgtttctgcttctgttttaaaaatccagggtcattacacacagcatggaaattagcacaaaatgctgtgcaaacgtcagatgctcccaaaccagcaaagggatgggcttgcttcacatcagatgcgggcacgccttacccctgccttccgtgtccccaccccagggtcaagggttcctcagaccagccatgcctcctcctcctgccgcctccttttctagatggggaggggattccgtcacaagaagagccgcccctcggccgtgtgcaggaagccccatgtcgctttgccgagatcagccctgggaggatccccttctccagctcagatcatgccgtgtggccagaaggctgcggacacaactgacctgcttctcgaggtggttgatgttttaaacaggaagctccacggagttcagccctgtgtgcatttcctcatgtatgtaaacgccaagactgaatgtgagaggtgttggccgcgggccttaagtctgagcagatccatctggaatgttcggggtgtgctgtctggatgtggtgcgctaaaaacacggaataaagatcagtgacaaagccgcggccttggcctgtgattcgaggacttgcccatcgaggacaggggcaccctggcccagccctgccgagggtctgagctcagggccattgcggcgcaccagcgtgggcccggcagcacccgtgatctcgctgccccccgcgggacctctcagggagatggggctgcagctgctcaggtggtgcagggatgccacttgcccgggcggggcaagactcagaaaccagtctgacccccgaagcccggctctgcactagctggaacacgggagtgtggggtccaggctggcccctgtcaggctcctgaacaagggacctccccttgggccacatctgtcaagcacctgctttgaaaagggctgttccggggtaggcaccagggtctggggtcccccccgcctctcctgggatacacttgcctcaccctcacccacacactgaaacaccctccttgccctgtgttactgaagcaaggcccttcaaagggcctcagtttctcagggcagc

SEQ ID NO: 13194 - DNA, 1128 bp, Homo sapiens
cttcgtttcaggccctccaggaggccggctggcaggagccggggagggaagaggagcctgtgttccctgtggccctgggcagcgtctgcaggaggctcaccctctctctctctttgctcctcaggtctcctgacaaacacagcccctgaggggccccgggagtggccttggctccctggagagcccacgtctcagccacagttctccactcgcctcggacttcacccgttctctgccgcccgcccactccgtttccctgtggtccgtgaaggacggcctcaggccttggcatcctgagcttcggtctgtccagccgacccgaggaggccggactcagacacataggcggggggcggcacctggcatcagcaatacgcagtctgtgggagcccggccgcgcccagcccccgccgaccgtggcgttggccctgctgtcctcagaggaggaggaggaggaggcagctccggcagccacagaaggctgcagcccagcccgcctgagacacgacgcctgccccaggggactgtcaggcacagaagcggcctcctcccgtgccccagactgtccgaattgcttttattttcttatactttcagtatactccatagaccaaagagcaaaatctatctgaacctggacgcaccctcactgtcagggtccctggggtcgcttgtgcgggcgggagggcaatggtggcagagacatgctggtggccccggcggagcggagagggcggccgtggtggaggcctccaccccaggagcaccccgcgcaccctcggaggacgggcttcggctgcgcggaggccgtggcacacctgcgggaggcagcgacggcccccacgcagacgccgggaacgcaggccgctttattcctctgtacttagatcaacttgaccgtactaaaatccctttctgttttaaccagttaaacatgcctcttctacagctccatttttgatagttggataatccagtatctgccaagagcatgttgggtctcccgtgactgctgcctcatcgataccccatttagctccagaaagcaaagaaaactcgagtaacacttgtttgaaagagatcattaaatgtattttgcaaagcctaaagttatatatttaacagttt

SEQ ID NO: 13195 - DNA, 1222 bp, Homo sapiens
ttaattctttttccccggggaggggggaggttttatttccaagttttctaggaacccatctccgtctgggcgctgtgagtggggtgggcacgtccgggcagcccagtgcgtctgtcgcacgtccccaggccgtgctgctggcgtcactttctttgatatgtagctttttcttaaagacttttgaatgtttaataattttgtaaatcatgctctttacacagagtaccacttatttaataagacgggatgtaaatttacaatgacaaatgtgtattttaagaaagaaaatgacattattttgaatggtactttgtggaaagaggggagaataaagttatgctgtgtacatcacttgcagatcaccaaaaacactccgctgcccgtgaccgccggtgggtgtgtccccgctcccgtcgtcccgcccacctcaaaccccgcaggtgtgcctcccagcggattatttattgtagaaagtgtattcatttgctttataatgaaaaatacatttgcaaaggtatattgatatgcatttttatacaggcacataaaaattcaacttggcttgggagcagaatgcattgcattgtataaatgactctggcctgtgtgtactttgattttataacttgtaatcttttgtttacaatgaggggctttctgtaacttgttttaatttagaacactttggtagcaatagaaactttggatacatttttgtatggtacctgtgatgtatatagaattagtactttatttttatttttaagaggtaaagcattatgttggggaaagtagggtgggtttccaaatttgcattttttatattaaaaataaagtcaagatttggacggtgtggccattttattcctacagccctagacggctaggtgagccccaaggacgggtggggtgctggctgcagggggcggggacacgcctttatcttgaaaactgtcatgggatggcattatttgttatttcacctgatcatatttttattttaaaacttcagttacataaaagttttaaatgctttttttaagcctacaccgtttgtaacatctccatagaaacttggaaatcaagtcttccttagatagttgctgtcctgcatctggcaggtgcttcctatctgtcgtggctctccttcccacagccagccccgcccggcaggcccctccccaccacgagcagctggtggcccccaggatcactcaccgcc

SEQ ID NO: 13196 - DNA, 1191 bp, Homo sapiens
ccgggccgcaccaaccccgcccgcgcctccctgcagccaaggcggacaaggagagcttcgagaaggcgtaccaggtgggcgccgtgctgggtagcggcggcttcggcacggtctacgcgggtagccgcatcgccgacgggctcccggtgagtcggaccgccgggcgggcccgggtttctcgcgcgccttgcgcctcgcttggcccggcctgacccccgcgtctccgcaggtggctgtgaagcacgtggtgaaggagcgggtgaccgagtggggcagcctggtaagttggggcacgggcggcggcggcggcggggggcgggcgcggggcttttgctgaccgccgtgtcccccagggcggcgcgaccgtgcccctggaggtggtgctgctgcgcaaggtgggcgcggcgggcggcgcgcgcggcgtcatccgcctgctggactggttcgagcggcccgacggcttcctgctggtgctggagcggcccgagccggcgcaggacctcttcgactttatcacggagcgcggcgccctggacgagccgctggcgcgccgcttcttcgcgcaggtgctggccgccgtgcgccactgccacagctgcggggtcgtgcaccgcgacattaaggacgaaaatctgcttgtggacctgcgctccggagagctcaagctcatcgacttcggttcgggtgcgctgctcaaggacacggtctacaccgacttcgacggtgagcgcgggcgcggggcagggaacgttccgggggccttgccggcgggttaacgcctgcaggggcggcacatggaggggctgatgactgttgggcggccgcgcgccctgggtctgctctcgtggggagcagaggcccacgcgctaccctggggagggctgagcgagggatcaagagcgggatcgtgctgggtgggggctaggggcgcgctcaatattgcttcctccatcgcgttggggggtacggggcctcttgccccggtgtgggaggcgcgtgacatccttccggcccgagagacccccggctgggggcggtagcggaggagtctccgtgcgtgacgcagggcgcagccgggctgggtctgcgccgggagcctggaggcccccgcggcgcggttggagtggcggggcctcccctgcgtgggggcgggagctgcgtgcgtgcggagcgcgggggcgcggcggcaga

SEQ ID NO: 13197 - DNA, 2019 bp, Homo sapiens
gggacggccggcccctcccccagcccccccatcgcctgccggggtttttccagggtgatgacgagcaggattttgaggcctggctctgcttcctgttactgaggccagggagttaaccagcagggacctcgccgtctgttgagcggctctgcctctgtggtgggcgtgctaagccctgtgtccccttaggcacccgagtgtacagccccccggagtggatccgctaccaccgctaccacgggcgctcggccaccgtgtggtcgctgggcgtgcttctctacgatatggtgtgtggggacatccccttcgagcaggacgaggagatcctccgaggccgcctgctcttccggaggagggtctctccaggtgcgtggtggctcgaggcgggggtgggggcctcgccctgcttgggccctccctgacctctccgctccgcacagagtgccagcagctgatccggtggtgcctgtccctgcggccctcagagcggccgtcgctggatcagattgcggcccatccctggatgctgggggctgacgggggcgtcccggagagctgtgacctgcggctgtgcaccctcgaccctgatgacgtggccagcaccacgtccagcagcgagagcttgtgaggagctgcacctgactgggagctaggggaccacctgccttggccagacctgggacgcccccagaccctgactttctcctgcgtgggccgtctcctcctgcggaagcagtgacctctgacccctggtgaccttcgctttgagtgccttttgaacgctggtcccgcgggacttggttttctcaagctctgtctgtccaaagacgctccggtcgaggtcccgcctgccctgggtggatacttgaaccccagacgcccctctgtgctgctgtgtccggaggcggccttcccatctgcctgcccacccggagctctttccgccggcgcagggtcccaagcccacctcccgccctcagtcctgcggtgtgcgtctgggcacgtcctgcacacacaatgcaagtcctggcctccgcgcccgcccgcccacgcgagccgtacccgccgccaactctgttatttatggtgtgaccccctggaggtgccctcggcccaccggggctatttattgtttaatttatttgttgaggttatttcctctgagcagtctgcctctcccaagccccaggggacagtggggaggcaggggagggggtggctgtggtccagggaccccaggccctgattcctgtgcctggcgtctgtcccggccccgcctgtcagaagatgaacatgtatagtggctaacttaaggggagtgggtgaccctgacacttccaggcactgtgcccagggtttgggttttaaattattgactttgtacagtctgcttgtgggctctgaaagctggggtggggccagagcctgagcgtttaatttattcagtacctgtgtttgtgtgaatgcggtgtgtgcaggcatcgcagatgggggttctttcagttcaaaagtgagatgtctggagatcatatttttttatacaggtatttcaattaaaatgtttttgtacatagtggataatcctgtatttatggggctgggcatcctgggggaagagaggggctctgaggaagggctttggctgctgggtgacctgacaagtttcccgtggggctggtagttttgcccacgggggaaacgggggaggcccagctgggtgccagcctccccagtgccacaggctacttcatgtggcttgtggcccaccgcactaccccgtgctgcacccagggagaagagcagctgcctcctggggtgcctctgggaggtggaggcagggagccaggccctgaggatgcagcaacccacactagtcaggaggtcattcctcggtggtcccaggaggatctctgcagcccccacccagggaggccttgccagtggaaatggccatacttgcatcctggcttggtggaaacagagacgtgcgggggggtgggggagggagtccatgctgcc

SEQ ID NO: 13198 - DNA, 1155 bp, Homo sapiens
gtgtcccatgtactggtgatatcacagtcaccctcagccgcatcagtgaagtcacagccaggcccgcccagggctggccaggcccccagagtcacagtgtctatgctctcctggcccaggggcccaggagctcttccttccctgtggccaagcggaggcagggctgtgtgggccaacaagatgctgtttccagggtgaagctctcagcacacgagggaggcatccacctgccctccacccggctgctgggttccaggtggcaggagccctttaagaggcccctcagcggcacccagacccaggagaggaacagagggcagccgtcacacccttttcttcctgatgtttccattttctattcagatggacccttggcttgaccatcatccaagggcttggtctgggggcaggcgacacacaggggcgcaggagcagagtcaggcttggaagtcaggcaggcctcacgtttgctgtgcagagccgcttttcgttcgacagaaactgtgccgggtaccaccttccccttgtgacccatcaccatctcctcgcaggtcacaaagctggtgaagaactaccggtcccacgaggccctgctgatgctgccctcacggctgttctaccacagggaactcgaggtctgtgcggaccccacagtggtgacctccttgctgggctgggagaagttgcctaagaaaggcttccctctcatcttccatggtgtgcgggtgagttgtgtcttgaatccgtaggtgaccgtgtcgggtaaggacagtatggcaggaggtccttcctcccaggtgaggctctgtcacctgcctgtggcggggcagatgttctgctggtctccagagagtgaaaagccatcgggggcttgtgccccccaagatggatgctgacttctcctgccagatgagttgtgcctggcaccaaggaggcatcacaggcaccactctcaggtggtcacagcagacaagcactgggctccaagagaagcgaagctgcccagtgagctctggagggcctggggaagctcgcagggccatgtggctggggacgccccagggccgcaggaagctcccagaggccaccaccgcctccctcccggtgcttccctcgagggttggagctgtcaggagagagcccggcagggaaggc

SEQ ID NO: 13199 - DNA, 1240 bp, Homo sapiens
aggaatctgggaccttcgcctttcggaccccaaaggtacggctccagggcaggccggctcggctgctggaccccagggccccgggtggggtggggggtcaccttcaggactgtgaggggaggggcagcagggagaccccagggaccagagcccagccaggggctcgccatgccctgtgctgctggggaagccccctctgccctctgcctccctggggacagagtggcacagagcagcgtccatggggttcccgaacttccgacacctgaaggcctcccctgctgcccttggctgggaagggacccggtggccacagggaggctgcccttgtgacccccgccccacgcccctctgtgggggcaggaagtgcagtgtgcccctgcgtgtcccccagctgtcccacgatgccaacgagacgctgcccctgcacctctacgtcaagtcttacggcaagaatatcgacagcaagctccatggtgggggccacgggcgcagtggggggcgggcaggggacgggtgggcacaaggcggtgggtggggggacaggtgggcgcagtggggagcaggtcgggggcgggcaggcacggggtgaccactgacggcagctctccccgcagtgaccctctacaactgctcctttggccgcagcgactgcagcctgtgccgggccgctaaccccgactacaggtgtgcgtggtgcgggggccagagcaggtgcgtgtatgaggccctgtgcaacaccacctccgagtgcccgccgcccgtcatcaccagggtgagcccctcgaagcctggcctacaccttccctcgtccctggcatgagcccctccctgctcacccggctctgtggtttcagatccagcctgagacgggccccctgggtgggggcatccgcatcaccatcctggggtccaatttgggcgtccaagcaggggacatccagaggatctctgtggccggccggaactgctcctttcagccggaacgttactccgtgtccacccggtgagtggacggccctggtctgggccctgtcagctgggtcagtacccacgctggggttccgggtgactgggtgggtggggaggctgagggggtgagggtgtcagggtgtggggtgggtcggggagtgcctgggccacactgcctgtcgcccgccaggatcgtgtgtgtgatcgaggctgcggagacgcctttcacggggggtgtcgaggtggacgtcttcgggaaactgggccg

SEQ ID NO: 13200 - DNA, 1268 bp, Homo sapiens
ctccccttgggtagagccaagtggacgggtctaggtttgcttgtctgacagtgtggagcgctggaaggaggaggtgacagccacttcccacccaggctctggtgcctagaaggcagctgggaggctgggcctggctggggccagctgacagtgagagtggccagggcttgggcatgggtatgtcggagcagcctgctgggcccacgtgggctgatgaccacacgggggatgcagtttatggttctgggcccctgctgcattctctcgggggtgggtactgacaggatgctggcttggtaaacactggagggcttgaaggtagggccaccggcatcttgagggacagggacgtccctcagtcctagagggcttggaagggggtgggctgtgaccagcaggctggaggcggtggtcggcacacccagagcgagctgtgtttgtccagtgctctgcccgcatacagggcttggggggctgtggacagggcctgcctccccgctgcctgtggacatgcgggtctctggcctggtgagtggccaggcgggagggcggtgggtccccgaggtgctgaggccgcctgtccctgcagatccacaagctgctgcaggtgtctgtgctggtggtggagctcctggattcaggctcctccgtgctggtgggcctggaggatggctgggacatcaccacccaggtgtgtggcgcgtggggctggggtgggccaggctcccgggctcctcgctgacctcctggcggtgctggcaggtggtatccttggtgcagctgctctcagaccccttctaccgcacgctggagggctttcgcctgctggtggagaaggagtggctgtccttcggccatcgcttcagccaccgtggagctcacaccctggccgggcagagcagcggcttcacacccgtcttcctgcagttcctggactgcgtacaccaggtgggcaggccgctgtgtgggtgggccgggactgtgcaccctgaccgctgagccctggcccctgacccacatggcgtgcaggtccacctgcagttccccatggagtttgagttcagccagttctacctcaagttcctcggctaccaccatgtgtcccgccgtttccggaccttcctgctcgactctgactatgagcgcattgagctgggtatgtggggagtcggggctggggcagccacgggtcaggaggggcccaggctcagtgctgcttctgtgcagggctgctgtatgaggagaagggggaacgcaggggccaggtg

SEQ ID NO: 13201 - DNA, 1233 bp, Homo sapiens
cagtagcagaagcaggagcctgggagcaaagcagctgccagcagttaggagtggtggtcgtgagtggtgcaggcgaggcggcaggggcccagcaaggggctggaacttggcgtctgatcacaggagcccttgagggtgctgagccaggagtgccttgtccagacagtttcagaggagctggtggccctgagtgcagaatggtgggaggggcagaaggatgggagcggggcagcttggggtgggttggggtgtggagaagctcctgggcagcctggggtggggattggcaggactggctctcacctgcactcagctcttctcccaggacaaggagctgcgcgcggtcttcctgcggctgttcgctcagctgctgcagggctatcgctggtgcctgcacgtcgtgcgcatccacccggagcctgtcatccgcttccataaggtggggtgcctggtggctgggcgtggggtaggagataagcgcatggtggagacccctgagggaccgacctccttctgtcatccaggcagccttcctgggccagcgtgggctggtagaggacgatttcctgatgaaggtgctggagggcatggcctttgctggctttgtgtcagagcgtggggtcccataccgccctacggacctgttcgatgaggtgcacctccaccctgccctcccagccccctgccctggctccgcctgaccatggcttacctaacctcctgcttaccccgctagctggtggcccacgaggtggcaaggatgcgggcggatgagaaccacccccagcgtgtcctgcgtcacgtccaggaactggcagagcagctctacaagaacgtacgagggtagcaggacgggagggcgtcgtaccgccttgatccctgggcccctgccccacacctgccgtctccccacaggagaacccgtacccagccgtggcgatgcacaaggtacagaggcccggtgagagcagccacctgcgacgggtgccccgacccttcccccggctggatgagggcaccgtgcagtggatcgtggaccaggctgcagccaagatgcagggtgcacccccagctgtgaaggccgagaggaggaccaccgtgccctcagggccccccatgagtgcgtaatgagggaggggaaggcaggccccgagcgtggcccaggatgggcgtggggtcaggggtccgagtgtgtgtattctgtccccgcagctgccatactggagcggtgca

SEQ ID NO: 13202 - DNA, 1145 bp, Homo sapiens
ctacgggcttctggcctatggcactgtgcactactttggcctggaggttgactggcagcagcgcaccatccactccagaaccagtgagtgccgacctgggggggccagagggcaggggcggaccagtcctcacacccccctcctccaccagctttcaccttccaccagttttctcagtggctgaagacactgacgctgcccactgtgtggctgggtgtggcctccctggtctgggagctgctgagtgccctgtggaggtacatggcccaggaagcagggagggggcacaggtgtgcagggccggcctgacgaccttgggtccttgcccacaggtggacccaggtgcggggctggctacggaagctcagtgctgtagtccaactgtcccttgtgggcactgcgaccgtggccttgttcctgattagcctggtgggtagcgctgcagggctgggggatgggctgggggcagggcagccctgagaacctcccacctgtctccaggtgccgtactcctacgtggagcccgggacccacgggcgcctctggaccggggcccaccgcctgtttggtgccgtggagcacctacagctggccaactcctacggcctcttccgccgcatgactgggcttggtggacggcctgaggtggtgctggagggcagttacgacggccaccactggacggtgagccctcccagggcgggcagggtggtggggcccaggtcagcgggcccagctgacctcggcctgcctggcaggagatcgagttcatgtacaagcctgggaacctgagccggccgcccccggttgtggtgccccaccagccacgcctggactggcagatgtggtttgcagccctgggcccacacacgcacagcccgtggttcacaagcctggtcttgcgcctgctgcagggcaaggagccaggtgcggagcgggcttggggggtgtggagtgggctggggtggagcggggtggggaggggaggggcagggcgggtactgtgggggccacgctgatgcctctcgctgcagtgatccgccttgtccagagccaagtggccaggtatcccttccacaagcagccgcccacctacgtccgagcccagcgctacaagtactggttctcccagcctggggagcagg

SEQ ID NO: 13203 - DNA, 1115 bp, Homo sapiens
gcctgggcaacctgtttggtggagccggtcagacccaacagtcttgggtggaagtcctggacgtagcgggccatggcttcaacgtcgtcccgctcggggtccacagtgatgaagacaggctgcactggaggcaaaccaggctctgcttccagctgccgcaccacctgcaccagcttctccagctcgtctgggcagatgtcagggcagtgagtgaagccaaagtacatcagcacccactggccccggaagtcagccttgcagcgagcccggcctctgtgatccagcaggtggaagtcgccctggcccacagctgcctggcgcagggcttctgttcgcttttgctgctgcagcctctccttctcagccctcagggccagccaggccccaccgagtccagccccgaacaggcctgtgatcagcagccgggttcgaagcccagggccctggggctggccctgcccacctgtctctgcagggccctgccttgacaaaagccaggacctcagatgcagggcctggcctcccagggtcccagggaggacccgaggcttgagctgagagagcctgtgccaagctgtggggctccgagtcagcagcagcatggatctgatgctcctggaaacaagcacaggcgtcaggagccagaagggaaggcccaggacagtgcctgggctgcccctgcgacttgagaccagccacccatctgaaggacccagcccacgttcaggcttaacaggcatttgcagctgctcacctgagctcagaactccacctccaccaaacatccacacctgggcaaccacacctgtcactcctgtcctctacctgggatcaccagcctgtcaccgcaccctgccctgcacctgcacctcagcaaggtgaacctcttgctgacggaaagcattccaagtgcatgccttgcctgaactaaccacgttatctatttgcaataaacccatttcttaaaaggaggtgggtaactctctggcttgcaatccccgagagcaaccgattcctccaacactttcctgttacctccagccacttcaaccaaccgcggccttcctccacactcccagcagaaaacctgcacgacctacccccggagctcagac

SEQ ID NO: 13204 - DNA, 1108 bp, Homo sapiens
ccctccccggagccctagatccctggcccctcctctcgcccttgccctgtgcacagaattggccccctccccaggctctgcccacagtgataccactgcagaccctgcctgccacgcctccagctctctgactgctcatgagcccccgctgctctatgacctgtccaaggaccctggtgagaactacaacctgctggggggtgtggccggggccaccccagaggtgctgcaagccctgaaacagcttcagctgctcaaggcccagttagacgcagctgtgaccttcggccccagccaggtggcccggggcgaggaccccgccctgcagatctgctgtcatcctggctgcaccccccgcccagcttgctgccattgcccagatccccatgcctgagggcccctcggctggcctgggcatgtgatggctcctcactgggagcctgtgggggaggctcaggtgtctggagggggtttgtgcctgataacgtaataacaccagtggagacttgcagatgtgacaattcgtccaatcctggggtaatgctgtgtgctggtgccggtcccctgtggtacgaatgaggaaactgaggtgcagagaggttcaggacttgtacaagatcacccagccagaaagaggttgggctgggatttgaaccctggtgtcgtggctctggaagctgccctggcgccttggtgatctgcgtgggtcagtgcacacaggcacacgtcagcctcaaggacatgggcacatctgttcacaggagcagcgccacgtgcctttgagtgccaggaacggggtgggagggtgggagggtgtgagggccagaagactcagaagatgcaaagtgcctgagagagacgggatattcccccagaagaagcattcttagagacacaggcactggacctccttggttcttataagaaacctgtctgaagctgggtgatgagttgcacactccaggtggggctaaggggcctggagcccctgctggctcctaggaaggcacagcagcaggccctgagacggctcctctggggcccctccaccctcccaggcctctgcatttcacctgtgcccacacttctgtctcctgccttcaccttt

SEQ ID NO: 13205 - DNA, 1189 bp, Homo sapiens
tttctccccacggagcccagcctggattcctgtgcctgctcgcagggaggcagagaaggtcccccgggaggagcggaagtcacccgaggacaagaagtccatgatcctcagcgtcctggacacatccctgcagcggccagctggcctcatcgttgtgcacgccaccagcaacgggcaggagcccagcaggctggggggggccgaagaggagcgcccgggcaccccggagttggccccggcccccatgcagtcagcggctgtggcagagcccctgcccagcccccgggcccagccccctggtggcaccccggcagacgccgggccaggccagggcagctcagaggaagagccagagctggtgtttgctgtgaacctgccacctgcccagctgtcgtccagcgatgaggagaccagggaggagctggcccgaattgggttggtgccaccccctgaagagtttgccaacggggtcctgctggccaccccactcgctggcccgggcccctcgcccaccacggtgcccagcccggcctcagggaagcccagcagtgagccaccccctgcccctgagtctgcagccgactctggggtggaggaggctgacacacgcagctccagcgacccccacctggagaccacaagcaccatctccacggtgtccagcatgtccaccttgagctcggagagcggggaactcactgacacccacacctccttcgctgacggacacacttttctactcgagaagccaccagtgcctcccaagcccaagctcaagtccccgctggggaaggggccggtgaccttcagggacccgctgctgaagcagtcctcggacagcgagctcatggcccagcagcaccacgccgcctctgccgggctggcctctgccgccgggcctgcccgccctcgctacctcttccagagaaggtccaagctatggggggaccccgtggagagccgggggctccctgggcctgaagacgacaaaccaactgtgatcagtgagctcagctcccgcctgcagcagctgaacaaggacacgcgttccctgggggaggaaccagttggtggcctgggcagcctgctggaccctgccaagaagtcgcccatcgcagcagctcggtgagcagggcggtgcggggagggatccgtgccttgtccgtggccccgtctgtcattcctcttg

SEQ ID NO: 13206 - DNA, 1167 bp, Homo sapiens
aacatggattcccgtgtgtcatttctaaagtgcagtaagaagatagatggaagtcacgccatctccctgcactccatctgccctcttgccttctccccaccacttccccgtctgtcctgcccctgcccagaaggatctgagcaggggcctggcttgctgctgaggctgtcacagctgccagagccctgggctgatcccataggtctttccttgaggacccgactcccaaggctccttccaaagaggagcccttcgggcccgtgggctgcatggatgctggcggcagagctggtcatcccccacccgcccccttgtctgcctttttaaagctgcttttgccttctgtgcccctaggtctcccctctcctctttgggtctgggggggtggtatgtggatgccacctcttgactcctgcttcttgctgcctggaagaccaacctagtgggccccgtactgtcagccttggaggacagagttcacagcgtagcaacgtgttcagaacttaaggactttgcaggtcttacaaaggcctggccattctaccttctttagttcaggattcaaaagacaggtaggagcttgggaagctcatgaggcctctcctaaggtcccgggatgctgcctccagctcctgtcatcctggggaattgctctggggtcctctccccttttagccttttccaactctcagccaaactggaaagccctcttcccagcagtgcagtgttgaaggtgcccgtagaatgggtgttataatcagagtgagcagcctggtcctaggcctctgtacaggaccagacccctgaggctggggtctcctgacccacacctgaccagcccccatcttccctctctgcttctccctccgctcttctctgcctcttggtcttgatgaaaatcaaagccattttaaaaagtgcatagcacagtgcctggcctggttcgggccctcaataaacatttcttaaatggatgaaagaacaaagcaaaatgcaaatgctgtgttttgtgatttgagatctagggaggtggcttaggacaaaaacccacagaaggacttactcagcgttcagactcatcaggtgtcgatcccccatggtcgggctcaggtgggcccaggtctcgtcattggctctgtcctctcctgtgaggcagctgcagcagtt

SEQ ID NO: 13207 - DNA, 2116 bp, Homo sapiens
ctgccatcacaactccactgaaagctaagccttggggcaggggcagggccagggtaggtgtccatcctgtgatacaggtccccaggccagggccactttgttggggctggtgggtggaggccaggtgcatattcctggtcctgcccctctctgggtgtccacagtcaggtccctctgagtgattctctcggagtctcctctggcaagcccctccagcagtcaccaccacctgggcacccacccccaggggaccccccgacccaacaccacctggcacctccccttgggaatccccccaaccttggctgcctccccactttggcccactgtgcaggtggatccatggaggccaggtccaatgggagcaaagacagcttattctggtggttggtgcctgtgctgaggcccacctcaggtgttcttgaagcccctttctgtttgggggcacagtgtggcctcttcaggaagttctgctctggatctgagcagctgggaggaggcagtagggacagaggctgaggagaggacagaaatgaggtcccatgggagagacagagctcagatctccacagagggctgacctctcacaggtgggagacaaaagacgaaacctgctttaaggggagccccatgcgtgtgtggggcaggcactggtgatgctgtgtggtgaggacagcctttaaggggagccccatgcctgtatggggcagggactggtgatgctgtgtggtgaggacagcacagaggttggggtggggggactcagcctgggcaggggcagggagagggggtgggagggccactggagaggggcccggccaaagaggatgtcaggggctcagcacccccaggcggccaggcacctgccgagcactgcagccacgcttgtggttcacctgcacttggagactctcgcacaggcgcctctcctccaccagcagctccagctttgtccctcccacagcagctgggccctctgcacctgagttcctccctccacacctggctgcccattgtgtggttgcagctgtgggtcgcgtgggcctggccggctaactctctctctcattgctctctcctgcccatctgcatgtggctgctctgtcgagctgcgccgtggtcccgagcgccggctgtgtaagtgagcatgcccatcccatgcctcttgccgtccacacgctgtgcctgtctgcctgggtctctgctctgcgtggctgtgagaggctctggtgccactgacagccccttgaggcttcccctgacacagtggggatagggatgggaatgggaggacatgggagtgggttttctctggagctatcaccccaggtaggcctcccaccacggcagagccaaggaggggctagagctctagggtcctgtcaggtgaggctgggaagtgagctgccatcggttcttgtgtgtgtgcgtgcgtgcatgtgtgcgtgttgcgtgtctgcgtgtgtgtgctgctgccaccgcagcatgtctgtaacgcgtgtgggcaccgttgctgctgttgtgtgccgtctgtgcaggaggctgcctttgtgttgagggtgtgcacggcctcacacctgccctgcatgtgctgctgctccatacgggtacgagccctgcctagtgtctgtctcctgtgtcacggacctgttcaacctcgtgctgctgccagcctttatcgcgactcagctgtccctggaacctgcccaggatcccctgggtcttctcatgagagcagagctgtgtggggggtgggcggtgaagggtactgcccaagtctcagcgtcccgggtatctgtggatcccgccatgcccagagccggtgtcggaggctggcaggagggagaagcccgccctttgccatgagaggctgtcttttctttggttgggctgcacttggagcctggatggagtggagggggccaccagtcattcctcatattccagccagtcgctggctctggtcccaggggccaaagaaaagggccagggtaaccgtaggatcccaccctttatttcttcctctggccgggctactcccgccagccgcagccccagcccgtttcctcctggaccctgcccgctcccctccgcccgtccccccttggctgtgcgc

SEQ ID NO: 13208 - DNA, 1207 bp, Homo sapiens
cacatactgaagcatagcttgctagaacaaatcctgtacatatgaatgccagcaactggggacacatttagtattcacattttatgcaaacttacttggtcaattatttcttttttaagcacaggtttattttggaattcagataagaactgacacatcatagacagtcattgttaaggtaaccctgttatttcaattgcaaacaaacaataaacgttttttcttcaagacagttaccactttttaagatcttagtactaccctatgcaaaaacagttttttttaaaagcctgaacaggttaagatagataatagccaactatgttttctcaggtgaaactattccaaaagaactgtacatttcagtgatataaatcagatccagaaaggtggatctctgtttagttcttgaaatatataattcacaaaataagacccttgttgttctacagaggtcccctaaactgtcttttattctggtgtagtctctaaaacctcattaagagggaggggagaaaatttagtcttaccagaaatgctctgctttttagtagccatcagttttaggtcttctttatgtaactcagaagttcatctttttccatttggtaaccactttttttccactgttctcgcaactgttgtaatagagccccaatttcttttcctgaagaaatgcccacttttctgatgtcatggccacttacaggaaatggaggaatggaccactgctgcatttcctttaggagacagtgctctccttggtacttcagtagttcacatacacgagtagttgcatcaggttccctagactacgtgtcaaaatcaaacatttagtttcgtcacacatgaaaacatacacttacaatcttatcctaaaatttaaatactcaacataaattttttcatttaaaataagtaaaattcacagatttgtagatcttagttttaataaattaattctaaattcgtgacgatacttcatatttctgaccaagcctagtatatacttacatctataatgaagtcttgatagggtttcaatgggtctgaactatctgttgctttaattaaatctttcctatttttaactataaataagccaaggtttttctcctcttttgcgatcttcaacctcaaatccaattttgtgacatcatcttgtactttgaataatgaggccaaaagagtcactggctttggtgaa

SEQ ID NO: 13209 - DNA, 1208 bp, Homo sapiens
tgaaaacttcctgtgtcattaaatactatgtaaagacatgactttcaatggctgcttacttttctattatatggatgtgcctaaacttaggcaatcattggttgttacatttttcttttttgctgttatatctaatgctgaacatctttgtactatatccgtgttacatttataaggtgaaggacgttggaaaatatgtggttagttcttgaatgtgctgccctttttaaagcatacatgttaagtatccatacaggcagggttgtggggaagcactgtctacagccggtgcaatatgcatctgatgggttagagccttcagctgagagtcccagtagcacttaccttgctctttctctctacacagtcttattgttacaggtatcgctgtgctgctcggagccagaacacacctgatagctctgcttcgaatctgggattccgctgtgcagccgaccgcctgcccactatggactgacaaccaaggaaagtcttccccagtccaaggagcagtcgtgtctgacctacattgggcttttctcagaactttgaacgatcccatgcaaagaattcccaccctgaggtgggttacatacctgcccaatggccaaaggaaccgccttgtgagaccaaattgctgacctgggtcagtgcatgtgctttatggtgtggtgcatctttggagatcatcaccatattttacttttgagagtctttaaagaggaaggggagtggagggaaccctgagctaggcttcaggaggcccgcgtcctacgcaggctctgccacaggggttagaccccaggtccgacgcttgaccttcctgggcctcaagtgccctcccctatcaaatgaagggatggacagcatgacctctgggtgtctctccaactcaccagttctaaaaagggtatcagattctattgtgacttcatagtgagaatttattatagattattttttagctattttttccatgtgtgaaccttgagtgatactaatcatgtaaagtaagagttctcttatgtattattttcggaagaggggtgtggtgactcctttatattcgtactgcactttgtttttccaaggaaatcagtgtcttttacgttgttatgatgaatcccacatggggccggtgatggtatgctgaagttcagccgttgaacacataggaatgtctgtggggtgactctactgtgctttat

SEQ ID NO: 13210 - DNA, 1139 bp, Homo sapiens
caccttttgtaggtgcaacctttcgtaggcaccgcatatttctgaagctttacaattgaaggaaggactaattgagaatactgtcagggagtcatctaagtgcctggtacacagtgtccccactgagagctgtagttttttagaaacctttgcgtacgctggttcaaagttgggaggctgggagctttgtgtgttttaccccagagcaaactcttcccagggtctcggcaatgatgccaggtcattccattttaagcgatatctctgaaactgtcccacttgttgttgaagccataatcccctgcttattctggaagacgtgaccttagtcttatggatttggcttgatggagtcaacagaaatgccacatactgaaggaattttgttttacgtttttaatgcattataatcccctttgcctccctgcccgccaccaccctctgcaatctttttccagctatagttcctagttttctgagactgatttctttcattctactagattttgattcggcttagcaaactctgtgttcaagagagtgcctcagtgagaaagagcaggaagcagcaacagcgtctgctccggaacatgggcgcgcacgccgtggtgctggagctgctgcagattccctatgagaaggtgagcggtgcctcatgcacagcagctgctctcaggatggggcggatccctgggtttccccaaactcttcacatctggatattgttagtgaagaaatgcatccagtgtgactattgtgactacaaagcaatttcaggtattgatatgaaacagagcatctgaaaaataaagtaaaatcacccgtgaataatcctcatccccagttttaagattctgtaaagaaagagagtccatttattctccatactcccaagacatattggatagagacaacttggtctgtgtcagagcttagagctatatctacccatgagttggtgtgtttcaatttcatttgcaatgtgactcaaccaatttaagtatcaccagctattaagtgcatgtaggaacatgggatgtgcccacttttgaagtcctcagtaagacgctgacatctgcttaagtatttggatttatcaggtgatgctttgatctaggtcttcttttctgttgctggaa

SEQ ID NO: 13211 - DNA, 1150 bp, Homo sapiens
gggtttgactgatgtttgtctcatgcttagactggagttctccttttttaagacgaagaaagaagcacctatccagaaagaggagtttatgccattgtgaatgctacctttaggattatgtttgggataacccagcatttttgtagattgttgaacaaacctgaaaaataactagcaaatgattcattggccaaacgagttccctgtcttgattattcttaaaatacacacacacctcagtgaccctaagaagccattcattgaggaaacccattgaactttaactctgacatgccctggccttatgacctgagagcattttaacattcctaagaactgcttccccccagaattcacactgggaaaccctgacctaaaagatggtaaagttgacttgagcttctcagtctttaagctcaataccaggcaagctggcccattctgggtgtgaaaaacctgctggatggggactagggcattacgtccatctgtagggtgtcccccataaaagttgtaggctcacgactcatctttctcctgtgcagccaagagccgggccattgccattcccgtggacctggacagccaagtcaacaacctctttctcaagtcccacagcattgtgcagaaaacagccatgaactggcggctctcagcccgcaatgccgcacgcagggactctgttctggcagcttccagagactaccggaatatcattgagagattgcaggtaatgcctggtgttgagagaagtgatgcttagcctggcctcacgtgattgccacacacagcagtgcatccttgagccacagagcatctaagctgggccgtgggaagatgtcggtgtgctgaacgaatagtcaaatgttatatatgtagggccaggagtgggaagttacttaggaatagaaaagttcctgaaaagtgatggtctttaaaggttactcctagatttgcagatttcttggtgaaaaattgggactctgctcttattagaaggaagtattgaagtattacagaggatgtttagagtaagagcataaatgttccattttccccatcactctggggttatttagcctcttgaatcagcaggtgaacaagggtggtgatacctgagagaagaattttacatcagaatgagccagat

SEQ ID NO: 13212 - DNA, 1176 bp, Homo sapiens
tacaggtgtgagccaacatacccagccctcacctagactttcttccctcttcacgtgttcttctttgacagctgtgtcacagaaaccgcttctacccttgttgaaagaagaaactgtgaaatgccaggacaataggtgtgcagggggtggtgaacttgacatacatgaaatagttaaagaatgggcaggaccggtcgggcagcttgactcggcagtgtgtataatcattactttgtgatcatttttatagtcgccatctgcttactaataatgtttttaaaacaggaccttaattcaacctctagagattgcttgtgttaaattatttggtctatctcacaactggtgagaacttttcaaagaaaattttttaattcatttacacagacttgaatgtttaaattagaggaacatatcatcacttttattttagtcacagtttccttctcttgttttgatgtgctgtttgactttttgccttgccaacccagattcaactgtcttcaaaatatcttcagctatcatttaaaaaatcagctttcttttctttagataattctgcaacatgaagaattaaaacaatattgtctagctgtgctgttgactcttgcgcaatcttcaggaagctaaatcattttcatgtggctgcttaggttttagagcaaggttcccataagcatgtgctcttttttggagaatgaatgatgataactctgtctgtttttctttcctattcttcgtgatatagaaaatataagctgtacagaggatataaattactaagagtctatatgcctttaaaaatgcatctcctagtcaaaaggtttgtataatttttgttgaacagtacagtttaggaaaagaaactataaatctataaaactgatatctatcaaaatattttctatgagttctaattttttcttgtccatctgttgccacaaacttacaaatgagaaatagcaattattatgaaagcacaaaaaccaaagagtgcttccttccagttttggaataggttatattattttgtatgtcttcatctaaggatgtaaaatatcattggaaacctcaatgactctatgaggtagataattttgtattgttttacagataaagataatgacatattaagaggttaattaagtcctgggatcatattgtcacacccaaagg

SEQ ID NO: 13213 - DNA, 1431 bp, Homo sapiens
cctaaaaagcaacaaaaaagtttttgtgaatgctgcaagattgttgcattgtgtatactgagataatctgaggcatggagagcagattcagggtgtgtgtgtgtgtgtgtgtgtgtgtatgtgcgtgtgcgtgcacatgtgtgcctgcgtgttggtataggactttaaagctccttttggcatagggaagtcacgaaggattgcttgacatcaggagacttgggggggattgtagcagacgtctgggcttttccccacccagagaatagcccccttcgatacacatcagctggattttcaaaagcttcaaagtcttggtctgtgagtcactcttcagtttgggagctgggtctgtggctttgatcagaaggtactttcaaaagagggctttccagggctcagctcccaaccagctgttaggaccccacccttttgcctttattgtcgacgtgactcaccagacgtcggggagagagagcagtcagaccgagctttctgctaacatggggaggtagcaggcactggcatagcacggtagtggtttggggaggtttccgcaggtctgctccccacccctgcctcggaagaataaagagaatgtagttccctactcaggctttcgtagtgattagcttactaaggaactgaaaatgggccccttgtacaagctgagctgccccggagggagggaggagttccctgggcttctggcacctgtttctaggcctaaccattagtacttactgtgcagggaaccaaaccaaggtctgagaaatgcggacaccccgagcgagcaccccaaagtgcacaaagctgagtaaaaagctgcccccttcaaacagaactagactcagttttcaattccatcctaaaactccttttaaccaagcttagcttctcaaaggcctaaccaagccttggcaccgccagatcctttctgtaggctaattcctcttgcccaacggcatatggagtgtccttattgctaaaaaggattccgtctccttcaaagaagttttatttttggtccagagtacttgttttcccgatgtgtccagccagctccgcagcagcttttcaaaatgcactatgcctgattgctgatcgtgttttaactttttcttttcctgtttttattttggtattaagtcgttgcctttatttgtaaagctgttataaatatatattatataaatatattaaaaaggaaaatgtttcagatgtttatttgtataattacttgattcacacagtgagaaaaaatgaatgtattcctgtttttgaagagaagaataattttttttttctctagggagaggtacagtgtttatattttggagccttcctgaaggtgtaaaattgtaaatatttttatctatgagtaaatgttaagtagttgttttaaaatacttaataaaataattcttttcc

SEQ ID NO: 13214 - DNA, 3063 bp, Homo sapiens
acattcttttgctgttttttttttttaacctggagttctgtggggtggcccccaagccccgggaattactgcatcttttctgtgtattatacttaaaagcgccttgagggcaaacaggggttattcctttttttttttttttttttttgccttcctggcaatttgcatgcaacacctgattgattgtgtgggcaacacataaaaggtggcaccagccgtcctatacacaacttaatttttaaatcagaaaacgcttcagtctctgataattcctcatattctcttgaagttcgggtaatggagtatggtaatgcagatgcagaaaagcagcagaggtcaggcatagtgtgtgccttgaattagctgccttttaaatattgtctctgtttgatgtttagttttttaactttaatgtcttcacttttcccctctatctttagatatcacacttcagtggcttattcagcattcaaaatctagaagaagctgaagcatctcctgaagtcttccagtccttcttggctataatcctagaattattgtccgttcctctgaagtaattcccagaatacggtccttcctaaaccccagaaattgcctttttcagagtttatttctcatgtgcactgctgaagatgaatatccctaatccttcataaagaatcagctagagttgtcatgataaagtcagcacacacaaaaaggcttcttacacatacctgtcttaaaccatgtgtagagctttaaaaacagaaaaaaaaccccatatacttatgaccatcttaaatcaagaaaattgcatatttccattctggtctttctgggccagatttttatattggttttcagtaaatgtctatctataatatttcattatagagtccagtagcttaatactgacactgacttgatacagcatgaagtttctagtgccacacacagtatttagaaaacctttaggcgtgaatgactcatgtgggatatatgtaaacataatgtttattttatctcacaaatgcatgtgaaatgtataattacatcttaggaatccaaaatggtctgcagagagtgagcggaggcaccagatcaatgttggttctttgcactggtgagattctgcctgatgaatattaaagatatcctgctttctgagaactctatcaccagatggcagttgggatatgggaggaactaaagcatcctgttttgtatctgtccagatcattatttctgtctcttgttttttcttcctggttcaggatacttttttaaggggttgagaattgaagattttccaaaagcgttcatgaatttagagcattccacccaatataataaaacctgttaagaatgtcagtctttgttcaaacatctgtttgttctatctccagtcattaaatcagtgctgctgcatgacactcttaactcctgactttttatatccagtcataaagttgactttcagcacaaaagatacttataaacaaataaaaaatttttatttttctctcttactgatgtaagctttggcactcttttgactggtgccattagacatcttgattattgtgacaactctagacctgcctgctttatctaatgtaatcatgctcaatgtctacaggttgtttaataatcagtcacacagagaactgaggaactgatgctgtttgtttgcttctatgatacagagatgtctaaaaacttcaaatggacatgttttgtagtttagcgacttccgtatacataaagggacatattaatactggttcatttgtaaattattattcatatagaccactgtagtagataaaactctatggtacacctgcttatgtgttgcctcacactgtgtgtgattttgtttcttttgttaagcagcacttatgtagactgcatttccaaatgtgttgagcactcagagtgtagtcaacagtaagttcttttaatgaatatcagttttaatttatagactgccatggccttaaaaatattctgtacaatatactgcactgtgttgcacagacactacttgcttttctccattcatatttttatgagtagaatctgggcttttaaatttctcttcttattctttgaagcatgttgcatactaccctggtgggatggatggttctgtaaatgaagggatatttaaacttgctactgttgttcaacaccattaatggtcagtgtgaaccattacaaagaatgtggcaacttgcttgtgcctaaaaggaggaattggaactagaatgtgtgactctgtggggactgcataggtttgttaattgacctatagctaaaccttaatgtgtttgtgtgtctatacattgctttccgcatttcaagacatccagacgctattaccaacattttcctgtgcattaacctctgcatgtgaaaacttttaacagttactgaactatgtaaatatgtgaatttttttatttaggtggatgcattttttgtctgtttactgctcttctcagctttattcaataaacttgcattttaagggttgtattggcaattttaacttaaaatgtgcatcatgatggaaggtgcagacttttttggaagtttccgagaggagggtctatagaccatttgtcagaaatcagatcagccctcaaagaatggggtctgtgggctagttaaaatagaaataaacttttaaaatatccacagaattgatattgtgattttttgggggcgggggaaatgctactacttgtcaacggtcacaatacaccaaatttaggactttaagtggcaagtgctagtaaaacattttatgtcccagtttttacaaatcaaaccaagaccctgctaagcaaatgaagttgcaagacatgcctattcactgacttcagttcagaatggaaatattttaagtaccgaacatgctggttttcccacaaaggcacatttttagcataaagctttttgctagtttggtatcatctgcccataaaataagtcaatacttgagctattggaaaaataattgtgtatatttttatttgtttagaaaggttcagttagcattttctccatacg

SEQ ID NO: 13215 - DNA, 1129 bp, Homo sapiens
atttatttttgcttttcaaagccacaaactaaattgagcagtaatccccaagggtcttgctctgatgcatttctccaggcccatgctgtaggacattactagagaagagactctttgtaccaaaagaaccaagcttttctgctcaggtgaaatccagcataggcccatactatatactgaattctcttatgtggcagggctcttaaacccaaagctcaaagtgctttctgcagaatactgtgaaatcctgacatattacaatggctgcgttaggaactttgatcctgtggaaaatattatcttctgctagagtctaatgtagataattaaaggcagtctgtctgcagaggtttaaggaatgagttaggagaaaaaattaatgttaattccgtttaaatgaaactaccagcagctgctggagaggtagagatctgtcagtgagctttcttttcaccactgaatgtgctgcttgggtttgcaggcgggaagcctgcaatgaaggagaaggagaccctccactctatgtcaacgtgaacatgttcagtgggcagctgatgaacacctggattgactctctgcaggcctttttccctggactgcaggtattttgccatcagatttcctaagaataaccaatcaccagaaagggcttctccctccttttctttcttttttaataccctgagcattctctgtctcctttggatttgggaggtcactgacactatacgtcttcatctctctgtttgagaaattagtctccagaatattgaacagagccattccacacaagtgcaaaaccgtgcttgagaagtgactgtgtgtgatttttgtttttgtttgtttttgttttgagatgaagtcttcctctgttgctcaggctggagtgcagtggcgcaatcttggctcactgcaacctccgcctcctgggttcaagagattctcctgcctcagcctccagggtagctgggattacaggcgcctgccaccacatccggctaattttttgtacttttagtagagacggggtttcactgtgttgtccaggctggtctcgaactccaggccttaggtgatctgcccgcctcagcctctcaaagtgctgggattactggcatgaggcactgtg

SEQ ID NO: 13216 - DNA, 2484 bp, Homo sapiens
aaagagtattttcagtaataaacgtgccatctctatctcttaaacatttattacaacaattgttttaaaatagaaaaaataaaatgcttctattttaccttttttcatttcagaagcattattctgtttattaacagtgtcccatctactgaatagaaaactttgagaataatatatatatatattttaaatgttttcactgactcattgaaaatgttaattacacacacatgcatgcatgcacacacgagcatacttgtacctttgtctctgggcaaacaggtgggactgttagtgacccatttgggaaaatagagcatctcagagaaggaggtgagttcttcctgcctgtgatttctcttggcgctcccctcctctcccgctctggcttctgtggcggcagtggtgggtaagcactccagtgttctcttaatgaggcactttgcctgtcactcgagcaagcctgggtgttccttcctcctcatgctcctggaatagggaatagggatctcatgcttgcaaactacacaatgctgcaggtgcttcccaggggccacaggctgtcaggaaacgtgttttatgttaagtcacaaacccacttgacttctgggtactggaattaataccagtgggtgagactgagggtgagtgagttagtacatattaatcctggttgttgagcttccagactaccccgtccaaagtttgatgctatgtagtcagtggtttgtggggctggatgccagaaggttctttgagccagtttcaaaggttacttgttttttttttttttttttaaagtcagaatgttaacagctgtgatatatcctgcagggcttttgcagtttcttctgttctgtgttctgaaatactgggtagagaatggctgaggaggagattaccagagaagttgctttgctcagtgctttgccccaggattgcctcaaatctgagtggacttcatcctttgcggcggctctgagcctggcccatcttcctattcccacgtgtagctagtgtctagtgtcagctttgctcagtgtggtggaaacattttgcagaactgttgtagaaagctgccttatagttggcttgacaaagcataattctctcataacaaactttcaaatcattacagtagcttagctactttagttgatgtgaccgaggaatcccttctagaatcataggtggcaagggagggtttgctagctctccatttgcactggccattgtgaaaaaccagcttctgtattcaaatctttccttcatttttttaaattttttttttggcagcgcttgtgctggaacttactcattgtaactgaatcctcagggcttttcttgttttagatcatggactgtgcacgtgacacttaaataattttctatgtatttaaagaaaaatgcaccaggatggtgtctgtgcacgtgactattagaggagcgtctgtagaagtacctggtttggtcagtgcagttgtgcaatctgagggccttgtttcctcctcccctttccccttctccccaccaaaggaaaatatccctcttaatgatttcgtagttcagtttactgaatgattaccacctgtaattcctctttggattgtgtagactcaacatgagacattcctttctgctttctggagggcaccaggggcctttctctttgataaattttttttgtctgttgacaaaaacaaaaatcttttttcaaatgtagtgctggtgaaaaggtagggctgagtgattaccttagccacagggtggctgagcaggaactttagaagaaaatcctgagctttcctgtccattcccagcatccagctcctattctagtgcctcttccctgcagggcagggaccccttgggaaatcgaggaggtgggacgggctgggccctgtgtcccaggtttcacagggctcagggttatgctcccgcttgaatctggacgtgaatctggtaaaaatatcaagtacctgtggaactccctgattctataccctcttccttctttctgcaaggcagaggaataatatttttaaaggttattttgttttagttttaaatagcaaaacacaagctgcatttttatttattttgcataagaaaggtaaatctttttacaaaaaaaagtatagagttggaaactctgggaaaacttacggaaatacacaaatgcttctctgtaatgtgcaatatgctttgcaactgtagatgatattttatgtttaatctgtaaataagaaatgtatttaaattaaaagggatctttttgtaaaaggaccaaatgttcttttataaatgtaataaggaatatcttgctctttaaaatttattaggatttttatgagtaatttttattaaaagatttctttttttgagttgtcatcttgtttcttttttacattctcatgtacattacattacatgcaagacaaatgggagaaaagtctctaaaggaagtgcccatctagatgaata

SEQ ID NO: 13217 - DNA, 1119 bp, Homo sapiens
ttgaaaatctgaaattggaaatactctgaaattggaaactttttgagtgctgatatgacactcaaaccctcactggagcattttggatttcagattttttggattagggatgcttaactggtaagtatgatgcaaatattccaaaatgcaaaatctgaaacacttctggtcccaagcattttagataagggatactcaacttgtatttaagatctctgaggagaatggctaagaaatacttttatagtgtttcacacccagtctttggatagcagctggatacattttctggcaagattctagagctgctcttactctagtgctttccaaagaagccagctggcttggtgtcaaatgaatagacagcaaggctgacatgctattgtaaatgtcttttcttgaatggggttcaggtaggcagcaagcagggagttttttttggtccccataatataactttggaattacaagcacacaattgaaaccccaggattccacatgatgtttatttccatttgggtcacataagaactgcatcacagtcttaaaagaattgtatcatatcttttatgtaatagctgattttgagcagccctgactctcatgcctaataagtcttcactgcaaaatgcactttctagggaacattattgaatgagctattttaatataactatttgaattttaaagagtatctactgaaaacattttggcaacataaatattgaatttctgaaagcatgacatctacatagaatcatttgttttctatttgcaatacgtggtattgtgttacttaggttaaaaacctaaagaagggggtggggctaagagaacctatggtggcacaatgtaaggcccaaatctgattgtcaagagactgaccttacccactttgtcacagttttgtagaaatacaggcttcatggaagcatatttgtctaaatgtatttggggaccattgctgatttctatccagaaagggaaaatagttgaacaaatgctaaaagtcataacctggtcaggggctggtttttgttttttttctagcaaagtaaaagaatatcgtagtgatgaactgtgggatagttctgttttaaaccagctaagctcgtcctt

SEQ ID NO: 13218 - DNA, 1231 bp, Homo sapiens
agtgtaatgacctccttgagcacatttttgttaagcatctaattgccataaagctgagccaggtagagaacctgctataatcaggtgaaatgaattaaaactcactaagaagttcctgtttatggaattgcttaagtcattggtacttttatgtagcttgaattttagcccactagaatttctagcatgctttaaagaggtggaaaattgaataggtctatgtaagtgtgattctaagtgaagtcctcacagcatattccacaagcgttacatatatgtcttctaagtgtgcctctttaggtctgacctctttttgagacccaagtctctcacttctggtgccacctaggcccctgtgtctgaatgtcttaccagcacctcagatacatcatgtcagacactcaactttatccacaaacttgatttttctctcccctttttaatctaatggttctactattttcccggtcacccaggtgttgaatcagaatttatttgccattttacatgaaaagcatttgataattcacaataatcatcaggtatcttccccccttttcagttctgttcacaaaaggaagccgctgcccaaaactgtatataatttgctctctgatcgtgatttaaagaaaaagctaaaagagcatggattatctattcaaggaaataaacaacagctcattaaaaggcaccaagaatttgtacacatgtacaatgcccaatgcgatgctttgcatcctaaatcaggtaaagtaataaaacagtgagttatgcttactttctggataaagcaattttgtgtagctcagaaattataaaccatagaaaaatattgtaaataaatacatttttgatagataagacgtgcaaatgtgttccttcaaaaggtacctagagtatgctatgataagccagccttcctctcagcctgccttccaatccccagatcccttctcagaggcaccccattgccagtttctcatgtgcctatctagggagaatgtggtggggaagagtggatctggagagcctgggttacagtgcccgtttttcagctttgtggcttggtgactgtgggcacgttacttgatatctctgtacctcagttttctccttcataaaataagggttataataactacccacttcataatgttgagtgaaataaatgataaaaggcatgaaaagtgcctaacacagtaccttagcaagtagttagctttcagtaaat

SEQ ID NO: 13219 - DNA, 3371 bp, Homo sapiens
acaatgcgtttgtgattatcattagtaaggtaagtcttagatcagagccctccagcccttctttttgaaacctcccaatggcatttcagaagtgagcagtggaattttcctgccatcctaataagagccctggattccatcattaacatttcagcccattggatgaagtggtgccctctcctctggtcccccgcgaaaaggtaaatacacccaaagggagggacctagttaagtcactggcacctagataagttaggagggtaaagccactacctcgtctgaaggactggacttgacaccccacagtggaagggagcatcaggagaggaacaaaaaaagggatctcagggagaggccagtgtcaaacttgacctcccttgtttggcctagaatgaacccttctctttagctcctggatatgaaaggccatctgcttggagcacagaaagatattgccattttacagcttaagagagtaaggccttgggctgtgctgtgacctgcccaagatttgacactggctaggagcagaggctgcgtcaggctcttaaagtcatgtgtttgcatgctggatgctatactgtccagccaggacacaagacttctgatttctaccctcaagatactcccagatcctaaatccagtagcctcccaggcaaaatatagcaatctgccacaactgccagatgaaaagcaacaatcagagtagaaaaatctgttgcctgatatacataacaccaatcagaccgtgtggatttttctctgaattgactgattttgtttttttcttactgaaaatggacctgcctttcactgaattttctgagggcagagtcttagctgttttctttaagcaccttttttttttttttccattgggaaatggctgatgagttcacatttagggatgtacacacacagatggcagacgtctccccactcatccagccccagatctgagccttgacgcaggccaagtggaaaaatactttcccgcccccctcccctgttcccacttcctcatctggcactatgcatgtctcactcaccctccacagcactcagtcccatcgacgttcactgaacattggctttctctttctgactcctgcctgttttagtccactatatattgctgtatttgcttaaatgctggaaagtaactgttaaaatgtgaaattgtaatttttaaaaaggctacaattaaattttagccaatgccactcaccaaatctttgcacctagtagatagatcaatgtaaaaacaaatacctaactgtacagtgagtgtgggggaaatgtagtaacctagttagtagtcttcaatataaccaattgtacaaggggaagtggtgtttacctacttgttcatcaccattattgaaagccgtactgatcagttagttgacaacgggcatttttttttctttgcttcatggaatgatttcttttcttaaccttcgacttatcctgaggtcaagccttttgtctttatgtgtaaccgacgttcagtctattctaggaatgaaccagcaagttgttcatttaaaactgaccaaagacaattaattcctggtctagtttcctgggccttgtggctcagctgccactaaagagctttttggataaaattgagaacaagctgtgcttcctaccccactctccccgtccccttttattcccttttcctcttaaagagctgctctgagctgtgggattctatgaaaaattcttgcctttccttgtttcagtgctaacgatttctcacctcgaagcgccttttgaaccccggacagagtgcacaatcggagggaattgcgagcttgggaattagactttggagtcttttctctgaagtcaccaggccaggggtcaggagagagatggattcccaagggatgaaaggtttctattcaatgaagaaatcggagtgggaagagacacagggaaattgagccatattttggctatcggctggaaccagcagttcagagatctgccttataaacatttaaaaccggtttgtggtacacaaagaggaaccagtgtgggaaggggcctttatgtggggctttcttctctgttggagtcccttggagtgccttgttgggtatatttctctgtcattcaggaggcacgaatgtggaggacttctcgtgacctggtcgtgatgtggcattcagtgcatgtccacagctaatggaaaaacacgaggactcgggtaatggttcttcctctcagtctttctattcctaacttttcacacatccagatggttccacactagtgcaaatgcctcactctcctgagaaacccagaaagaagagtggctggctcacaaccatggggttagcccctgctgggctgggagtcggggtggcggccaggaggaaaggcagaaaggggtgagccgaggtgttgcctagctgattttctgctgtgcagagctaatgctgacatttcatgtcaacttccccggttctctggggtctcctctcctctgagcagccacatagaacattccccacatatccaaagctgcccaggggagccgagagaagggactttgctgtcaggtccaagccctcctgacctccctgagattgatctgccagtgtcctgctgtccctctgggactggccacatggccatcgctgccccttgttgacacctcctttctgtgtgagttgtccccggccaataacaaagctgttccttgaaccagaacaaccagagtgcacttttccttccttagacggaagtagatcctggctagggtttctgcccaggcccttgttcccggcagtgtgactgtttacatggtttggcaataggtttgattctgattgcttcagagtggctggtctattttgtttcctttggtttccttcctccccaaattgtgacaggaaaaacagaccaaaaccaccctaggaaattgctggttgcctgtccccacgtgatgataaatgttgccctcttctggatatcgtttctctaccttacgaccaaacgcccgtcctatagagtgtctgattggatcctctgtcgcgtattctgatggtgcctgctggtttgacgtggagctatcctgtgaaataaaacagcttaacttttctcaaacatgctccagtggtttttgaaagggcgaggtggcacatcaggggtggagaggtcctggggggagtccccatcctccagtccacactgtctgcctgcttcccccaggaaacacctttgaaatgtccattagctcagatccaacaagatgaaggtaaggttacaaggaggaccacttccattgtagagctaactgaagaaggtaactaactgtaggatgactgctggggaaagagggtttggaaatgtc

SEQ ID NO: 13220 - DNA, 1342 bp, Homo sapiens
ccggccgtgacgcccaccgagaagatgttccccaacagctcagcggacaagtcgggcaccatgtgacctgcaggatgggccgcgccgccgtggcccgctgtggctcaccacggcccagggtggccttggtggcttccacgtgcttcccagtgaccctggccttggagggcagaggtccgtctgggagggtgtgtctgtgcagagctgaggcccgggcgctggctgcagctcacgtccagccatgggaatcccacggacctctcgcgtgtcaacagacgaccagaggagtgctggagctccagcagccccaaccacagcattccctaacatggaggcaaaataccacatggcttctcccgcatatcgtcactggaaacttcctctctcgacattctctctacatacgtatatgtgtgtgtatatcgatgtgtgcatatatacacatgtatacgtatgtacgtgtctgtaggtgtgtgtatatatatatatatttatgcatctatatacatatactagatctggacacacgcatactaagtgtatatagtatctcctttttctttttatgaaacttagatttacctcagatccatgccaccaaacatctcccaccgagttatttggtgggatttgcagggacttttctgggagaacttaaaggcccatagtaactgcgaatgaagcaatataccactaacctgcagaaaaacacaaacaaaaacagactcccactgtctccagaagtcgtggccttccagaacagtctgcccctcaaggaagggtggggcaggcagtacccccaagcaggctgctcccagaggtggggaacccttcataggaaatccccacccccgtccaccccagagaccctgcccttccacccggaggccaaaggccaactgtactcccaaaggcatgggagaaggttggcgagaagacccctgactaccacatccttgtgtttgtgtgtagagacgggggatagtgagaacctaagccccatcgtagcacagtattacatgtggttgggaaaaataaaaatacagtggtgtggaatactccaaaacctagaaatgctgtaggaataaatctgtggtaactatagaggtttaacttatatcattttcaaactatttaattttttcttttcctggttctactaattatactgtgtcagatttggaactaaacaggcaaggaggctttgagtcacatcgttttcattttaaatcaggctgtgatgcactgtggctggtgccgtcttgcatgaaacgcatgagccgtgagcgcccagttcagactggggccagggaggggcagtccttggcactttctgtcctag

SEQ ID NO: 13221 - DNA, 1095 bp, Homo sapiens
acggataccaactgtccataagcaaagtagaggtttatttgtttgattatagtggtgagaaatgaatgaatttctttctctgtcctttacaggaagaagttctaaaggattttgaagacttggctggaaaactcccatggtcaaaccccttaaaagtgtggaaaattaatgccagttttaaaaagaaaaaagcaaagcgcaaaaagataaatcagaattcaagtaaagagaagattaataatggacaagaagtcaaaatcgatcagagaaatgttaaaaaagagttcactagccatgctttagattctcatatcttagattattatgaaaatccagccatcaaagaggatgtatcaacattaataggtgatgatttggcatcttgcaaagatgagactgatgaaagctcaaaagaagaaactgagcctcaagtgctgaagtttagagtcacatgcaacagggcaggagagaaacattgctttacctcaaatgaggctgcaagagattttgggggtgctgttcaagattattttaagtggaaggccgacatgaccaactttgatgtggaggtaggtataggctctgactgtggtgattgaagaatgctgtcacagatttgtagaatttccagactaacccaatgttatgcacaattaaactgaggaaatagtagggtgtggttaagaagagcataggctatggagacagatttagatccaaattttaactccacaactgtataactttggactagatagtctctgagcctctgtttcaaatggagccaataatattatgtacctttaaggttatcctgaaggataaatgaggtacatttaaaatatttggtgcaataccttgcatacactaagtgctccatagatggaagccatcaaggttgagttgtctgttttctttttctttttcgagacagagtcttgctctgtcacccaggctagagtgcagtggtacgatctcagctcactgcagcctccaccttcctggttcaagtgattcttgtgctcagcctcccaagtagctggggctacaggcacatgccaccacacctggctaatttttgtattttttaataga

SEQ ID NO: 13222 - DNA, 1157 bp, Homo sapiens
ctctccccgatcccccactccctacccccgttctcgcggccttgtgacagacaactctgatcgctctgggggccgcgatctcccctccgtaatcttcctggacgccttccctctcgttttctggcttcccacctcagatggctgcttcccaaaggcattaccttcgccacccccaccacacgttctctggctccccgtggcgtgtgccacagcgtgtctgagatagcctcgttgaatgtgtagggttcgagcctggagttgagccagattgtgtcgttttacttgccttgggcgtggagaacgatcttgtgagaatatcttcaaaggcagaaaaatattccctttatgaattctctttccctctgcgtgtaagtcgggaatgtgaagaggagtgtaggaaagagccctggttcaagtaggtaaatcgcatgagagggaaagttaaactgttgggaaagccccttctatgctaattgattctatagagtccttgcttgtctcacttcttgggcgtcagtggtctttctcttggatatggatgctgcagtcagctctgctggtctgggtcaggggtgcgtgtatgacctgcattttctgctttctcatgttacttgtgcaatgtattcaccggtaactcatttctttcccagacctctgggttccactgggctttgtctatatttaagttcatttctccagtttccttcctgcacataggtactgaacgaatccccaagttctgtgctaattaccttcatcagttgactaaacaagtttttagatgacatatttgtgaccaaggtcatatttacatttctttgttggacagatgttacatagctatacttgtgattggggaggatccagctgagtggagtgtgctgagctttttaggagagtgtgtactccctatttgaaattattttttggttgttaattttatattattaatgtttttaggtcacagaaagttctaagtggtaattttagatgtgtgggatctgagctaggactaaagcagagaatacccacgtaatcagaggtttctgggctccatagaggacgtagggcttttttttttctattggatttcttccagttttctcaggatcattagttctcttctgtagccaaaaattctggcctgttatgggatt

SEQ ID NO: 13223 - DNA, 1147 bp, Homo sapiens
gtattttagtagagacggagtttcaccatgttggccacgacggtctcaatctcccgacctcatgatcttcccacctcagcctcccaaagtactgggattacaggcgtgagccactgcacccatcctgtttttctttcatattaaagtttcaaaataactgaccctttttgaaaagtttatgtttgaccttgcctttatttacaactattccccacatttaaaatgaaatattttatttttaatcttctgttttccaagttatatgtgtcatcttactggtagttaaatgaatttctgtaaatttccattaaaaatacttttataaaagctatccactcgtcctcatttgaagcttccttctacaccagtactatctctttctagaccagggaagatagaaaggtagaagccatcatgcatgcttttgaaaacttagagaaaagaaagaagcggcgggatcagcccttggaacagagcaactctgatgtagagattactacaaccacctcagagactcctgttggtgaagagacaaaaactgaagcccctgaatctgaagttagcaactctgtttcaaatgttaccatcccaagcaccccacagagtgttggtgtgaatacccggaggtcttcccaagcaggggtaagagttgaaaagacttcagcacttagacatcctcacctttgctaatgtcaatacctaacttttggaatttttaaaatcagtgttttcagctttgctccatatcacaataaataaggccattaactgtttaactggaaccatttcattggcctattttataaatgcttattagaaataacgcaaacatttgtcgctagcctctttagctcatttaagtgtatacatttttgtatttaaaaattagattttaaattagtgtttctaatccttatatttttcatcagtagacattctgaatgcttaaagtgaataggaaattagactgtttgctgataaaacatttctggtaagcatctgaccctactattgctacaggatattgctgcagaaaaactagtccccaagccacctccagcaaagccttctaggccccggccgaagagtcgaatttctcggtacaggaccagttcagcccaaagactaaagcgtcagaagcaggcca

SEQ ID NO: 13224 - DNA, 1143 bp, Homo sapiens
gggtctgacccaactgtggtgtcaattactggatcccatgtcaaccgtgctgcatctaaataccccaaaaccaaaaaggtaagtcacaaatgcatcctttataagtccagtctggcaagggctgtcttagtgaaatgagaggacctataatccctagaagaaactaatctcaatattactagattgaaagttctaaaatgctttgacacaaaaggctggagtcatcctgctacctgtttccttatttttagtcagcttaaatcactgatagctgaaattattcctctcttagtgggcgtggagagggtgaaggaagatatccttgtgttctagttgctcaattcattcttactgcagctgctgcatctcctcctgtcctagtttctagatgacgtttgtctttatgaactacactgctacctcttgatttataaactaatgatctcttttttaccttagtatctagttacagaatggttgaatgacaaagcagagaagcaagagtgccctgttgagtgccctttacgtatcacaacggatccaactgtactggcaacgaccctaaacatgttaccaggtcttatccattccccgttaatttgcaccacccccaaacactacattcgctttggctcaccctttatccctgagagacgtcgaaggccccttctgcctgatggcacattcagctcctgtaagaaggtatgtctgtgtttttgtgtgtgtgttgtgtttatgtgtgtgtgctttatttttttaagcctaagattcctatcatcatgacataaataaaatgttctctagatagccactctgcccatgtgagtttataatgagttagttgttcagccataaatactgattcatcaagagtctgtgagactgtggtggaatgaatgtactgcatttttagtgctcagatttgtgactggtcactgatgtctcttctgagaacccttgaggttcctgagtgagagcacacagcagtggatgactgggtagagacggatatgttttgtgtgtgctcttgtgatatgggttaacatgtccatttatgattattgtgtgagattaggccctgggtcctctagaacactgttgcataaatgaaaaaaattaaattgttttgaatcaattcaaccg

SEQ ID NO: 13225 - DNA, 1131 bp, Homo sapiens
ttaatcctcatccaaaatcttccaatgaatcttttttattacctcttcacacgtctctagcacggggcagacaacttttaagagatctttatcttccttctaggcgcttattttatatattagttttattctatacgatcacagtctctcctaaataaatgttaagatttcttcctcagtcttgccattttacaccatcccaaatggtatgaaaagttgaatagcagtcattttttattggtttttgtcttttgatgggatctcattatatgtaatccagatttcctcaagtttttcagttaaaaggaattgataggacaatgttccaatatgctgagacacaagacaataaaatgcttgactgtgtaactgaattagtgtgttgaattgtatcactcaccagttgatgtacatttaaaacaggtgcactaaatagttttagataattattgataattctctggttcttttcaattatagcgctggataaaacaagccttagaagaagggatgactcaaacatcatctgtaccccaagagactagaactcagcacctataccaaagcaatgagaatagtagctcttctagtatctgcaaagacaatgcaggtacgtatctaaaacctttctgattatatgaccaatgattgtttcaggtctgcataaaaaatttaagtatgagtatttctgatacaaaaagaaatggcgtgttttctaaatagttactttacatctgtctttacagaggaagagagagatctcaagtcagggatcagttttcccaggacgacaaagaaggactagacagtgtacagataacagcagaaatggttataaaaaaggttagatacatttaaagtagtaagtttaggaaatttatattcatatttataagatggggcaagggcaagaaagtggtggaacactaatattcaggaaagaattaaaattctgagtgattaagttgggtgggacatggttgagggagcaggggatgaatgaaataagtgaaaaattattatcaattgattgttttcaaaggggcttgtataattagcatacaatttttaaaagaacagccgggcgctgtggctcgcacctgtaatcccagcactttgggaagccaaggt

SEQ ID NO: 13226 - DNA, 1120 bp, Homo sapiens
aagcaattttggaaaggccaggattctttagtactctggcccatgtacactgttgctacgtgggacttttacagaatataatggctttatctgctctacttccgtccctcttatctttccctgttcacctgtgtccctctcccctcctttctgccctttgactttttcctttctcccctaccccatgtctccgttgatttttattctttcagctttgtcaccgaaaagacctggatttggcaaaagtaggataccttgactccaacactaacagctgtgctgatagaccttccctactcaactcaggtcattctgacctggctcctcatccctccctcggacccacttctgagactggtttcccaagcagaagtggagatggacatcagaccctcgtgagaaactcagaccaggcatttcggacagagttcaacttgatgtatgcctactcccctttgaatgctatgcctcgagcagatggactgtatcgaggatctcctctagtgggggataggaagcctttacatttggatgggggatattgttcccctgcagaaggattttccagcagatatgaacatggcttaatgaaagacctctctcgtggatccttgtcacctggtggtgaaagggcctgtgaaggagtcccatctgccccccagaacccaccacagaggaaaaaagtaagtgtttcatgttatatcggcgaacttttcaagaatgttaaccaagtagtttagtagatattcataagtttctgctatgtgttccgcactactctcagacaagtgagacatagtctctgccaaatccagtgaaagacaggctgttttagtacaacttggtgaatgttgtaaatattcagcaaatgtaaatgcctgtatgtgccatatacttgctaggcaattgagaggttagaacagtgaaaaagaaattttacctattatttagtgtgtcccaagttcgaggcactgtattaagctctttaaatgtgttttatcctcacagtaagcctataagataggcaattttctattttgcacatgaggaaactaaggcaagttgagtaactttcccgtggtcacacagctagtaaatggaaggaccaggatactaccca

SEQ ID NO: 13227 - DNA, 2253 bp, Homo sapiens
gtctaccaggcctccagggtatctgcggtttccaattcacagcactacccacaccgtgggagtgggggtgtgcaccagtaccgactccagccactgcaagggtcaggagtcaagactcagacgggactttcctagggcttctggatttgggcaaacagaactgaatgagcccatagctgcttccttccagctgcctctggaacctaggccgagcatattgctgaggaacggggggtacaaggtgccagaggattgggtctggtggacaagaaacaagacttgtggtcacaattggcctctggccttggagaaagctgtaaatcttgtctgaagcagagactataaagaagtttctccctgctgtcaagggtacattgttgacaagcaaatggtgtttcggttagtaacggttctaagtgcaatgagttgtgttgaagcctccgtctcccatccttgcctgtagcccgtagtcacttgtgcagtgaggacatctttttaaatttaaaaaaaaaaaaaaaaaaagttttcaaaggaaaaaaagttaaaagagccaatctcaaagccccaagccatctgagtactgttagggttttatgcacttaagaaaaaaggtaggtatgtaaatgttcatcctaagacaaccattccaaaagcaggtatctggccaatgtgtgtccaccaagaatactgtttatctttgtcttaagatcaccaagaaataggcaaggatagtaaagcttggaacctgcaccaactggagggtgcctggctctttgaagaaaagctcatggtcagctcttgattattcgggagcagattatttgagtagattgtctgagcctccaactgttaccatcctactcccccttcccaagctatttcacagctcagtaacccatgaagtaagtagacaagaaaaggaggaatgagacatgatataggccaattgcattgctacttaccagcttttggcaataaatttcattaggaaggataccgagtggtttgggaatgcttcgaattttattttttctactcccaattaatcaggagttgatgatcccatgagcaggaccgcctccatgattggggagcatgcacttgtgactgcagggtaagagtgggaagataggtttgtggagtggcaccgacaggactgtgattgtgtgtgggcctgccccacatttctctgggggatgcttatgtgagagtgggcccagtgaaagagttaccaagccacccacacccctaacactgttctggatgagagatgagagcagaccggcttctccccatcagtgcattgtgcctgttgtacacccctggaggagccctggagccagcccaggtggggtacacaatctttttaaattccatatggttgccagcttatttctttcacttgtttactgtaatatctggcgtgtttttatttatctaattttgtattcagttataaccatggtaggggtagtgaatatatgacaggtgtaatccctggtgctgcagtggaccttcttttcttttggacaagataatactgtgagtttccctccttccttccctctaatttgttttccttttttccccagcctcttgcatccccttcttttctaccctgtcctacaactatcatatgcacagtcttctctctttgtgtgtgactgttacaaaatttcacttttcaaaatcgaaatcaggtgtttgctcaaatgaggggagattttttttttttttttttttttaaatgctgagacctcagcagagtacttttctttttgttgtttcccccacaaacccatcagtctgggagagcattgggagtggaaatcatgttgcctgggatgctggtttctttgtatattatataaaacgtatgtaaatgtctctccatttgggctggggtttgcattctccccttggctatttaaccaaggggagaggccagcgggcaggcggccctcaccctgcctggcacgtgcagagaccccagccactctgtgtgggcagggtgctgtcaagaccagacctcttgggggggtaggggcgggggggtggggggaactcttggaagggaagaagtatcacttctttctcaagtggagtgtttacaccttgctgtaacatttgaactttcacaagagatgtaataattttgataataaaattcttaaccataataatcataaagttgagaacttctttgtccaattttgtggccctgccttgcctggttttcctaatgccattttt

SEQ ID NO: 13228 - DNA, 1161 bp, Homo sapiens
tacaaagccagacgcctgccactcacccctttctgggactaggctggagaagagccatggggaggccactggggaagacagaagctggtggggcctggctccctccaccaggccaagctggtggtacttcctgctcatcggcccatgtctggttctctcctgggcatcctctcctgcggttcctgagtagatgacagcgggctgctggtacactgtatctcaggctgggatcggacccccctcttcatctccctcctgcgcctttccttgtgggctgtgagtatgaatcggcccctaccaagctctgctctttgggtgtgttaggattgtctccagacagagggtggagcaggggatgccatcgctcagagcagatgtgtttaaccctgtccttccgggtgttcttcagcctgcgttgtcactgggtctggttatggttcagctcctggggatgagaagagggctctgtcacatctcctgtggtctcttccaggatgggctcatccacacgtccctgaagcccactgagatcctctacctcactgtggcctatgactggttcctcttcgggtaagcctttgcaggagttgggttttggggccttagtaacagtttctatatgtgagttgtgtggtggctcccttgacaggggctggaggtaaggataattccacccctcgagaaggaccgaagctgctgatcaggccccacctgccacgctggtgccagtgacacagtctgtgtctggtgaccctgtcctcttggccttgtcatcttggtgctgctgactttgcctctctaccctccttttttcaggcacatgttggtagatcggctcagcaaaggggaggaggtgagtataccacctacgacttgtgggcacagctcagcactgaaagaggggcagtgggtagcctgtctgagttccacgtgttaggggcagctccttgccccaggtgtgcagggatgtggccccctgtcatctcctcctgaggcagcgtggcaggacaggcaccagcacagtagctctgtgttctgggcctcgcgggcctgtgctgtggagaggatacaagcccacacgtcggggtgagcagttacatgacagccttggctgcctgtgatcttccctctcacaggccacttgttctctctgctcagctc

SEQ ID NO: 13229 - DNA, 1169 bp, Homo sapiens
tgtgccaagcaagcactggggtaaatttagcacagcacaaaccagacaaagtgcctgccctcagggagctgactttctttctagtagggaagacagacaatcaacaagtaaataaatctacaaactgacgtcaggtgataaaaataaatactgtggagaaaaaccaagcaggaatagggagacggggtgatgccatttcagtagggaggtcagggaagggctcgctgtggaggtgatgaccgagtggtgagggagccagacattggaggtgtggggaaagagtggcataggcagaagcaatggcaagtgcaaaggccctgaggagggcaagatggcggcacatacaaggaacagaaaggataatgtagctagaacaggagtgagcaggcagggctggtagagtttataaagggggaactccttccatggctcctgcctgacccctgagactgccccagtgctccaccccggagccaacggcacccgaaagtggaaatgaggatgagtttctccctgcccaggctctgcggttaccctcccttctatgacgagaatgatgccaaactctttgaacagattttgaaggccgagtacgagtttgactctccttactgggacgacatctctgactctggtatttggggctttgcttttttcccctgggccctgcctctggttcctccctcacctgctttgggggcggtctccctcctgccttccttctgtcggattttccagcaccacacaaagagctgtcttcgagaccagacaccctaccccttcttccttctgcttgggtacttccttctgcttggctcccagagtgagaaactaggcattcatttgttcaatcttcaaacatagtctatttgaaaatacctctcccctattgacaccctaatgtctaaaacaccaccataaacattttcatcctccttttgtgccccctattaagaagcaaacctgtgaagctactatcgtttatcatcagtgtgaatgcactgagattagtcaagaacaacttttttttttttttctttcttttttgagacgcagtctcgctctgttgcccaggctggagtgcagtggcacaatctcggctcactgcaacctctgtctcccgggttcgagcaattctctgcctcagcctcccaagtagctgggattac

SEQ ID NO: 13230 - DNA, 1179 bp, Homo sapiens
atgttacctccaccaaagcactctttcagattccccagcagaaagttagtcagtctctcctttgtgctgccacaacactttgatctctctctttcacttcacttatctgatttcttaaaaatttatctgaaaaagagttcatacagacagcagtaaattcaagcaatacaaaaggtaattccctgtcacccgtgacctgaaggctcctaattctctcgagaggcaattgctgtgacctgagacaatctgtgtacgtattctgcaccttctatcttgggaattatttcagattggcttctgtgtgtgtgtcttagttctttttggacctgtctcccttactagagtgtgaagtacaggttttatcttcgttgtactttcttacctacacctgacactgggcttggccttggactagggacttgagagagatataagataggtaagtgaatgaatgaatgaagcatggctggccagtgcttacccactcagggttgggtgccatcttttccacagatcccacccctggggaagcactactcccagcgctgggcccaggaggacctgctggaggagcagaaggatggggcccgggcagcggctgtggctgacaagaagaaaggcctcatggggccactgaccgaactggacactaaaggtaggcctctcacctccctgccaaccccaggtcaggacttgaattccagaacttcagcccacctcccctcctttcctgtgcccgcttagatgtggatgccctgctgaagaagtctgaggcccagcatgaacagccggaagatggatgcccctttggtgccctgacgcagcgcctcctgcaggccctggtggaggtgagcagcctaacccaaaagaggaaccatatttactttgtgttttaatgtgttatgcttattttttatcggaatttatcatacatttattaggttggtgcaaaaataggttggtgcaaaagtaaaaacctggactaatatatagcaaaagattgggaataatatataacttgtgcacctaatagaaaagtgcacagatcataaatgtacagttttcacaaatgagcttgtattaccagcctggagattacaaaatgaaacattactatatcctagaagcccctctcatgcccctgtttttctccaactttccccaaaggtagccttactc

SEQ ID NO: 13231 - DNA, 1738 bp, Homo sapiens
aacctcagttcaccaggcaggacgctggcagggctttctagcagcctccatgccagggcacaagggagctgtggagaagctctcatggctcttaatttttctgccttatctagtgctaggcttagggccggtgcccataggtcacttctgaaagctggctgaattagagcatgaccacaaggtgtcctgggacccaactctgcccctcacagatatgagcacagtggcagctctcaggttcatgcacctccttagagcagtgccaccaggatgcaataataaccaccatgcactgcctcttggttctcttgacagttttaaaccatctggctggatctcgtggccttccccctcagactacccatgtctccacgaaggcgtcctggagtcactccccgagcagcgcggcggcggcagggagttgggttggggtgggcatttgatgcgggaggtgggtggtgtgcttgctagctgggcaagaaagcagcagtggacctgccccaaggccacacgtgcctggtcaggctggcttctgatgttcagtcccctgggccgggacagattttttttaacgtcttgaaacttaaactctgtgcttgtaggatactgtaacctttttgtctttttttttttttttttttttaaacctccacctccagtggctgtgactggtcccagtgattatacgttattggttgctgtgggtctgggcgggcctggagccagaaggcgacttattttttctctcctatgccaccccaggtggggagggagggaggtttcagactccagtttctcccttgcccttttattcccaagcctccttggccccagtataagtgttgggaactctctgccagcttcctgagttctgcctaaagatggccccccagcactggttggggacaagggccaaattggtgaccaccagtcatgcctaggacctggggcccaaaagccgggcaacctctggctacaggggccattgggtgccctcccagttgagaggggccgctgtttcgccttgtccgtcagtgccagtgcctgtgccagaggtggcgaggtgagtcctccagagcttcctggccgggccctcctcctgcctgttctggctcctctgctcccacgctagctgtcccttttctgattctggtggatcctccctcccctaattaaagtctctttttgcccctttggggctgcatgaggtctatgctgtgtgtgtgtgtgaaaggaggggaggtggggcttcttttccctgagaccagatggctggtaattgtgcctggagctccccactgggtgcagtctcatgattggtcctgccattattcctgccaggggtcccaacccagagactccattcattgcagtccaggcaccattaatttctgaaactgctctgtctgcctatacagagctttggtgcttttcacataaggaacttacttgggctaaaaagtaacctcagagaaacagtgctcccatttggtggataaggaaactgaggttccaaacatgagatgtaatagcttgccccaaatctagccagtgagcaagagagtagacttttgcctgtgccaaaacagtaatcaccatccacaagtggctatttaaattttaattattacaattaaataaagtttaaaatccagttccccagtcccactggcaacttaacagctaccagtgactgtaccatatataacagcatatatagacatacagcatatacaac

SEQ ID NO: 13232 - DNA, 1186 bp, Homo sapiens
cccgccctggtgacactcttactgaggacatttgctttagaattgaggccccttgaaagaaaggtgaatagtagatttcaggctatacagtataaatacagtcattagttgggggaggagggcagtgagcagagtggtccctgcagatgatcccacagcccttggcctggattctgagccctgcaccgccagccttcctcacccctctcctcacagggctctgtggtatatgactgcttcgaggctgccctagggagtgaggtacgaatctggtcctatactcagcccaggtacgagaaggaactcaaccacacacagcagctgcctggtaagtggacccccaagtcctggccccctagcctctgtcccctctggccattccccctcctgatttcaccctcttctagctccatccactctccggcaggggtctgagctgctatcctccccagagtcagtccctcggaccttctctctctgggtgatatggctttccagcccctggggaaggttctttgagcattggatagatgtgggtggtatgtaggggatggggagccattcctaatgcccccctgggagccaaattgcccccacttctttccttggcccccagccccactggaggctcttctgtgatctctcctcagactgcagggggctcgaagtctggaacagcatcccgagctgctggggtaggggctagggccagtgggccgggggtagggaggggcagggtctggagtataagaaacccttggagtccacttcagatatgggctaccacatctcagaagctcacagaacatattcattcattcattcattcattcatttgttcataacacattaattgcagtatctgtgctaagcactggaaatagaaagatgaatcttgggtcaggctcagtggctcatgcctgtaatcccagaactttgggaggccgaggtagaaggatcacttgagctcaaaagttcaagacgagcctgggcaacatggcaaatccccgtctctaccaaaaatacaaaaattaacaggacatggtggtgtgcatttgtggtcccagctactcaggaggctgaggcaggagaatcacttgagcctgggaggcaggggctacagtaagctgagactgcaccattgcacaccagcctgggtgacagagcaagactccgtctcaaaaaa

SEQ ID NO: 13233 - DNA, 2220 bp, Homo sapiens
ggtggcaggaagagggggaggagaggattggggtagcagcatttcccttgtaggattgaatgagcttatacatgcagatagctcactccagcttttggcccagagtaagtggtcactaaaggttagccacagctgtcagtaacaattccctctcttcctgcctgggtgttctcttccattacagacagagtgggaagctttggagctgacggatcaccagtgggcactagatgatgtcgaagaagagctcatggccaaagacctccacttcgaaggcatgttcaaaaaggaattacagacctctattttttgaagaccgagcagggattagctgtgtcaggaacttggagttgcacttaaccttgtaactttgtttggagctggcacctcttgaaataaaaaggaggatgcacgagctggcaggcatgcagcaaggcttgttcttgtctgggctgggttcccctttatgtttgaaactagaggaaataggagtatgctgggcaacttgttatttttaaaatgttgtaaatgttccttctggtgactctagtaatgaaagtcagagaaagggggaaacctcaggctactgataatatataaaatcttggccaggcgcagtggctcacgcctgtaatcccaggattttgggaggctgaggcgggtgggtcacgagatcaggagttcaagatcagcctggccaagatggtgaaaccccatctctactaaaaatacaaaaaaaaattagccgggcgtggtggtgggcacctgtaatcccagctacttgggaggctgaggcagagaactgcttaaacctaggaggcggaggatgcagtgagctgacatcgtgccactgcgctccagcctgggcgacagagcaaaactccatctgaaaaaaaaaaaaaaatatatatatatatatatatatatctatcttagcagaagcccagtcttcgaaggaagcattgttaattatagctaatgattatgtgcagtcagcctgacatctagccacagtaaactcctgttttcttgggatccaaacaccctgtgttttaccattagttttgttagtattgttaactttctttacacaagtaaaccatttccactaccaaaggtttagaaactatggatgaacaaaatgaatctccctgttcattttgagcctacatagacatagagaccaaatatgtcaaaaccttattcaaataaactctcttcagagtgaatacccagggtcaggacagactcagcaaaccttctatatcacttaattctgcccagtgaaaatcagtgaccctgaggcactgccagattctaaagtgcctttgggatcatcagagactgtctataaataatgcaaaatcttgatctggatgtcagtgtatcaaatcttatcaaatccattgacaaatcagtggtgctatactggaaatggctactcctttggatgaaggacctcatttcccagttgcttggaacaaaagagaatttacatattgctgtaagaagggagagacggcagttgttggtagacacacagataagggtgcccaagaataattctgtctggattaaaggtcccagggaagtgacggtgccatttctgtaccaagaggtgaatataatttgcatgttgagtgcagtaattaagaacaaacgactcgactccacaaattaaaccgtcctgttttctcttctttgcctgtgaaagtgttgcctctgtaagtcactaacaaccttctgccagcagttgactgtctatcttggatcagtgcggggagtctaagacgaaagagatgtgaaccttgccctcaactcacaagagagagacacctaagagctttttaaaattttttattatttttttagagacgataccttgctatgttgcccagactggtcttgaacttgtgagctcaagccatcctcctgcctcaccctcccaaagtgctgggattacaggcatgagccactgtgcctggccaaaagagacctttttttgaggtcaccgaatctgagaatctggaatctctgaccctggcctccagagtaacatatgtggacatagatacagacatgtccctctaaaacttattcataatgacccgcagacccaagttaagaaaccctgacctttaacgatagttaaaatggctgcttataccagatagaaaaggaacaagtgttcacaggagagctaacctttgacctgggtct

SEQ ID NO: 13234 - DNA, 1154 bp, Homo sapiens
ctgggattacaggcgcatgctgacacaccctactaatttttatatttttgtagagatgttttcgacatgtggccaggctggtctctaattcctgagctcaggtgatctgcctgtctcagcctagcaaagtgctaggattacaggcataagtcaccatgcccggcctgtgaacccagattttacaaattattttcagtgtattgcctaaggctttaaagagcagataatttatctagggttgtacatattagcgtggtgcttgggtttctcagcatacatgaccccttcaaggccaacattccatcagtggggctgtcttctgccctggctttttccatacaaaggtatggttttctaccaagatgcttgaagagggttgctactaaagcacctgaaaataaggaggattctgattaggccgtcaaacactgaaagggacttgggcacgtcatgtggatttaaatatatctgtgacacataggatactattgcatttgtttgtttttcttgtctccttacagccagagcgtccattacttgcagaatttccatcaaagcattcccagtttccagtgtgctctttatctcatcagacttttgatggttattttggagaaatcaacagcttctgctcagaacaaagaaaaaattggtgatgggcctagatcctttttttttttttttttttaatgaataggactaatatctcacacttacaaactttgggcttcccaggacatttttacatgtaaatccccacataaccttggataggccctcttgctataccaagaaggtcattttcccagaacaacctgactgatttctgctaaaattgcttagtctgagtttggttagacaagctgagtagatagttttctctttggcttaagtttaatcatgttcttccttttcaaaaaaaaaaaatttatctgagacatttgacaaaacgagacataaatcatgaggttaataaagtaggaaataaaggagaaatcagggtcaagtataaaagaaatactggcctcttccctggcctttttctttttttttgagacagagtctcgttctgtcacccaggctggagtgcagtggtgcgatgttggctcactgcaatcctctacctcccaggttcaaacgattctcctgcctca

SEQ ID NO: 13235 - DNA, 1193 bp, Homo sapiens
tgattagaccccagataaattgttgcctgcttctgtgtctctgccagcctgtgatcattttgtgttagagtttgaaatccgctgtttgcctttcttactggtaggatccttttttgttcctctttttttttttttttttttttttttaaagacggggactcgctgtgtttcccaggctggagtgcagtgctgcaatcttggctcactgcaacctccatctcctaggttcaagcgattctcctgcctcagcctcctgagtagctgggacgacaggcacatgccaccatgcccagctaatttttgtatttttagtagatacggggttttaccatgtcggccagatggtctcaatctcctgaactcatgatccacctgcctcagcctcccaaagtgctgggattacaggcatgagccaccgctcccagccatattttgttcttaaagtggggtctttattaacttgtggacatcatggattgtctaacaccatcacagtccctggctcaggattctaatgtagcattatttattggtttggataaacccagctgtgctacactgcagagtaaaatctctgagtcatgattctggactttgggagctagttttgaaactctgatttattgtagaacttaggcttgtaccaattttacaaataaattctgttctaagttctgcctcagttgcctcatttatctttctggatttgcttcattattcaaggattaggtggaattgaattgagatttgtgcagagaaattatggagactggtgctaacatagttctgccgattaaaatcatgtctcctattgtaagaaccaacttcatctgagatgagatatatctgatctttctggaggattgacttgatcttgatcttctttccttttttttttttttttttgaaacggagtctcactctatcgctcaggctggagtgcagtggcacgatctcagctcactgcaacctccacctcccaggttcaaacaattctcctgtctcagccccctgtataggtgggactacaggcacacgccaccatgcctggctaatctttgtattttttagtagagacagggtttcaccatattgaccaggctggtcttgaactcctgacctcgtgatctacccgcctcggcctcccaaagtggtacaattacaggcgtgagccaccatgcccggccaacttc

SEQ ID NO: 13236 - DNA, 1136 bp, Homo sapiens
cagaaagcctagcttcagtgctgctaccaagttctttcttgccaggctgtaagtattgtttaatatcagtatttctacccacttttgtacactctagtggtattagggtgtggttggttagggtttttttcttattttcattgttttggtcgggggaggttttaaagtaatccttgacctatatatatagatttttgacatcccctggtacatagaaatccatacatctttctcctctacaccccttttccccccaattcattgtggttgtaggtgtttatgtgagttcacactaggctcattggtttatatcatttgtttaacggttatcacatggacatgtcaatgctagtttgactctaaatggttcaaccttacaatgggaatgttcttccttgttctctatcattggtccttttttggaggggaagggatgaaaggggctcctgaatcatcactgcttgaaacaaaagcaagatggctgggacaatgtcacagtttcatttacatggacaggtttctgtaagctttaggtacataccaaagggcatggtgtgagtaaatggggatcaaatgaggaccctttacttggagtgctgcaaggcaaaggtgcactttttgtaagttgcatacagcaagaggatagagcgcagcatctgtttgcacatagtgactgtcatctgaatctgaggctccttcagtccaatgggccactggtgctccctgctaatgattttgcaaaaggctgacttgtctgaaactctgaaagtcccggtccactttggtggctgagctgtgataaccctgccaaagacagaatctactccactgaggcggatgggctggggcttcctgaccagtcctttgttgttcatcgtgcgcaactctgatgtgtggcagggtaacttgggactcactccagattccaggaatgggctgtctaggactagagtgacctcttgaaagcacagctgcacttcaaggtcggacggtgtgtgtgggaagcagggggaggccttgaatgggtgcttggaggaaggtgtaggtgtcgtgtgccgcagccattggaaactctcatccagtggggtccatggtgaccagagctggtatcctgccattgacagtcctaaaggagg

SEQ ID NO: 13237 - DNA, 1655 bp, Homo sapiens
tggtgaaaccccatctctactaaaaatacaaaaattagccaggcatggtggctcacacctgttgtcccagctactcgggaggctgaggcaggagaattacttgaacctgggaggtggaggttgcagtgagccgagatcacaccactgcactccagcctgggtggcagagtgagactccatctcaaaaaaacaaaagaagagaaaagttaagcatgttgcctggatttgaaccatgtttctgtgacttcacagctatcttcttttctgctatttctcactgcctaggatctaaagatttttttttagacccctctaatcttttttaatttatctaaatgtcagttttcctttcctttcacaggtgacaaaaggtgagacactcacctagaacagtgccgtgctgctgctgggaagttgctttacacaacacaggccacatgggaaaggccccagcagccttcagctccttcctttctccttaaagagcaacagggcttattcttgtttttcttttttcaaaagtgtggcctttgggctctgccatctggggtgtggtgtggtatgtgggaagaagttcagaggaaccgttggaaacgacgttaggcattttaccttttcagtaacattttatacatctacttgtcaatgtatttgagacattcacagccaaaagcctgggactctttgtgaaggtcctcctcacctctatctttctttctctctctctcaaactttccttaaagttctcattgcctttgcactgcttctgtgaacagtctttgtctcctccccacctttggtgggaagtgcggggcagtcctggtcaagacactcatgccctggcaatgtggctgccagagaatgttgttgctaacccaccagtttcttgttgatttggagaggtcaaggccaggcccccacttggcttgaagggacattttcagacttttctttctgtcacttggagtgtctatgcctctcatatttccctaataaactcctcaactttttatctgactgctgtgattatggtggggagaggagctagagatgggttcacttattgcacagaaatgtaatacatggcgttattattctaacataaaactttcagatgtagctgtttgattcaaagcctaggtggcttaccagcccaagtccccatgtttggactttcagctgactagctcatcttgggaatcatttggtcattcagcacatttaccaagtatttactatgtaggcatgttaaactccaataaaacatacagcattgaatcagacatgatgcttacagtcttttgaaataccagcattcacacaatttagccacaatccaaggaagattattagttttataaggcacaagctaagtgtctactctttgaaaagcagatagccgggttcagtggctcaggcctgtaatcccagcactttgggaggctgaggcgggtggatcacaaggtcaggagatcgagaccatcctggctaacacggtgaaaccccagctctactaaaaaaagatacaaaaaaaattagctgggagtggtggtgggcacctgtagtcccagctactcgggaggctgaggcaggagaatggcctgaacccgggaggcggagcttgcagtgagctgagatcgcgccactgcactcca

SEQ ID NO: 13238 - DNA, 1236 bp, Homo sapiens
ggttctcggttctaaaaacagacttccaactgggaaactttttgggggaaattaactggacacctatctcggaggtttattttcttgcaaccagtgaagtcgtcctcctcccttccctggataactcttcagtttgactgtcactgttctggtgtcaactccagcgtcggcacaggcagaaggacttcagctgctggtctcattggttccactgccattgatatgggggggtgcagaggagcactcattgtccatgatggagatccaggacagactgggggactccgggaagaggctttcttggggaagaggaccccaaaggaggtacttcctcctcactgatgccctcagggctgctgtgtgggtgtgttaagctgataaggttcagtttgcggcggaaactacctgctagtcttgtgtcaggggctgccagcctccttttgtttcacttttgcccccttcttgggaacatttgaccaaaaataatcctcatttcatcttgtgtacagtcctttgtgtaccccgcccaggttgagaggtgaatcagcgtaattctccgaagctctgctgggcagctcagccatgttacattgtctatgcagaataagcaggcctggtgtctgcaaatgtaccagtccttctcccgcatctcctgggtgcccccttggctttgcctctcctgtgtcctgtctttctgcgttttagaagtgagagcctctccttcaccttttgagcaactgagtcatctcaagtcctgagctctgctctgccgcctgctggtgccttgtaaaggtatactcgttacaggccctagaggttctaatggtccagggttaagtgagaggagactgtactttgtttcaaaggatccttcaccctgatctgcagtgaggtggatagatcacctggagtccctcgtctgtggtcttggaggcttaaattgtaaaatacatcccttatggaatcctaaattcctctaggtgtttttggaaggcgcatttgagccttgtgagctaaaatggaatggatttaatatttcctatctggcatttccatcttgcccctggtacacaagtcactggcctggaactcagccttgattcactgtccgtcttcacggattagctgtgctgttatgttgtctgtgctgcagattggcccatgtgggaagtcgggggggacctgatttcctgcttggaagacttgggggactgccgagcatatcaaagtgtttat

SEQ ID NO: 13239 - DNA, 1091 bp, Homo sapiens
tctcaagatgatttctgaacacacaactataagtgcatgagaacttaaatacgtgtgctcttatgctaattatacacaaagtaaaagttttttcacaaggagaatttttttctccagcaaatagctcgctcaccctaggggtacatacaccccactttagagaccctcaagttacagtggtatcattaaacgatccataaaggagtgggtttaagaaagctgatacaggaacatgtttgaaataatacattttctcaagggtgtcctccaaccattttctttgataaattatatttctgcccattgttgacttgaaattgtcctcacccctctaccaagttcacccagtgtattctgaaggaaaatgaatgaatatggaaacctctctcatcctaggcagtagagcgagggaagctgcactggctgagaggctgtggaaccggatgaaaaagcagcccctgagtcctgtggcgttggctgtgagtcggccacgtgcttgctgtgtgctttaggaaagttacttaatttctctgagctttagttttctccctcataagtaggcttgctgtgaaaatgaagtgaaatcacattaatctgcatgagcatttaacacggtgcctggtgtacatcaggggtgtgacagtgagtgctggctgctgtagtaattgaatgcttagctacgtgccgggccctttgccagctacagctcatgtgagacctcatgttcagtcttggcagtaacccagcaaggtaggcattttacatgtgaggagcctgagaaattcagtcttggcctggatcacagagctggtatccaaattcaggtccgaggccaaagcccagatctttgcactacaccttgttgcctggcacaggtgagagtgcccagcccatagtgggtgcgcaatatctgtttctatttgaatgacccaggcaggcggttaataatgcttgtgatttctttgagagagaagtaagttcttgtctttggtgggggaagcatcaggtgaccagcatttgtccagagcctggtacccatcctctcccaagcccaatcagtggtgctttctcaaaaagaaaccatctcctga

SEQ ID NO: 13240 - DNA, 1255 bp, Homo sapiens
gtgcttcatgtcagccttcacacacactccagtcctgagaagcggaggggagagggacagcaggcttgggtctgcagaagcagtgttctcttgcaaggcagagtcaccatgtgtcccatctttacagattggctgcaatgccgtcagctgggcccctgctgttgtacctggaagcctcatagaccacccatcggggcagaaacccaattacatcaagaggtttgcatcaggtggctgtgacaacctcatcaagctgtggaagtaagtagggatgtgtggccttctctttgaggggacacttctaccctttaccctactcaccatgactcagccacactcacaagaaacaaggtcacctttctttctccctcctgccagtaaaatactgttttcaatctgttggaggacatccttgaaaaacaacacaacacctgttcacctaattcccaactgttggagctgactctttggctgtggaagcagagcattttctggagggttttttttacagctggggtgaagggaataaaatgccacaaactccatgaatgaaagaagaaagatggaatcgcttctccaccccaggcagagcctgttgggttggggaggagttgaggtgtgggaacggccccctgctgattctctttctgtccccactgttagggaggaggaggacggccagtggaaggaggagcagaagctagaagcgcacagtgactgggttcgagatgtggcctgggccccctccatcggcctgcccaccagcaccatcgccagctgctcccaggtcagcccagggccatgagtatcccttgtcatttagtctcgagtcaggcccatcagctcttagtctccttagcagaaagtcctctgggaaggtaaagggagagcaacaggcacctttggcccagagcacagggagtcaggtcattgtgtggggaagtcttggtcagaagccacaagtggcctgcctccactgagatgagacagctacaacagaaccggcaccaagaaggaggcggattcgggatgaattttcccttctgacccatgtgagactagggcgccgaggtgcccaggtgcagttccaagtgttcccaagcaacgatggggttggatgggaattatacgcttagctaccaagccacccttcccagacagcaaggacggccaagggtgagccttcagttatacaccaccaccctagagggagccagctaggcctttcacatcatgggaacctgtttggtttggt

SEQ ID NO: 13241 - DNA, 1178 bp, Homo sapiens
cttcgtgaacctacttaaccgcagctttacagaactcagtgtaacaactgctttacattctagacaggcagcctggtggagtgaagttttgtggactcagcattagaaggttaggggatggggctcttttcccaggtctgccttgaactagctctgtgactttggcaagtgctttctcttctctgggcttcttcatttccttagtctgtcgcaggtctctgattgactgtgcccttggtaccctgccctccccgccttcctgtgcactttgtaacctatacagctcggcacatggaggaaactccttattgtccttacttgcctttgcagacttcggggacctggtttttagagagtctagaatctgatgagagaacctgtgcttacttggtgtgtacctcttgaactgctttgcagccatcctcttccactgtctgcctttctgaaatcacaagtcaaactttatacctacagggcttgtgctggaaaagatgaaatggggaaaatggtaagaaatgtctgttccacactgaaacttcttttaagtcctcttttctatcccaagaatttaagagaagagtggttgagcaaagaaaaaaaataacagcttttgttcatttacttattcattcagcaaatagtcgctgagttccttctatttgcaaagcactgtgctggatgatttgaggggatttgaaactgcagatggctcagaccatggctccaaggagctcaccttctagtggggagaagaaacagcataaagtgttgtatgtgttccttgctgaagatatgcaagagagtccagccatttgagggtctgagaatcttcaagaaaggtgatggatggccctttttgagctggacctcaaagaatagataggagggagatgaccatgacaccatgttccagccctacaaactgttcaactctggatcccactacgtgacggaccagggagcagcctcaggaaacactcgaatcaagtctcccagtctgaagtaataaccccgttatgcataaactgcctggaacatcagaggctctgtcatccaggaaaggaacaccagctgtagctcccttggggtctctcctcaaccttaagggtagccaggactgcttgccgtttccccacacacatcaggctctctcagacctctttgtctctactcgtgta

SEQ ID NO: 13242 - DNA, 1211 bp, Homo sapiens
acagccccttggactggcagtggccaaggagagaaacagacagattgagactggtgtggagtccatgcttaggactggacaggtggctatgtgtggtgaggctgaatgagctgttactaggaggcagggttaaagcagtgtcttgggtaatttgtggttattcttgggttttgttttgttttgttttgttttttgtaaaatagacatgaccctcctaggcaaagattattcaaagaattaagaattccacaggcaccaccacatctgcacatcttagtggagctgaagctgctgctcacttgctctgaattggaagtgctagctggagcatgcttagggggaattaaaatgtgcagacctggaagaggtctagttgggaaggagatcctgagacagcctcccccactgccttcttgcccttctgatcaccttagaggtggtcactgctgcatcctgctgcaccgcgtgtttcccgagctcctccccactgtgcatcaccccatcccagcctcaacgtaggcctcctcctccttctgcacacccaacacaggcttctctacctccaggcagcccccttctatccccagaggtccctttccgagggacatatctgaccatttcactttcctgcttaaaatccagtgacatcctctgcagccattaaatagaaggaaacctgaattttaccatctggaaagatgtccctgataaatgcattggacaagagcaagtggcagaatgacctggccagcctcagaaggcagggaacagtggtcaaaacatgggcttggaggctgcaatgagtttgaacccgagctctaccacttagtcactgtatgaccaggagcaagttctgaatttctctgtgcctcagcttcctcatctgtgaaatgggaatgataatagtcctctcccctataaggttgtgaggcctcacccctataaggctaatatgtcaaatgtgctagtccagtgctgctcctagtagcatccaataaacactagttattacattagcatataagtacatgtgaacacatataatcataggtcacatcgatgcctaagattatatgtgttctcatgtatttatatacacctctctctctcttttcacctcattcttcaggactcagaggtattctcttccaggaagtcttccctgaataccccccacccctaaggctggattaggatccttctctggcctt

SEQ ID NO: 13243 - DNA, 1179 bp, Homo sapiens
tggtaaaaactgacatctagacaatattgggggttcctatccatgaacatgctgtcctttaagctacctatatgcctgcttctaacttttccttaattgaaaggaatgggagaataggtatctcattcgtcaaacacctactgtgtgccaaaaatcatttaatgatttcacagcaccataaggatgagattatggctcccacttgacattcgctgaggctcagtgggatgttcatatccatccattaaacagacatgaatgggacctactatgtgataagccctgaaccaggagctggagatgcaacagagaacacaatagaagtgttctctgcactcatggagcttactgtctgtgggagagagagggacacatattaaataatcccatagataaatgatgttaggagagtttattctggggctagggaaggcttcctggagacagtgctgtttgagctgagattggaaggatgagtaggtactaaccaggggtcaggtgttccaagcagagggaatagcacttgaaaagctcacaagacaggaaggagcttagagccttcccaggactcagaagtgtgtatggccagagcatggaagggaggatgaaataagctgacgctcactgaatcaccgaaggggaaggccgggatcagctctgcacaaccttgtaggcctcaaaaagggagggcatggagaaagagaacaaactacgtgttaggtgctttaccaggtgctaacacacacgcgatcacctttgatccctgcagctaccccatagtaaatgttatcaccatctccaatttacaaatgagaaaacagaggctcagaaagggtcagtcctccactggtcagaggcagaggcaggcttcccaaagcttgattccaaatcccatggtctcctcagttcaggagcctggatgtaccaggtgcagtccccgctgggtagcgcctggcccctcctttcccagatgcgaggtttcctgcagggagagcccaaccaggctccctccagccccacgtttttggcttctggcctgtctctgtggcatccttgcttgaaatcagagagagaaacgtggggtctggtaattgtattccattaagcctaattaagatgcaaatttgcacagttaatgaagaaggcaatttggaagcaatttcgccagtgacacaggac

SEQ ID NO: 13244 - DNA, 1198 bp, Homo sapiens
tgacctctggacacatgtctcctgagcagtaagacatcatagaaactatcccaacattttagcagaattcaggcccttcccataaccctaatcttgtggactttcattagttttacaaaggggatttcagctctggactggggaggggaacagttttagggagggactattatcatccttgctttaaaattaaactataaactatattcctcctccttggttggcttgacctacgcccaggcatgagcttggatagccagcctgtgaggctggcagcaagatggagtcagccatgctagacttctctgttataatcttgtgaagacagttgcaacctccccttacataccctaggggctaaatcagtcttggacacttaacctctcaaaagttttggtggagatgtgtgttttcacaagtcaggtgttttgagtggctttggaatcaaggtactgctctggtcaagaattttatctgtttccttatattttatacttgtataagcaataacatggtattttactccgttttgtgccatttcttttttccttcagcttatcaaatatggagttattagcactaacgttctgattgaagatctcctcaactggaataacttatacattgctggacgactccaaaaaccggtgagtgttttataggctgcacagttaaggatgcctttcctctctgagcctaaccttactttgatcattgtgattgcaatgagatggaactctggaaatagaaatgagtttctgactcttcctattccctataaaatttattgccaaataatatccacatattctattgtgatataagaagaaatatgtatttggtttttttccttgggctcctggttcagaggtcctaaaatctttggaatatctgagtgttagggatgagagggtcttttattattcataacaagttcctttcagtcgtacctgagtttatactaataaagtgactcttgatgggcccctagatagattcaggatagggctggttgccagggagccagccgtgtgataagaggctggacctttcaggccccccactcccaccttcacagaggggaaaagggctggagattgggccaatcaccaacggccaatgatttaatcagttgtgcataggcagtggaacctccataaaaaaaagggggttctgagaacttctgggttggtaagca

SEQ ID NO: 13245 - DNA, 1101 bp, Homo sapiens
gatcgtgaggtcaggagatcgagaccatcctggccaatatagtgaaaccccatctctactaaaaatacaaaaattagccaggtgtgttagcagatgcctatagtcccagctacttggaggctgaggcacaagaattgcttgaacccaggaggtggaggttgcagtgaaccaagatcacaccactgcactccagcctggcaacagagcaagactccatctcaaaaaaataaaaaaagaaagaaaagaaaatgcagaaaagtataaagaagaaaaatatttatctataatgcaccattcaataatactgctgtaaacattttggtgtgtcaccttccagtctgttttatgtgctttgttgttttttcaattttgaaattcgagtgctgtttctaacagtatttctgtcttgcaggtatcagcatagtgttgagtgggcagcagagctgatgcgtagacaggggcaggatgagagtacagtgcgcagaatcctcaaggattacacgaaaccgcttgagcatcctcctgtgaaaaggaatgaagaggctcaagtgcatgacaagcttaactctggaatggtttccaacatggaaggcacagcagggggagagagaccttctgtggtaaacggggactctggaaagtcaggtggtgtgggtgatccccgtgagccattaggctgcctgcaggagggctctggctgccacccaacaacagagagctttgagaaaagcgtgcgagaggatgcctcacctctgccccatgtctgttgctgcaaacaagatgctctcatcctccagcgtggccttcatcatgaagacggcagccagcacatcggcctcctgcatcctggggacagagggcctgaccatgagtacgtgctggtcgaggaagcggagtgtgccatgagcgagagggaggctgccccaaatgaggaagtaagtagaagaaaataaatcgcttcctccaaagccatccgttcctggagatgttggctaatagggatgtcttttgcctgcagctggtagctggcctgttgtagggtccaagggaagcagcaggctttgggccacagcagctgtgagggccatttcaactaaaacc

SEQ ID NO: 13246 - DNA, 1480 bp, Homo sapiens
ggattgattgctttaaaaaacaaacctggctcttacctttgatcttttcttccccagaaatagtaaacttgcagctgcccctaatgcagcatatttttcttaccaaaggagtcttcagccctataaaaggattcctctatagtgtatttctctagtgtatttagtgtgtcgtcaaaattttgatttatacagagctttcaagaacacacaatgcaaagtgagcgcagcatagctgttaacaaacatacaacttttttctagggctttaagggtggtcatttttttcaagttctctcaagtgtcccaaatcagggtagcaatcttgttgccacatgtgcagcaaacaaagtggaagtatagatcttcttctcccttagggaggctcttgaaggagcaggaggtacagtactgggtagcagtctggccctcctgtcgtctggttggtgttggggcctccagccagggccctctaggggaaccaagcctctgctctcacctgtgggttcttgcccatcagggtaattgtattgagaactcaaatatacgtgcacttacatgtgtggttcgtactcaagtgatctattatctagctgcaaagcctggctttgatttgaaattttgtaaaaatttcatggcacccaaggtttctgattctgacccagcagtggtcctgaagagagctgatggcaagtcttgtagtcattttgattttaattgaagggtgagcataaccttgtgaaccagcactagcttgttccaagctggaatttatctaatctatttttgtgtttaaaaaagctgtacctaccaaataaataaatagtttataaaatgtattacttaaggtattagctgagtttagagtactttctgcttaattaatttttatacttaactcttcagtagaggtttacaaagagtacaaaggttaaattacaaattcattcccagcctaggctctgggcacatttcctgttcttgaattctgctcctgaagagggtgaacaaatggggcattcaagttgtgagctcagaattactttaaaaggaggtaacagccagccattacacctaaatttaatttattttattaaaataacataattgagggaccatcagataactgtattttgtcaggtgcaataaaaacaaaattaaaacccaaatcatcaagaaaacctgtattcctggcttccttgtatacacatgatgtgactagagaaacaaggctgtttgtttgtttgtttgttagagaaacaaggctggccctgcggccccgccccataggggcagctcctggaagacaaaattcagcatgatggaagactgctccctgagagggctgagatgcggattggccgagtgccttgcctggaaaaccatcccaatgcactggacaccttagaagctgtgaaaggaggacgtgtcccctaagaaaagttccatagtaccaaagcaggctccttcgggcggccagagt

SEQ ID NO: 13247 - DNA, 1550 bp, Homo sapiens
tgaagaaagtaaaggaagagaggcctctttttccccaggtaaggctcagggctgctagaatgtgattaaagcatgggttggttcgtaaagatggcaatataaggtgggagtgttttgttttgttttatagggaggggacccaggtcctctacaagatggtggggggcagggtacatcctgtgtctttgagacacagctaatgagagcattcttgggctttgtttcagatcctgtcttccattgagctgctccaacactctctaccgaagatcaaccggagcgcttccgagccatccttgcatcgggcagcccacactgaggatatcaatgcttgcacgctgaccacgtccccgaggctgcctgtcttctagttgactttgcacctgtcttcaggctgccaggggaggaggagaagccagcaggcaccacttttctgctccctttctccagaggcagaacacatgttttcagagaagctgctgctaaggaccttctagactgctcacagggccttaacttcatgttgccttcttttctatccctttgggccctgggagaaggaagccatttgcagtgctggtgtgtcctgctccctccccacattccccatgctcaaggcccagccttctgtagatgcgcaagtggatgttgatggtagtacaaaaagcaggggcccagccccagctgttggctacatgagtatttagaggaagtaaggtagcaggcagtccagccctgatgtggagacacatgggattttggaaatcagcttctggaggaatgcatgtcacaggcgggactttcttcagagagtggtgcagcgccagacattttgcacataaggcaccaaacagcccaggactgccgagactctggccgcccgaaggagcctgctttggtactatggaacttttcttaggggacacgtcctcctttcacagcttctaaggtgtccagtgcattgggatggttttccaggcaaggcactcggccaatccgcatctcagccctctcagggagcagtcttccatcatgctgaattttgtcttccaggagctgcccctatggggcggggccgcagggccagccttgtttctctaacaaacaaacaaacaaacagccttgtttctctagtcacatcatgtgtatacaaggaagccaggaatacaggttttcttgatgatttgggttttaattttgtttttattgcacctgacaaaatacagttatctgatggtccctcaattatgttattttaataaaataaattaaatttaggtgtaatggctggctgttacctccttttaaagtaattctgagctcacaacttgaatgccccatttgttcaccctcttcaggagcagaattcaagaacaggaaatgtgcccagagcctaggctgggaatgaatttgtaatttaacctttgtactctttgtaaacctctactgaagagttaagtataaaaattaattaagcagaaagtactctaaactcagctaataccttaagtaatacattttataaactatttatttatttggtaggtaca

SEQ ID NO: 13248 - DNA, 1633 bp, Homo sapiens
tagtgttacaaattccaatttaacgtatattgactttattgtgagattttatatatcattgtttaaagaaaactttattctggccagacatggtggttcacacctgtaatcccagcactttgggaggctgaggcaggaggaccgcttgaggccagggattcaagaccagcctgggcaacacagcaagactctctctctaccaaaaaacatttttttaagtaaataaagagaaaactttattctgagaacatgggctttggagttcaacagacctagattccaacataggcccttaaacttgctgtgtggccttgagcaaattaccttcttagagtcccagttttcttatttttcagatagaaataatacctacttcataggtttgttgtatgaattaaataaattattgttgtatggattaaataaagttgtgtttatatggcatgtgataaatggtagctgttgttatttctattgaactttgatcttgtttaaacatttcatgttttttttaaatcctttctagtaaaaaagcacgcttagattggaatactgatgctgcgtctttgattggagaagaacttcaagtagatttcctggatcatgttcccctcacaacacacaactttgtaagttgcagatctcttctctttctggcatgttgagggctttgccaggcataacagagatttctcaggtaatatgcgtatgtatatatatatatagttggattgtttaaagttctttatgctgttgtttacagtaaggcaatttagatttcattagtcagagatatactctaatttgtgattatgaattctgtacatgctggaagtatgattcattttgtaaaaacttttttggaggccaagaaatgaagttgtcttttgtcatcttttatttattcagcataatttacacctgtgttcttgttgtaggctcggaagacgttcctgaagcttgccttctgtgacatctgtcagaaattcctgctcaatggatttcgatgtcagacttgtggctacaaatttcatgagcactgtagcaccaaagtacctactatgtgtgtggactggagtaacatcagacaactcttgtaaggcattgttcttttatccaaggaagatagggatgaggagtatacatactttaaagggtatttgttgtagattttgactgacaggtctggattctagactcatttaatgaattgtgatccagaaactactttagaaacagtgataattctgaaactagctaggtttggtggcattcatactccagaatgagcaggtaggagtaggacttgttatctgtcaaattgagattgacatactgtgactgtgattcagtaaggaaaggagcaaaaggatatgaaaacaagaagattttttgcttttcgctcttaatagtattatctactggggttgctagtagacactgctctgtattttgttgaatatgctgaatgagcctttgacattgagaaggagcagaaagcaccgttgatgctattttcttcacttcaaactggagaaaacttagttgtttggacttaaaattgtttgaatataaaatcttgaaagattcttgtttctttcaggagacaatatatttcatatagataaaatgt

SEQ ID NO: 13249 - DNA, 1198 bp, Homo sapiens
ggctggagtgcaatggtgcgatctcagctcactgcaacctctccctcctgggttccagcaattctcctacctcagcctcccaagtagctgagattacaggcgtccaccaccatgcccggctaatttttgtatttttagtagagacggggtttcaccatgttggccaggctggtctcgtactcctgacctcaggtgatccacccgcctcggcttcccaaagtgctgagattacaggcgtgagccaccgtgcctggcctcttcacctttaaaataatcttactctattattctgaaggatattttcccccaattaatatatcatggactcctctccatccaggtcattataagtaatataatagctgcataatgtgacataatacagatgtctcacactccattcaagtactttcctattgctggacattcaggttgtttcgtatatgtgtgtgtgcgtgggccatcacaagcaatacagactggtgcatttatttctgtgcccacctttccaaggggtgctgcagcctgtgttggtcctaaaggtggtcctttgtttgtaggtcaatgtgcgaaatggaatgagcttgcatgactgccttatgaaagcactcaaggtgaggggcctgcaaccagagtgctgtgcagtgttcagacttctccacgaacacaaagggtaagagctcaaaagtcaattgacttcttcagactagtaaggatcttctagcttcaaatagctatgtttgtattaaattgtactagcttcctatagaatattgtatatttctatacctttctttataaagagataattcagaaaaataggtattaagaaattgaaattattgcttggacattctcttgaaaagttaaatacacgttaagctgggcctgatgaccaatacctgtaatttttttttctttttgaggtggagtcttgctctgtcgcccaggctggagtgcagtggcgcgatctcggctcaccgcaagctccgcctcccgggttcacgccattttcctgcctcagcctccggagtagctgggactacaggcgcccaccaccgcgcccggctaattttttgtatttttagtagagacggggtttcaccgtgttagccaggatggtaatacccgtaattttaacactgggaaactgaggcaagagggttgcttgaggccaagagttcaagaccagcctggg

SEQ ID NO: 13250 - DNA, 1300 bp, Homo sapiens
cccaggctggagtgcggtggcatgatctccgctcactgcaagctccgcctcccaggttcccgccattctcctgcctcagcctcccgagtagctgggactacaggcgcccgccaccacgcccggctaattttttgtatttttagtagagatggggtttcaccgtgttagccaggatggtctccatctcctgacctcgtgatgcacccacctcggcctcccaaagtgctgggattacaggcgtgagccaccgtgccccgcagttgcttgctaaatcttttaactgctggtcccattttcctcatctatgaaatatttaatggaagtgtactattaaagaaacttttctttgctgatgaatgcaggaggtatcattaaaaacccacatagtgctattttcataattactctttatgtattgtgttcttgggttgaatacttttgttctagagttacaattatttgtgtttcttaccaggtttaagaattgtttaagctgcatcaatggagcacatacagggagcttggaagacgatcagcaatggttttggattcaaagatgccgtgtttgatggctccagctgcatctctcctacaatagttcagcagtttggctatcagcgccgggcatcagatgatggcaaactcacagatccttctaagacaagcaacactatccgtgttttcttgccgaacaagcaaagaacagtggtatgtgaacattctacttaggaaatttagctatttatctgcctgtggagcacattaaggatcatgttcaacttaaagacaggcaaaatattcattgtcatttagggtctttatttttttttttctaactgcagatttatttttttatattgctgttccttccacaccccctattttttcctacctcttggccttccttctgttactcttgcctggaatgtcttcctttgtgccacttcatccaaacaaatagtacattcttatgggtatatttcaaagacttttctttgagaagtctctaggcctttccaactacttattttagaagacattttatttcttctattaaaatattcacctaaagctttttgactattacaatcaagtataaagaagaaagtaaagttacatagaaaagattatttttgtatatttcataggcccaggaccagtctggaggcagcttagaaatcatagaatcttctttttcagggcactgacaccagccacttagttctgcgtagtttattttttcagtgccagtgacaggttcatattggcatcatggcaggacactgccactaggttttct

SEQ ID NO: 13251 - DNA, 1145 bp, Homo sapiens
tgattgcggggcagggacttgagtatggggaggaggctgctagaagaccatcgcagtgatccattcattcagtctagtcatatggtgctaagagctggttttaagcacagcaaatataggctggatccctgcagtctgtaggaggtaagtatgggaacacagtacttgccactgtcaattaacaaaaagcgagcacttcagattggctgctcagaggcccctcaggctgtactcaagctgatttgaatggcaaagaacctctgtggggaaactagccagtgcaaaagcccagaggtggagttaggaaatagctggtgagacagaagcctcaggagacctcgcagcagggatttatgttggggaagatgatggggcagagaggaagccaaagaccagtgaggaggcagtggtgtgggccaggctcaataaaggatggctgcttctgctgtttcctactttaggtcaaagctggttctgtgaagcaggagtttgaaaagcaagatgaactgaagcgctctgcaatgagggcagtggctgccctgctgaccatccccgaggtggggaaaagccccatcatggccgacttctcttcccaaatcagatccaaccctgaacttgctgccctctttgaaagcatccagaaggattccgcttcagcccccagcacagactcaatggagctcagctagtcccctcagcaccaaggtgggccctcgcttaagagaaaggagcccacccaagtccgaggcctccccatcccaccatcgcaggtctctacttttgcccttccaccatctcactgggggccctgtcgctcctggtcagggcttacagtgccttctccagggacccaactcaaaggcccccagcccaagctgtgaggctgccaacagttgggccccttccttaactcaggacagtcatccaaagaaatagggtgaggaagttttccagtgacttcacactgtacccctccatagtctgtctggttccttcagagggtgtctctgcctcacaaactagtagtatttagaaataggctgtgctgtcagctgtaaaagatcaggaggcagcagacaccactctggtttcttcactgcattcagcaatgcctgaagttagtgctcaggccgggcatctcaaaa

SEQ ID NO: 13252 - DNA, 2737 bp, Homo sapiens
gcacaccaaacccggggcacttctgttgccatctctcccctctgcccctcacggcccaaccggagccccaggagcccacagggctggtgttgtgtggaacaaaggcccagatttcatttcttgttggcaccctgggctctgctcacctcagtctgagggatgggtgggcctcagacaccatcagccttgaaacggtgagccagccaagtagtgttgaactgcctcccccactccagctctcagctccctgtgccctaatgtacatgcatatgaaaacccaacctagaaaacgaagaaatgagatacaaaaacagacaaaacaaaccccaaaacttgctgcattattgctcttttattgacaatgggcaaaaaaataagtagacctgatatggttgatgaaaatacgtaagtaaactttatataaatatataaatatataaatatatatatatatatactgtataggtagtacttgtgtgtgaaaggcaggcgtttcagtccacattagcaatacccaccttacaaggagctccacttacctaataggaagacagtaccttagctgggtgtgtgagacaatagaccaaaccctaaatgctaggaacaaattcagatacttcatattttcatacaaagaagtccctctaggactggctaaaatctttacacaatcattactaactgtgccaagtaacatagcatctaactgtttaaaaagtccagtattgctttgtataaatccttattttattaacagaatactatcataaatagtattataatgctgttatttcaggtaagcaaatagctaaactgcagtacactctacagtagcaactcaggacagctggttacaagctggttgtcttaggacattggttacacggattcttagacactttaatggctgcgataactgtgactctccatgatccatgtttcttttatgcgcatatgatttgacgcacactcattcagagtcctccgagaggggcacccatacacggcagaagtgttcatctccaacatgaaagtgaccagctctcatcctcgtctccccaacaccataacgtcctcatcccgcctccaacccacaccaggccgaagccctcagagagtgttttcatcaggaaccactctcgaacctgaaggttgactttagcgtttagcaacccagggcggtgtgtgtgtttcccgttttgttttctgagtggtagcagtgatcaccgtaattccatgtagccatgtgctagcagaacccctgtgtcctcaccgtggcccgtgtgaccccagccgacgagtgcccggcggagcccccgctgccttcccatggtccagtgagctgccagggcatcacatgactctcagctgtgctcttgtcgcttctgtgttgtggtgacaccatgcgctccccagggccagacctgcacgcggcaggtctgtgcccgagtcacccacgggccatactttgtagtttcagcctttcgagccactgcagccgtcagtgctgtgctcctaagccatgggacccgaggactgccccccggcgcctgcccaggcggaggccctttcagaaagggcgaagctcacgcctgactctgcgggccgcggggccgcgttcccagtggacagcgtggtgagccgtggccggacggcaggaggagaggggagccccctctggctgtgtgtcaccttggctggctggctggccagggttttgccgatttccctcctcacatccctcccaccctcggtcatatcattgagatcaccgtaccagcaaatctgcaaaccaagcactttgttaatctccagagagagcaaatacagcaatctagagtttagcctttttaaaaatgtgactttaacccgcccacctgtgtcctcccattggcgtggcatttctttggtgtctgctcagaaagaaacagcatgggaccgtgtgattgggtccaggctgggctgtcagggaagcgccctggtgtctccgactcatcaattctcgggtcttttttaaaagccaggctccccaaagcactctgtctcgcaattttgaggaggctgttccgacctggaagcgttaaactgctgcatgtcatctggcgtcagctgtgaggctgcgctctgcgtgttgtgcgtttgcaaaatgtattggcgtgactgtaaacacatcgttgaagtaaagcgattacatattgagtatgtcagcttttctcaccctcttctgtgctgggaggagagtctaactgtaacctttaggttgttccagaaaagattcaggccgtttggcacagaattgctctttctgaagggtagcagtaatgaataggaacagacagaaaaccccaggaggggctttcaggaaactctccctctccatcgccatcctgcaagctccacagcctcgggctgccagcctgtggcactgtcctcggtgtgtcctggagctgtgctgggcagcagggcctcgcgtaaggaactgctggaacccactgagcccttcccggggtttcccgccgcactcagtgtgttccttcaggctagtgaggtttcattctgttttatttgcaagcttatcaaaagtttgtggaagatacattgttgggttccagaggctggagtcatgctgcccacatcttgtttgggaaagcaaaagctcccagtgagctggtgtccccgtgtgtctttcatgggactgtcccctttagagatcccacctgtcagagccacagcttcg

SEQ ID NO: 13253 - DNA, 1220 bp, Homo sapiens
cccctgaaactgcctacattcctgggagtggggcaccgggagcagcaaggctcaggggcttttgccagcagctgtggcccaggctctcccttgtggggcaggagagaaaagaggcactggccgaccggtgggtgccggctcgtgccgctgcaggctgtgttgctgctcaaggagtgtacgggagggtatcgtagccgccctccgccgaacagtctgtccaccagtcagcgagcttctcccaggaggggccccggggactgcctggggctgcagtggcccagcttgtcccacgcaggtctgccccaggagcctggtgtgcctgttttgggaagacccccccattcctggggttgcctgccccacctgccccaccttaggactccctcccgcacctgcccgtcagcagccttgcctcccctcagcttagtccctctcaggccctttggagtctgccctttaagttggattttttcctttgttttcgttttgtcattattattattatttgccatggtaaaaaaatcagaaattcattgccagttgccagcatgagggttgaacccagggcttctcaacctcggcttgattgacattttgggccaagtgactccttgctgggggaccgtcccgggcttggcaagatgtttactcgcattcctggcctctactactggttgccagtaatatcttccctgtcatgacagtcactgatgtctccagaaattgccaggtatcccctgggggacagaatcatccctggttgagaaccactggtttccccagtggccttgtgaaacacagctaaatgtcactggactgctttgggcctctgcaggctgtgggctagagcctccgtttgagtttgtgcagtgtgacaggccctgccctctcccttcccttagcccctctcaggcagcagcagttctgccagaaccgaggcccttgagcgccatccgccccagggcccagcagtcaggacctcagctgtccaccctctgccagagcttgggggttggacagccacgtgccggccccaggttcgtgtgaggggtgggcccacggccagctgctttcatgtagtgtgacgattgctgttgtcatttgggaattctgagctcagacggacaatagggactgagaccccaccctgggcctgccattgaaacaaaaggaggaacagatctcagggacccccctgtaccccgaaaggtttgggggtg

SEQ ID NO: 13254 - DNA, 1227 bp, Homo sapiens
tagtaacatagcaagggcccggtagatgttagttgtgatcattgttgtccttattctggctgcccttaagctcaaaggtctcccatcctgagagaggaaacctttcagaaaggcctgtccagaactggccctgattgaccgttggtcgtctgcctccctagagccctggcgtcagtcacccatctcatcccatccctccctgggcctcagtttccacatctgtgagaagaagaatgagcctcttgatccttgtagtcatttgcagatgcaggatgtttagcccaatggttagggaggcagattctgtagtcagactacctgtaactctaactccaactctaaagccagctctgctcctcattgtccctatgatcttgggcaccttccttagcctttctgtgcctcagtttccccattggtaaaagatggatgacaggaggaggccatggagttgttgtgaggattaaatgaatgaatccatgtgagtgcttcaacagtgcatagtcagcaccagaaacatggcatcctttagctgatgttttaggcccgagaagtttgactgtgtggaactggaccgtattacttgtttggggagatgtgttcctagatgggagtggattgtttatctttttggcacacagacaggaccagggttaaaagagaggggtgcagagagatagtggtgaggggaagaagttaaagggctaaagggctgcaggctgttggtggtatgacagatggcagacacagtaagaagtgactaagcccatggactttagcttgtgcttgtagcgtgctgtccaaacagcccacaaagaagtggatggttaagggtattaagaaaatcgctttgcctgtggattggggaaattgcaaagtaaggcagcttgcagttgggctgggatgaagatttctttagataggaatgggcaaatggcctgcaccatgtgtgagacaccctgaggtgttaggacatcaaggtagaggcccccagccctgtgtcagatggagcagagctgtggtgcgtctggagccctcagctggtggcctgtgctgagcttctgaggctttgggcaggtctggcttcctggtggtacctggggctgcttctggagcctaataaggcccaaagctgcagagcctggcctcaggggcagtggccttcagtccctggttctgctgctctgtcctcttcagctggtctgtctgcctgggaggggaggcagc

SEQ ID NO: 13255 - DNA, 1311 bp, Homo sapiens
gatggggaagaggatgcgggctggtctcacccggctcctgaccccatggcggactcgaggctcaccaagctgctgcagaggggacaggcagcaggaggcgggtcctccacagctagctcttccgggtgtcctttgtcagcctggcattagcatgtatatatgagagagagatttcacagctaattctacaatcatacttcacaattctttatgataaagaataattttaatggtaattttttatctagctttgtctatgtttctaacatgtttatttacatggtttacaattcaaaagatacaaaagggtatatggtgaaaagttccccctgttgtttctacttggggagtgaaagggaacgggggaattgtgacgaaacaacactagtcccccagcagccggttctcccccccagagatgtctcgtgttattagtttcttgtgtccgattccagagtttcacatatacataagcaaatgcctagaaacaaatgttatccccccatttttaaacacaaatgtggcaatgccatacacacagtctgacaccttgtatagctaactttatcaatgacttagccctacaaggtagatattactatcctcatctatagggaaggaatttgaagttcagagtttctgtgatttgcccaaagcaacacagctaggaagtggcagagccaggattcaaacccaggtctggctggctcctgctccccctaagcacgaccccgccaagcctcacccctctgctgcccttggagtggctgctgtggggcctcgttcatccatcagatgaggcgagcttccatcctgcattgatctctcaggacacttgggttgcagttgacagaaactcacctgaacactgcttagaggaagggagaattgattggctcctctcaccaaagtgcagagggaaggagtataatggagcagggtccctcctgaggtcaagaggcaggatcggctaagacagccatggttgtcacgctgctcacagtgctcctcccaggaaggagcatccacgcagccctacttgggtccctgcaggcagggctggacagtgagaggctcaccaggtccaaatgcctggaggaccagacgaggcccaaaacaggagagaacagaagggctcttaggaagaggaaagggcctcgaggaagtgaggaacacaggcaaggtcccatcccagcccctccctcctgatctcccctccccgtgcatggcagggcattgaatgtggaattatccttaaccagggtagtaattactgaagatgtagctggcatgttgaacaaattgttgtgt

SEQ ID NO: 13256 - DNA, 1133 bp, Homo sapiens
tacatgagctgggcatattcatttcatccacaaatatttatccagcagctagttgtgccaggcgccgtgctgaggctgggcataagtggggtatgtcggacaaccttattcttatcctcacggagctgtccagaggggagagggaaagggaaattgtcctctgaacagcatcgcccaggtgctgggaggaattgcccagcgtggcctgtgaggtcagcccaggcgtccctgaaggagctgagccaagaaggtggaatcggggctgagtgggctccaggggctggctcagcaccccctctgggcaccctgctcaaggctggggcatcacttcatcctggccgctctgtctcggggctaggaaggccaggctgcagttctccagcagggtgacaggtggtgggtgggctggacctgccaagaccaacccagtgagaggtggggctggggattgctttggtcaggccaggagtgagccatgcttcctcctgctcctcacccgcccccaagccagcacccagactgcagttgtcaccacgccacctttcatcccctccgaggactgctctaccagctgtgccctgagctgtcgttttaatctgatctaaatttgccaccatgcccaacctggggaaggttgggtgaaacccctgtttgcagaggatggggcttaggtgctggagctggagcacccagttcagatctggattatgcagctggggccagcggaatgctggccataaagtccctgtctcataggaggggcaggtgcaagtgagttacagtggggaaggccctcaggagcccccagtgagcaatagcactcctcaccctccatcccacgcacaagcacccagagagggcagacagctgtaccttgctgaaggttgattaccacggccagggcctccctctgcagcctcaggacagggttacctgggcccgcaccttgccactgtctcttgcaagctgggaacgtttggactagtgatttctcaaacagcctcggtttcctccagtgcctggtgcatggcaggcacacagcagatgggggctgatgctgttttgtttcctgaagtgaccaacaacagccccaccacaggcaggcagctctttcctgtcagtactaggggctg

SEQ ID NO: 13257 - DNA, 1189 bp, Homo sapiens
gcaggtgccagatgacatgagctgctcacaaaagggcagatccatacgatccccttataaagagtgtcctggagtagtcacatttgtagagacagaaagtggaaggatggacgccaggggctgaggggagggggattggtgagttcgtgtttaatgggggcagagtttcaatttgggaggatgaaaaagtcctggagatggatggtagtgatggctgcacagcactatgaatgtacttagtccactgaactgtacacttgaaaatgagtaagatgatacgttttgtgttgtgtgtagtttaccacaataaaaaatcggggaaaaacagtatgtggggcatagtgagcactgggctctgggtttgctctgctgctgctactgttgtacttattaagctttcagctacatgaggtcagaaactcatttctttggctttgtagtctcagcactcagcacccaggaggtacctttgtggaacctcctgcctggcctctaattctggcatgggtatgtgcttgtcactcaatcctcctagctggctcagctgccttggctcggtccctcctgtcaggagtcttcttttggacattgactgtctcattagaatattgttgaatggaacagagtctcataccccaggtagcgggcagtgacctctgcatggtgcagtccttgtcagaacctttgtaccccttggccaggctccagctctgagctggcatatttcagtcttttggatgccactgtgtaaatactgtggtttccttctgggtcctcttctcaaggttttcctctgcatcttgctggtcgggaattgcagcaacacttaaaatattcctgagtgtgaaggttctttcagcaaacactattcatttatttattcaataaatatttattgagcttctactctatgagccagaactgttccagttgctgagcagttaccacagtgcacaatacaaggaaattcctgtcttcagggttctcatttcagtgaggaaagccagacaataatggtggtaaatagaggttatatgtagtgtgtttgattggaaatgtgcttaggagaaagatcgagctggggtgggtaggtggtgttggcatgttagatggaatggaagcaatggcctaaaggaagtgggcaagtgagctgtgtacacatctgggaagagccagcctggcccagggc

SEQ ID NO: 13258 - DNA, 1107 bp, Homo sapiens
gagtgtcggtgtcgaaacccggagcagcctcaccgtgtggaccttcgggcgcccatctggggcaggacaagggggctgggaggcttcggtgtctctggggcggggtttctgctgctctgtgccctctgcctgcccctctgcctctctgtcttcgggatcacccggggcccactatggcttggcctggggaagactagaaatcactgtgtggttgggggagtggccgtggtcagggcttcaggacagtcttcctgctgggcggcccttccagggtggaaatgggggaggagttagctgtggccccagaaggtggggtggttcctgattcccaggagtcccagtactgtcatggaaacccgagtttcccaccccaggggggctgcagcgactgtggccatgggacaggccctgtctgctgccctgcctggagggtgtgctggctctgggcggtgcgggtggggctggggggctctttggaggaggagcattgtgaggatggggtcgggctgtgggtgaacacatacatggctctgtgcgtggcaggcgtgggtgtcaggctcttgctctctgtgaatggagaaggaggagcgggacgtgtgtatagctcctaactggtgtcactgggaggaagcagagaccccgcccactgcctgtctgggccccactcctggccctccggagtctctgagactcccttcactcttcagtcctgccacagcagctgtgggtctcccggagctggtctcacaggggcccgggccctttctcccacaccaggaccaaaagagaagctggggctgcccaaggaaagtcctcagcagcttggggaggcggcaccagggcaggtcccaagtccctgctttcatgggaagcagtgacacgttggtcagcacatgcctcacaacaccaccctggggaatggcttcctttttcccttcagcgtcacccctggtgaccacgcaggggacaggaggatgctgagagggagcacgtcgtccttccgtggggcatccccctgggttgcatccaggcagccgccttggccgggaagccgggatgggaaggctgggattttgtttcagaagtccctggttctgtgtccacctg

SEQ ID NO: 13259 - DNA, 1570 bp, Homo sapiens
tttgagcagttagaagtgctctttagaagttgtctgtgggtgatgttactgtagtggtctcagggaaaggattgtccagttactttagggggtttttggtggggtttttccccctgtgaaaacttactttgcccctagtctggctgctgctaggacttctgaggagcaatgggacatgagtgtccctgtatctgcgccactgccgcaagggaagcctcaggaaccagcacctggaggccaggatagccaagccctgggtgagcgagaggctggagaacacaggagctcacccagggctgctgcccaaccatgggccactgtgaacagacttcagtcctctgtttttgtttcataagccgttgagacatctgatggacttggcttaggccctgctgggacatcccacgtgtgatccctttcactccatcaggacaccaggactgtccttaggaaaatgtccttgagatggcagcaggagtcatattttctgtgtgtgtgtttcggaaagccgctgtgtcctgcctcagcacaaagacccagtgtcatttgctcctcctgttcctgtgccactccagaacctcagcagatctgagccaccgcctgccagtgtgagaggcggccactttcatggcagctcatcaggcgcagggccccagacagcttcccagcaggccctagagcccggcctgggccaatgatggagggcggccgccagcccagggcctgcccatccagaagggactccccagggcctgggggaggagacccttggaaaagtcctctcttcccagctcctgattctggatctgagattctcagatcacaggcccctgtgctccaggccgaggctgggctaccctcagggagatccagagactcatgcccatggccatccatgcgtggacgctgtgtggagagtccaggatgacgggatcccgcacaagctcccttcagtccttcagggctgggccatgtggttgatttttctaaagctggagaaaggaagaattgtgccttgcatattacttgagcttaaactgacaacctggatgtaaataggagcctttctactggtttatttaataaagttctatgtgattttttaagagggtgtgatcgttgctgagatttctgtctgatggtgatgatttcttccctttacccatctatgatactctggggcctggcagagctggaggtctgagctttattctccccaaagggtgagcatcattttcaagcacattcaggttggcaaatgcaagtgcatctggacgcagccagatcttgccagcaagtgagtgtgcccaagaaggcacattgacaaaaccaggtgatgccacacagttcagctttctgctcccaagctaaccaagcaactctctgtctctaatggttgccagaaaaggcttttagcaccatttagcactaaaaatatagtacatcatatagattgttttttctctagaattcttaagtctggccaaaagtgaactctcgttctctgtttctctgtgtgtctttgtgcatgcttacatgtgcattcctgcatcctggaaatgtttttttg

SEQ ID NO: 13260 - DNA, 1099 bp, Homo sapiens
gtgattggcttttaactcagatgtgtatgtggtgaaagctctgagcctcacacctgctgtctgttgctaaaaaggaattgataaggcaacgaagggatggggaggggctgtgctttggggaaggagctacagagggcagggcctggcagcagcaccagaccattcctgggcaggagtcagctaaagcttcatgccaggatggtcaggagattccaggcagggagttgtgggtcagggagagcaggtgctaggggccacagccctgtagagggcgggtgcagcagggtaggagagctgatggctccaggtggctggagtcaggagcatgaccggcactggggcaggcagcgtggctgtctcctgaggctgctgagtgagcccccatgggggtagcggcagccagcgaggaagctggcctgtcatccaggtgagctgggctttgactggagtgtccagctatggaaagggggctgacacctgtgcttcctctccaggcctctcaggaacctggagctcctcggccaacagcatcctccacatcgaccccaagacgggtgtggctgtggcccgggccgtgggatccgtgacggtttactatgaggtcgctgggcacctgaggacctacaaggaggtgggctctaagcagccggaggcacatgtggctcagtggcctgtgaggcgggcctgaccttctgggaggattatgaagacttttccttttagggaaaagccgtctgaggggttgggtctgggagtcatgagtctgggactggccacttgctgactctgacatggggacaagctcccttttttttccaggcttcagtctccccatgttcaagagggtgtgatgaggacaggcagccttgtagggtggattccagctcccatgggcttgggtctggcaaccccggagtgggcacttcctgggagccggtgcttccctgtcacctgcaaggctaagactccctgtgcaagtcaccctttgagtctggaggcgacaaaacctgctgtctcttccattcatctccagttgagaatgaatcagtggggcaagtctggctgagatccaaatgcatctcatttttagaggcagcat

SEQ ID NO: 13261 - DNA, 1121 bp, Homo sapiens
agacacacactcacttaaatctttagactctgcctgggtcacagacctctttcattaattcacatcattttgtttcaaaatgggtgcctggcagcaaatcccccgctctagtttttggtgagtgaaagtgactgactgctcatcctatttcaacaaatatgtactgagcactagctgtataccagacactgcaccactgaactttgttaaagaaattcagacctttggagcactagcttttgagcgaggatagattttcacctggactcagagaaacaagggctgctgtttatggagctcgggttcttgggctccagaaatccccatttccctccttcccctggtggcctgcagggcatgctgtggcctgcttagcgctgcccctgcgatcgaggaggatttcgtttctttaaatgccccaagagccaggttctctgaagaaactggacatttgcagcccagggggccctcttgcaatgtaaatagtgatctcatttattcaagtcatggattgggacactcctgggtgggttttctcatagagaggccagtctgctgtgttgggaagtaagaaccttgtcactaggttgggacactctggggagtgtggcctttactcctctcaggacccctaagtccagccctgcattgttcctgaggtggatcctgctgggggcaggtgtcccctccttgggaggtgggttttcctggaggccagtccctggcactgaatcctcatcatacctgtatgttgtcccttaggtatcccctgtttcctacctgagggtttccatgagccctgtcctgcacacccagaacaaggaggccctggtggccgtgcctttgggaatgaccgtgaccttcactgtccacttccacgacaactctggagatgtcttccatgctcacagttcggtcctcaactttgccactaacaggtaggatgtgggcaagggtcatttctcctatgaagtcctgtctggtacctggtagagacaactggggataacacagaaagtctgctgctgttgaaggaagatgtgtattacttcagtttccaagagatgtgggcatgctgcaccatgcagggccacgaggaaacaccactgcccttgggggat

SEQ ID NO: 13262 - DNA, 1196 bp, Homo sapiens
ccagtggctgggagacagcccccagcattggcccaggaccctgggccctctggtcactgctcagagagaagtgatgtccatgtcccaggttttcctctcatgaaacatgtagtgtgtgagttatgcttggcgccatgggcttggggcacagtagtcctttctctcctgtgtctctcaacaggtctttcccccgttcaggctgatgcccaggaaggtgacactgcttatcggggccacgatgcaggtgagagccaagaggccacgtcctgctccagccccagtgcaggccaccacctggttccaggcacgccgcctctggccctgcgtgcagtgactgggagaagaaggcagaagctgcctgcactggggccctggctctctgagtgggaggtgcgggctgcctggcatgacgggcactgacacgccgctgtttcctccccgctcaggtcacctccgagggcggcccccagcctcagtccaacatccttttctccatcagcaatgagagcgttgcgctggtgagcgctgctgggctggtacagggcctcgccatcgggaacggcactgtgtctgggctcgtgcaggcagtggatgcagagaccggcaaggtggtcatcatctctcaggtaacaggcgtgctattggagactgggcagctgtgcctgggacagaagcctctttactgtgtttgagttctacctctgaggaccacccctctccaagggtgctgcttctgccccctgggtctgcagtcactgcaggggccctggtgcaggacagccctgccaatatgggagcacccagacccccattggttgttcttctccaagctgagtctcccagtccttccagctgctccttatgggacagggtgttcagcaactcccggccccaaagggcccttccagtggaggatgatggcaatcatggtgaaggcagatgctgctctgagcactttgccttcatctccttgaatcctctcaaggctcagggctaaaatcagggcctttgcattctccctgacctccttcgccagcagtgacttgcagaagcatctcggaaggctgctttggggttccactcacagctgcgccagaaacctggtctgtaagaagagccttctgtgatgtgtaatgcaactgtggacagaaacctgtttcagagtcagtcataccattcctcatgagaactaggtc

SEQ ID NO: 13263 - DNA, 1172 bp, Homo sapiens
ttgcgaagttgcccacgggttttcctgaggaggcaggaggtcacaggtcgggggtgaaaggcgggcaggggaaggggtcaaggaatagcagccaaggctcatcacagcatatgcctctcctgctttttatgttggcctggggcttctcaagttccctggaccttgggcttttgtgtggagagaacttgagctcccggtggccatagcatccctagagttcaccctggctctcctcttttactccagtttaatcatggtttcacatagagataaaccatgcacaatgggcagtcagtgtgagggctcagtctgggtaatgccctttttctgggtgcctgctatacttatggagctcccctgggacctctgggttctgaaagtgaggatttgggaatgatatcttgtttctttcctcttaacttccctattcccatgtttaaaacatctctttctcttgctcacaccaccacttccccattccctgtccgcacctcactttgtctgccttttctttatgccaagaatgtacgccctgcagaagtcaggctgctgattttggaaaacatccttctgaacccggcctatgacgtctacctgatggtgggaacctccattcactacaaggtgcagaagatcaggcaagggaaaattacaggtgtgtcattggctctgccatcatgacagatgcttccttcctcctttttttattgtggttacatacatgtaacaaaatttaccatcttaaccatttttaagtgctccatcaggtagcatcaagtacattcacactcttctgcagccatcaccatcatccatccacagaactcgttcatcttcccaaactgaagctctgcattgttaaacactaactccccttcaccctctcccagcccttggcactcatcactctatttcctgtctctgtgaatgtgactactctggttacctcatgtacgtggaatcatatagtatttatttttttgtaactggcttatatcacttttttcctagcctgatgtcttcaagtttcatccatgttgtagcaagggttggaattcccttcccttttaaggctgaatagtgctccattgtgtggatggatagaccacattctgtttacccattcatctacccattcatccatcagcagacacttgggttgcttccacttt

SEQ ID NO: 13264 - DNA, 1218 bp, Homo sapiens
gctgctgttttcgtatctcttgccctgtcttagcatcttaggttgggttccttagaagcagagcctgagttggggggtcttgtgcatgtgttggttcatttggggagacctctcaggagaaactctgaggagtgagggatgagaggtggacaaagctgtggcccacgtgaggtctgaccctgtgggagctctagagtgtgagtggcccccatagaactggctgctttgagagtgggggctgagctctggccccatgttaacctgttatgggctgggctcctcccagcccccatagggaggactccacctcgcagacagttcaccaaagacagttgtgttgtgagctgttagcgaccagcatgcacagcagcaggggtggatgagtttgcctgcccagtaaaggagacctggacaggcccctgcatatctgctggacttggtgacttatgaatggtgactctgcctcatgttgctatccacaggctccaccaaggacctgatcgagacttgctgcgcagccggacagcagtgggccattgacaatgacgagtgcctggagatccctgagagtggcactgaggacaacgtctgcaggtagggtgggctccctggagcaggcggagctgcccatttgccttctccagaaccctgcttgcctaggaccccaggctccaggcagcccggagagagtgcaccttcacatgcctctggggcatgagggtgattgggtgtggctgccgtgcgccatctggccaggctttctccaggggtggaaagtccaagactggtcctaggaacaaaccagccacataaattggtagctggcctagtgagcaagatccgaggaatgtacaatttgaaacaagttttaaaggagtgctgtcccctaggaatagtcgggtgctcccctcaccacattctgcagttgctgccgcactcatgccactcaggctttctctcctctgccctcttcctttctctgctttgctacccttgggtcttcaggaggctggcctctcactgtgctcccttgctgctgtgctggttgtttcttctgactctgataccacagcaaagcaatcctttatccccatgccttcccttttccaggcccaggagagctcttggtcagctgctcatgctttgtttttttccagggaccccgtctaacctactcatttttccaaataagaaagattaagttcagagaggcagtgt

SEQ ID NO: 13265 - DNA, 1223 bp, Homo sapiens
cctgctggttcagtgctgggcacataaatcattagtaacagcctgctgcatgaatgaaccaacacctctaggaatggctgagaggcccaaataggcaccttcaggaggctccacccacagcctcttgtatgagtgtgcaggacccaggttatttctagcattacaggcaaatgtctttatactggcctcagactactctccacataaagtattaaagtttacaaagcactgctacatcctctcccctggatcagggtagagtgggtggcttaggcaatgtgcccaaccacgcagctcatagcagaggctcctgtgctcccttagctttcagaacgaagctccttgccttccacccactgatcctctcccctcctcatgcatgtagcaacatgggcccatcctcatctagggacaggagagatctgctgagctggtgaggtgtagagcaggtggcacctcatcacctttctcctttccacagtggactggtttcctgttttccgagacctggtcaacattggcctgaaagcctttgccttctgtgtggccacctcgctgaccctgctgaccgtggcggctggctggctcttctaccgacccctgtgggccctcctcattgccggcctggcccttgtgcccatccttgttgctcggacacgggtgccagccaaaaagttggagtgaaaagaccctggcacccgcccgacacctgcgtgagccctaggatccaggtcctctctcacctctgacccagctccatgccagagcaggagccccggtcaattttggactctgcactccctctcctcttcaggggccagacttggcagcatgtgcaccaggttggtgttcaccagctcatgtcttccccacatctcttcttgccagtaagcagctttggtgggcagcagcagctcatgaatggcaagctgacagcttctcctgctgtttccttcctctcttggactgagtgggtacggccagccactcagcccattggcagctgacaacgcagacacgctctacggaggcctgctgataaagggctcagccttgccgtgtgctgcttctcatcactgcacacaagtgccatgctttgccaccaccaccaagcacatctgtgatcctgaagggcggccgttagtcattactgctgagtcctgggtcaccagcagacacactgggcatggacccctcaaagcaggcacacccaaaacacaagt

SEQ ID NO: 13266 - DNA, 1106 bp, Homo sapiens
tatactgggcttcacacttatcttatggcttggcagaatctttgtagtgtgtgggatctctgaaggccctatttaagtttttcttcgttactttgctgcttcatgtgtactttcctaccccaagaggaagttttctgaaataagatttaaaaacaaaacaaaaaaaacacttaatatttcagactgttacaggaaacaccctttagtctgtcagttgaattcagagcactgaaaggtgttaaattggggtatgtggtttgattgataaaaagttacctctcagtattttgtgtcactgagaagctttacaatggatgcttttgaaacaagtatcagcaaaaggatttgttttcactctgggaggagagggtggagaaagcacttgctttcatcctctggcatcggaaactcccctatgcacttgaagatggtttaaaagattaaagaaacgattaagagaaaaggttggaagctttatactaaatgggctccttcatggtgacgccccgtcaaccacaatcaagaactgaggcctgaggctggttgtacaatgcccacgcctgcctggctgctttcacctgggagtgctttcgatgtgggcacctgggcttcctagggctgcttctgagtggttctttcacgtgttgtgtccatagctttagtcttcctaaataagatccacccacacctaagtcacagaatttctaagttccccaactactctcacacccttttaaagataaagtatgttgtaaccaggatgtcttaaatgattctttgtgtaccttttctgtcatattcagaaaccgttttgtgcctgctgggagtaattcctttagcaattaagtatttggtagctgaataaggggtcagaacttctgaaaccagagatctgtaatcatctctattggcctggggtgcctgtgctataaatgagtttcttcacatgaaaaacacagccagcccaagatgacttatctgggtttaggattcaatagtattcactaactgcttattacatgagcaatttcatcaaatctccaaactcttaaaggatgctttcggaaaacacgctgtatacctagatgatgactaaatgcaaaatc

SEQ ID NO: 13267 - DNA, 1420 bp, Homo sapiens
tatgtgtgaccacagtagcacccagaagtaacacataatggctcagcaaagtagaagttgatctcttgcccatatgacagccctggtggggtttagatctgcacaatagctttcttccaggtggcaagtcaaggacccaggcttcacctatcagtggctctgccatcccctgagctctcgccattatcttagttcatttagtgttagaggaacgactgcagaggggcattctgggtcagtctggatatagtcctgtcatttctgtttacttgccattggttaaagcaatccgatggctacatctggttgcaaggaagaataagaaacatagtccagctgtgtgcccaggaggagaagagtgagttttaatgggtagctccagtctctgccacaattgtcgaaaggaagcagttgatggattggttcttggtgctaccaagggaagtgatcaggttttttaatccaatttttttgtgtcatgatgaatccattttttaacatttctgtcacaaacaataagcagtaatacacagttgtacaaatatgttctgtttttttttctcttctagtcaacgaaacggaatattccaatgctctttgtccggggagatggcgttgtcctggttgcccctccactgagagttggctgaaacaaagaatttgtcctgtatggaaaacgggagactttgtacagtggcctctctaaaagtacaaaacattcataagagaaacctgcatacattttgatattaagaaataattccggggattcttccactcctgaaatgagttgatttgcagataactcacaacttcttaagctaaatggtattttcatttttctcaagctctccaataaatatgaccaccaagatgcagaactctttcaggacttcttttgctccattattctcacagatacttactgatttttcttttctttaaattggtgtttccttgtagatttttttaagtgcggtcttctgtcttgtgaattatttaaagtaagcatgtcttaccttcacttagcacacatttgcagtgcacctactgtgtttgaggcaccaggtttgagtgctgggaaccagagttttatcaaaatgctttctgggccagacatggtggctcatgcctgtaatcccagcactttgggaggccaaggtgggtggatcacctgaggtcaggcgtttgagaccagcctggccaacatggtgaaaccctttctctactgaaaatataaaaattagccaggcgtggtggcgcatacttgtaatcccagctactcaggaggctgaggcagtagacgcttgaacccaggaggcagaggttgcagtgagccaagatcacaccattgcacttcaacctggtcaacagagcgagactccgtgtcaaaaaaaaaaaaaaaaaagttttctgccct

SEQ ID NO: 13268 - DNA, 1221 bp, Homo sapiens
cgtttgtgtctgcatgaatctgtgtgtggggggctgcgtcttccaggccctggctaggtgcacgtgcgtgtccctgagtgtggttgtgtctccaggtccctggttgtgggcactcgtgtgtcctcggctgtacccaagagggtgtccctggtgcctagagggtccaatggccagagctggttctccagggccggcgctgagtggggagaggtgatagggcagcgtggctccataggtgcatgcactccataggtggtgtgcaggtggcagcgccagcgtccagcagtcctgagtggtgggaccaaggcccggaggggcagccaaggggtagtggacagccggcagggccagcaggacacttccccctccagactatttctcttccttctgtgggttcctcttttgagtaggagattctcgtccccctcccactagggaagccacacagagagaattccagggacctcctcctacagcctcaaagcttcagcctggacttcagcctggactggagaggagacctgtgggcagctctcccaggcagggaggtgtgtgccgggtagggccaccggcctggctattttggtcactgttgggcctctgccagatcccggcatccccaggaccagccccaaaagcttgggaggcagcctgggcccccgtttcctgtctggggaaataaatcagctcagtaattgcccagacacttgaatggagggtcttcgggctgaggtttactggcgcatggctccatttggacttcactaaattggcccccgctttggcacagctgacgttcaagtaaatgtcactgaggagatctttttaaaatttctttttaattttttgttggctagaagggaggggatcttgtccagagtctcctagccagaaggagtttatttttatgagagagagagcgggtgagtgcttagcaaccacctgcctccctctcgaccagggagtcacccagggattgtggggtgggcatgaggaggtggggtgggggaggaatttcatcaagatggtgttggagaggatccaaagggggcctagcacggctaagaacccccaacagggtgggactggtagaatggtgggaggtgttaggcctggctcagcccccagttgaccttgggcaaccctttttctgcctcagtttccttacctgtaaaatgggtggggcagactggttatagagtaaaccagggaccagaggta

SEQ ID NO: 13269 - DNA, 1117 bp, Homo sapiens
atctacccaaccttctaacctaccaccatccatacatccatctaacaaactgattatctatgcaacaaatggatatctatccatcaatccaacattcttcaatttagctgtttatccattcatctggccattcattcaatcatccaactatccatctgttcattcatccatctatttatctcatctattcagctatccatccatccatccatccatccatccatccatccatccatccaaacatccaaccatccaaccatccaatcaaccatcctctttattatctatcttttcatccatccatctatttatccatccatccattgttctatcccccctgccccctgccatccatcccatttatctaaccatctgttgtttcacctttccattcaaccagccatccattcaccctataaatatttggtggtcactgttgaaaggcctcttgtggcctggggcctggggataccatggccttccagttgagtatgtggccgtggtgggtctggcctccctcagatgtttactcatctcatttgcccaacctgcaggtatcggctatgcctccgttgtaattgtgtccctcctgaatgtctactacatcgtcatcctggcctgggccacatactacctgttccagtccttccagaaggagctgccctgggcacactgcaaccacagctggaacacacctcactgcatggaggacaccatgcgcaagaacaagagtgtctggatcaccatcagctccaccaacttcacctcccctgtcatcgagttctgggagtaaggccacctcattgaagcaaggaggaggacatgggtggggcagagaggatggcccacttccttatctcctcccctgggatacaggagccactgtcttcgggggagtgggaggagggtgcagatctggagataaatttatgcctttggccatagacaggactggaatcccagttctgccacttactggctgtttgaccttaggcaagccactcctcctttctgagcctcagtttctttacctgtaagataaaaagaatgaatcattactaccctgtgaggcaggtatgcatacttatgttgtctaaaaatgatacagttttcttaa

SEQ ID NO: 13270 - DNA, 1169 bp, Homo sapiens
agggacaatattgggggagggcaacactttatagacgaggagccagaggtctgggaaagttggctaacttcgttctgtcagtgacggaacaaacagtagagctgagaattgaacctagtgtttggcccacggttggcactgaagaaggttctgctgaagtcccaacagaaaatcagtgcccatttcacagatgaggaaactgaggctcaggggttccttaacttgcctgaggccagactaagttgaacctgggtttgcctgaatctggagtctgagtctatccttttcttttctttccaacaactctgtctcaagacaaatggggattcctgggtttggaaaggtgaggtgacttatgtaaatgcagcgcctcaggtgggatttgacccccagcctgttaatgtccgagccttggctctctctactccagggccaggcccctcactgactcctggctctgtgtttgcttcaaggcgcaacgtgctgagcttgtcccctggaatcgaccacccaggctctctgaaatgggacctcgctctctgccttcttttagtctggctagtgtgtttcttctgcatctggaagggcgtcaggtccactgggaaggtaagttggacttctgtccgtcccctgcctcctggagagctgtgccaggctggccctctcccccacttcccgcctgcaattagccacgccccaagagggaggtggccagtggtggcgtgctggtaagcccgccctctggaaaaaagtaaaactcaggtttgttgtagcgtttgtccatttcatggtgtcagtgctcccaccatgtttgctttcaagctgtccacagtttaatgaccagctcacagaattcctgaatattgaagagccaggctctcaggagcctacacgagctagccccatccaccacagctttctcatctcaaggtattggcagtcagtgcagatggtagcagataactaatgttgggcttctaataaataggttagctggtaacaggaggttagccagcaaccgtggtaagagccattagccacagcatggaccctcgctttgcagagggggccacaagcattcccatcagcattgcagggagcttcgtgggcctgccccaaacctacaaactccaaggctgcgttgtaacattatccccagataatccaag

SEQ ID NO: 13271 - DNA, 1173 bp, Homo sapiens
ttcctcaagccccatggctgagaggctgcctgctcgctggccatggcttccagccctggccacagaccaggtttgtggctgacgtgggggctgggcccacaggcagcagatggacctcatcctgccaaggccctgctctcgtgtctagtccagcaaggaggagttggagggtaatggagggagagccccagcctgagaggctcaggatctgagttcaagtcactttgcctctctaggttgcagtttccttttttgtaattttcactattccaggaagttgaaactaggctgccattaatccattcaacaaatagtgataacggtggcgaaagcgcagtagcctgtgagtgccgggcagcattctcagtgctgctaggtagctcattgaatcctcctcatggtttggagtatgtgcagttattagtcccattttacagatggggaaattcaggttcaaggaggctcattaccttgcccagcatcccacagcttgtcagtggctgtgctgggatttggacccaggcggccccactcccgacctgggtgccccacactcttccgcctcttgtgcccacccccgtgccagcctgaggatgcagtaagtagggcgtgtggcaggcatgtccctgctgtcacagagtggggtctgggaagggggcagagatccagacactcacacaggaagtgcaagccctgcagacgcacaggggaggaggccccggagtgagcatggacattcactgaggctggggctcttcgctgttggcctccggagcagctctttttgcctggttaaaaacaaagcagggggtagtcagagccaggtccttttagctctggatcccccagactgcatgactttgaacaaggccctttcactttctcagcctcaccttccccttatgtgaaatgagttagtgaagcccctcaccaacagccagggcgctgaggatccttagggcctgcctaggatctctgggatcaatggcgagccctgctgcccaggcccttacctcccaaaggatgcctggctccccctgctgctgctgctgcccagacacttacctcccaaaggatgcccggctccccctgctgctcagccaccctcttttctactgcccagaggggatggagaaaagttgtccttgtgagtttcctggacagttgggccac

SEQ ID NO: 13272 - DNA, 2153 bp, Homo sapiens
ctgcttagtgaagattctggagagcagctttgcctgcatagttccttgggacctccttctgcattctaactcgggggtctgcaaacagtaacaacaatggtggtgacagcagccttgacttacgggcttgccatgtaactggcactgggctgaatcgccactctttgaacctgggaaatagctctatggggtagggcaaaggagcccattttatagatgtgaaaactatctataaactgcaggagtgatatttacttgcccactgtcattccagggttggaatccagatccatctgcttctgaatcctcttaaccctgatgctaggtcgctgggaggtggggtgtttgatttctggggctccttgcagctcagtactgccttgaaaggcaccttggattcgagcataaatgttccatttgcatgtgcaaggtcccgtccccaggccatcgccaggtggacataaccctcgctgcctcctccaggaagccagctctgacagccctcctctctttccttgccacctccctccccctcataggtgtggattgacgctgggactcagatattcttctcttatgccatctgcctgggggctatgacctcgctggggagctacaacaagtacaagtataactcgtacaggcaagtgttgcgccggcgggcctggtggactttagaaatgatgatgatgatgtttaaagaaaaagagaagtagggagcgtggcttccttgtgttgtgaattaacttgctccctgacatatgtgtaacttagggactgtatgctgctgggatgcctgaacagtggtaccagttttgtgtctggcttcgcaattttttccatcctgggcttcatggcacaagagcaaggggtggacattgctgatgtggctgagtcaggtacggtggtatcggtggcagtggtggtgggcactgccacctagtgtgtaagccaagtactgcaggcatgaagccagaccccagggggctttgaggggggacgagcctggtttctaaaatggaccccccccccgccaccaagatatcccccaaatttcaaagagtacaaagccaaattttaaacatttgtattgcaatttggccctgatgggtggcaaaagcatggggggtggttaagttggggaatttttagctaccttagtgtggtcttccccgcccccccgtccttccccagcaaactcctggtttccacaatagaaaccactttcctaactcaggcccaagtcagccaccaatcggcattccatcaccaccttctcagccttggtttctgtattttgcactttgctcccagcgtgctccctctaagcagacgcattcatccatcccaccgatttctcgtgaatgagtcccaactctgtgtcaggcaccaccgtaggcactgggtgcagtgtgtggggggagggcgtagatgaggggacgacctactgggacggtggcagatccaactgggggtgggttgtaagcacagtgtcgcccctcggggtgtgggccctgttgaccaggcactcttcctcgggctacctggagtcacaggcatggaggatgccagtggcttagaatcacggactctgcacagacggggaacttaggaatctgggatcccagagttccagcaaggtgcttctggaacctgagaatcatggggccttcagttgctagaatctgcaatctctcaggtgcctcgattctgggacttggccatggctgcttgaggtcctgggtctgtagctttaattgcagtggcttgggttatgggattccctcaggctcccaggatcctcaaagtccacctttccgacctctccacccttccccggccctgcacagtttacttggagggtggtcatcagttggttttgttattttacatgctgagcccccagccccaccccgtccatgtcctaatttcatacaacttccctggggctacctggaggtggcaaggtcctgggctgaggctccttccaagccgaagggagagcgtgggggttattaacttcagggaccaccatagactagggccagacacagccggaggccctgccattccactgcccttgacctcctgtgccatctgtatttggaacatgaggcgatgtcccagtccctgagtcctagagccctagcact

SEQ ID NO: 13273 - DNA, 1188 bp, Homo sapiens
gctagagatccaagaaggctggcaggagtgaggctcacaactcagcctcgcaagaggtggcagaggcacaggaggccacagtccttcctggggcattccaggcagagaaggagcagaggctctcccggcaggagctggggtctcagggctcagatgagtctgttgcatttgaatggggtcatagcaggttctggtcattccccaagcaacatctcagcatctcttaaagttgcctgcaggaatgaagcatgacatacctgttgagggactaggggagtggtggggaggtgagtggaccaaaggatataggccccaggcatgcagatgggcccggtgtcggggaggggtgctttctttcctcatctccccactccccactctcagcctgggagactcctgccaagccctcattaaagatgccaccctgggctgccctggcacctagcaaggcacaccaagaacagcttttgagtctgtatcctccactgggggaagtgctcccagttcagaacaagggcagcccgtggtgctgacctaggatataacaaagctcttcacttcaaaacccctgcaatagctgggtttacagacatttaccacctgcggacccaaaagagaaggcctaggagagttttctagaaggttgggattgtcagggtcctggcccctcagaactggcttgatcaagggccttatgtggagcagaggttgtctctgaaccaggagagaaggtactatacctttcaaatccccagggcagacacacccccacccagcccctatttggacctaaactgtgccatttgaacagtcacttccaagctcagtctaaatgaaaccgaaacgtgaccacgcacaaaggcagtcactgcctcgaggggtgcagaccgcagaattttcacagcaggggctcttggaaccctggaaacccccttcttaaatttgggaggaggagtatgcctttggtgtccccctcccaaggggcaattctgaaccccatctttggcaggcatacatatttcactgtttccaaagctatctactctgccaaacaacacccagtcctattccaaactctcaacgattctatcttgttcctgtttttctatgtatttatggttgccgtttgtgtctgatttgattttactgttttttccctgattttatggagtagcattgtgacctgtt

SEQ ID NO: 13274 - DNA, 1161 bp, Homo sapiens
tttattacgtttttgagttgtgtgtgtatgtgtgtctgtgtgtgtgtgactgtgtttgtgtgtgatccacacttcccaagcactgggcaccttgaacttctgttatctgagggattgggggtaacttgaagctaaggacaggcttttatttttctgattgtgcagagaccagctggagctgacacacacacacacacaaacacacacacacacacacacacacacagagagagagagagagagagagacttgtgcttcaatgaccctcccccttgacattttctttcttttattgcagcaaatgcttccagaggacccctttccaactccccctccccaggctctggctggcctctgtgcacaatcagaaaaataaaagccagtccttagcctcaagttgcccccaatccctcagataacaaaagttcaaggtgcccagtgcttagggagtgtggagttgagggcggcagcaaattcctatcagggagactgctcagaggaggaaggcgctgcgacccagttgagaaggtcagatttccaccagcagattcttcctgtggtgtggcctgattaatttccctccttatgctggccctttctgtctctaatagacccttggaatgttagccagaagtgttatagaagtcatcagatccaacccttattagagagatgggggaaacatagatgcagcaagaaggaaacaacttttcattcatgcaacaaatatttactgggccttgttctgggtattgggggataaaactgtgaacaagaaaaagaccctgtgaaacagagtttacattctagagggggagacaaagaacaagtgaacaaataaatgtgaatggagagtttcagagagtcatcagtgatatgaagacaacacaggaatacagggtgatgtagaagagagtcccgcgggagggtgcttctatagcaggatggcctaggatgatcagggaggcatccctggaaggtgactttgagctggcactaaagagtgagaaggcccagccacaccaagagcagaaggaaaagcaaggcaggcggagggaacagcaaatataaagaaaagccctggtcttcagggggttgtgtggggaggacagtttgacctgttggaggaagagaaagaagaatagaggaagggagagaatg

SEQ ID NO: 13275 - DNA, 1150 bp, Homo sapiens
ctccagcctggcgacagagcaagactccgtctcaaaaaatatatatatataaaattgtgctagtgaagatagtttttcaaactacatctagacacaacccactgttccttggagcctcttattctagtgggacatctcctaattgataaccattttctggtggtactttttcaaagatgtatgaccttctcactgtgtgatctttctgtctctaggaccgcctatggctgcggtagcagtgagagaagctctcaggtgagagtcttataccctgatgttaccttttttgtctgggtgcattttggttaaatgtccacgctgccccacttccttacattacttgaagattctgttttacttcttacattgtgatatcctggaagaaaaagcctttgtcttccttttttatatgagaataggctatatggtttgtgacttattttcaaaagtaatagaaaatattttttgaaactacttctctcctcctctgactggatttaagtctttattgaaagcacttgctttaacatagtttctctttcaatttctctctcactcttagtctcatttttttgtctctgcttgtttttccagaaggtgcacattcctccttgttcatttttaagcagcttccaaagctgctgttgatgatgcctgatgctgctttgaaggcagaaaaccaacagtgagatcaagaattgtaagaattcaagtgtataaagaaaggttgctgctcaattcaagtgtataaagagaggcgtttaagatgatccaggaagttggtgtgggagaacaaggtggggggcacttgtcctatcagagagcaagacttacgctaacactgcagtaaaaagatagtggtggtgaccaagagaaagacacagagaacttagtggaatagaatagagaacctacagttatatccacatatataggaaaaacagatatggcagagatggcatttcagatcagtggggaaaaggatagattttccccatatagataatccattttccagaactatttcttgaatagaaaatggtaaatggattatctacatgggaaaaaaattagttggatccttacttctcatcagattcaagaatcaatttgcagatggattgaggagttacatatgaggggaaaactg

SEQ ID NO: 13276 - DNA, 1113 bp, Homo sapiens
tgatttatgaaggggtcagaaattctcctagccttgaattcagattatgtcctgcaatttaggcatcattcatacggaagacaattattttatgattcaagattggggcatttctgcagtacacacaaaaggcccaaggtgagataaggtctcagtgctacagttaatttgtatattctttttaatataatctattgaacttactttaaaaggaacggaaagaggggaaaacaagcaatccaaaatgtatcagagagagagctggagttgaggatgccttgctgattttctgaaaatcaagttaacttttctaggcagaatggccacagtctgcagtcatcctggaaagccctgggggatgcatctgcatttcatcctgtctcaagctgtaaacctgactttatgtatatctcattgcagagagacaggggtgggggttctgcttagtcactaagcggctgagtctacttagagcttttctactattcagacagcttcacaaatgtggaaggacaggtaaatgcagcatgatcatactgtgcataaaatgttggaagctactctgagtttctttatgtcttaaatagacaaacaggtcttcttgatccagggatgcttgtgaacatccagcagcctttgatacgtgaggatggtacagttctcctggccacggattctaaggtgacgttctctactcatgctctctctcatcctttatgttgacattgcaggctgcttctctaactgtgtgcaccactttcttcctggccttcagagaccacatcaaaagcatgacctatgtctcggtctccttattgttgtgatagctatcttgtgatttgttttagagatgctgatggcttctcagatcagagctggctggtcataatcactgtaacatgtcagtctagatgtcaatttggtggacattcagtggttctcttttctgttatagttttctttttctcttatacacattggcaaactactagccaaggaaagaaatacttatcagatggcctttttgcaaaagccccgggttcctttttattagatgatcttcaggaggaagctcagccaggaatctatcagttccaaaactttgctagagca

SEQ ID NO: 13277 - DNA, 1873 bp, Homo sapiens
actcccttttatagattggcccggatcctcgttcgcctgccggcactcaggctgatgagctccaacataacagaagaacttttttttactggtctcattggcaatgtttcgatagacagcataatcccctacatcctcaagatggagacagcagagtataatggccagatcaccggagccagtctatagcgcaaaccacacacctgccaaggagcaacagaatccttccaggaccgttcacatacaaagaaaagtagtggtattttggtatgtgcaaatatttccatatgttagccatttcctgtctggtttctccttatctgttaatcccagacaatagcaattaaaagactagtaggatcctttcctgacataagaaatgttttaatgccttttgatgaagcagcagattttggaacaatcttttaactcaatttgtatttagaaattctcaaagggcaaaaaacaaaaaaaaaggttttataatgtcagagactagtattaaagaaaactgaaagaacctgagagaatagtatgtgtgtatatatatatataaaaaagtccttggaattatagatactaattaccagggtaataatattagcactttctaagcacttatcaatgtgtaacgttagcaacatcttgcctgtgggcagggcaaatggaaaactgtgtatgtcttttgccgaaatgctaatgatttctgtgaaaactcactagggtacaggagacaatcatttatgtttaagaaaagaaggcatcattcctaattgtgtgcacatgttgtggagttgagctgaattctgtgaatggaaacgtggctcatttgcatcatgcagtaagtgggagtgtggtagcacagtcggtggtgacccagttcagaagcttctagccatagagcagacacttgtcaggttccctgactacttggtcctggtctctgatgggcatctgcagactcctctagaacctggggttctcctttgatgactggttatctgaattggattgcaactagtcagacattaactgccaaatgagatgtacagttcctccagcaagtgaaaacatccccaagtcacatccgccgctcgtggcagatggagccttgtgaccaaaaagtgcaaggtgggcattttgagctcttgacagtacttccaatacaattgggggtgcttgtgtgtttgtccagatggaggagtgtggccttggagtgtgagcgttaccttcccagggctttccactccaaatgcccccttgaaaagggctcgtgtttctgcagctccatcataactgtgaggctggattggggctgggcaggagcctgctgccgcctggcgagagtggttagggcctggtaaagctggatggaaggtttcaggacaatttcttcctgttgaccttaaataccagagattttaaaaatgtgtatagactcagcatctctgttggcaagtctgttaatgttaccagcacactgtgcactttggttcccccaggtgtgtgccagccgaccaccccggagcattttaaatgcaggctgcttgctccttaaaaacaaccctcaatttccagggtgatagtctttctcctcataaattgtagcaaccagagtttacagcaagaacagtatgcgcttaaaaggaagttatgtctaacttcaaacacccgtaaattcccacggatgtgaatatatagcaagcttttcctgtttgagaacagtggcatgtggaagacccggtcaattgctttgtcttttgctttttaaatagtccagattaagaaaatacaccctgttgggttaaatttgcctctcttgatttgttaatcagatgatatccaaaaagatccctggacactcccctgactc

SEQ ID NO: 13278 - DNA, 2162 bp, Homo sapiens
aaaaaaccagctgagacaatggaattagggcaggtttgtttcatttctgcttgtgaaggcttttagtagcaggcatcctgcagctcagtggtgcctctaacacagattgttgcctgccttccgtcgttttgatccttgagagtgaccatgagggccatgttgcagttccctgggaatacaagcataacagctttcagatcccagttcttggtgttggtgaaaaggtctccaccagcccctcctctcattcccaggtcattcagtggcagccagtaggctgcttagactcaggctggataaggaagtgttgggctgtggtgaaacaaccttgcagaaaacgtgattttgcttggaaaggtgctgattctaacctggtcctgctctttaagtccccttgctggtgatggctgattccagggactgttttgggctttgaacacctcttggttggtttctgagatcctcttggccttactttgaagtggccttttctttaaggatcatgtccacgtaacctgtattcttgctgctttaactcatttcaagcctctgactgcaggtccatttcatctcctgtcaggttggttaagtaaagtcagcccaaagtcaagaattacttaaagagatgcaaaccaaatatttgggctccaactttcacagggcttatagcccttattagcagtttgtgaaactttgggtttcatgaagtgagacctgtcctctggctactgaactccatggagccacgttcatgctccctcttctactggcctggctgctcctccctcaatgaggagaggcagctggctcagagaggtgggacagacacatgctgtcatcagttaagtgagctcttttccagaagtatctcagataatgttgggttaagacagatagatgttgaaaatggtggagatcattacacattagcataaaacaggacaggaagagattttttgaaagaccaaattagttgagcaagtaatacttttcaagttactcctggaaggtgtttttaaggaagtgtgttacctaccatactctcctaatttgacatttctgtgtcctgaggagttacatttattgtctaacccttgccataaggctgtggtttgaggttcttttgctgttctgggctttatatttaatttcaggtgtagtcacttctaagatgtgtaattgccctcaagagggactgatttttagcttgtcattgtcagtattgaatgtggactcttctgaggcagttaggacaccagccatggtgttaacagtggatgcgttaggctccttaatctcaaggcaatatccacgctacacacatacttattagctgtcttacttgtttgggggatagttacggcaaggagcaaaaaattctaaggactctagctgtttctagtgcttttactttcatagtcctttgaggacatttcctgcagagcactcttgctcacagcccgccctctgcagggcttccagcccctggccgcaatcagcagttcatgccacatgtgtacatccatgttctgggacctgatctcattggagtccagaagcttgttgcccactttccagtgtaaatgactttatgtgcaatggggtcataggtaacattttaactcttttcttagtccaggtcataggaagtctcatcatctgacagccacttttctcccagggaaggcggtgcccactgggccctgggaatgcctgagccagcagagcagatgccccacgtgcttcctttatccagcttccattctctcagttatgaggctctttgaaaatgtcttaactttgatgtaaatttttaaagccaacccctcatcaagacagggttggtttgggtcttttgtacacagggtctggaccttctcattgtgtgcctcccaccagcgtgcacttcgtatgtccagccctgggtcccttcagcagcattgtgcgtgtacaggtttctaggctgtaagactgaatgaatgtacatgtgtttatatcctctccatatgtacagtgtatatagtgtgtgtatgtgtacatagatgtatattatgtatacagacatgtatccaaactttcctttaaagagagtttttcataaagttgctaatgtaaactgatatgggtgttccaaggtccctcggcagggaagatttgctggt

SEQ ID NO: 13279 - DNA, 1170 bp, Homo sapiens
ctaggttcggacaagagccaggaagctggaagacagtttatcttaatatccaaaactaagtgggaatttttaaccttttcatgcacctattcatggccctacctggaaggaacttggcagttgggttgagccatcagccttcccagctattcagctctgttgagtagcccagagacaggcgtcacggtcagagattcagaacggtctgtgtcagtgaggcctgactcccaaagatggtagcaatttcccaggcttgcgctgtgctcagtcagcaagatgtggggcactgtcctatgactgaataaatagtaattcccatctttctatcgccagttaaaaataaacaacctaccaagtattattctttaaaactaagcatggatgttgatggctaacttctgcggcatataagctacagatctcaagttacttctctaactgtaagcatgtaaatgactttaactcctttctataagttatgattttaaattttcagataagaattgcattttaatatggatatgtgtgcccttaaaagctacagataccaaattttcctcgtccaggtctactcggacgaattttcccccttaatctggccttaaactgagactcggcccttgagagccagggcctggcccagcagtagttgctcatagacctgggaagcaggggcctgctggaaggaatcactagattgctgcaaaaactcacataatccacagtttcctctttttctttttaaaataagttatcaaaatgttttaaaaacactttatgagaccatagtactcagtgccttttgtgagacagtgggtcatttagccttcagcttccctgtttttgatgtagagaaagcttctatttcactggcctcatcccacaagattgtgcgacctttccccgtcatagcctgtcgtgacaatcacgctattgaaagtggctttctagttaaaatgcaattggaaacttgacagtctctaaatgaattaaaagtttcctttggggctatttagcttaacagcagtctacaaataattaaagtgtgagcttaagaaaagtatctttgcggggagaaaaatgtcagatatttttaatgcccagctataaataattttggtgtcttgatatttatacatgcaaaatagaaaaaaaatgttcaacatttat

SEQ ID NO: 13280 - DNA, 1138 bp, Homo sapiens
attgcatgtgagagctgtgggctccacctgtggcagcagataggctgaccgcactgtgtaggcttgctgctgtggtgtgaggggacaacagcaggccttctttcagcgctctcctcaggggccagcagggagacagcgataggctttgacagtgaggatcaggttagaaggcaggagatccaggtgtccctggtggatggtggggttgtctcggctgagaaactgccctgtgcctgccactcaaagttgccaatgcttggttgccgtctgtgctctttggcagggaaaccctcagggaagaggaggaggagaaaaagcagctttctcacccagccaacttcggccctcgaaagtactgcctgcgggagtgcatctgtgaagtggaagggcaggtgccctgccccagcctggtgccattacccaaggagatgagggggaagtacaaagccgctctgaaagccgatgcccaggactaaggcccacggtcactgtgggctggggtgatggtgtctgaccagtggggagattggaatgggattactttggcccagggaagcccctggttctgtccctggagactctggaaatccttttgcattaaaaggactttacacacctgtgtaaaaggatgtgggagaggagggtctgaagctgagctgctaaatgaatatccctgctctgctggtcaataaaacgcttcctaatagcagcttggcgtgtatctggtcctagtgaagaggaaggcctgtgtagcagaaaggctttgggcctgagaggttaaggccacagcctgttgacacctgttttggtcctgcgaccctttactggtctccgctggctttgaatcttcctctgggctctactctggagaacataagggctgctgtggttgagtctggctagcactgtctgtggttggcagtgtgtacacccctccgttcagttccttgggggtatttttcagaaatccaaaggcaacccttcgtgcagtgctcacttttttaagtacagttgattacccttgcctgctggggggcctagccatgggccagagatggaggagccccagtggctgacaggccagcctcactcaggcacgtacctgctgaccagtcagccactgccaacccatggccca

SEQ ID NO: 13281 - DNA, 1162 bp, Homo sapiens
attcttttgattaagtttatccatggctgtattcttctatgaattcttccatttaattcttccacgattatcttctcctgtaaatacatcacaggagttagaattctctacccatcagctgtaccatgtcgcagaattcatgcaggcacaaagttggagttacagagatgggttgacagcaggcaaacttggcctatgtattataaccacaacttcaagttcttacctcatgtgaatattcaccctttctttagtcttccaaggcaaacagccccgtctcatcaccagatgagcaaggtcttgatatggcatagcagatctccctagacacagatcatgagaaaagatggaagagacttagggattcaggcatcagatgaagttggcttttcccttttatgccttgtttgtatttaccctgtctaatacactaaggatacttactcattgtacttgcagctcaatatgtctttgctgttcagatactaaaatgtacctctgagtcattgtgagctgtgtggtaggttggacattggcatagttggtgatgggactcaaaatgaaaaggtggtctctttaccaggtcacagactgtagcagattgtgcttgttatctgacaatgactgtcactttgagggtcgttgatttgcatgcactactctggggccttgtattggagccttttttaaaaaaaataaaatctgagatagaggttgggggtgtgtgtgtctgtgtgcacatgtgttacaagtgagaatcatcagatgacatcccttctcctttcttgatgacaaccatctgagtatcagaatagttccagcacctgtgttgtttgtctggttaaggcctctggaaaaaatgaaggtcactgggttctgaacaggggatagatacgggttccagttctgcccttattcccagttattcctgcagtgctggttaaatgaacagttttacagaagtatagtgcagatcccttaatgatcctatcatcccagtttcacactggaagaaactgaggctcagagattgaggaaccttgtgactgccatctgtgccagtcaccacctctgcatgaccacatttccctccattagcactaccagcatgcctgtgaggtagttactcagctgttcatctgaccccagacgtagaaaagtt

SEQ ID NO: 13282 - DNA, 2297 bp, Homo sapiens
tgaaggggagagtttagacccaggagagcccagcacctctttttaaggtggggtgatgggaatatttcaccagggtctattttctcagtttaagttcttttttgtctctttcaggaagttaagctcccagtgcagggtatcaatgtgaatctggtcctgagctttttagaaaataagagtggtggccgggcgcgctggctcacgcctgtaatcgcaacactttgggaggccgaggcaggcagatcacaaggtcaggagatcgagaccaccctggctaacacagtgaaatcccgtctctactaaaaatacaaaaaattagccaggcgtggtggtgggtgcctgtagtcccagctactttggaggctgaggcaggagaatgctgtgaacccgggaggcagagcttgcagtgagccgagatcgcaccactgcactccagcctgggcagtgagagtgagactccgtctcaaaaaaaaataagagtggttaactttttggttgatattagtattatttgtgagaagagtttccccacccttcttctgatagaacaattgtctgtcactggagaaatctccctccagagctttggcaaagttactctgatctgggtctgtttaaaaggccgggtctctaatttaggaatcggtgatttggaagcttttgcagaacatcaccagaagaagggaagcttcccagagtcagaagctaaattaaaataatttccaaggctatttgatcagccttcttcctttttggttcattgtgtcctgacttggggcactgatgagattttttattttttttgagacagagtttcactttgttgcccaggctggagtgtagtggcatgatctcagctcactgcaacctccacctccctggttcaagtgatatttgtgcctcagccccctgaatagctaggattacaggcgtgggccaccacgcctggttaatctctgtatttttagtagaggtagagtttcaccattttggccaggctggtttcgaactcctggcctcaagtgatctgccaccttggcctcccaaagtgctgggaatacaggcgtgagccactgtgcccgccctgatgagatattttattaccaatgttagtattgagaaactgaaatgtttgaagaagcacaacccaggatcgtgctggtagcaccacagtacttaaactgttggtcaattaaggccagaaagggaaattgttaatttagctctggtgctttggtttacaggaacataactcttaactgacatctgacatcatgatagccatatgtgctcagctctgggtagagtttctgcagttactcatctgaactaatgaacaataactgaccactagtcactttatgccgtgtaactagctctaggccatactttcactggttactggtgtgaaagctgaaattcattttgttacattctggtgaagacccctcttgataatgggaatgttttaactctcttgatgaaaaaataatctgtatttgtgttgatgttcacatttctgtagcacatttcttatccttttggttgaatgaaaagatcttgtataggggtgtggagatggggagtgggtagaagtgtgtgaaggacgctttgcatttgggatctgttcacaaacagccatatgagtgtgttaatgaatgtcagccagttaccaaccctgctggttgttatgggttgttttgagaagttggcaaccaggcatctaagatgttgcctggtacaggcctcttttcttccctgaggcccatgacatttctctgttactctagagggtttctcagatggccagtaggctcctccctgcttagggtctcatttctctgaaaagaggatgaactgaaaagcaggtagttccagaagctaattgctgctttccatcataattatttttcttgtgagaacatttctcttttaattagctagtgattttgattaagactaattcactaaacatacccttccctcaaatcacctcaggtagcaatctgtaagtaactaaaagcattgaaaaacacacaagaaacatttttaaaaactatttttaaaggcctggccgggtgcagtggctcactcctgtaatcccagcactttgggaggccgagacgggtggatcacctgaggtcaggaatttgagactagcatggccaacatggtgaaaccccgtgtctactaaaaatacaaaaattagctgggcgtggtggcagacgcctgtaatcccagctactcagggaggctgaggcacgagaatcgcttgaacctgggaggcggaggttgca

SEQ ID NO: 13283 - DNA, 1494 bp, Homo sapiens
tactctaggagatcctggtccccatggctttctgaggaaatctagtggtgactataggtaatgttggcatttttattgtatctattttatactttactttttgtggcatcatcttctataaaccttattctcattttctctaaatataggtgtgggttttgctacctggaattagaaaatataccttctgggatcttcaatatcattcctagtacctttttgcctaaacaagaaggaccttttttcttggactttaatagtattatccccatcaagatcacacaacttcagtgatggagaaatctcaagttactggcttttatacttaccaaacatcagttcttcaaataaggacgcaaatcttcaggacagtaagcagaacaatcagaatggaattaaatctctaaaaacgtgttacagtggaatctggtgcttgtcagggtgtttggtaagaactgtatatagtcagaattacctaaatcacctagaggtaccgtttacatggttttgtgtatatagagttggcttgcattttaggggccattttgtataaaaagtgcatatgattaaaattagactcagtcatcactgtgagatgcctttgctaagaggataaaggaactgagaccagatgagaaaaagaaaggatatagattccttgagtggaatagtgggctagattaatataccgaaatatttccattgtttcccttttttgcagagcatgtggaagttaaacctgcttgattctactatacatcttgggcaactagttaccaaatgaattgtgccaccataactgattttaattttgcattatttatgattttaaaatatttgttgcccaggtgttatgaaagaataaagcttttaagtatagactaccttagcatgaagatgctcatgcctaagaatgaaaattgttgaggttatctcccattcaatcatgtagcaagaacttaaagaaattcactactgcagtttttatttttaaaaaacagtaattgagatattgaagacattacaatttagtttgtgtggtctttttttaaattgctgtatcgttcagtctcttgtggcaatagcactttgaagaaaatagagaatttaatatatggtgattgggatatgtagcattcaaaaaaagtgaattgccaagatactggtgtcatgtaaattcccactttacataaaaacccatcaggacagaatgatgctcaatattttaaaattctaaaaatagggtgggatttttcattgtctctactttataattatcaaaacttattttgtattgctactaccttaaattgaaataaaatgtttatacttacggatattgcatagtttaagttagatttattgaaagatttcatctgtcgtgtttcatgtaaatgagaacagattatttgcatgaaaatatatacttcaacaaaaatctgttctttaacagagtagtggtagattattacactaatgagatttcactttggt

SEQ ID NO: 13284 - DNA, 2491 bp, Homo sapiens
catttgtaggaatcaagagattcctatacatgggacttttagatgtacattggcacttggattagattccaaaagacaaaagtgttgggtgcttctagcttgaattcagtccctaaatacatgaggctgggtgagcagatgaaaccggtagccactgtgctgatgcatgtgactccattcagttggggattttggttccatgtggatccatactaagtattcttcagtcagtggattttagcaaggggaggtaggagtggaagagaggtgtgaagaaacctctccgaacaaatgaaccagcagtaagtttctaaaaatcagaatctagatagaagttctgcaatatgaaatgagcacattctttgataaggcgtatctattcatgcttttgtaccactgttttgtacctgactccctgaccgatttgtattttttatatacaactagaaggaagtcacaagattgccttctacagtgtgccatttccaaatggatctgttgttggaggaaactggttgctagtcaatgttctatatttaatgaatgtgtgataaatcatcctgtaatcagtatggagtaacctgtttttgtagtttggatgaatatgtcctgagaaatttccatccactttggttcagcggacatcaaggtagtaataataatttttcctccacaggtccctccactcatatggcctctccctccccagctagtggaggggaagcagtctggacttagaaaggaaataggtggtctgtcataggggctttcattagagttaaacttcatagagtcaactgtttcatcatcatagtgagcccagagagccactgcccagcagcatgctcacaccacctaccctagtgtaggtaataggtctacgctaggaccccgtgctgggctctcagcccatcatgagattttggtggatttaatggcaggtaggaacttatttatagtggattgataattgctttataattccttggtaatgacagctcagggaaggtttcacaaggtcatgatcaggagacttgaattgttactggatgtaggaattgtttcactgctcttaacttgctcaaactggggcaggttccaggaacttgaactaaaaatatctatttaagcctctctctctttctctcctccccaacttttttctgaaagccttgatttctgtagacagaactatggtttttggcatgttgggtcaagacgtgtttctataggaaatgcttgcacgtggcactggcttggtgagtcaagcttcctgagcttcagaccgtttgtcctgtcatctgtcctgcccaacactgtatggtttttctctagcacggcttcaattttgttctctgcacaaagcctttggtggttctgccctctgccctccagctttacccaccagagtaagcaatcttttctttttagaaatcaagaatttggcttcacagatggcttctcacagatgccctcctgccagccaaaccggacttgttcttcctgcctctgtgccttctctcattctccttctctccctccataccccacttttgaggttctgtgggtaccatctttgtggactcttgtcttttttttcaacccacatggagtgccctgtgtgtacatactgaccttttttttttttttttttttttgcttgaactctggtcggtatgagctccttaaaagcaggtactgggctggctgtggtgactcatgcctgtaatcccagcactttgggaggctgaggtgggaggattgcttgagtccaggagtttgagaccagcctgggcaacatggcgagaccctgtttctacaaaaagaaaaagggaaaaaaaaagcagggactgtcattctcatctcctccctggggtatccacaggaatggacattcaaatggttgtagcctggtggggtagaaggcagagaagactacccagccagtgaagtgcagaggatagacataggaaaacattccaggcatttggagacagctgaaagtatccatgctgactttcatgatttagaagtctttaactgaattattaaaattgccttttttttgtgctgtacaatgtctactgtactgtgggtcatttagatgagatgaaaaacttaattaaatctgaagtgtcagaggcgcttagtaagccttagtaaagttgtgattgaagaaacttaatacaaatgaactagaggtttgtaatcatgccactcactaacgattttatttctgtagcagaatcattttttctatgtaaggtgttaatgtgtgtgtatgtgctttggttgtaggaaaacttgaaaattccaaaatccttattttcctatttgagaggctggttcagcagggtgtgtgtgtgtgtgtgtgtgtgtgtgtatgaatggtatatttattacattattttgaaagagaattagtgtgttatgtggataatgttatatacagccaaagtggatgtttctatttggcaaggaaggtaggatt

SEQ ID NO: 13285 - DNA, 2465 bp, Homo sapiens
tgcagctaagtggtcctggggcatggagtcttcaacctctctatgaatggcacaccttagtcacttatgttacttttgtgtccccaccatgggttgggggattttttgtttattctgatctatgagttttgaaaaagtgaataatcaaaaggaaaataattccttgttgttcataaattaagcatcactaaagtctcttgaaaggcatttctgtattgggcaagatttaaaatactaaagccttaggtcctattcatatttaaagtagcatgtttgtaacctgttactatttggagagagaagcagttgcctgccaaattgaagactacctttcaaatagcaaaagagagagagaaggctgatatttcggcttttaaataaagatttgtgtggttctgcttttactgtaactgtcactttcccagtgaaaatgatttcatatacattgagggtcttacaggtatgggtaaagttctataaattgcaacaaaatgatacccaatttcattttatcctttttgtattgtgaaactggaaactttatgacattgtaaattatcagctggtttttctgaatataaagtgtgaaaacacagaacagtattttgatctatttgataattttgtgggttttttgaagaattaatgagcatgtacatagaaatagtgactgcttgaatactgtatttacttgcactctttcagtacatcaagattcctgtatattttagagtataataaaacacagatgtgagttgtatttaatgaataatgtatttgtatctgtgcatattatctacaaatctataaagtttctagggcattgactactagattttaagcattttttctaaaatatttacagaaattataaatctaatcccccatcttttctttataatataaagaagtcataatgaacccttcctaattattagtagtaggaaggtgaatatgcattttaatgacagtggactacattttctattgtaccttttgaaaaaaaaaaaaatcaagcagattctaaaagtatacatatgtgtgctttctctttccttttaggaattctcttctgaattccctgagggaattttctagaatctcagaattgaaagagacctgaggttcatccagtctctaacctcttaacaaatgcaggagtcccttctacaagggtgatctttccaccttgaacacttccaagtgactctacctcaccaagcagtccattcagttgttgagcagctctaactgttagaaaggtcttccttagatggagttgaagcctccctcccggtaacttctgtctttgggcctgggtctgtcctccaagagaaccctgagaatgttggaaggatgaatctcgcacattctgccatgtcttctcttttacaggctgtttgacttctctgctgaagtgatttccagaaggactcatttgacacactattagatttaccacatctaatgaaatccaaggtgtagctataaagtgacaagctgtttttaatttatcacatacaccagaacttctatcctgcatcacttatatgtaaatgatgctgttaccaaaaacattaaggtagttcttgcgaatgccaccccactaagaaaactatttcattacttttgtaatccatctgtgagagtctgccccccagcttaaccacttcctttggtctgcacccaatgaagggaaaccccaaagtactgtctcaaatggtatttgaactacgccagtattgttggaataagtacattaattacttgaatgaatgaacacagcaccgtagaaatttcctttatggttacaccttgtatgtctaaagcattcaggccctgttctgtagtgtttcttatcctcacacagagtagaaaagcctgtttgctttatttaacttatacataaaagatgacatctgaaatatctgatgtgtattataataccagcttctgctctagaactactttgggtgaaatggtggtaatagcaaatgacctcctttaacaagacactcatctcaaacaatgccatttagttcaggagatctctaagtgtagctgtaaattttggggttaatttggcttatattggaccttttaaaagaaataaagttttttaatgcaataaatcaagtgtctgtctcttttacatgcaaacttcttttcccttaaactgtctagcattgaattgacaagttttttttccttttctaataaaaaaatgactttttagcaaagttgttttagacttaaatgaacctatctatatgggattttcaaatatatttattcaacaaatactgcttgcctgctgtatacttgggagtgggaatgggcagaaaaccaagaaattgtgatcttgtcctttaggagcttacaattaatttcattgtggaaaggtataagtagaaagtaataaaagtgtaattgaggtagagattaattgataaaaggtacagaat

SEQ ID NO: 13286 - DNA, 1186 bp, Homo sapiens
attaccagagttttctttgagagatattgcagtgatttcttaaatttatgtattactgaaatgagtatgttctacatattcaaaaagcgtatagattgaatattttaaacttttcataggcagtttcttaaatcaacacgtccccatgggtaaataattgctgattagtaagtaactgaatatattattagtgaatgcatttgaaaagtttgtgtgtgtatatgtgtgtgtgtgtgtttgtgtttaagatttatgagaatgacttgttgctaggaattctaagaaacaaacaccactttttaagtctcttctgggaagccaattctgtttaatatataaagaaagcctttaaaaaatgttttgttgcccagattagtattttttttcttgatagaaggataaaagtaaattctgaattaataaaatccaaagtaagtttttgaatattatccaataattcaatgttttgttaaggtactagttatttataaataacatagcccttaatttctaggatcagcgtattctttcttttgatatctgttttctgctacaggcctgtgattggaattgaaacagtacaactgcctccaccagaggaaaatagtatgggaattcctattatggtaggttattttctagtagtctcttgcagtaatataggcagctcttgtaatttgttagtttgttgctgtttaagcctccttgtaacttagctttcatacataactgtatgtgagtaaatagttagtgtcagccaaaaagtcctttattgtagaaacatttatagtagtggaccctgtgttagtggaagacttagtatagccgttttataattcaagtaaattttcagtggagggggcttataaatctaagatctctgtcttggagaagaaaatgttaaacagctgaaaataatggtatcgcaactagttttatttattttgttctgaaatactaaattactaaaggttttcaaactttggtttagatgtatgcatccttttgctcatagctcattctcttacatgttaaatgattgtgctgcacactttaaacattaacagtcattcagtaatcactggggaacctcaattatttgagtgactcctatgttttcatgaaagtagtttttaaaaaatctcacaacctccaggtgtgttggactgcaggcactagtgaagat

SEQ ID NO: 13287 - DNA, 1227 bp, Homo sapiens
ctttctgctcctcagattgggtaatctcaagtgacctatcttcaagtttgctgattccttctgctgttgagcccttctagtgaaattttcttttaagttattatacttctcaactccagaatttctgtttggctccctttaaaaagtcattttgatctatttgttgatcttctctgtttggtaagacatcattctcatgatttcctttagttctttgtgcacgattccctttagctctttgagtgtatttaacatggttgattaaaaatctttgattagtacatccaatgtgtgggtttcctcaggcagtttttactagttgccttttttcctgtgtatgggcaatacttcatccctttgcataccatgtagttttgttgaaaactgtaatttttaatattataatgtggcaactctggaaatgagatttcccccactccccagggtttgttgctgcttattgtagttgttgtttttgatttggttagtgacatttctatactaattttataaagtctatattctttatcatatatgtccattgaagcttctgttccattagcttagcagtcagttagtgattgacagaaatttcctcaaacacctgggacaaaataccagaaacaactctagtctttgtacttggcttctgtgtatatgtcgaaacatattttaatactgaaccagcagtttacaactctgtcttagccttcacttcctatttgcacagaccctggaggtcagccagaggtgagagtttaggggtatctcaggtctttcctgagcatgcactcggccctagcaagttaaccttttctatatcctacagtcactctctgttggactataccagttaaaggtcattggcagagaaaatgcagagtgatagatttctcctttcactctataagggccactgccctgtttccagcagcaccatggagggtagtttaccagcattgttcagtataagtcagtgattgcaaataaccacgatagtcttaaagcaatgatttttactaggtattagagtatacctctaggtcaggattttagattttattcagcttgattccatgtgtatggaatttaaatctacagaatacaagtttgtttgttttttttttgagatggagtctcgctctgtcacccaggctggagtgcagtggcacaatctcggctcactgcaacctctgcctcacgggttcacaccattctcctgcctca

SEQ ID NO: 13288 - DNA, 1208 bp, Homo sapiens
ttgagtgaatcggtatagagaattacataaagcactagttaggcttaagttttaattgtatctacaaccagtccccatctaccgttcccccaacacaattaccccagaaatcaaactccctaagacagcaaccaatattttggcattcaatactcagtaaacatttgaaaagaatgaacatatggttatatgatactttgggggtaacctaactggaaagaaaaattatagataagcaggtgaaactgatattaatatgagtattcaaatattctatttatttgatcattttctttcagctaaaaaattgccaaagaatgaaccacaaaatccaggagcaaattctgccagaggaagaggagtagaccttaccgaacccacacaaccaaccaggaatcagtgttgtagtaactaaacctctagtttgaactagctggaatagtcttctgcttcctaaatgttaataacaatggaattggagcatttaaccagcccagtatgacttccaaaagaagagacttatgatagagtcaagtttctaatacagaattattttaagtgttttgaacttaatttttaataacatgcatgggtccctctcactaatgtttcaacaatagggaaaaatgagaactatgtggacacttgtttcattggaaggttagggggaataatttctcatcactaggaatatagacaaatgactgtctgggcccacacagttaaccagcccatttctccacactggtacagtagtcacctgtgaaaaaaaaattggaacttactaatttgggcttttcaaaaacattctttgtttagaaggagattctaaagttatttatgatgcttagccatagtattcaggcaaatgttcatttctcctggtacctgtatttaaaatgtacattccacattttaataaattaaccacaagaaaataatcccacatatacaaggtcaggggtggggaagagtattaatggtatcttaattatacccagtctggttttttttttttaaatggggtaaaaatcaaatgcaaccccatcttgttttaggaattttgagaactaataaatgcaccttaatggtcagtgttcctttcaaacatgtgagttctttaacaaaaatgaaataaaccaggtgtctgtgatttctaattaatcaccgctggccattacacaggttttgttgtttggggtggggag

SEQ ID NO: 13289 - DNA, 1127 bp, Homo sapiens
tttacactgtcatgatattctttggtgaatgagctctccacaggacttagagctatacctttagggagcttggttttctgcatctctgaaccaccaacttacaagtcctgcattcatgactaggaccatagagaaccctcttgacatggtggagaatttgcttatatggaaacctaagaagttgaccctattaggaccagtcttgatgctaccagtactgattcttaaaatatacattatttgcatacattagccaccagcccatttttaacgttgggtggggaggctaaggctcaagaacatggtagtctcttaattataggtagattttgtgagaagacttcagtcctacaggagttcagaaattttctcttattaccagtgaacttaaaggattgatggtaagactgatgaaagaggaccttccacttaaaaatggggaatgtttggtttccaattgaggtcttacatatgtttctttgatcttatcataagctgctcatgtttcccacctggagaatgtgtcagaggaagaaatgaacagactcctgggaatagtattggatgtggaatatctctttacctgtgtccacaaggaagaagatgcagataccaaacaagtttatttctatctatttaaggtgagattttaacattttaaaaacattttctctcattattcaaatgtacccagtctccatatgccaggtcgtggctgtgaaggctttcagctcctggtacattttgccctcagagtttgctgaacaatacgtttcttcatgactgattctctaaaatggcccaccatagtttgaacacatcattctctttgaggcttttacacttgtatgcaaagttgagtatcttggtttgcatatgcaaatagattttttccatccacccaacaaatatttattgcacatctgttctgcatgtggcactaacgtaggcatgagggatagaacagtggacaaaacagagttcttcccctcatgcaatatatatttcagcagaagagacagtcaacaagtaaataatacctttgcaggtggtgataagtgttggccgaagagaaacaaagtaggataagtggaatcagaatggcagggatggtggcgagttgggga

SEQ ID NO: 13290 - DNA, 2433 bp, Homo sapiens
gataaaaatgtaatcaaaccaacaacatagattcctttcccagtcccagttttgtcagctggtgtttaaagggagtcaaagattgctaatatttttttttcctgtgcagatctgaaaaccatgagtgaacgcctcaagaataggtactacgtgtctaagaaattattcatggcagacttacagcgagtctttaccaattgcaaagagtacaacccccctgagagtgaatactacaaatgtgccaatatcctggagaaattcttcttcagtaaaattaaggaagctggattaattgacaagtgattttttttcccctctgcttcttagaaactcaccaagcagtgtgcctaaagcaaggtggtttagttttttacaaagaattggacatgatgtattgaagagacttgtaaatgtaataattagcacttttgaaaaaacaaaaaacctccttttagcttttcagatatgtatttaaattgaagtcataggacatttttattttatggaatagattttaatctatttactactattaaggtaaattttctatggcatgtccattagctatttcatgatagatgattaggggtttcctcaaaacctgtgtgtgaggaaattgcacacagtagcaaaatttggggaaatccataacattttcagaccatgaatgaatgtttccatttttttctaatggaatgtgagagtttacttttattttattctgaaggactttaaggaagggatacatgattttaaaaaagcctgtaagaggtgaaatatgtgatgtttgaagtctctttatagactttttatatatattttttaaaacactcatctagatgaggtgctttgagcagttctgaaaaatgcagttccaggaaagcaactgctttggttcctaaggaagaaattctaaataatgcaaacttttaaaataagcatctaggtttttgataattctgtctacttacaacaaacttgttagtacataaccactattttaataattattttctctacacaaatgtgtaatatcatatttgactttgcttatgcaggccataagttccaaaagataatttccctgcccacaaaggcataaacttgaaaacacatgagattgaatcaacatgctttaataggaaaagatgtatggtctatatatgtatcaatctggtgaatcctcgttctaataaaggttctttttcttttctatgatacacacagccacgctgataatatgcaaatgaacattttcctttatgtctctccagataatgtttattgtctgaggtaaattaaattcccaccagggtttgctgtcagtattttaacacccacattagtatatgcgtccagggtcataaccccctaaaatccatcatgcaaccttattaatctgtcttgggattccagtttagtgcttggatttatttcctgattacactacatagaaaagtgagacatctgccattcccaactctgggaaaaccaactaatatacaaccatataaatgaaggccatcttgatggtctcaacactaatttttatgatgcaaatttatacactgatttttgtaaaggacaaagttttaaaagcgtatttaacttgatgttttctatcagcataaataaaatggtcatgaatagtcattaaaaacagttgccagtgataatctgcatgaaggaaaaagaaccctgcaaatggctattgagttggaagtattgtttttgatatgtaagagatattcagaatgctcacactgaaaatgcctcaactttttaaagtgtaagaaaccaccatgagtggtgtctagatttctaatgaagaatcatgatacagtttggattaagtatcttggactggttttaaacagtgctttgtaccggatctgctgaagcatctgtccagctggtatcctgtgaaagtttgttattttctgagtagacattcttatagagtattgtctttaaaatcagattgtctcttctatattgaaagcatttttatgttttctaatttaaaaattaatattttcttatagatattgtgcaataaagctgaagtagaatgtgtggtttttgcaaatgctttaacagctgataaaaattttacatttgtaaaattaatatattgtactggtacaaaatagttttaaattatattttaaaaagcttccaatcttgtggtgtgttttattcattcagtaggctgaggttaacagaacaaattatgatctggttgataaccatcaattgaatccttaaaccttagatcttaagcattctgttgcatttgggggaggtttcataaaaaatccataggtcatcagtaagagattttcaggagagacacttactctgtcttttgagttatccactgcatcttacccactcacccgctaaacaataacaaaaaagattcattgaaag

SEQ ID NO: 13291 - DNA, 1186 bp, Homo sapiens
cagcttaccgcaacctccgcctcccaggttcaagcgattctcctgcctcagactcccgagtagctgggactacaggcatgtgccactacgcccggctaattttgtatttttagtagagacagggtttctccatgttggtcaggttgctctcaaactcccaacctcaggtgatctgcccacctcggcctcccaaagtgctgggattactgagccactgtgcccagcccaaaatgtatcttatacaaacattgtagaaatgaataatgattactcaaataagatcttttaattataagcttctggcatctctatttttcccttaagtaggggatactaaagtgaatgattttctaagaggatcttttgaaactctttagtacaatatttgagtaaaataaattattgtggatcttttgaaactctgtgtagtattcgagtaaaataaatatttgacatttacagtagggtacaccctaagttgtttatgaattccttataccactgttatatttaatttttcagataaaatatgtatgggaaaatgactagagaaattgattcttttttaggctcagggacaagataagtgactaattgtgaaccccaagctctaattgtatgttcagagtgatgtctccataaaattacaaatgtcatgtactttcagggtagctccttatttagtcagaaatctcagagattaaatgtgtgaatatttagggtttttgcatatttttgaccaaccaatgaaagcgaattagttcagtttagaaagtttgatgtctatacttgtatatacctctttaaattttagaactttgtaggttattcatttttaaagagcaataaagtttgtataagatagtgattgctttccttctattctttaaatatcaaaaatagagtatctctctgtcttcactattctcatccttggacatttcctctcccctccccttggtattctcttttttgaggggggggtgttctaggtgagttaatccttagtattttcagtagtcattgctataaaactctcagcttcccctccatactttcaacctaacacttctctctcccaacttatctctgtgtaatctcccagttcatgattaacaaattataattttattgagggactgttctaatcctgatatctcagattttcttggctgttatctcccta

SEQ ID NO: 13292 - DNA, 1123 bp, Homo sapiens
catatcgagctaaaggaaagcctgatgcagcaaaaaagggagttgtcaaggctgaaaaaagcaagaaaaagaaggaagaggaggaagatgaggaagatgaagaggatgaggaggaggaggaagatgaagaagatgaagaagaagatgatgatgatgaataagttggttgtagcgcagttttttttcttgtctataaagcatttaacccccctgtacacaattcactctttttaaagaaaaaaattgaaatgtaaggcggtgtaagatttgtttttaaactgtacagtgtctttttttgtatagttaacacactaccgaatgtgtctttagatagccctgtcctggtggtattttcaatagccactaactttgcctggtacagtatgggggttgtaaattggcatggaaatttaaagcaggttcttgttggtgcacagcacaaattagttatatatggggatggtagttttttcatcttcagttgtctctgatgcagcttatacgaaataattgttgttctgttaactgaataccactctgtaattgcaaaaaaaaaaagttgcagctgttttgttgacattctgaatgcttctaagtaaatacaatttttttattaaaaaaaaaaaagaagctcttgggaacgtagaagagggggagtagcttctagacaggcaatcaatactgtgtgctccaggtagattaggcatcatgggttttcaaaataagtgatgataaacacccatactgcaaggaagatctttgccctacatttagaaattggtgaatgaatgtacactcatatgtatcaagttaaacataaaaatgcttcagttatatattctttgctttaaattttactcaccttctgatcctgatcacatcagataaggaatttcctactatacttactgcttcattgtatttttaaaagtagacagcacaaggttccacacagagtatgtagtcaataggtgttaatagcagtgatgattatagatatttggtacaacagggacccaatcaatgtttattgatttactatacataggggttaagagaagatgacaaattgagagtgttgtatatgactattaagtgtcttgcccctatctgggaaatcata

SEQ ID NO: 13293 - DNA, 1230 bp, Homo sapiens
ttatttagtctctgagtgtattttttttttttttttgagacggagtctcgctctgtcaccaggctggagtgcaatggcatgatctcggctcaccagaacctctgcctcccgcgtacaagcgattctcctgcctcagcctcctgagtagctgggattacaggtgcccgccaccaagcctggctaatttttgtattttcagtaggacggggtttctccatattggtcaggctggtctcaaactctcaacctcaggtgatctgtctgccttggcctcccaaagtgctgggattacaggtgtgaggtattattttttaagtaggagtatttggacctaaacaggcagaattcttcaacaaagtacaatgaaaggcatttctttgacagtagcctgaatttggaggctcatttgcaaaggcactttccactgccactctaccccagaaattgcttatgaaataattctggcatttactccttcttcctcccctcccccttttattaaagagactagcttgtacaaagtcatttgcaaattcatttgtggttctccattttgattcagatagcaactctaaagactgagttataaaagtctttagactttgcagtttaaaagaacgataatattaccatgtaaaaattctgattagcataaagctttagaaagtccgttgcgtataccaagccaagtgcatttttgtctccaattcccaattctaatcaatttcgtcctcatttttcactattgcaaaagtgtagatcatgatgcccatcttttttgtagtcgagtacattttttcttccatcaaaaaagcaattagtgtcctgatgtacttcagcttcacacatttctgtagatgatttgatcaggttgttgtcttcacgacagacatctgattgtttttgaatgtgggaacactccttagacaacatggccagaattaacccacatcctcactggtgttccacaccttctcatatgtaggagaggaatttctctgtcatttccctgagactgcaccttaattctctactataatccttgactgaaggaaaagttaggcgatcaggtggaatttttaaattgttccacaaaaaactgagttctgctagctaagtggaatgttgagaatttagaacattcagcacaataaaatataaacattaaatttgtatggcattagaaccgcctttagaatttttagtggaagcgttagatcacatgcattt

SEQ ID NO: 13294 - DNA, 1380 bp, Homo sapiens
aatgaactaagataaagacagaccagtacactaaagcctaagcattccctcttcccccaacgttatgtttttttgaaattttgatggaaaaatatccagcatggtggagtggtgtttcgaagatgggtttgatcacacatactttgtcgtacgtatctacccaagctgtcactattcgctaaagtttaaaatgttcttttcctttctccaaagtaatctacattcttttcttccagccgaccccttggtgggaagtattgccactcagtatatgaccaacagagcagaacatgacagaatggccagacagtggaccaagagatacgctacataaattggggtttcacaattcttacattatttgtctgtcacagaagagagctgcttatgattttgaaggggtcagggagggtgggagttggtaaagagtagggtatttctataacagatattattcagtcttatttcctaagattttgttgtaacttaaggtatcttgctacagtagacagaattggtaatagcaacttttaaaattgtcattagttctgcaatattagctgaaatgtagtacagaaaagaatgtacatttagacatttgggttcagttgcttgtagtctgtaaatttaaaacagcttaatttggtacaggttacacatatggccatttatgtaaagtccctctaagactacatactttttgtttaaaacaaaattggaatttgttttcccttcttggaagggaacattgatatttaacagagtttttagagattgtcatctcatatatataaaatggacacgtggctataaaacaccatataagagatgagtagtgcgttttattttatatgccaatctactttgtttaaaaaaggtctgaatcaggacttgtgaaaacctgtagtgaaataccttaagctgttaactaactgtaaggcgtggaataggagttgctcagtggattggttctatgttgtggactacttaagtctgcatttgttactgtgctaataaacaatattaaaaaccacctaataaacactgctgtgttcatttacttttcttttgccttttggttgccattcgcagattcttctgaaatcgataggtatctgcttctaaaacaagctaaaaataatgcatatttagtaggtattagttagttacctatattaggatctgtactttacacagctgtagatgaggtatcctagaaaaggttaaataatctaccccatttaggcttcaaagacgaaccctactgcatctttttaaaagcattttctgacttgcagatgctgtagtagcaagtacatgagaaatgggttccgtcatggataaattggtaccctgccttagggggcattttggcagtac

SEQ ID NO: 13295 - DNA, 1316 bp, Homo sapiens
tctggtggtgaactagagttgagaattaaaattctttctgacttgctgctataggcaatgtgggagattgaccttgggccttttttcctattctaggagcgagctggacgccactgtggggctctgagagtcctgaattcttactgggttggtgaagattccacatacaaattttttgaggttatcctcattgatccattccataaagctatcagaagaaatcctgacacccagtggatcaccaaaccagtccacaagcacagggagatgcgtgggctgacatctgcaggccgaaagagccgtggccttggaaagggccacaagttccaccacactattggtggctctcgccgggcagcttggagaaggcgcaatactctccagctccaccgttaccgctaatataagtaaagtttgtaaaattcatacttaataaacaatttaggacagtcatgtctgcttacaggtgttatttgtctgttaaaactagtctgcagatgtttcttgaatgctttgtcaaattaagaaagttaaagtgcaataatgtttgaagacaataagtggtggtgtatcttgtttctaataagataaacttttttgtctttgctttatcttattagggagttgtatgtcagtgtataaaacatactgtgtggtataacaggcttaataaattctttaaaaggagagaactgaaactagccctgtagatttgtctggtgcatgtgatgaaacctgcagctttatcggagtgatggcaatgctctgctggtttattttcaagtggctgcgttttttttagtttggcaggtgtagactttttaagttgggctttagaaaatctgggttagcctgaagaaaattgcctcagcctccacagtaccattttaaattcacataaaaggtgaaagctcctggttcagtgccatggcttcatggcattcagtgattagtggtaatggtaaacactggtgtgttttgaagttgaatgtgcgataaaattattagccttaagattggtaagctagcaatgaatgctagggtgggaagctggtgagccagtggccattagataaatacctttcaagtgtgagcttagacgtcaaccctaaaatacttaaccgtaatgctaattgtgatcattatgaatcccttcagtcacattagggggaaagtagttggctataagtacgtcattcttagtccagtcagtcttaaaaacatcttgggttacccactctgtccactcccataggctacagaaaaagtcacaagcgcatggtttccaaccatatgtgttttctgcagttatttct

SEQ ID NO: 13296 - DNA, 1180 bp, Homo sapiens
ggactacaggcgcccgccatcacacctggctagtttttgtttttttagtagagacggggtttcaccatattggctagtctggtttcgaattcctgacctcaggtggtccacctgcctcagcctcccaaagtgctgtgattagaagcatgagctactgcacccatccgaatttcctatttcttttcttagactttgcttataaaatacctaggaggtagatgtccttaactttgttgtggggggaaaatagaaaattttctctccctctcctacttcctttggtgcatcaagaccagcaagtttagaaaaatgtggaccagagacatgtagactcattctttatatgtatgactagaggccataactgttggataattttgtgttattcttttatacaaaacaggtcttatttagaatatagacgttaaatatctttttcttcaatagctgttcggtttggtcgtattcctaagcgtgaaaaacagaggatgctaattgaaatgcaaagtgcaatgaagaccatgatgaacagccagttcagtggtcacttgcaaaatgacacattagtagaacatcatgaacagacagccttgccagcccaggaacagctgcgacccaagccccaactggagcaagaaaacatcaaaagctcttctcctccatcttctgattttgcaaaggaagaagtgattggcatggtgaccagagctcacaaggatacctttatgtataatcaagagcagcaagaaaactcagctgagagcatgcagccccagagaggagaacggattcccaagaacatggagcaatataatttaaatcatgatcattgcggcaatgggcttagcagccattttccctgtagtgagagccagcagcatctcaatggacagttcaaagggaggaatataatgcattacccaaatggtcatgccatttgtattgcaaatggacattgtatgaacttctccaatgcttatactcaaagagtatgtgatagagttccgatagatggattttctcagaatgagaacaagaatagttacctgtgcaacactggaggaagaatgcatctggtatagtgaaatcgattttttgcttacattgtatcagggaaagctttgaaaattttcttttattcgggagatatgctaacttggggggatggtgtcaggaaacc

SEQ ID NO: 13297 - DNA, 1199 bp, Homo sapiens
tgtagtacaatataaaccataattgtgatttaccttaagtaggtataactcttatgggatatacagtatagtttttgtgaatctttacatgatagcattatctttttataattttttttcctaagataaacaaatgcatagttttcttctatgggtgatagaaacagctttttgaagtaatgaaaacctcaaaagatcatgttgattcttaatttttgccttttgcataagcctctttataacatgtatctttaaaacaattaagtctttaggaatgtgtaaccagaactatgttagtattgcttataaaactttagttaggttcaatatatacatatatacatctctatataggtatatagatttgcattttgtcttgtaaaattttatttgaataaattcttcctgtaggtaatgggaaacaaaattaatagttcatatgtcactcatagcatttctatatttgaaagtagcccaatataaaacttttgattctaaaattaaaccagcagcctattacaagcacattctttgattgagtcattggttataaacttactaaatgcagagaaagcagccaatttaggaaacttctgagttggtgggacactgttgattaataatgtactgtatgaattaagtgatgctttaactttgattttacattttaaagttaaaatgtgggcattatgtcagcaaacttaagggcattatgtcagcaagctaaaacattttttttcctgtgcttttaatgtatctctttacatgatctgagagaggattcaagttgatagaaatagctgaggggaaaagggggaacatcttgggatgaagcttgtccttatggtgatggtttaattacagattaaaaaattagaaggaaatttcagtggattaagtgtatagctttcatatctacatttcaagaaattaccattgtaacttgataagagatgatttattttatgtaaacatctttgcaaagcaaggtgtagcagctcagctagatttattactgtgcacgaaagtaaatacctatctcaattattctttttcttttccaatataaagtttgctgaatgtacaagaagagtttatcacttaggatatagaatttttttaggggttgggggaggggatctgttaggaaactgttacctataaacaaagattgactggattcgatccaaaagataaaa

SEQ ID NO: 13298 - DNA, 1101 bp, Homo sapiens
gcgtatacacagaatatatgggggaggaaaaacttgaacatttttaaacttagcaatagaatatgtatgttttcagtttggggaaaaatcatttttgtaggtggttttatggttactttaagagccctttttttaaggcctatttttgtctttcaatattattcctaaatacttttgttgtgagaattgaatttattggcttgcagtcaccaaagaaatatttacagaaatgtgcttaatagtcttagttctgtttaatggtttttaggggtagtctgtgttcacacacatgcattatggttatatattatggttattttaagtattgtagatgttatataagttaaaataccagtacagatctatatgatctgcaaagtatatgtgttttgcttaggtactttttgatcatatgggatgtctgaagaaatatgaaactgtgcaagacattctgaaagaattctttgatttacgattaagttattacggtttacgtaaggagtggcttgtgggaatgttgggagcagaatctacaaagcttaacaatcaagcccgtttcattttagagaagatacaagggaaaattactataggtaagatacaacctttaaaaatttgaacattagttaaaatggaaaaaaaactttattaatagaagacatttttatcagtagaatataagcaaatacaaattgaatctcttatcttgatcctaactttatttttccctcacatagagaataggtcaaagaaagatttgattcaaatgttagtccagagaggttatgaatctgacccagtgaaagcctggaaagaagcacaagaaaaggtaatcatttgcagaaaaagacattcagagaagcttttaaaagcaacttccaaaacaaacaaaaattcaacccctaaattttaaatttagtactactaaaggtgctgagttgtctatttagagactaaagtcttctgtttatccacagaacagataaagtacaggaatttatagtacacacccaccacaaagcacttggccagtgtgactcaaccagagcctggagaaatgactccaggtgtgagaaggtagctcagtctccttgacctttt

SEQ ID NO: 13299 - DNA, 1186 bp, Homo sapiens
tatagctgtggagagatgtgattatctggttattctacttagaaggtgaatgttccaaattatttgaccacaaatagaatgaagtctgttgaccttaatttttatgaattgttggtgaaatcagtcctagtgaattaaggatgtttttctcaccaactttactctttaggctgaagatgggttatgtactttatttagagtaataggaaattctttaaaagttatcaatattaaatcaggtaggtaagtacataagtaaaataggactattttattctgggcttgtaactgagagaaagatgcatttgaataatacagttaggcaaattttattattaagcggatgtaatcaaaattattaaaaatgcattctcttcaaaagatttgtttttgcagtgtgaagtttttaattatgtataaagttttctttcccaaagccatgacattttttcatttgcttctttttgttttcattagcactttagcaaggctactttttcctgctgtggatgacaacctccttaagttcctttatgatgataatcaacgtgtagagcctgagtggtatattcctataattcccatggttttaataaatggtgctgagggcattggtactggatgggcttgtaaactacccaactatgatgctagggaaattgtgaacaatgtcagacgaatgctagatggcctggatcctcatcccatggtaattatttggaacttattatttatttaacaaatgataatgtgtaaactacaaattcccgtcattttagaaaagtaatggaacatttttattttagaacatattgtagaccgtaaagacctaattagggtataatttgatatgtgcctacagtaaaaagtataaactttggaatgagttttggaggtaagtttcatggggagaaactgtttatttaaatttagaaacacctcatattccaggttttcaaacctctaaaccctatattattagaaaacaatccttttctgataaaattatgtgtaaccttgtttctgttctcaaactaccgcttaatagtttgtaaggatgcttaaaaacacattgtattcattagtgtaccatttgtaaaaagacagaaaacaaactaccttgtatatattttaatatatccccaaggctgggcgtggtggctcacacctgtaattccagcacttt

SEQ ID NO: 13300 - DNA, 4328 bp, Homo sapiens
tgtgagtgtgaaaataagttttgaagatgaaccaagaaagaaatacgtggatgctgaaacttcattatagaattgaaccaagaggcattatacatatagatatatacatatgtaatgtgtgcgtatcatgtcactatatataagaatattgtatgtcatgctgtttatgtgtgactaccgggtttttaaaagtagtgtctggagtttgtaatgagcaccgtggagactatgtatttaatgaaatgctctctttgaagtgaggtacatggttcttaactattcaaatatttattctgttagaaaaaaaaattttctgttttgcaatagaaggatgtggagaaatgctttcagtctacttttcttaaatctctgttcatcagtggcaattcgtaaaaaccttaagtgatactttgtttatatgtttataatttttaggtgtttcctgaaattttcacatattatttcacttttgttagtgctttatgggaagaatagggagtctataccagtgctgtgggaaaaatggtaacatttcagggcttctctatttgtgtttcatttctgtagatgtccatcgtgtttcactaactggcgttttcttagccatagagatgactgtagaacaatagaaactttaataatgatagtttttaacttttatgtttaaattttttttaaatcttaaaaccttcatatctaggtatccattgtgacagacaagtaaaattgcaggtgatttgataattaagcacccataccatttataacttctgaatttaaaaagttatacaatgccagtttgcaatagttgattttgatgcctttgtagaatattttttctgaatccttatgctcttttaaagccaatgattcccactctgttctctgccttgtctctctttgtcttaaaatgctttagtttccatcaggttcaagttcttgactattattctcttataagtagtaggcgtaaataatcaggagttagaattctctcagaagggtctatgatcagtattactttattaagaattacctttcattttctctttatgttattctttcacttttgtagattacatttaatagcttgttacctgtgattttattttaaaatatttattttgatatgatgcttaaatattatataaacatttggaaaagtaacaaatagagtaaattgttaatgtaaatagttggtgcttactttcatttatgtttattatcttaaagcaattgatagattttacatctttgatataaagcactgccatatttatattttaaaaggaaattagacattttatatgtagctcagattaatgacatttttattttgtgtattagtttttgcttttctgagctttttaaagtctaacaaatctttttagtcatcttttatatacttttagttccacatgaaataaatgttgttaagcctgtaggactggatgaatggggttgtgaaactgatttgacaagagaataatttacaaaaatcaaatgagtattgagaagccacagaaatatcaaaaatggtgacatcactattaggatgaaaattttatgaaattccaatgctccctttaaccatataattaaattacaaaggtatacataattaatctaataaaggatcatgaggaatgccaaaagctgaaattttagcaagtctggtgttttaaattcattataaactatttattaactaatgtaatgtcctcctctaagaccatattgtaagagtcttgttaaaatgatggattcaacttctgcctcggatgagaggttggaaatgtagctgcttttctttagaaaatatgtagctgtcatcatttggtactgcctaaaaagagttagactctattggcaattgatagagtattacccacggtgcttattattgtttatgagcttccattgtaatgattcctttttatttgtagcagcataattatttccaaagaccccagtatttgctgctatttttaaaactcccctgatgtacctgaacaagaggatttcctcacatcatttccttgtgtctggacatcaggggtaacaactgtacttactttacaggaagaaattttaaaactgaaaactacctgggatcatagtgtttctgtgattttatttaattgtgtatagtaattatccagtgccagaaaaaccgtcacttgcaaaatactttgcactcaaaatgtttttacaatgcttctaaatgttactggtttctgctttcttttgactacttgactgacaaaatgatctgactactccatttaagagcaaaggtaactcatgtttaggtaattaactgcttgttttaagtgattatatttcttccactgtttttgaaaaataatcaaagatagcattcattgagagacagtgacagatataatttactacatatattgatttttaaataaagttgccttaaataagtgtatgtaagcagtagtagttgctatgtactgatttacctcaaggtgcaaaataattaaacctgtacatattccatttacaaaataaattcagccctgcactttctttagatgccttgatttccagaatggagcttagtgctactgaataccctggccacagagccacctcaggatattcttttctccaccctagtttatttatttatagatatctgtttacaaagtctgtagtaaatcctgatgctgaccatctgaaatgtactttttttctgaatgctgtttcaatctaaaatagcagcttttgagaaaacaatgatgtaaattccttatgataaaaggatgattctatatattctttaatgatattaaatatgccgaagccaagcacacagtctttctaaagtgtgtgtatgtttgtgtgaatgtgaatgatactgatcttatatctgttaaaagttgttttaaaaagctgtggcatcccattgttcatatttgccaagtcttctgtaaagatgtctaggacgaaatattttatgtgctaatgcatgtatttgtaaaccagatttgtttaccactcaaaattaacttgttttcttcatccaaaaaagtttatttcttccacgtacttaaattttctgtgtgggtataatatagctttctaatttttttctttcacaaaggcaggttcaaaattctgttgaaagaaaaatgctttctgaaactgaggtataacaccagagcttgctgtttaaaggattatatgatgtacatcagttctataaatgtgctcagcagtttaacatgtgaatcctgttttaaagtgctcagatttcaactgtgtaagccattgatataacgctgtaattaaaaatgtttatatgaaataacttaatgttttaaatttatttatgtagatcacatcatttttatcgtatgcagtgcaaatatgtgaaatgtcttttggtttattccaacaattatttattttagaaagtaagtttaaagactttaaggacattcaaagtttaaaatagtgttcaaattgcaaaatttggcaatcttcatataaattggtttcttttctaacttttcaaaaactaacattaaatgtcaattataggaaaacatagttggaaatgtaatcatccaaagatcatttttaaaatgaaatttaattagcacatattgaacatttgacttaattgttaaaccccagttttgttttgtttttttaatcagatttttgcacactgattagtttttgtgttgtggcttttgttgctttattattcaaggttttttttttttttcttccccatgggggagattgtcttccaatgtttaactacgtttaaataaataaaaattgaattttattgttcatttatataaaatctgataccttgatgtaatttcacaatacagttccaatttttatggcttttataattacaatgatattttcttctataataaaatccaaagtaaacatttaaattgtagaactgatatttttcatttatatgaagtataagcctctactgggtctatattgtgaatcatcctgcctttcaaatttgtttcataattgttagatgaaaactatttttttggagatgttactgaagttgattgagcaataaaagtctacttaattagttgttggctattgtctttactttgtactctgattattagaagagccacatctctctctcagcttgagatgggataggagaggaaggaaaatgagtgatgtctgtttccggcctcctaatattcctaggcttcagtaggagagagaaaagaggaaacactgagaaaaaaataaaatagtgtttgtttcacaaaggtgtttgatagttaagaaataat

SEQ ID NO: 13301 - DNA, 1192 bp, Homo sapiens
gtcaagtaatatgttatatggcttttatttatggtattaaccattaagaaaaagaatgctactttgcttgatacaactgccagtagaagagaatatttcttgccttggttccttgagtgagaatgttgagtaaatgcagtaaatgcaagttggattgattccaaagaatacataacattttttaaacctgagagaaaattttaggcaagtgaatattaagcaccattaaaatgaaaattttaagaaaatttatcctattttcaccacttttaaatacatttacactgattgttggaaaactgggtattttacttaaatcttaatacttgtgtaattttgctttatgaaaagcagtgacttttgatatatatgattataaaaccaccaatgacaagcaatttcagattccagatgtcagccgttatatgtattggtttgaaattatgctattctattctttacaattattacttacataatataatttctttctgttcatctgcttttaattttgtgattttgaggtttgtggaccctcttccttcctgaactctgccaccctagcttgccaatccatgcataaatgtttatacaggtgctgtaattagccaatgcaccaactcagtagagtcctttcagtaatattttgtctttatttttgttttgttcataattattcccaaatgaccttaattataaaatgtccaagaggaacttccttatccatttttgcatatgccattagcagtatcctcgggataagattttgttataagcctgtttgtatctggggaagttggtcatttgttaggaataagggattcattcagtctaaaattggccttcatttggcctttcattttatcttattgagctattttattcagtaataggaaattcagtaaataatcatacactctaatcctcattttcaaaacaaggtaaaatttggaggtggcttaacctagatgtaacaagtacatgtttgggtttcagatatacctgggttccctatttctaatatgccacttaggtggctttgggcaactgacagctttgaatctcatttttctcatgtgcaaattggaattactctattaaacttatctcgtagggctcgtcttaggatcaggtagaatactgtgtataaaatgctaaatgtgcctcttggaaacttgctattaataatcag

SEQ ID NO: 13302 - DNA, 1193 bp, Homo sapiens
cgggggcggcccccgcgcaggcaaaggcttggggggccagggcgcggcagtgcagctctcgccggagcccagccgagcccagccgagcgtccgccgctgcctccgcgccgccgctgcctccgcgccgccgctgcctccgcgccgccgctgcctccgcgccgccgctgcctccgcgccatggccggcctcagctacctggaggcagtgaaacgccagatctaggccctgcagcagcaggcggacgaggcgtaagaccgcgcagggcctgcagcgggagctgggcggtgagtgtgagcggcgcgagaaagctaaaggtgatgtggccgccctcaaccgacgcatccagctcgttgaggagaagttggacagggctcaggaaagactggccacggccccgcagaagctggaggaggcagaaaaagctgcagatgagagtgagagaggaatgaaggtgatagaaaaccgggccatgaaggatgaggagaagatggaaattcaggagctgcagctcaaagaggccaagcacattgcggaagaggctgaccgcaaatactgggaggtagctcgtaagctggtcttcctggagggtgagctggagagggcagaggagcgtgtggaggtgtctgaactaaaatgtggtgaccttgaagaagaactcaagaatgttactaacaatctgaaatctctggaggctgcgtctgaaaagtattctgaaaaggaggacaaatgtgaagaagaaattaaacttctgtgtgacaaactgaaagaggctgagacccgtgctgaatttgcagagagaacggttgcaaaactggaaaagacaattgatgacctggaagagaaacttgcccaggccaaagaagagaacgtgggcttacatcagacactggatcagacactaaacgagcttaactgtatataagcaaaacagaagagtcttgttccaacagaaactccggagctccgtgggtctttctcttctcttgtaagaagttccttttgttattgccatcttcgctttgctggaaatgtcaagcaaattatgaatacatgaccaaatattttgtattggagaagctttgagcacgagttaaatctcatgccttccctttttttgtcaaatggcaccaactttttcagctctcttattttttccttaagttgcatttattcctaaggtaggcagggtattt

SEQ ID NO: 13303 - DNA, 1249 bp, Homo sapiens
aggcaggaggatcgcttgaacccaggaagtggagattgcagtgagcggagatcgcaccactgcactccagcctggtcgacagagtgagactcaatctcaaggaaaattaaaataaagttgttctctgaagagcaaatgtctcattccagtaatgacccactcaccaggaatatggtggagttcagtccaattcagatcagccatatccaaaagactacaagtcattactaagttgagcaaaagagtttttatctattagcagaaagggcctctctggcagcagagattaaaaattggcccgacttcatttccatacttcagggaatagcaaattgaagatttacttatctaggacttgaattccttctttgggaccaagttaataaaagaccaagaaactcctgattaaactgggtaatgaaggattctgtagacagggctgcacgtatcggctttgtttgacttctcttttctcagttaacatctcagagctggaacattccacattccccagcagcgtgtgggggccgactaaagtttgcaattccgactaaaaatcaccctgcttctggcttatctgaatcccttacccaccccacctcaccaccccactcctatttattcagcaccacactacccaggaaatacactagcaaattgtgcaatggaataaaatccacactttactttagattcttgcaactgtatcatatgtaatagtatcactttttctacattttggtcaaataaatttttacataaactacaaaaaaaaaaaaagaaaatgatactaggctttggggttggagtgtattgccttcagatcagatacttggctctgattcccataatgtctttaagaatttctatcactactctctctttttcccctcctttctgtgctaagtataaccaagaaaaggggcttttgaccatttccagatgagggttttaaagtggcagcagagagagaatcccttgggactggtatcatattggcagcacagatcatgactaaaaaaagactgcacagagaatggggaatttgggagaaggtttgccaggtttgcttttttggtagaccttttccagcagagtcaactagtcaatgcttccctactaaacccttggagtgccttgagcctgtgtgcctctaagtggacatggatccattctaaaacaatcagaagagtacttagaaaacatttatcttgtggccaggcatggtggctcacacctgtgatcccag

SEQ ID NO: 13304 - DNA, 1217 bp, Homo sapiens
gtaaagttagattcttgagggttgagaattctatgtgcatttttaaaaggggagatgttgttagcattttttgacactatcagtgtggaacactgccattgggcagagccacttcatccaagccccagcacattaatggttgcctctggctgacactgtagtgcctgggctgacataactgggcccactgagataaaaacagcaacagaagtagaaaatattaatggatacctatgacaagttctggggcttcctagactcctcctctaaaccatctgatataccaggtcactgggattctaatagagtgctctctattaattaattaatactgcattaatacactgtgcaatgcctaagagtaagatgagcacctcacaccatcctctgcattcctaatgtagacccatctcaacccagcagctgctcttggatgctatcaccaaagcattaagtaagtccttctcactctggatttcctaaaagggaatcagactccagtacacagtctgctttcactttttaaagtgtaagccaagcaccagtccccagtatgtcacagttcaaggatttccaaggagtccttctgaagacccattattatgcctggggtttaacagaaacaactctcctctaatttccccccaaagcagcatggtgggggcaggggactcagaactacaagccttctatccaaacaatcctcttaaccagtgttctggttacactgttccaccgaagtgcccctcactggacttgaggtgaataggtacaggcctgccccctcctccccaaataggctcttggcagagaggtgcacacagggctcacagcagaattttccagtggtagccactttcctcttatctgtgctggtaaattctaaagtgagactctaaagtaagaaattgtgccgtgctgccctaaccaaaacatagttaaggacaggcagacactgaccagagattactggccttgcatgctccatagctaaactctcgaggttttccggagaaaccctaaacagctaaaattgtgtcttttgatacttccgtggggcttattctaatacaaaatgtccattctaacctctcagctagctgtcagctcattagtttacccaaatatgttcaaacaagatgacctgtttttatactctactggctcttctttcctctcttttctttctctaaaatcacgtttttgcctttgatctt

SEQ ID NO: 13305 - DNA, 1099 bp, Homo sapiens
acacaagtatgggcaaaattggagtatgttagaactccaaactcaaggataagctagactaagaccctgttttgataaaaaaaaaaaaaaaaaaaaaaaaaaagttagtgggatcagtaaaaaagttacctacagttaacattgttaaacattttgaattttaatcattcttgtttcatattctccctgatctttttatgtattcctccagatatgagctagttctttgtatgcaacacaaaaaggtgtgggtttttttttgtagtttataaagaaggcaaattgttttgagatgttgctttcaaacttatgtaaggtaaacaaaatgtaatgatgaagagtacatacattaatatttttgtgtctcattttatatgtaattaaattttccatttttttcttcctaggtttacccagggttgatgataaccgctggccttattcattggattttaaatacattgaacataactgttcacataagagacgtatgtgtgttccttgcaccaacttttagcggccttacatctatatctactttcctgcttacaagagaactttggaaccaaggagcaggacttttagctgcttgttttattgctattgtaccaggctacatatctcggtcagtagctggatcctttgataatgaaggcattgctatttttgcacttcagttcacatactatttatgggtaagtgacatttaatgttttgctgccattattactcgtgacctttctcctgaaacactttaggctgtacgcagatttgtcttttacaaattatgtagttgcgtacagagatctgtattactgttcataatcaatttaataatggataacattttaaaatatgttaggcatctctcaagttatgtgtaaatatcctttttaaataagtcagaactccaaaagaagagctatcataaaacaatctgttgatatttttgtttctttgttttggggagataggtaagaaatagttacccaggaaagttgaagcatggtttgatggctaagaattttaaattgtttctgaaactagcattatttattttgctgctgccaggctatttaaacttaatgattttttcccc

SEQ ID NO: 13306 - DNA, 1175 bp, Homo sapiens
gtttcaaaaattttttttaagtttcttggcagtaactttgcaggttcctcctttgattaataacttacgttcttctcatcccgtttttgttttaaagcaggttttatgccagatattggcactggctttttatagattttaaatctataaatttattttgcctggagatgtcatgcacaaatatgtttttatctgccagctatgggttttttatgatgttattgacaaatagtgaattaagtctaattcttcataactaattaaatttgaatcatatacatttttctaaactgtggatgtgtaggttttatttagtgaacactagttataatttctaaatgtggctaattaatcagttgttcagtagtatcaatttagaaacaattagatcgtttgtgagacatttatataattccaggttggttttatagttttaagtatctagttcagtttcctgggaactttttccctccaacatattgtaagagaatttgtctttgcagttgctctatatgcaatcagtgctgtctactttgctggagtgatggtgcgactgatgttgactttgactccagtcgtgtgtatgctgtctgcaattgccttttcaaatgtttttgagcactatttgggggatgacatgaaaagggaaaatccacctgtggaggacagcagtgatgaggatgacaaaagaaaccaaggaaatttgtatgataaggtggggaatctaaagtaaggcctttaaattgtctatgtcctttcttaatttttccaccacagtaagaactatacatatcaagaaatgttattaaatgatgatttggacaaactgtgacttttctagttggtctccactgtttgcctcaaaatatgaatcctggtcagtcctttagctcagagttagaaaatagaatgtaatcagagaaggaattcctctttttggtaatttgttatctaaatacttaagatatatacccttgttaatatacccttccatttttgagagcaaaaactttatgctgtactaaattacataacatttggcactgtaaacccctctgaaaccatgtggacagacaggtgcttatccttgaggtccatactcagtgcatactttcaaaatattttggaagtgacatttgattggttgaacagtaaaatgaagggagcaaaatgcc

SEQ ID NO: 13307 - DNA, 2071 bp, Homo sapiens
taatactatgtgttttgtttttttatagactaccaaaaggaagcgtggctacattaaaaataagctggtttttaagaaaggcaagaaaatatctaagaagactgtttaaatgcactgttctggttcctaacttgaagcagttgtccttgtgagaaccggtctttgcctttagctcatgtcgtgtttcacagcaaagagggtacagaaccatcactggtccaggttaatgtacaaaattttctggcaatgcctgattaaaaaaataaaattggcttgttgagaacagctgttttcgatttctaatgtgaagcaagacagagcactgctgtaaatgtctagcagcagattttttttttattggtacatattatccttcaaatctgagaatttggactaactgcaccaaagaaccctctaatttggtccctggcacatgcatacttgtcaatgtttttattcttttacaagacctgcattttatttgaattacccgaatagcaatatgtaaaatacaagtgacaaaatgtgatgagagcttcttgaaccggtaaactagtacaggtctgagaaagacatattagaagaatcattatacttccttgaattatatttattttcatgtttctctaatgcaaagaatgtttcatcaaatgtatattttctgttgcttactgtttgctctgagaagaagctgctgtttcaaagatggacctctgagtagctaattgattcaagtagtttttttatgttgacacattattactgctgttagcagtcgttttcaccaggtacttacagagcagatttcatacatcattcattcaagggctaaatttatattttttggaaatcatggcaactacacaggatgttgcttaccaggacggagttttggtatcttagtactgaagttagcactatgtttacatgcaaaagattaaggaaaaaacccttaaagtggacaggtatccaaagttcattttctgtgactcatcaaagtgacaaaagacttgtaacaactttgcctggacttttttcattttacaacagttcatccattcacaatgattttgttctctgctccatattttttaatcccttaagcatttgatgaaacactctttagtgctatatgcattttcttacttttgttaaaaatgtgacagttgtcaaaaaatgcactaaaatgtaaatggagattgaacaagttcactttccagcttataggcaactttatacagacttgaacattttctccagttgtttagtaaaagtgaaagagaaagggtttttcctgccacaggatataacttttttttatataacaagcataacacaccactgcttttggtggaaaagtgcagaatagtatgtaccttttatgaagaaaaatgtaatttacaatattcagtgagaatgttactgctgattttcttttccaaggtgtagaatattctttgatttatagaattcatttttgacccagatgatggttcctttacagaacaataaaatggctgaacattttcacaaatagagtgtaacgaagtctggatttctgataccttgtcatttgggggattttattttactttgttgctttaaaattcaatgcagagaagttgttgactgtaggggaaataaagttaattcaaattttgtgttaagtgttgttttttacaaatcttttggttttgaaaggaattggtactgaacacatacctccttcttccttgttgactttcacaaaggttttaaagaaaatgtgtggaaaaaaatacgttagattatttcatcttagaccaagctattttatttggccttcttttaccctggaatgaaaatctcaggtttttttgtttttgtttttgtttttgttttttgttttttgttttgtttttggaagggatttggggagggggaacacctagccaactaggaattttatctctgtttaataaggatagggacctaacaaaaccatccatgaagttctggtaatgaaatgtcaagtctcagtatagaattttctcattagaaaaatcccaaaggaaagacccctcacctttct

SEQ ID NO: 13308 - DNA, 1440 bp, Homo sapiens
ctgcaatctgttaggacagaaaacctaacttattctctgaggtaaatccagtggcctaactttgtcttttcacatttcctcccaactaggtttccattgtttactgcagtgtatcagatctgctacgaaagcagaccagttcaagagatgttgtcttgtcttcagagccatccagagcatacataaagtgaatcatgcaacgtgttgggggaagttctgcctttctgatcaatcttttgggttcacgtggaaaccaggacttggcaacatgatgtttgactgtaatctcatcacggatatgtatgaatttttacaggttcgtttttgaattgtgagaggcagttcattagcaaagatgtactgggcagtaactaaacacacatgcaaacatgtgaatggtggtttattcctcattctgtggatgtttctatgagccaaaatttgatgtctttttttcaaaattgcttatgaaatttccacacaatcgtagcttataagattggaacgatctcagccaaatattttaggtgtaattcatatgtatttgagtggaggattttttttctcatttttctagtgttaaattttaaccagcattaacatggtagagtggaggagtgagtgtgttcaaagatcaacatatttaacttttaaacactatctcaaagccagcataattaactactttgattgtgggctgacctttgtttttttaacaatcaggcatttttaattagataatccactcatgtatttccccctcactgcagttgtctgcatttttagcctcttttctcttcgttagttgtcagaatatgccttcgtcaaggctcagaggtaacaagacagaaaattcatctgggattttcctgctgtggctggcacattcttctgattaacagacacttgtatgatgctttaggctagttagtgcattttttagcaaacatttatcttaaacatcacagatccactggggggtgcaaggggctactgttagtcctcttgttagatgcagtcactcctcctggtcacctagtgagcagggacagagccaggagtcaagtgcagtgccaaggtgcatgaccctctgagaagtcactgggctgatttgacctccgactcattggttgtgcaaatgccatgtgcagcctttcctgaggccataggagggcttcctgcagctgagatctatgcaggccatcctctcaacaagtgccactccaagggcggtcctcggtgcagcagcatcagcttcacttgtgggggggtgggggaaggggcggtctcagaaatgcaggttcccaggtcccaccctggacttctgaaggggtgtggcatctgtgtttctgatgcttactacaatatgtgaaccactactttagaaaatctgctttaacttggtattcctctaattgtgttccctaggaaatgactgtc

SEQ ID NO: 13309 - DNA, 1737 bp, Homo sapiens
tgaacttttacagttcaggcctgctgtgaatctttgatgaagctttaaggtgacactgttgtacaagatgtcagctttgctgaaacgcacattacctggaataagtgctttaattgtagaattagaatgggatttactgtactgttttaaatgagattggcttcagaatccattacagttaccttacatagcacttgatacgtgttaaatgaacatatgaatgtaatttatatattcctagaatttaagttactttgtgagatttgggcctgtccctcaatgccagtttaggatttctttttttctataccttgaaatgattataaaatagattttcatgggaattttaaaaactctatccaaaacatttttggagcattttaaagccccatacacagaagtatacgaaagcacacaaaacactccaagtttcagcagttttagcgccaccattaacccactttgcttgtctcatgaaaaatctttgttaaagtttgtacacaggtaacaaaaagttactttaaaagatatataaagggctgtaagctaattgtggtgtctagtaagtagcataatgagatgtgaggagttggaactttgcgtgttttgcgtattttcatctgcattcagcttcttactctgggtttgtactcgagtgttatttctttacaaatgcccttgtaattaccactctgaagtctgctgactgtgtctcttgaacatacttaggatattctgcacattatggaaaaaggtaaattttagaagtttctgctctactaactgtagatatttatgactctgcgagttatctatttttataaccacctgtggtccattgttcattttaattcacatttcttatgaagtatggtaacagggagggagacacctagattagcagctcaatttgtactacttcagccaatctgtgaatgtaaaaactacactgttgccttgctaggatccaccctcctataatatggaacaaatatctgaatgaaatccaccctaggagacggagtcaaactaaacttgtggtttttcatttaacttttgactacagcatggccccatggcatccacaccaagagggtgttgtgatgaggtgccggtgtgcaaagggaactttagtttttccactggttcttatctgctagccttttacatacatgtgtactatatttgtttatagactgtaggtggatatataatttaaaagcttgatttaataaacatttaaccccctaaacttgcaccgtggatcctgtttttctttttatcagcttaggtaatcattttatttgtcggctttttcttttttcctgaactgtgtttcattaccaatatcaaaaacagttttcaacagaagggcttcatctctaatcccaggccttaaatgcatctgtttttattgtttactgatatttttatacaattgcagtttaggatggagaccttctagtgaatttgaaatccccttctccccactccatgtatacctttaaaagctgggaaaatataaccagtgctgatctcgtaaaaatgtaagggagctctccctctacctctacctctacctctctacctctctacctctctacctctctacctctctacctctctacctctacctctacctctccgtctccctctctttccacggtctccctctgatgctgagccgaagctggactgtactgctgccatctcggctcactgcaacctccctgcctg

SEQ ID NO: 13310 - DNA, 1261 bp, Homo sapiens
gagccaagtgtgatagtaatagtatttaagctgtaatcatatttttggtgtctgatgatttagaaaaggaacagtgacagacagactagaaaattcaaaaatgcttttaaatgctcttgtatttaagtgatggccacagtatctgcatatatttgaagaatggaagttccactcttgcggaaggccttacctattcaggctgcagagcttaaggcttttgtaatcaccggcaagaattcccatccaggacacctcaaataaccacttacagcccgactgggaatcactggcccgagtgaggcgatagggatggaaataccagcccaaagtcctccaggctgcaggcagccagggcgtaagtgggtagaggaggggttcggggtcggtgtgagccccataggttttctggcactgcaggggccctagagaccccggccccgcaagcacgccaggaccctggaatcctaggggattccctgtgtgggccggtgtatttatttaaattcccgttgcagcgaaggccgcccttctgtcttcctgccagccctggcgcttcctgtgcagcgccactggacagccatctgtttcctcccctctgccatctgcctcgcgccgggcccagcgtgcggccctggaagcctggctcggccgccgcccgcgcacgctggccttctttgttactactttggctcagtggtttcctgggctcgctgctcattccctggcagggctcgcggcgtccgcggcgactcctgggatcggcaggggcctggcttccagcccagcgccggcagcagcccgggggctgcggagcggaaagggggctgggacgcggtcactgctccagccacccggcgctcctgggcggaaatcgcgagcagagcccttctcagcctcctgcagaaaacgcgcctcacctgacttgtgtttaaatcagcaagggcagtgacgcggctcttccttttcctggggcagtcactctcctccctctgctgagcccgctctctttagtttactttaagcaaaggttttgtttgtttatttgtttgtttggttttggtttttttgagacggagtctaaaaagtcttcagtctgtggcccagactggagtgcagtggtgcaatcttggctcactgcagcctcctcctcccgggttaaaatgattctcctacctcagcctcccaggtggctggggctacaggcgcgcgccaccacgcccagctaatttttgtatttttagtagagacggggtttctccat

SEQ ID NO: 13311 - DNA, 1462 bp, Homo sapiens
ggtgatgaaaaggctctaaaattgtggttgcacagtcctgtgaatatactgaaaaacactttagatgggagaattgtatggtatgtgaattattaaaatatcccagtaaagctgtttaagaaaaaaaagaatgatttttaaacgtagagaatataggggaaaagagaagttaataggtggtgtctaacaggataaatctataaatattggtataaattggttttttgaattatggaagaatcaccaaaagaaatggctaaaaggcttgggaggttgctgctgaggagtaagactgaggtcgggggagtgcggatgggagtcacctctgcactaccgaagttttttccttgtttggaaatgtatttttaaaaaatggaataatctcagtgcaagtcggcactgggtggaggacacaggtgcccccctgagcagaacttggagtcaaacctgtggagtgtggcttgtgggtgggccacatccctggcaagctgtcctgactgccatttccttcccaagatgcagccgtctgatgaggccacaacccctaggcccctcaggagctttgcagagaggaggacgtgtactccaggcgaggcctctggacctgtgttcctgtgccaaagtcctgtcaggctggtgggcaccaggaaaggcctgcaccctcttcctgctctcccaggaagccagctccctgagctcctgagccagccggaaactcttcctccagccttccggggagaacatccctcccattctgggaaaggaaagcagcctccagggaaatgttttctgccttcctgcttctagaaccacctcaggtactgatgaaccccacttagcacagctgaaggggtttgtgaatactcccgcctaaatcccttctacttcactcctcaggggagtgaagtgccttaagaaacaaagccctgtcctaatttatctagcttgtcagtccggtcttagagataccctctttcctgaagtgaggcgtgcctgtagaaacactatgtggtcagcctgtccccaaggagatcttgtgtctcctctccatctctgcctttgttaccagtgtgcatgtgtttgtgtgttttttaataaaatattgactcggccagttgcacaaggatttcttattgaaccagatgaaggctgtaaaacctggcctgaaacagtttccattcgagcttgtgtctggcccatggccctccacccgtgctctgtgtgtgccccttgctgaactgctggacttcaggttttctctccatcttgggggatagtatagcagggcagagttttaggtaaacatgtgcaggttctcaattatattcacgtcctccttctcctgcaataccaatcttctcattttggaaagagctttagagcaagctaagggttgtgtttacactatgatgattaatgatctcggcctaaatgtgctgtttcgctgatcttgagctgctca

SEQ ID NO: 13312 - DNA, 2180 bp, Homo sapiens
accacacctaaggaccaaagataagaaagactttttgcccaagacagtgaaagtaattataaaaacaagctttgaccacttaccaagtatctgaagagatgagttcatactatgatttagaaagtggttcaattcccctgttggcatatgattatttttactaaaattaatacagctctgtgggtcttccttagtgttttctttgaagccaatctgttttttttaggacaccagcctttggtttttcatctgttcgagatgcctcttctctgtctccttatcagatagaaatggagtcatgtgctgctgcttcatctagcagaggttggcctctggctctgacactttttgtcagttgtctttaggtggtcctgaatcttgggcccttttgattgtgaatactgtgtagcaggatcttgagagtccttgttcttacataggcattgctctagtttgtctttggcaaaaaaaaaaaaaaaaaaaagtaaatatccagggaaccctgcccagactaatactgttggtggcataagagaatcaagccattctcaagagataacttcataaccagaattgtctgttggctagcagctgtcacagataggcagggcacttgggatatgacctttctgtccaggtgattcacagactagacctttcttatcctcctcctagagttttgacttgggactctagtgttaagatgatgagcccgtgcatcaggtccttctgcactttggtggaagtctcccagggtaggtttcctatttgaaacagtggaatcatgtttccagtgataaagtttaatgacctcatccttttttttttttctcatctgccatttgtgtgtcttagatgggttttaattgcatgaatgtggctaatgtggttctcagaaattggtcagtatggcccaacatagcttctgctctgtcttactgactcaatacctttaggatttgtatcagagtttggatactagtgttagtggtggtgtcaccactacttaattgggagataatgaaaccaatcatggatgctgtttttattgggcatgtcatctaagagaggagaaatagctgggttttgggtctaattatgaataaggactgattcagaaaacgagtttatggtaggtagactaaagtttcacatcagactgtaccattgtgatttagacctatctaaaattcagagcatatcatctgggctacctcagggtcaccacccatgtattgggcttagtcaggattgacagatacattctcagctggcctgtcatataaaacatactgtcattgagcttaagctccgcttgttctgaggtttcacctccatgtgtttcattggtgcaaaagtggatctcttagttggtcacttaattctttctttttcagaaagatagtatgttcactggtatatttggtcactcttagaaccttccttcacattgttttttatgggacccatgaatggttagcctttcttttctattgtagaaggaaataaataggagtaaaaagaccattgtagtaaataagttcaaggggaacttgggaccagaaaccactgttatgtacaaaaaaatggcaaattcaataaactcaaatttaaaataatttttaaattaacagttatgataaattttatattttatacaaatagattgcttagaatggttctcaagaattataagagaaatgaactcacagtacaaaaattttataattactatacttgtgttttgtttgggggctgggaaatgtatttttacattgtagccaatcattttatatttgtcaatttaaatcttatgggtcttttttttttatctctcttgatgtcagattttatagtctttttaaataaatccatttaattaaaacgttcttacctttgtaagtgtttattacagaagtgtgatgtttaaatgaaaagctgtctctgtagttgtgggagttggctgcacaatcttgttgagtgcctatatagaatactagattttagatatatctaggatagaaaagaaacaaatccatttcccatccataaactgtccctcttgttggaaagttagaatacacatttaaacaacatttttagggaaccacagaggaagacttacaaatggctttaaatacttccaaagaagcaatttagactccttgtcacatttctag

SEQ ID NO: 13313 - DNA, 1118 bp, Homo sapiens
gactaaatttatgtcgtgtgtgtgtgtgtgtgtgtgtgtggttacccattttttagaaggagccgtacagaagaaaaattattctacattatgtaggattgctgtttgcattgccattttgcataagaaagtaatttttgattttgaaaatctcaaaacttttagatctgaaatacagccatgtgatcgatcatattctaaaggctatttaaaacatgtaaaaggatttggggaacggcagaaaacatgcagtttgggcatttgactgacttggaagtctaagcttattttagttataactattaaaatcatttttaaaaatttgttagttttgctgacagagaaaaatcgtcagttgtcagattttgcacaccacaataaatgtaccaccacacacggaatatgctaagaaaactatcagatagcgtttgatacactagtcattgtctcaatcactgatcctgtaagttgtcatcaaaatatgatttagaaatattggccaaggtgttgctttaactgaggagaaaagaaagcacactgcctaaatgtgtaaaagaaaaatgcagaggttattaaaatgtaaagaagtaacaatctttggatttgtctatacatatatatatatatatatggctttgccttaatatacccccttttttgtttgtgactttcaactgtaatcagttaataaagtatttattctctgcattcaggttcaaataacttgttgcattctcttatgtttaaatttacatgtgtcagctaataaatgagattcattagtacagtcatcccttggtatccatgagggattggttccaggacctgcctcaggtaccaaaatctacagatgcccaagtcccagatataaaatggtgtagtatttgcatataacattcacatcctcctgtttactttaaatcatctctagatgataatacctaattcactgtaaatgctatgtatatacttatactgtattgttcagaggaaaataacaaaaaaagtgcctgtttagatgcaacttttttttcaaatattttccttctgtgattggttcaatccatggatatggaacccacggatacagagggctgactaatttaaaattttcgacc

SEQ ID NO: 13314 - DNA, 1140 bp, Homo sapiens
aaaccccgtctctactaaaaatacaaaaactagccagggatggtggcacatgcctgtaatcccagctactcaggaggctgaggcaggagaatcgcttgaatccaggaggcggaggttgcagtgagccgagatcatgcccctgcactccagcctgggcaacagagcgaggctccatctcaaaaaaaaaaaaaagaaaagaaaagaaaatatgccctctaccttctgagcccgaggagaaaagaaagaaaatatgctctgttgttctgcccctcagatttattttcgtgtttttgtaggatcagacaaaggtgaaaatgaagcaatggaatcctgtaagtaagaagttttgtgatacttaagtagcctggcctgcatcccaaaaatttagattctaaatcttctgtgttcgtttttctgcctgaggaatactgctgtgccaagtggctcctcaaggcgatagattgggttgcttccttgctgttggcacggcctcttcaccagtgtctacactctttttccccagctggtaagcgggcccctcagtgctaccccagttccgtcaactctgccaggactgtgatgctgttcaaccttggcagcgcttactgcctgaggagcgaatatgacaaagcccgaaagtgtctccaccaggtgagtccagagtgggaggaactgaaccttgtaaagcagccaacacaagtttgaggtttatattttttgttactttgtttgaagcatctgatcagtttgttaaatattggaatatcactttcccagatataaaaatattcttgcaaggtaaacaactaatcagcattgtaaatgaacctagacacttaaaggaaagttcttcttgatgattttattttaaaaaaaatttttttttgccaggcacagtggctcatgcctcccagcactttgggaggccgaggcaggcggatcatgaggtcaggagtttgagaccagcctggccaatatggtgaaaccccatctctactaaaaatacaaaaattagccaggttggtggcacgcacctgtagtcccagctactcgggaggctgaagcaggagaatcgcttgaatccgggaggcggaggttgcagtgagccaagattgtgccactgtactccagcctgggcaa

SEQ ID NO: 13315 - DNA, 1208 bp, Homo sapiens
ccattgcactacagcctgggcaacaagagcgaaactctgtctcaaaaaaaaaaaaaaaaaagcctatgtggctttcacataggttcctgcttatgtgagcagccttgttgtgcctagaagtgatgatgctttaccatgtgaaaaataactacaaattctatttagtcaacttagtggcatctggtcagcatttctgatcccagatcagaaaagttaagtgacaggctgtccagggtaacatgtttgatattatctaggcattgagtgtatgagttaaaccagtaagagttaaaatgtttcactcttctcagtaacaaggctagggtgttgagcagcccctctcaaagtgcccccagacctcagtcactgcagcaaacagagcttttgatctaaagttacagtgtgtacagtccagctgaggttctcgtacagcaggtggccatggctgctgccacgctgggagagacagatggggtcaggcctggtttggggtctgaagggggttttgttttggtcccttggtttttaggttaatccaatggctggacctttgttaattgggaggcccaccctgcctgggagggaagaacagtgatgtgaagagttggaaagggctccgagtagatgtttccaaggttgcctgcccaccactaaccattctgaacagccagtaagcaaaatgccattaagtatcataaagatgttgccttgaattcttgtattttaaaaaaagcttcagactgtggtcattgaaaaaaacagtaaataaaatgtgttactagccacttggatggaaaacagagattttactatccacaaaatgggccgggcacagtggctcacatctgtaatcccagcactttgggaggccaaggcgggtggatcatctgaggtgaggagttcaagactagcctggacaacatgatgaaaccccgtctatactaaaaatacaagaaattagctgggcgtggtggcaggagcctgtaatcccagctacttgggaggctgaggcagaagaatcgcttgaacccaggaggcggaggttgcagtgagcctagatcgtgcaattgcactccagcctgggcaacaagagcaaaactccgtctcaaaaaaaaaaaatccacaaaatggtataaagacgatcttgcctatacagcttgcctagaaagctaggcttagatatataaaatctcattttctgaaaagag

SEQ ID NO: 13316 - DNA, 1740 bp, Homo sapiens
ccttcccctcccaagaacagactaaatccgtttaaagaaaagcaacgcaccaaatactcgtggaaccaaattctgctctcgccgggactgggactgcacagcgaactctccttttgggaactcctttcgtctatcgcgaagggaagcctcagctgctccagggagtcttccgacctccctgcccccgctcgcccctcgcctgtcggggcttgttccggcgttccctcttcggaaggcacgcggcccccaagttatccggaggaatctgtgtcgccgctggatagtggcatttaatgcctgcagtgtcgggggtggcagcgctcgggccggacgtggcgaggccaagcgggcagcgctgctctggtgccggctcccggattgcaggcctaatcgatgcatttttctgagtgagtcggtgactcccccacccacctcgtccgctctctcctcctcctcctcctcttcctctctggtctcctccctcctccgggctgggttgcaaatggcttcgttccccgagaccgatttccagatctgcttgctgtgcaaggagatgtgcggctcgccggcgccgctctcctccaactcgtccgcgtcgtcgtcctcctcgcagacgtccacgtcgtcggggggcggcggcgggggccctggggcggcggcgcgccgcctacacgtcctgccctgcctgcacgccttctgccgcccctgcctcgaggcgcaccggctgccggcggcgggcggcggcgcggcgggagagccgctcaagctgcgctgccccgtgtgcgaccagaaagtagtgctagccgaggcggcgggtatggacgcgctgccttcgtccgccttcctgcttagcaacctgctcgacgcggtggtggccactgccgacgagccgccgcccaagaacgggcgcgccggcgctccggcgggagcgggcggccacagcaaccaccggcaccacgctcaccacgcgcacccgcgcgcgtccgcctccgcgccgccactcccgcaggcgccgcagccgcccgcgccttcccgctcggcacccggcggccctgccgcttccccgtcggcgctgctgctccgccgtcctcacggctgcagctcgtgcgatgagggcaacgcagcttcttcgcgctgcctcgactgccaggagcacctgtgcgacaactgcgtccgagcgcaccagcgcgtgcgcctcaccaaggaccactacatcgagcgcggcccgccgggtcccggtgccgcagcagcggcgcagcagctcgggctcgggccgccctttcccggcccgcccttctccatcctctcagtgtttcccgagcgcctcggcttctgccagcaccacgacgacgaggtgagtgcgtgggggcgtgtgtttgtgtccatcggataactgcgtgtgtgctcaacagcgtttcccggccggtcccacagcgaggggaggaggccctctccggatttggtttgtatttcctttggctacgtggcagtccttgctaccaaagtagatcatgacctgggaagtatgtggaagtggattctgtgtacgtgtcgcgaggggctccgaaaaatcccatagcgtggggtcctcccttttctgattttaatttctgtgtggcaaaacgcggcaatcgtcttgagttaggcgtgagttgggaggagataggtgtgtgtgtttgtgtagacgtggcctgctcctgctcttgtgggcacaccagaggcctcccaacgtgctgagaa

SEQ ID NO: 13317 - DNA, 1255 bp, Homo sapiens
ggcaaggagctggctgaccttaccactagctttttgccttcgttccagaaacttaagcctgtagcttgcttgagtgcctgggagaaccatgctttgcactttgcattactacctgtggtgtgaggatggttgttactggctcttaaccttgcttcacacatctaggctagagcagcaaaggaaacttttctggtacattcttacatccaggccactaatatcagactaggtaacacagtcttaacaacttttctggataatgaagctaagattcagggcaaactctcatgccaggaggtttgttttgtttggtttctgccttcgaagtgtctctgttacagttctgaatgagactagagtgggatatggcattcagttgtgttcccccctccattcccccttaatttggggcagagagagtgggagaaaaaaggaagcagatatttttagttatgtttgcagttacgccactgctgcctctccctttggggtgtgcttgctcattggggaagctggtcgttcggttgtgagagccagggccctccagttgctgtcttccctcctcctcccgtcctgcatctccatttatgcctgtaccctctcttgtccccaggtgctgcacctgtactgtgacacttgctctgtacccatctgtcgtgagtgcacaatgggccggcatgggggccacagcttcatctacctccaggaggcactgcaggactcacgggcactcaccatccagctgctggcagatgcccagcagggacgacaggcaatccaggtgagccttccctgcccttctgcagttcccacgtgaatcgagcccccctttctgtcgggtggcatggacagacaattgggcagattccagtgtggggggtggaatagtgacccaaatgagctcaggtgacatccctgcagcagcggtccctttaggggttctggcagtctcgtgaagatgtcagggatgtggccaaagttactggtcagatttctaagcacctagcctgggccccaacataccacctgcacgtgtcccacccagccacctcccgaaatcaaagtggacattggcactttccagccaggactgcagaaaggctgggtgcttaatgcttattactactactactactactactactactactactactactactacaacatattttttgagatgagtcttgccctgtcacccaggctggagtgcagttgtgtgatctcggctaaccacaacctccacctcccggat

SEQ ID NO: 13318 - DNA, 5556 bp, Homo sapiens
taagtaaaaaaacaaaaaactataaaacatggaaaaaataggatttgaaatgcataattatagaatacctgtgttcttgagaatactgtttatatggggtttagattatgttgtgttgttttgatctttttggaaaatcttctctttttaaatgctgcaacagagaaatttcctctgttctctgtttatacctcagtgtgtttaacatcctcttctgcatcgtttcttgatcttagacgttgtggctgtggcttgctagccaagaaaagcagacccttcatattttagggtatataatctttgtttcttttaagggagggtgtgtgcatgtttgtttcaaagccatcttgcacccaagtagtaaagctgaaaatgacacactgcctcccaaagaacctctccttttcacactttggtttcttaaaaaagtatatagatggtagctcaggatttttgattaaacatattctcaaaagttatgctttcttattttgctgttaggttataaagggttaaatggaaggaaaaaggaaattaacctcgttctcagagagagggttttcaggcatgggctgacgtggacatgaatgtgggtggacatgcgtgtgctgagggagtcagggagcacattaaagaacaaggcacccccaaactataggaactccacagaaagggcagggtctgccctgacccgcgagtgcatgttgttctgtagtgctaggggtttcttttcctaagaagagtaggcaaaggaaagaacttttattttacaagcacaattttttcctgctttgaaagttcagggaaatagaaggtttgaaagtcaaattaataccaacagcccagtcccacaccctctgcttgggtcactttttataggattgtttgcacccaggccatgctttaggacctcatggttaacatgaatccccccgccccctctccccccaaggcctttgaccataaaggatctagaaaccaaattgtcccaacctgaaatgtaggatgtaatgtcttttcttaaacctgtaactcggtaccaaagaatgaaaatttaaggctcccactgcagaactgtggggtagaatctgtgtcactttacaggattggttggttgtaagctggacttgggtacaaaacttgtgcttctgggcattgtctgtctttcaagtgcaaagcagatgtagctgataccctgcttgtcagaacccagtgggttcctgcaatgccccaaatactgaaataagaaccaaattctggaggagccctcctcagggaaaagagggactctcaaacaaacgtcagtgacttacaagggagacctcttgtttaaagacttatggatcaacttctgttcctctgtttaagagaaatttctattgcaaaatgggtatcgttttaaatgagcagaacagattaacaaatggagcaatttgtttctgttatcccaatagaaaaggagatgatggggacagtgtgacaagtcaatcaagttgcttttcccgtacacctcttttggacgtttaatttactactactacaagctactctgtctcttcccattgctttaattctagggtttctgagtgaccaaaatgggaaggaaaaaaaaaacctcatctcacagaggagaactgcatgcaataaaagattcaaaagttggaaagtagcttcaaactgctgctggctcccagctgctgttacagggtgggaaggtgttaggaaatgttgtttgttagaagctccttttactgtagaatttaatagtgaatccttccccaatgcctattcagttgccttttggccgttaagctctaagttctttggtaaagagttaatataattaaacatttttactgttttctattttggagtaacttggtgctgatcttccttccctttccccagctgcccaacaagccaccctttaaacaccaaagacaactggttttaaatgcttgaaaaaaattttattgaggagatggatcttgattaaaatcttttcatcatcattttcattctgctcttttctttctaatttccccagatgtaggaaaattttgggacctgaatgagaaatgttcttggtgcataacagtaactagagctccttatttgacattttactatggatgtgatcgaaaagccaagattttcgctccatggctgaaattatcaggtcttaatttacagacttgtaaatttgcaggcttagagcaactagaactatcccctgaaataggtgtgtaggtcagagatactacctctttgtcctcagtggtggtatatctatctccttacctttctgtacccaaaatggtgcatgactggtatttgagaaacatggtcacatttggaaagcttttgtttttaaaacattggcggtttttcctgcccgtggttgactcctgacccatagggattggtgcgaagcactttggagagtgtttattgtatgatgtgaaatgttctaaatcaaagaaagatgataaaagccaacatttggcagtccctagtgtgaaactgtgaaaagtacctgtgtttaaatgcataatctcctgcccgggtaatgccaggtagccaggagttgggtcaaagaagggagtcgtcatcctgatggaaaaaataaggtcctgggtattatgaggtaggagaataaaaaggtttctggggagtaagtatgacaattactagtccccatggaggtctgatctggtcaggtggcaagggttgggtggggtatgatgtaagctcagtttatgtgtggagatgcccattgggtttggatatataggtttgagtattgagatgtttaaaggacatctaacccataggtaaaaactacttttgcttgacactgacttaacatttcaaaagtgttatttttggtcccaagatctaatgctgtctcagaacatgtgccctgttgtggctgcaagtggcactcaagttgactagagcacagtgacctgggttgtaccccaagtgcactaactcctcaatgcccttttaagtctaacttatttgggaaacacataacaaagggtaccataaaccgaatccaaattacgtgttgggccaaaaatgttgccagaactgaggcactttgtgatggagttgcaagagatagcttgagatcggctcagtctgatttattctagttaagccaaagcttaattatttgaggaggaaagtcttttaggcttgaagcagcaaaatactgtttatatatgtgttaccttcctcgttggaagattctacgattgctctgttctggtaggtggtgaaagatatgccaaagttttaggcttgtttttctgatcttatttttttaatccagtggtgccaaaaagtatttagggtatgtttaaggtatatttaaaacatcactctgaatgagtttccaacagtctggggctgtataaaagtcacactcttgtacttgcaggtgatggtgtcacagggccagggcctccagagctctacggctttctctggttttctatagggccaagggcacaggacgcagcattccagaccacactgactgcttttgctgagtttctacctcacttgtggcaagtcatctacctcatgttagcatctgacaggtctcaaaaagaatagtattaatccagtgggcagtgggtgggagtgggaagctacctctaaaagaaatgttaccataaatctacaactgatttctcccaggagaaatgttctacttaccttgaaagagaaatgtcaggcaaatgtagtcataaatccaagtagttcttagcaatctggcttttccccctcaaaaagaattatgcataccattactgttgttcagtattatgaaactactggttaatctgacctattggaggacttaactacaaataaagacctttaggtctctttctcttcaagagaaaaatattttatctgtatttcgaatgtctgcaaataataccctttaggagcaattctaaaggtctagatcttggaaacatcaaatatttgaagggaatgagaatcctcttgacttcatgattgtatttgtagctctctggacccggcaggacgttcatcaccatgatgttgcaacaatcactgttttgactgagcagtgactgttgaagtgtgtattgctcttttgttttgtttttatttttttctaccaaaggtaacatgttgacgggttttttttttccttgtttattaaatacttgataaagttgagaagcacattaccaggatatactgtattgaccctcccacctctcttctgccctaatttttggttgtttggaagagaggagggtcctaagaccactgtcattatcatgaggggcttataaatgtcatggtgaagaaatacctcaatgatgtctatttttaaaactgatcttacgggttaacaagccagcctggtgggatattttccatcatcatttaaccaataatggttctaaaagttttgtgtatccacatggtcttagacctccttttaatgattgtattaacttacaagctcaggtagtatttttcttaagactctatctcagagcacactgactgaatgttgatgtgtgtagcaaagtgtttactttctttaaataaccagctctgtaactctgtaagttctttgtgtttctagcagtctgtgtagttgtctttcttcagaggaagatttttcacatttctggggttttcttgcttttagggtggtaagattcctttctttttttcccttttctcctaaaatcgatgcaggtaagggtgggtgggtaaggggtgttgttttttaactagcatgttagttatacttgggtgggtgggagggttgttaaactgaatcttgcttaatactgtccattagctctcatgccgggtcagcaaaatgctttaatttttaactgcagaacatgtgactcggttgagtctttttgtcttttttttttttaaataaacaattgggggaattaatgtgggcaagttgccttatgttagaatgactaagttaaacctcttaatttgtatttgtccaaggcagacatgatataaggaatatgcactaccgtagtaactcccctggccgcagaaaccacactgcaagcctgtccggggtggggtgctgactgccatttgccacttttaaatgggcactgccgtggtaatgtgaatcccatcaatgcagtagatgggtggggaaatgaagatttccccccaaacctttaggcaaaagtgagtttttgtttggttgattttgggtttttttcccccctcctcttttggctttcacattttaaatcttaaatgttactattgcaggccgcaggcatgacaggcaatgagcaggtgaagaaccaatggaaaagtgttcaaaaactcctgtgttagctaacaggcttctgaatgtatcactgtggtccacagagaaggctggaggaggtagcaaggagatgctgtatcagctactacagccttaaaacaaagttggtgtctctttggactttaaaattgttcctatgcagcttattttatttttgtttaatcaaataaacgagg

SEQ ID NO: 13319 - DNA, 1458 bp, Homo sapiens
aaagtcagggagaggctggtctgtgggtacaggcagcacctgggaaccaggatgaaattcagaaatttccacactgttctctggtaccaacatctgtggccactgaagcccgtcagagggaccaaacctgtattttcctgaagcaggagtgggtctttggggcaagtttttgttgccccaaagaaggtggatgggggcatccaccttcttcccaccttggccagttatcccagcaagaagctaaaaccaaggctggcatgggcctggctgtcagcctcgcctttctgggggcatttctttcctccattgctgctggcctgccctacatcagggcccccaccttcctcagggctttcggtgcatctggggttgatggttctctgtctctctctctccagggccaggtctggattaatggctttaaccttggccgctattggccagcccggggccctcagttgaccttgtttgtgccccagcacatcctgatgacctcggccccaaacaccatcaccgtgctggaactggagtgggcaccctgcagcagtgatgatccagaactatgtgctgtgacgttcgtggacaggccagttattggctcatctgtgacctacgatcatccctccaaacctgttgaaaaaagactcatgcccccacccccgcaaaaaaacaaagattcatggctggaccatgtatgatgatgaaagcctgtgtctttgagggattctaccctgaacatacctcacagatcctccctgtcatgccacatttcactgattggaatgtggaaatggaaaaggaatttaggatgtgcattttcacctgaggtttccctgcatccctgcagtgccaaagccccaccttcagggaccacctggaatgtgtgaggggctgacagcacagtaacgtgcatacatatctgcagggctggaatggaagctttaaaggtggtagtgatttttattttggaagaatcatgttacctttttgttaaataaaatttgtactcaaatgatgatgtcactgtttttaatgtgcaggtattgaattatatggtctgacttaaatcataactagacttgagtgggctgaataaaccacttcactaacttgaagttcaaaaggatggaaaatagtcttggtttgatctgtggactgctgcttttctgatcgttatttgacttgcttttggactagataacctataaatacagctcaaaacaattatgcaaacaatctaaatgattaacagttgcacagtgtacatagtatggtatatctatatagaagcatagtattttagccactaaaatggtgagagatctatacttatatgcaaattttttgatacatgaaaaaacagattaccttaaattggatcccgttttgtgtgtttcaacataagaacttcacatattcacacagtacaggcctatacacatgtcagtagtcaggcat

SEQ ID NO: 13320 - DNA, 1107 bp, Homo sapiens
atctctgggcaatggaattaatggatacttttcctgttttcttttcatttttctagcatttctaccatgggaaggtattatttatgtgatgtttaaagtatctactttctattctagggaagaataccactacaatctgaacaccagtttggtgttttttgtttttcttatttctcagtggtgggagagggttaataggaggtaaacttttatggtgaattgttggtgttttttcttttagtcagttttgaggtctgagtgaaggaaatttttccagcagtcattaagccttgtcatcttagcagatgctcagatattttcccacacaaaagcttgcattagggtggctacattaggatctcctcatttttccctgctcttttttcactcacaggttgaaaatgaatatggcagctactttgcctgtgattttgactacctgcgcttcctgcagaagcgctttcgccaccatctgggggatgatgtggttctgtttaccactgatggagcacataaaacattcctgaaatgtggggccctgcagggcctctacaccacggtggactttggaacaggttggtgtttgtagtaacagaaattgcagcttaaaatcagctttttactcagtcagttgctctgggcagctgttgttataagtgtcatgggcagattgagatttttcatgttttcatttttcaaggaacaggtagaatagaatacttgcacccctcagtaacagagggttatctgtaggccaagagcttccagggtagctgcattttcagcactggtggagctagcctggaaaatggagtactgctatctcaggggctaggctggcccacccaagatgaagaagcaggtaggcatctccagctgtgagaagctctaccttgaggcagtcaccttttaggctgtgtctggggcgcgcttctctgctctttctgccctccctgtcctcccaccttggcaggacactcggggttatgccttggctgtagccaaccttgaggtcagccactggctgggaacttaccttatgctttgttgtctttctgcataacttagaacactgaactgtcagggctggaggtggtttggcagatg

SEQ ID NO: 13321 - DNA, 1197 bp, Homo sapiens
aggtcatatttacatagttttacaactttttgcaactttgtctttctgacaatttgtcgtgaatatttctccatgtcacatccatgtatcatcttaattattatcctttaacagctccctggtagtctcttttgcggatggaccatcatttaattcccttgataggcaaactcaccacttagcatgtgttgtcagtgaaccccattcattatatattactttcaaaagattttttctaattgatctttgctcttgtattttcattgggatttctatatgccatcttgattttcataagtttgtcttccactgagggctggccactcttttttaaaaattgagatataatttatataggatagaattcacctttttaaagtgtacaattcagtggttgttagtatattcagagttgtacagccattaccactatctaattttaaacattttcatcaccttagaaaaaaccccatatcctgttcctccctcctcccagttctaagatgaaaaggttggtcctataaactgttctctgttgtgtctgaacaggaagcagttcagttctttaatgtgaccacactccagaaggagctgtatgactttgctaaggaaaatataatggatgatgatgaggtaagttttcatgcttagcacatgtctggtggctacgagaaaatattactcacatctttgctagaatcactggaaggctgagtcctccctgaagtaagaaacagaggggaccttgagaaagacagttcctgtgggtgtttcagtgacagtcagaatgctggcatgggaaagagcggctttctaggaaacctaggcaggagtgccacatttcctgatagcgaaacgggtgtggggccacactccaggaattcacagtggtcattcttcatcttttcactttatataaaaacagtgaatttttaattgctcagcactctgaagagacatggatactcacaccccaatttttctgctagactattgctattattattttttctaaattgcatctttactgtaagcattttgtcattctctagaattgcttgaaattcctgattccaccttactcagctgaccccttttctgaccctgactcaactggttatggagtggtcattttgtgatgagtctggtcacagaaaagccatcattagcggtagtatttagagtatttgtttggaa

SEQ ID NO: 13322 - DNA, 2150 bp, Homo sapiens
gaggagctagagcaagttaatctgcttgtttctctagaatcatttaaaggtaacctctgaattgggaagggaggttgtagttggcagggagttttccatttaataggcttaatttcctaagcctgactgaagaaatactgtctttcctttttctgcagctgaaagtagtgatggcatccacataattttgaagtgatgtcttatatagactgaactgtattcagtaccaaatagtcacgcttaaaagtgtgtgaagactgaatccaagaagtcttgggattggattttaccatatgaaatgtttcatattgaaaacacaagatgacctttctaatgagctgtatgagaggtgaatctcctcactgtcactgccatagccaagcatcctcatgagagtgagcacatcggcacagcatgcatccagctctggaggccacggtgcaggcatagctgcctgctgctctggcagaggccagtaaatacagttcctagaagcagcctttgctgtctttttacactgtatgcggtttggaaatgaatgtagaaacttactgtgggcatttacctttctgtgccagtttggcttttattgcctgaaccttatgctgacctggagaggagatgggggacagtgctgttgtggggccagcagtgaatctgtatgcggagagttgtgttgtgctgatgtggccgttggtggtcaggtaagaggctcggcaccttcttggaagaaatcatgtctgagggtgtacgtttgatatgatcatgccagattggagaagatccaagccaggaagatgggcttgaagcaaactgcattatcaggagtaccttggtgagaggatcagtgtaaatcctaataggtacaaagacttttgtgttttggctttgtcacagatttattgaaaaacttttttgcttctgcttccatttttagcattttagtttctggttttcatttttggagattccttgccttttaaactcgtggtttttctctcattttcttccctctctccctccatctctgaccacccccaccctaaccccccacccccaccatcctattaaacatttttaaagccctaccccagacattggaaataggtgacccaagtagggggagaaagtattattgttgatagcttctgactaggtgttaagggatcttcattatgaacaagatgaatttttttctggaaacactagatgttatcaatcaaacactaaaatgtaccatacaaatcccttaagcctctcaaatattgagctttagtacaatcatggatagacattctggtgatgatttaggggctttttatacaccacatactagcttctttctctataagagtgcctctttcataaaaccaaatgcttgtctgctagcatacttttcaaagggaatccactgttttctcactttcctcccatatctccgtccttcatccaaaaccttcccagaatccatcagcaagcatgtttgaggcctgtggtgtaggggactgaattttttttttaacttctattccattttaattgtaggatatctttgtccatatacccaggtgtcctgatttgaatgtactatttgatcctcattgtgttcaggcaaaaaataggaaatgagtaattttgagtttgaaatctctcccagaagacaaactacttcagtgagtaaaagctttgacattttatgttttattcataaagggggttaattatttgctacaaagaagcacgatctattttcatcatcgatttgaaaatatctgtaactcctatagatcctataggcagagagttttcctttctgactttttccctttgctttcgtgtgaccacatgttttctgtaccagtcactggggaaagaagtgagtttatctcgtttgttttaaaagttttgcttgtctatttagcattcctttttgggtctcaagatttatggaacaataaatgtcatttaatgctgtgtgcttattttgaattcctcatcaggttttagaagcggggtaaaaatacttagatgcttatcagacttgaaattatactgagtggcattgaacgtgagtttgtcccagtgaaacaggctaaataaattttggcaccagcaaatttgttactttgtttttttaatagtaggatgta

SEQ ID NO: 13323 - DNA, 1269 bp, Homo sapiens
ccactactgatgtttctggacaaagttagtgaagctcatcacagcgaaccaggtctctcaaaagaaaggacagatagaccaccctcatcaatgaaaggaagttctcaaacacatcctttggaacttactattgtttcccagttttagttttttgtttcgtttcgttttgtattttctgtaacagaggactatcctcagtctgcatgtaacttttatgatagttattccaaattcaagaagaagcagtattaacatcaattgatcgacacaaagtaatttttaatttaattcatcatttcacatgtttgtactttgtcttcccattaacctttgccagtgttatgattgtataaatttttttaaatgctggttaaacaggaatgcttaaagctttaaaagtttaacagtctaaaacatttttgcttttattcaactgcagaataatatttttattgctactttgagttttgtttcgtatcatgtcctatgctagaaatatttaaatgatgtgaaacaaagcaggactaatttgaactacagctggactccgtttgtgtgatggtgatacatgtcattagttgcaacttctttggggtgatctatagtttgaaaactaaaacctcaaagacagatgttacagaatcagccagttctgtaaaactgatattgtctattggttattgatcttgccatctttatttaaaaccatgtcccttctatgatcccttaagaaagctgcaccaaatcatctgcctgttttttcttgatacttactgaaatagaaggttttattgcagggtttattttggtttgtttatatctttgttgtgaatgatgcttttttgtatttattaatatcaaattcacttatgaataaacttgataatggaaacggacaaaaaaaatcaagtgcgtgtgtgtccttgaccgtcttctgtttctcacgtaataaacaaattatcgagacatgggagtgaccagcaccttttctttaaatggtggaacctggtttccttttaccatgaaattgtcttacttgaaaatattgatcctgatgagagagaagatggtgccaaggctgtctttgtataatgggctcaaattctctacctcttcagggctaatacttttaactgagctgctgcctatagtgtcttttggaaaactacttaaagggtgattttctgttactttttagcaaatttttttaatcacctcttgctacacccattcttttcatgtgcagccgactcaaaaattaccagtttt

SEQ ID NO: 13324 - DNA, 1146 bp, Homo sapiens
aaattggataatttaccagttaaattctgcttacataaatgttacgaattgattgggtttttcttgaactattacttagaacactgagatggtgtgtttgaattatatgaggaatgtttaactaccaaggctaaagtttgactcccagtaatctgattctgaatacttccattatttgcagagcacagaagttccacttacaactaccaatttttaggaaaaaactttccagctagtaagcctaatttgtgctggagaaaatcatagaaatacacttaactttggaaatgacaaaaggatccaaataggaagaacatttaggtttctttgagaaaactggttatgggaatattttttgtagcatcactatttctctttgaactaaagaatattgacaagattaaagacacagcctgctaataagcagttctttgtacctatgtgtgaaaaaaacgtaatgtttctgatcataggcattgttaatgcctatttcactgtgctgattagcaaaatgttcttcattattttcaatttttctctttaaaaatttactgctctcagctcttaggagacatacggactaaggtatagacattgctattttctgacatcttatgataccataacttttttttctttcatcaatttaacaaatgatggtcttctattaaaaatcaaagtagaagtaaaatccttagacatacatctatttttctgtaaatatggttatcgagagagatactgcttgaataatgtcctctggaggtgctcattctttcagcttgactacttcatacaaattaaatgaggtcattcacactgaattattgtgtttaatctgttttatagacatcttcaccactcatcagccaaaattcaagtatcagataacataaagatttgttttcagctcttttaaggaaatcttaaataaactattctttctcatttcacttgaaatatgcaaggtataactggcatttacatatattaaacaaataagatttagatgtaaagaaatcaaaggaatctgaatatgctttcttatatttattgaattaaacaatatagatacattgagaaaagcatagagggctctcaaggagttcgcctccttaaaataatagtagactaaatagtttttca

SEQ ID NO: 13325 - DNA, 1279 bp, Homo sapiens
tgagtatccagggaaatgaaagtaggacttgaaaataccccatgaattgctctgtctcagctgtgtcctaactccaatgtgagaatgacagggacagggtaccctgaagctggatgaggcagaggctctggatcctcttaactttcctttctccttcctttttcactcccagctcctgggcaaaaataaaaataaaaaataacttactaagcactcgacagcatgctaggtgccaggctggatgccagagatttggaggtacaatagacctgtccagccctccaagagctgcaaggaggaagcagaccctacatttcactatgaagcaagaatggagcttaggtaaacaactagagagggctgcccaaggaaacgtaggcatgtttaagatgtgtttggctgggaggtgaaggtgggaggtattactgaaaggtgatagaaaagaaggttataaaggaaggtaaaggattgcctttagacttcagtgccaggcaaagggtattgcaaagccattgaggttttttgagcaatacagagaagtatctcatatgcactgtggtagattacattttgaaggccaattttttacacctccctatgtccacaccctttcccacgtgattttccagttccctgtgttgacaccagtggagtgtatttcaccaccccttgattttgggatcagctctcaaagttaccaatgggatctgagcagatatgtcatgaagctgaggcttgaaatatgcttttgtagtggagtattcctgtgtacttctgccattgccataataaggacatgccctggatagactgctggcccaggaagcatgagagacactgcccaagagacctacagacttgcagtgagaagtagagcttccccagctattgcagtcaaagcagatccactcagctgtgttacatcagtcaatcctcagccaactcatgatacatgggcaaacccagctgagatcaacagacacatccactaacctgcagatgaatgttcctgttgtatattcctgagatttttgtggttgctcattacatgtaatagctgactaacacactaccatatttccctccaaaaaaatttaaaaatactttgtcaaggaaactaatcactccgtgatcaaccgtgggtacttgtgaggttaaggctaggaagtatttccctcctttttttgtggaaggaagggcaggagagtgctggaaacaactgtggagaagtcatggttctgggtaagacaatgtgctcatacgcctcctatgtatctga

SEQ ID NO: 13326 - DNA, 1228 bp, Homo sapiens
atcaagaagaaaatcatccttgccattcagcagctgggaaatggcgagtggacccagggcctgcagaagcgactgaagcacctgaaaggaagcatccagctcttcgaagctaagctggacaaaggagcccggatgctctgggagctcgccattgacttctcccctcgatgcagtgagaaccctgagaagatcattgccacggagcagaacacgtgtgcaatggagaaatcagggcggatctacacggaaatcatccggatttgggacatcgtcttagatcactgcaaactggctgattccatcaaggccatctgcaatgcctacaaccggggcttgtcctgtgtcctgcggaagaagctgaaaggtatcaataaaggccaagtgtcagctaacatgaaaattcaaaagcgtatacctcgctgctatgtggaggacacagaggccgagaagggcagggagcatgtcaatcctgagtactttcccccagccagtgcagtggagacagaatataacatcatgaagttccacagcttcagcaccaacatggcctttaacatcctcaatgacacgacagccacagtggagtaccccttccgggtgggtgagcttgagtacgcggtgatcgacctcaatcccaggccactggagcccatcatccttattgggcgaagtggcactgggaagacaacctgctgcttgtacagattgtggaagaaattccacgtttactgggaaaaagctgagcaggcaggaagcccattgctggccaaacaggtctggctgaagagaaggttggaagtggaacccggaaaagagagtccaggtggggaggaagaggaggaggaagaggacgaggaagaggaagattctattgaagtggaaacagtagaaagcatagatgagcaggagtatgaagcctgcgcaggaggagccggtgtggagccagcaggggacggccaagctgcagaagtatgtgcaccagaacatccccaccagctggagcatttacatcagatctttgtgaccaagaaccatgtgctgtgccaggaggtacaaaggaatttcattgagctttccaagtccaccaaggccactagtcattacaaaccactggaccccaacattcacaaactccaggacctgagggacgagaactttcctctgtttgtcacttccaagcagctgcttcttctgcttgatgcttctctgcccaaaccattttttctga

SEQ ID NO: 13327 - DNA, 1162 bp, Homo sapiens
tacccagtaagtacttgaatttgaattctcttccttttcatttttgcctgcaaactgaccagtcttttctgagttcatctcttctgtacgttttgtcaagtgcagtgaacagcaactacaaaatattttgtttttctgtctttttctttagtaaagggtagatgatctgcctttcaggttatctcaaggggcagtttcacctttccataatataaattacccttgtgtaagttatttcttccatcttctgatagcaatttcctgaatgcctgccagctaaccattaagccagtgttcagtattttagcattttaaaaaacaagggaccaatttctgtgtcagcatgggctagcttgccattgaataacaaaggcaaaatctcactgtctcacacaacttttctattgcaacttgcctagggactttggtttagatcataggttggccatgatcaaactatggtccatgggcaaaatctgtctagctccttatttatctaaataaagttttactggaatatagccttgtccatttatttattatctgtggctactttggttctacaatggcacagctgagtagttgctacagagtgtgtacatctcacaaaacctaaaatacttattctgtggccctttacagagaaagttcaccaatttgtgctctaagttgccttcattctgggtctcaggctgacaaagcagataccatcaggagtgtgggtgctaactttgggaaatgaaaaaagagtatggcaaatcacttaaggactcttaaaggactttcattggccaaagcaaatcacatagccacattaaagttctaggaggagtgtgatccttgcatatacctgggagaaaaaccagaaatatttggaagacaacaccactgattaacatcttcatttatatgctttcttccaatatattttcaacttgttactgaggtaaaatttaaaagtgtaccgatattaagtgtacacctcagtgggtttttatatatgcccttgaatgcaccacccaggtcaaaatatagaatatttctagcacttcagtaggtgtccttatgttccccaggcccccaccaaccccttttatcaccacggattagttttgcctgttttaaaactttatgtaagtgaaataattatatgcactcttcc

SEQ ID NO: 13328 - DNA, 1200 bp, Homo sapiens
gcctccggagggcgatggggccctgtgcctggtctgtcgccgcctcatcgtagctacccgcgaacgcgacgtcaggcgccactacgaggctgagcacgaatactacgagcggtatgtggcggacggcgagcgcgcggccctggtggagcgtctgcgtcagggcgacttgcccgtggcctccttcactcctgaagagagagctgctcgtgcaggcctcgggctctgccgcctcttggccttgaagggtcgcggctggggtgagggggactttgtataccagtgcatggaggtgttgctgagagaggtactgcccgagcatgtaagcgtcctgcaaggcgttgacttatctccagatatcacaaggcagaggatcctgagcattgacaggaatctacgcaaccagctttttaaccgagccagggactttaaagcctattctcttgccttggacgaccaggcttttgtggcctatgagaactacctcctggtctttatccgcggtgtaggccctgagttggaggtgcaagaagatcttctgaccataatcaacctgactcatcatttcagtgttggtgcgctcatgtcggcaatcctagagtccctgcagacagcagggcttagcttgcagagaatggttggactgaccacgacccatactttgaggatgattggtgagaactcaggactcgtctcatacatgagagaaaaggccgtaagccccaactgttggaatgtcattcattattcaggatttcttcacttggaactgttgagctcctatgatgtagatgttaatcagatcataaataccatatccgaatggatagttttgattaagaccagaggcgttaggcgacctgaatttcagactttactaacggaatctgaatcagagcatggtgaaagggttaatggacgatgtctgaacaattggcttaggagagggaaaactttaaaactaatattctctctaagaaaagaaatggaagcgttcttggtttcagtaggggcaacaacagtccacttctcagacaaacaatggctttgtgactttggcttcttggtggacattatggaacaccttcgagaactcagtgaagaattacgagttagtaaagtctttgctgctgctgcctttgaccatatttgtactttcgaagttaagctgaatttatttcaaagacatattgaggaaaaaaa

SEQ ID NO: 13329 - DNA, 1185 bp, Homo sapiens
ccttgacgaaaagaagaaagaacctgcaattacatcgcagaacagccctgaggcaagagaagaaagtacttccagcggcaatgtaagcaacagaaaggatgagacaaatgctcgagatacttatgtttcatcctttcctcgggcaccaagcacttctgattctgtgcagttgaagtgtagggagatgcttgctgcagctcttcgaacaggggatgactacattgcaattggagctgatgaggaagaattaggatctcaaattgaagaagctatatatcaagaaataaggaatacagacatgaaatacaaaaatagagtacgaagtaggatatcaaatcttaaagatgcaaaaaatccaaatttaaggaaaaatgtcctctgtgggaatattcctcctgacttatttgctagaatgacagcagaggaaatggctagtgatgagctgaaagagatgtggaaaaacttgaccaaagaagccatcagagagcatcagatggccaagactggtgggacccagactgacttgttcacatgtggcaaatgtaaaaagaagaattgcacttacacacaggtacaaacccgtagtgctgatgaaccagtgacaacatttgttgtctgtaatgaatgtggaaatcgatggaagttctgttgagttggaagaattggcaaaatatctggaccattaagaaaacggattttgtaactagctttaaactaggccaagcaactagttttcctgcaaatcaaatttttaaagcaacttgagttagactttgtttttgacctaacatcccttccttaaatgccttctgtagtttcagatcagtagggagaccatataataattgtatggtacctgtttcaaaacatattttttctgtttttataagtaagttgatattaattaaactcttggcaatatttcttctttcttaaaggaaaatacaccttaactttttttcttttacactgtgaaacatacacagtagaaattctgttactctctgttattaatacataaatgaaaatacttttttttccatattggcatgtagctacaaatattaaaggaggagaaaaggtaatataattttaggtttaccaaatatggtgtgtattcaaataatacttgaccagcttatctaaaatgtacataattttgaggtagcttatgaatttgatttt

SEQ ID NO: 13330 - DNA, 1185 bp, Homo sapiens
ctgttacagatggtgtatggagatggtcactaccttcaaggatctcacagtttagtggatgaatcctcacaatacacctgtgaggtcggctgggaaagtactgtgtttttctttcttccagatgtgcaaactgaaggaaagtgacttactgaagggcattctacctctaggtgacagacctgggacctgcaccccagtcctctgactccaggtccaacactgtttcagcaataaccaagtgttttgtttttcagaaaacaatgtattatgtaaaatgtcaggaatataaattcaacttgttagaacttttattagattattgctggtgatggggtaatggaagtctaaatgtatgtattttaatccacacattctgttgggttttggttgcagtcaggtgacacacagtcttttgcacagaagctccagctccgggtgccctccgtggagtctttgtttcgaagtccgataaaggaatctctattccggtcttcttctaaagagtctttggtacgaacatcttccagagaatccctgaatcgacttgacctggacagttctactgccagttttgatccaccctctgatatggatagcgaggctgaagacttggtagggaattcagacagtctcaacaaagaacagttgattcagcggttgcgaagaatggaacgaagcttaagtagctacaggggaaaatattctgaggtaggagcatgacctttttgcctgtacaaaaatttcttccccttgttctctcattcatattactgtattgctttactcctgtgattggctaaactgttaattctctggatatatcctggttactaatggtatgtagtctgtggcattatctagttaaagactctcaatatctagttaagtaaagacagaggccctttggcaagactcagtaaaattttggagaagattgttgtctgtagccttctggttcttatattctgttcccctctcctttcgtagtccctctgttcaaggtcacttggacacccagtgtggagttcatcttctggctcatatcctctcctttattcctctctaactgatgcggctccaaaatgacctcatctgccagtgagagtcccattattactgattctaaaattgttttaggtagcctgattatttgacagatttggttcattctcattgtacctacat

SEQ ID NO: 13331 - DNA, 1195 bp, Homo sapiens
ttgtctttttttttttttttttttttttccaagacagaggagtctcgctttgttgcccaggctggagtgtagtggcatgatctcggctcactgcagcctctgcctcctgggttcaagggattccccaacctcagcctcccgagtagctgggactacagccgcatgctaccatgcccggctaatttttgtatgttttggtagagacagggctttgccatgttggtcaggctgggtctcaaactcccggcttcaagtgatctgctcacctcggcctcccaaactgttggactgtgccttgccataatcttttctttgttatatgattcctttagtaattgagcatagattctttgtcttttctagtgtttggtatgataattttgatcttcaggtaggtggtagacatcatgtctgtgtatcattgttagtagacaagtacgtactttaataaaaatgcatctgtttttaattaacagagaattcttgaattggaaagttctttggaaaaaagcttacaagaaaacaaaaatcagtcaaaagatttggctgttcatctggaagctgaaaaaaataagcacaataaggagattacagtcatggttgaaaaacacaagacagaattggaaagccttaagcatcagcaggatgccctttggactgaaaaactccaagtcttaaagcaacaatatcagactgaaatggaaaaacttagggaaaagtgtgaacaagaaaaagaaacattgttgaaagacaaagagattatcttccaggcccacatagaagaaatgaatgaaaagactttagaaaagcttgatgtgaagcaaacagaactagaatcattatcttctgaactgtcagaagtattaaaagcccgtcacaaactagaagaggaactttctgttctgaaagatcaaacagataaaatgaagcaggaattagaggccaagatggatgaacagaaaaatcatcaccagcagcaagttgacagtatcattaaagaacacgaggtatctatccagaggactgagaaggcattaaaagatcaaattaatcaacttgagcttctcttgaaggaaagggacaagcatttgaaagagcatcaggctcatgtagaaaatttagaggcagatattaaaaggtctgaaggggaactccagcaggcatctgctaagctggacgtttttcagtcttacca

SEQ ID NO: 13332 - DNA, 1330 bp, Homo sapiens
aagcagaaagcaaaggagatgcaagaaacgttaaagaaaaaattactggatcaggaagccaaacttaagaaagagcttgaaaatactgctctagagcttagtcagaaagaaaaacagtttaatgccaaaatgctggaaatggcacaggctaactcagctggaatcagtgatgcagtgtcaagactggaaacaaaccaaaaagaacaaatagaaagtcttactgaggttcatcgacgagaactcaatgatgtcatatcaatctgggaaaagaaacttaatcagcaagctgaagaacttcaggaaatacatgaaatccaattacaggaaaaagaacaagaggtagcagaactgaaacaaaagatcctcctatttgggtgtgaaaaagaagagatgaacaaggaaataacatggctgaaggaagaaggtgttaagcaggatacaacattaaatgaattacaggaacagttaaagcagaagtctgcccatgtgaattctcttgcacaagatgaaactaaactgaaagctcatcttgaaaagctagaggttgacttgaataagtctctgaaggaaaatacttttcttcaagagcagctagttgaactgaagatgctggcagaagaagataagcggaaggtttctgagttgactagcaagttgaaaaccacagatgaagaattccagagtttgaaatcttcacatgaaaaaagtaacaaaagcctagaggacaagagcttggaatttaaaaaactgtctgaggaactagcgattcagctagatatttgctgtaagaaaaccgaagccttattagaagctaaaacaaatgagctaatcaacattagtagtagtaaaactaatgccattctttctaggatttctcattgtcagcaccgtacaactaaagttaaggaggcactgttaattaaaacttgcacagtttctgaattagaagcacaacttagacagttgacagaggagcaaaatacactaaatatttcttttcaacaggctactcatcagttagaagaaaaagaaaatcaaattaagagcatgaaggctgatattgaaagtcttgtaacagaaaaagaagccttacagaaggaaggaggcaatcagcaacaggctgcttctgaaaaggagtcttgtataacacagttgaagaaagagttatctgaaaacatcaatgctgtcacattgatgaaagaagagcttaaagaaaaaaaagttgagattagcagtcttagtaaacaactaactgatttgaatgttcagcttcaaaatagcatcagcctatccgaaaaagaagcagccatttcatcactaagaaagcagt

SEQ ID NO: 13333 - DNA, 1160 bp, Homo sapiens
aaggaggcaacacatggtaggcagggaagaattcatttgggagaagggcatggtgacttgcaagttggagactcacaagtaggggtgcttaccaaatagcctaatcccaatctcagagcagtctcacttgcagagtagctcgtaaggctatattagatacaaaattggtttctttttaacattgactgtattttagtgattttgttttggcataataactagtcttcaaaacataacctgttatgtatatacataaagattcaacttagtttttcttagtgtttttacttcaaagcaacaatatactttttttttaaatcttaaaataagactagaaggcttttataaaggaaattacataactgttccttaaattagaaatgacacatcaaagattcttttctaattattgggggggcttgctttagattagtatcccacagatgtcaaaggaaatgtcagacatagctaattgtcatattagaaactgagcctgactaaataagtagctatagaggttattctttcaaacaaggctaaaccacattgacacagccatacaagaaatgtcaacaaaccaagacagagaacagtgatgcatttacaacaattttcggttgatggtgttttagaggtggaggccaaattcacgtgtgcctcggtgggaagatatctaagatatctaaggatatctagtagagatctctgctgtacttatgttgagaaaagggatttgtttttgcaattaagtctaagaaaatttcatgacaagtggtatttaaaattagattttctaaatgtcgtatgattcattgccttattttgtgccatagggcctaactatgtttgcatttgtttttgagaatggtgtttctgtttttggtaagtcaatgtctattaaatcagatacctgtttgtggttatttttcctgttaagtctcttgctcagcaaacacttgccctcattactcaaatcagatcaatattccaattccaaatattattttagcacaaaggttattgcagggtttataagaataaagagaagtctgggttgccctgtacaataaatcatggcaatgaccaagacaaatgagggaatgtaaggatggaaaacagccttttaccagggcagtcaagacaagagaggacaatttgta

SEQ ID NO: 13334 - DNA, 1149 bp, Homo sapiens
tgctgcttggaaaactgtccacacttgctactctttgagaatgaagttgtcattcagggcccctcatgtagccaaaagaccaagaaaaatctggcccacagataagttgcagactgcctttaaaatagattttatcagtggagaaatggtgatagttttttcttcagttttctcttgggaagagttttatgttgtttaaaagatattttgataacttaacctgctttatgggcttacataatattcctttcatccattctttttaaagaacggcttacctttcctatttatttttagggtgattttttaaaaagacttgtgcaatacattttgaggtgaaacttagtggattttttctgataaattagagcatttaattgactattttattcaggttgatctgttgaatatttgctaaagaccagttctttaagctaagacatgtaaaaaatcccaaatggcagtacctcattgtttacttagcttttgtacttatatttttcagaggaaaaaacactactgtaaattgtgaatagccaatacataactgtattgtatgcaaatctgtgattgttggcagtgtcatctctgagaaacagataaataaagtttatttactatataacatttgtttattgtacttgttcctcagttgaaatctattttaaaatgtttaagaatgcatattctatttggatgaatttagtgaggaattatttgtcaatataactaaatgctgagcatttgaaaagaattttcacgttcaaatttggtatgaccaagttagaaggagcatggaaataaatactccatgatgtctgctttaggattctgacaacttgggaatgcctcctctctctggaatagaccatacttgaattattttttaacttggtgaaagagaaatttctgcacactgagagatgggtactgttcagagggcttcacacacccttcatattctaggaaatacaatactcaatatctaggtattatctaatctctgcctcaaggtagaatctcagttttccagccagtctggaccttagctcctgatgtatcttacattgtgatagagtggggagttctgggggatagataaacaaggggtctgcccataacccacagctgactcatttactgttccag

SEQ ID NO: 13335 - DNA, 1027 bp, Homo sapiens
gcctctgcctgcctcccgcctgtgcactctggaacctctggcctcaggggacctgcctgtcctcagctccctgggagctgaaagtgaggatactccgtgctccaggccacagggtgaatgtggccatgcctacctgttttgtttttttaagaacagaaacaactattttaaaagaactcttttaagaaatttcataaagggacatgcattttactgggtttgcttttcttaaaacataccaaaaaagaaaaaaatagaaaaaaaaaaaaaaaaagcttgatctctatcagacttcctttcaactgtcctcccctccaagcagaccacctgtccccttctatcccagctcagagcagctgacccaactcagaatctctttcctacaggatgaagtgccttttgaatgttattttaagccgagagttaatttttctacacaacatatttccagacatcttttagtcttttattgtcttagatactataagaagatgaacatgacaattttctagaacctggtagcgtgtgtgtgtgtggcggggggtgctgagggaggggagtgagtcacaggagcctgtcccccaacaggtgtgactgctctgacaacctgtggcatgctgcagggtcaggctcctgataggaggatttcatgactatgtcattgtctccactcatttttgacccagtttggaatgtatctgcaattgtgtggctcaacactttaggaaacaatagattattttatattattatttctgatggtgacaagtttgtcttgaggtcacattttctccttgaaaagtgacatcctgtcacttctgctctcacactactgccatacatttgtgttttttgttgttattgtttgggtagagcagttacaagaaaccctaaaacccttggatataaaagaaatctgtttattgatttttaaatctttcctttccaaaagctggatacacatggagctgtttgggaattttccttgctgctaccgcgctgccaccaaatggaattgaccagcggc

SEQ ID NO: 13336 - DNA, 1178 bp, Homo sapiens
tgaccacactccaaaattctgtttttattttaacccttgaatctgctttatgtacataatcaaaatatctatatctatatctatatctatatctatatatttttaatcatctacatgtaaatgaagcaatagaattctaacataaggccaagaaatgagacgaatgtttggggtttatgttttttaaggtaaatacgggtattgtttttaattattaccatgtattaaattgtgggctttgaaacctaatgaaacctgttagccacttctctgtgccatatacttcccatgttaccaaaatacccccaactctttagccaaaagagaaccctgacctcctgagtttccatgctcctttctgtaccaggtttaaatgtagtcttctggagaagtatttttgacattgagctctgggacaggacaccttgggtttgtggactgcagcccactatgatgttattacttctctggccaggcctccagtggaagtgcacaggcactcccaatgttgttaatgctctgtcttccatttgttctggaatcctacgtgttggtctgtggttccatgcattagctgtttgtaaataatgcatttgcatactgaaaaaggaatgccacctgccacagttgatggtgaggaagctcctttgacgtggtgcaattttgatgagatgtctctggggacacgaggatgccctaatgatgctgacttgtcatggttgcagcatttgaacttttggtgttaaaaaaaaaaacctgtaagtctgtaacctggcaacattttacaaccctgtatttttaaagatggctttctaataaaaaatccagaaccacacagccctatggtcaaacaatcctacgtttgtgcctctgcttttaaaggtgctgtgctggacagttggcatgccagggttcgagaagagtgaatggcttgacgtacttgcagttaactgtgcaaaattggctggctgcctctgttcctactgtactgtaactttgatcatgtctgttcctgttccattctcccaggagcttctctgcagactgacacaccctcccccaccccgggtagtggagatgctggtgtctgggtagtcatggatttctgctggacatttgaatgtgataaacaatccagcattacttaggaaatgctacatgcggaatgtgcacgtttc

SEQ ID NO: 13337 - DNA, 1172 bp, Homo sapiens
agatattttttttgcactggtatttattggcagtacatatgaaatggttgaggcttttgttttaactgacactctttagagcatttttctctatctgttatgcgctgtaggaacaagataaggattactcttgtttaaattgtatgggaattagaaatgtcatgtttttatatatccatctacttatttactcttttatgtatttgtttttagggagtggagcaactgctgtagtccaagcagcttattgtgcccctaaaaaggagaaagtggcaatcaaacggataaaccttgagaaatgtcaaactagcatggatgaactcctggtatgcacatcttatacttctgaaatggagagatatactcatatattcacattacaatgggaaataacttgaagtttttgatttgtttctttttaaaaaagtttatgatttcttcattaataaataatattcattgtaaaatttataaagtctggataagtagaaaaaaattagttataatattcttactctgagactaacatttaatatgtaacctttcagagtgaacatttgaatatatttgtatttttatgataatgtagtcagattcttgctcttttcatttaataatttatcatagaactttttctgtgtctgtaaatatggatcagtatcatttacagtgtgtttatagtattctgttgaatagaccacactttattaactatgatatttgctaattactttgtttcctcttttttattgttataaacaatgcttgcttttctattcccttaaaataataccatggaattgtgattcctgggtcaagtggaatatcctttgaaaggctctggccttttaaactttcattctaatgctggatataagacaagagatagaatgacccccaggcagcattagcttcttcaaaggctagggaaaggaagaagaaagggaagtcccaagcaatagctgtaagaatgttctgtgacattaaaatgtaaccatacagggattgtattgtattttttttaggcattgtgctacccagaatagttttaagtatatagtaagtgctcagcaagggaaattagtttttaaaattacttattattgtttcaaaattttcagtttctttggcttaatgaaaataataatacttgctttggataccttttgagg

SEQ ID NO: 13338 - DNA, 2064 bp, Homo sapiens
agctaaaccacaaccctggaagaggcggcctaaggagattccacacatgcgtatctctgttgcttctattggcctaaacccactactgccaaagaacccagcaacaaacctcccggctaggagctttagaagtctttatgttcttcctgccatcattcctccttttcccacagggaaagaaaagttggatcactagtggccagcatccccagagttccgttagtaaacttacttcatatgtcccctgtcttcctccatctgagaagtggcccatgtgcttcaaggcccaggagggagatctgtcagctcattcttgccttactccaatgatggcccaggtggaaaagtagcagctgtatcgggcttcctcatcctgcctgttcccccacacctgccaggatatggacatcttgggatatctctttaccactgaagtagaattgattgttcagctggagcccagagaatttaatttaatgttttttctttgtacctgatgtgaattctagcaacctttgttaggaaaaagcacagcctcagatggaggcagcctaaactgtgttcttgttttgttcatggtgtttctaagcgttttgctgaagctgctctcaggcacccccttcttcattgctctctccagaaagggttgctagccttaacttcagctggtgcaaaacatctgactgtagccgaacttcagccatcagatccttcaaagtggaactttggattgtttttacagacaacatcgagtaatggcttgtaaatgtgaattttgccagaggtggtttttgaacaggaaaatcataattcatatcattggagaagtatttattttcaaatatcaaattgaagaaaaactcaatcctcccatgaaaatcagttcgcctggcctccaagtcgtgaggaaatgggtatgcaaggctgagatttctacagcaataaaggagacacacactgggccagagaggcctgccttctgcctgctctcctgcactgaccctttggagggggtctctgtgtgctgaagctaactcaagatggaaagtgaaaccacatgtgccgtgacctttaggttttatgagtagacagtgttcatttgattttctacagaaataatataaattattctttaggtttaaaaaagagcactcataatgcaatatgtgaataatcagtgaggttgatttttcttttttcctaccgtttcatagtctttgtctaactgctagtaaccctaccgagttttatatatgagtgggatactcaatctggccttaaaaagatacacaaagatgggctgtgggtccctggaaagggggagagttgccctttacagaatcactcgagccctttccagcactgttggtctgatgaacaaggttgttttaccttattttctcttggaacatatctgaaaaccttccccacaaataacttgtcacaccttttgtttcattctgagtctttagttttagtcatgggctttcttcacctgctctaggtgcaaaggcatgttgggaaagagatggatgttggggaggaagagaggagatggatttcagttgggagttaggaggagagtaggtgagatgatcagacaccggagttcaacgtcccagcagtcttggtaaaaggagggagcctgctgagccaggagggagaaaagaagattgaccagcttgctagaaaaatacttagcttttctttttctttttttgtggaggggggacggagaggaacaaggatggggaggtaggaatgaggtatagaaaagagatagcatcttctttggcacaagactagtggcttaccgcttaccttagagttttgttttttttttttcaaacccatcaaaatctacttatttatgaatccaaggggtggcagcatcactctgttctagcattctttgtggagatggtctggtgcctagctgggagtgagcagcagcccatcccctgttcactttctctagcccatcattacctgtgaactgcagtggggcagtcatggcaaatagaattgggctggggtttctccttcttttcagttcattgtttg

SEQ ID NO: 13339 - DNA, 2191 bp, Homo sapiens
gaatgaacactgctcccctttcccacacctgcaacatacagtgattccgatgtgcactggggttttaagggggcctcttcatcggtttctgctgcagcagggaagtagcccccacccccacgcaggagcctcaggtgttggtgccctttctgtgcatctggactctgtctgtctggctgtttatccatccttctgtggcattaggtttcctgcctcctcccttttgcttaggcctaggggcagctgtgatgggctgcagaatgaggtgggggctggtgccagctggcacacgtaaattaagaggtgtgggacggatgggtggcctacgtccaggggtgagtgcaggaggttggtgaccccaacccaccacccggcctccctccctcagggtggcctggcacccaggactgggagtaggggtttgggtggtggtcccaggggcatgctcagtggttctcttttctctggggcacaggctctgggcgtggggaggctgagacacgggagtgcatctactacaacgccaactgggagctggagcgcaccaaccagagcggcctggagcgctgcgaaggcgagcaggacaagcggctgcactgctacgcctcctggcgcaacagctctggcaccatcgagctcgtgaagaagggctgctggctagatgacttcaactgctacgataggtaccccaagacttgccctcctttcctcttggacccacctgcgcttatactgcccactgggccatttgggtctcaggatgtctgagtgggagataaaggaccaagaaggggctcttgagatggtagccatggccccacgcccttccacaccctatttgtcctaccttagccctgaggaggggtctcagtgtcaacccctggctgttcttccttggctttgggtctcctgtaggggaggtgagttcacaccgtccccctggtgttgcccatgaggtgctctgtctgtgaggaggggttggcagggcaggcctgggggagtcttgcatcccccaggtgaggggtatatggaaaattctgtgcctccaggcaggagtgtgtggccactgaggagaacccccaggtgtacttctgctgctgtgaaggcaacttctgcaacgaacgcttcactcatttgccagaggctgggggcccggaaggtaagggggcagtgtggaagtggggccttgagtcagccgacctgggcttctttggcttggagcgcttggctcctcagttgggtggggtgtggctacagggccctgtagtctggctctggaagtgtgagggtgggcagactgtttgacacagggctctgtgtgtcccccagtcacgtacgagccacccccgacagcccccaccctgctcacggtgctggcctactcactgctgcccatcgggggcctttccctcatcgtcctgctggccttttggatgtaccggcatcgcaagcccccctacggtcatgtggacatccatgaggtgagacagtgctggcttggggcagggcaggatagaggtggggaggacaggccagacctttttaagccttgctctcccccaggaccctgggcctccaccaccatcccctctggtgggcctgaagccactgcagctgctggagatcaaggctcgggggcgctttggctgtgtctggaaggcccagctcatgaatgactttgtagctgtcaagatcttcccactccaggtgagtgtttgaggggctccatccaggtcctctgcctccactgtagcttgaactggaggctctcctgacctggggcaatccaaaccccaaataatattgtggtatgagagaaaagtgagccttactgggcctagttactcatgttacacttggctggtctgtagatttcatgcaactatggaattttatcataggactagggtagggctttgcaaaaccttgatttgccccggttaccagggttttgtttttgacattgggttctttccagcggccctggacaccaggtctggctctgcctcatttgttgggtgatacggggtcactcacaccccatgcatggaccttagtggccccatttgtaaatcgaagtgctagccttaagtgatctcagggatcactgttggcctcatgctctggggcctagcttaatacaggtcttctcctggtccccttacaaatgctgaagctgggaggctggggg

SEQ ID NO: 13340 - DNA, 2669 bp, Homo sapiens
ttcttagcaaagggaagggtctctcatctccaggccacagagatagttcttccattgccctaagaggctaggctaaccctcttgacataacttagacagcaaagcacttcatcctgtagttgggctctgtcacctttctcttcagttggccacattctcgtttcctccatcctgctatgctttgtgtgctcgggctgtgtgtggggtttttccctggtggaaggaagcccagctgtgtattgaatgtccttcatgtgttgtgtgtggctcagaaagcctgtcacttggcccctgtgctctgagccgtgagggtggggaggtggctgttccattaaagtgggagtattggatggccctcttgaaactagaattttgccttttttagtatgcagtataaagtttccagcatctattggtaacacaaagatttgctggtttttaaaataatacagtaagcataagtatgtaagtttttagaattggtactagaagttggacagctagttattctcgagaactttatttcactagaaaaatatactaattggaaagcagtttccaggagttaactcagtttaattttcagtctcagttattttagcctgttgagtttttgatggcacacctttggagagatggccacgcctgattcccatttcaggggcatcagaccatacctttttaagaagctccgtgaatctagtcatctacccttcatcctgggcgaacagccaaaaagagaaggggacaaggtgtctttttctccttctcactggggtgacatgaattcttttagttaatggctgtttgcaaattctaaactaatgaaatacttagcagctaacatgttcaatctagtaatgatgagtttaaatctcaattgacagtaatgttttagataaacaggcccagtaattcagttgatgaactgtatatcttctcagtctagatttgtaaatgtttaatgaattcagggttataagcatagttctttaagtaagattccagatagttgatttgcaaccagcagtctacctatgaatgtatcccaaacctttagaagattggaaaagatttttgaaataatgatttagttttgtaggaaaaacacccccttgaaaattaattcggttgacccagtaacattttttaaaacaattggtggctccaaaaggcctgccaacaaagaaaagtccaaattatctagtgggacattttgaatgttttatgtttattttgggtccactgtaaactttggttcaaaaaagaatttgaatttaaagaatttaccattatttaaattattaccaagtttttacattttcatgatggtattttccaggtatgaatgaaacatgactttttgattgtggtacttcctgtatcccctgtagtgccaaaaccagtgatactttatttgctcctatggcagctcatagaggtaaccgaagtgatttttcctcagtaattgaaacacatattctctaaatgccaatgtgtggtgatgggccctgcactgccttcatttctctagggcagtgtctttggattgtctagggcctaggtaattctgagaactactgtaaaccaaccacagggcactaaagcaatgtacacaccactctttgtgtgtatggaaggggttatataaacctgggctatgctggacatctacagaagagtattacattcacttgcaaagtttacatttttgagctcacagttatgaaaaatatgacccacaagtttttcaggcaggtgaggatgggtcttcttgcaaatgcatgagttctgtcttgagtcctgggaacttctctgttggttgagtgtgggctcattccctgactctcctaatcatgtttgcgtcagaatgttagcattgtaaataaaagaataggttgtataatagatacacaacacttgaaactttactttaaaaaaatcgatagttctacatatatatttagttatatcacttgacagatttcttctacacagtgtggagattgttttataccacagattatttttataaagttagtgaatttgaatgattttgtaatcagagctaatgagctttacctttcaagagaaacgtacactggagcatgagtggtgtggaacttttacttagtgtttatatggattcttgtgatacactggcagactggagtcaatttgcgggtcttttttggccaaaactccacttgtggttgtgtaggacagtgatattcagctcagcttcttgtggattgggaggagagagggcctgcaatgtgttttacattggtgcttcctcctgagatttctgttgaacaaagggttctgaggtcaaaaattagtttgtaagcctttgccataggacatagtcatgtgagagtgtttgggggaacagaaattgtataggggtgcctattggggtgggatgggactcgaataagattcaggtacaaaaactttgaaatgagaatctggtggtttgagtaatccaccagactgaattatctaagatcacattatccaggttggggggcagaattacccagttaagtaattgttcagaaaagtggggagggtggcatgtggatgcagtgatccaattaaatggagagctgccaggcacattttgtcctctctggtcagtgagaatggttgggttggctcgctgc

SEQ ID NO: 13341 - DNA, 2112 bp, Homo sapiens
tcttaagtgtttgttctctgccccattcagtggactgttgacttcagtccctgcaagtgctttagcccgagtggggttttctcagagcactgccacgagttaagtgtgtgtttagccaaataatttctccgtaagggaaaaatgcagtcacccaaattttaccaacaatgacagagatgagagtagaaaagattaggcaacatctgagttttaacttgaaaagtgtccaagtcatcatgaaaggccgactgggagcaagtgattattagagattcttcaggagacctcatctgaaaatgttaagactgccagtgagggaaggaattgttaaaatgccagcggcttttttttcctctttttttctgtaattctgtaaaaatgcagagaaagttgagtggtacttcagaattgagggagagggttaccgcagagtagaaatatatttctagatttcagttccacaccacaaatccacaacaatgccatttttcaactgtacaaaaatctgcttatgaactggacatgatcttaatggtagtgtcaaaggccaagtttttcacctgttaatatttttccacatttgtccttgaatctgaataactttatacagtactgtaaatttaacttacatcgagtttgttgtcaattcttatgaaaagagctttctgcatgtaacacatacggttaaagaacacagcaaaggacaaaatttgcaggaacagttttggaaccaacagaaaatgtcaccttttatttgccatcttatatatatctatcagttttaccagctacttctaaatttgtacattatttgtaagggaaagaaggaaaaccctaagacttgtctaacttagtggagaatgtgtgtgttgggcttaggatggatagctaagtcttattgagctgtgttacctaacttgtatataaaaattgtaattaaaagtttgggttcacctgtttctcacagtttaaaatgatgagtaattgcaaactctggaaatgtgactagtatatgatttaaggctgtagaagcaaggaagctctttcaagtgctaaaactaaagacttctagtttttggctcaaataagtactgtttgtataccaggatatgtgagatgtaaatgtagtaggtcacttttcacccttgtagctataaaataaaaattttgtagaacagaaatagcttgtactactgaattaacaaaagttatactaaagtatcatgtttaaaaaaaatatatatatatatacagagttaagcttgttgctgttaccctgtctggatttgaaaagtgtgctgatttatatatatatattacacacacacacacacacacacacacacacacacacacacacacacacacacacacacacacacacacacacatacacctaaaatggcctaaagcagacatccatgtaattacagttgcaaaatgaaaacattttggaaagaacattgtatcatagttcattcatttgcagtggatctttgttcctttttactgtggtaattttagaaatgagtgtcaagtttgaaattagatctgctaagttggggttttgctgcttgaactctgcactgggtcctcaaataaaccgatgtgaatgtagttttttccccctgtgtgaagaagcagttacaccccaacaataggaggaaaaatctagaactatttcaagttttatctttttgtatatgaaaataaaataataataaaacaatcttgtctttcttaattacgtggcaggggattggagtttcctttcatgaggattagacatgaaatgaaatggcgttcggctgcttagagggctgactcaagtcagttcctgtttggtatgtgtaacattaacagatgttaatggctgaatgcctagtctgccatggtcctgtggggctggagctaagcacaggtctccatttctgccattcagaagtccagggtctagttggggacattatgaatggggaccattctcctgaacgaactgttctgggattttgagtaagtttctgcaggttagcatattttccaaatgtccaagacactccccattccctcatcctctgccaccagtcctgtactttgcagacaaccctgagc

SEQ ID NO: 13342 - DNA, 1166 bp, Homo sapiens
cattttgcttggcaagtcagggaaggccttctaaaggaagtattgtttaaatggaaacctgaaggctgcaacaagagttagccagacaggtcggaggaagagcttccaaacagagaggaccagcatgtgtgatggtctggaggcacaatgcaccagaacctggagcagagatgagtggccagaaagacaaacagggtacttgagaccatgttaaggaatttacatccaatcatgagtctagtagtcagcaactggaggtttttgagcagagctgagatagatttttaaataattactctagctgctttgtgaaaaatggactaaagactgggaaaggagtccagtcaggaagcagttatagtagtttagcaacttactcatgttggactaggctatcattgataccatccttctcttcagccctttagtctttaaggagtaaaatttaaatttgtattgggttgaaaaagtacatattggaaaacatgggattttctgtttcagattggccactagtagactatattttattactgcatggcttgtactttataaaaagcatatgttgacacatttgtcaggtttcctatgttattcgagatgaagtggagaagtacaaccgaaatggagtcaatgctctgcagctggatccagcactaaatagacttttcacagccggtcgagactctatcataagaatatggagtgtcaatcagcacaaggtaatgcagggattaaaatctgtacccagcaaattctggacaaatggcttttactgtctaatatgacacttttcacagtttcagatttaatctctctgaatgctgagttatttggtacactctataaagacatcgcaaccagaattctgtaagcctctgagaaaaaccatccctaggaaagtttcagaagtgtttcagctaagacaaggactccctaaactaggtttgccttacagagttctttgccacaaaggaacaaagtgatttggctagtagggggattactttcaacaattaatttttttgctttaaatatgttccccaacaacctcttggtaaccttactaaaaaaagattgaatattcttttacatttctaattaatcttgaaaaaatattttattttcctcacttaaaagtaattaggatcctcacaaaccccaca

SEQ ID NO: 13343 - DNA, 1159 bp, Homo sapiens
aattgtgctttcaaattagttttctttttcctcatagcatgaagaacagggatagagatagaggataaacagaagtcatccaaagtgcaccgttaattcttaaatcttaatttaaaaagacttaagttttcttgcttaccagactatctgtaggtaacaaaagagaaggtgtttgcatttattcctgttgacatgcaggtcaagtgttctttctgtatacttattttttaaatgttgtatatcttgtgttaatttcatcatgccaacttatgaccaatacaattttacctggaagagcactcctgctttcatgcatagttttctctcccaaagacaatattcccttcttaaaatttgtttctttctaaacgatgatagataattgtactgtgaccaaatatttttcggttgatgtagtggttgttgaggttttcttgtttgttttttgactttatttttcttgccactttaaacaggctggcaaagcttgtagagcataacatgatcaaataacaaattttgtaattttagactttgaaaggaattcataattttagagcctctggagattatgacaatgactgtacaaatcctataacacctctttgtacacaacctgaccaggttattaaaggtaagaaaatggaaggtactgtaccccttattgaagttagcgatagttacttagagattgacaaaaatcaagacaatgacctttctttaaatataatcctgatgtaaacaaaagataatacattggtttatttttaatataaggaaaaggtttttttttgtttgtttgttttgctttttgttttgttttgtttttttgagatggagtgttgctctgtcacccaggctggactgcagtgacgggatcttggctcactgcaacccctgcctcccgggttcaagccattatcttgcctcatcctcctgagcagctggaattacaggtgtgagctaccatgcccagctactttttatatttttagtagagatggggtttcatcttgttggccaggctggtctcaaactcctgacctcaaatgatctgcccgcctcagcctcccaaagtactgggattacgggcgtgagccaccacgcccagccagaaaaagttattttaaaaaatgctgttaatgggccgggcgcggtg

SEQ ID NO: 13344 - DNA, 1195 bp, Homo sapiens
gcttgctgtgcctgtgagttgtggcaaaactggacaaagggctaggccttcagagccacagttgggatggttgtctagccaagtctgcagggaagtgctggccctgccttcacagctgatgagtgggtcctctgagagcacctttgggcactgggctggtgccttgggtctaggccagggagtattcaaggatgttctccaggtatgcctgaattcaaggaagcccctctcttctaatgagtcattgatggggcaaagggaatgtgttggggccaggtgggcacctgggattccttgtctgagtgcaaagagtgctccctctcagtgccaacactgcagggaggccaggccaggcccctcaggcctgacttcctatcaccaatagaagaaggggtggtttattaaggccatttccttcctttaggcagagcagtgttcctgggacaagtggggactggtggttaggttggactgcaaaattcttcaccttgaggcactgtcctgattgtcccctacccatttcttcttctttcctaggccctgctgcaggcacctggctcctccatggaggatccccttcctgggcctgggagtcccagccacagtgctccagaccctgatggacttccccatttcatggagactcctcttcagcccccacctccagtgcagcgagttatggacccaggtactgggcaggccctggagaggagtgggccccaggcttggggctggactttggcagctatgtcaaaactttccccaggccttgctgacccctcatatctcatgtataccaagatatttaatagttgcatatcatccaatctagtatacagatggggagtctgtagtccagagaagagaggtagcctccttcaggtcacacagcaaattggacacagagcagagtctatgcctactgccactgtgctattcacatgatgaccaactccaggcccctttctttcctcagaaacaggcagtgtgggaacctctttgaggttgggtgaggggtatcaccaggggctgaggagattacagtctcacaggctgggccagatgccctaggcaaggtgagcccagggtgctgctttccagcagtcagggtttcttgctggcaaagaactgcaccaccctcccctaggcttcctggacgtgtcgggaatttctctcttggacaacagcaatgcca

SEQ ID NO: 13345 - DNA, 1237 bp, Homo sapiens
tagttctacccctggggtctgcttctctgccagtggctttcattacctgctggactgagcctgggtctcccaccccagaggctggggtgcaagctgggacctggctgcaagctgcttttcccactccctctttctgggtacagccctgggtgtatccctcccgaggcctgcccacttccactgcacgtcagggccctcccttctggtccagtctaaacctttctggtaaacccttttggctttccggccaaccctagcctagccctctagagcagcattcccacaggcctgggccagcctgtctccatattgcctcctgggagcccctaaggatgtcctgggctgtgagccatttctgaaagcatctgtggatcataatcaggaaggagccattttcctaagaggaaaatttgtgcccaggaaggtagcaagaggccatggagtgaaccctgagaatgtccggaacagttcatgccagacatgtgttctggctggcacactgggagtgctgatggttcctgaaatgggggagagggctacttggagagtcccagggttggcgcagtgactgtggtctttgctgtgggataggtgcaggagaactccccagcccagcaggcgggcctggagccctactttgacttcatcatcaccattgggcactcgaggctggtgagttccccaacctgcctctgctttgcttgcttatgtgtgtttgtgtgtcttcatctgtcccacagggggccccagtctacccttccctccctttttttctaaagggagtcccagccctgtctccccttcttccagggctgtactcagagcctgactggggccctgcccagtgctcagcttctgagctctgtggggtggacagaggacatatggcctcttggaggtggcaacaaggcccaaggggcctgcctcctggggcatgagggatatgagggccctggccaaggggcagctcagagtggggcagcactggaatgctgtggatctgggaggctttttgcttgctttgttttttctggcaggctgaggaaggtttggcagtgcttggggaaggtgggggtcccagtggctgcaggctcaaccctggtctgtgaacctggcccatccactaccttggcccatccccacagtgaccctgctgagggctgctgcccactaaggcccttgccccatctcaggcccagacttgtctgagggtcctagcctgggcatgaggtggcct

SEQ ID NO: 13346 - DNA, 1222 bp, Homo sapiens
tagtctggggcctcactacacatcacagaaggtgtctgacagcctggacaacatcgaggcacctcacttccccctgcctggcctgtctccacctggggatgccagcagttgcttcctggagtccctcatgggcttctccgagccagccgccgaagccctagatccctttattgacagccagtttgaggacactgtcccagcatctctaatggagcctgtgccggtgtgaggaccaggatgtcttttcccagccccaagagacctgttgctgctttcttgtaattatggggctccccagagtctgcgtaacagtctcccactggctggctcacccacaggtgccatgtgcacactcctggttttcaaacaattctctggatttatttatttgttttaacttttctgtgctgaagagaggactggggggagggggcttcccctttcagctgcccggccccccacacccacagcttgctcttctatctccacaacgtgagcctggaagaggagaaaatgtggctcctctggagcttggcagaccacttttcggtctttgcgtgatgttccttagcccaaagacggtgagacagggctgaaatcaggtggcttctgccaccctgagccctagacccatgggtggctaaatccactggactgtgaagactataatttatttccataatttatttggagattgaggaggctttggttgcacttctttggctggtgggtaatgccaggggtggggtgggcacaggccctcaagagccccttttgccttgtagtcctacaccttgccctgcctgggctttggtgcagactaggtgtggatttgagctctgtgatctatgtctgctgcctggctcctagatggctctgtgggcaggtgctggccaaggacatcatctaggcagggggagagcctgggctgaacagctgtgaccaaaactcccttctgccccaccctgccccctccacttcctgccctctgttccatcttcccccttcccaaaggccacagcctttattccaggcccagggatgtaggagggggaaggaggaaacaggaagcccagagagggcaaagggcctacctcggggcgcgaaccatgccccagactattatctcagggctttctgggcactgcacttcagcgtggcccacctgcccatgccctgaggccagttggcgaggggtggctcctgagggtttttataccct

SEQ ID NO: 13347 - DNA, 1128 bp, Homo sapiens
cgattatttcagctttgtaggccccaaggagttgagacttcatcaggagggtactgggaagccactggaagcttggctccagctgcccagacacctccgcctgcaggctcccaggtacacactcaatgcatgcggaaggacagggcctttatcttcccccaacctgctttcctcctgttgttcttgcaggaaaggtaaagtggagcagacccctgccattctacatgcacatctgtggctgaagaggggctctcaccatcaactccaccgcagatgccatccaagaaggccaggaggtcacccccacccccaacctggaggaaggtagaatggaatcctgagggctgggctagtggctgacagcattcatctaggacagtcagaagaacccagaatgcagcgggagcaggactgggagggggagggtcaggctcccacgaaggctccctggaggaggcagtgcaagctgagcccttaaaggcattgggattctggtaagcagagagagggcaggagagcattccagtcgagaagaccggctgcagtaaaagcgtgagggtggaaacgctcgaggtgatgagtagactcgtacctgcggttgggaagtggggctgagggtgggctcccaggccaggacttggttgccggggcatgtcgtaccgggagggttggccccgagtcaggaaaggccttggcgggagcagagaaggcagtggaccattttaagtggccaagatctggcccggaagaaaccagcctttttatttttttaagggaaggttgaggtgggagtggggaagctagttctaagaacccctagtttggaacttctgcagggaagggtctcttggcccgtgggcaggaatgaagttcaggcccactgattacatccatccttcccgctccctgcctccccgctccccacacaccccagattcctctccagccacagtttacttttccggcggatctgggggtgggtggtaggttgggggcggaggggggaacttttagattggaataaaataaactccctctagaggggtgggggtggagagcgtacaggagacgtcggctctgccactgtctagcccgtggccttgcggagttacgaggtgctcccggcct

SEQ ID NO: 13348 - DNA, 1549 bp, Homo sapiens
ctatgattccagtgtgcagacaaggttgaaaatccctatttataatgctccctgttacaattgcttttcaactaagagatgtctgtacttttggtacctagatgatgtaagagccaggaaggtgcttgctgtttgggtttgaccaagtgtcactttttaataatctgccactcttggcagggagctcactcagtgggtttgatgtggtggatgctggctcgggaagttctgcgcatgcgtggcaccatttcccgtgaacacccatgggaggtcatgcctgatctgtacttctacagagatcctgaagaggtaagcttctccaaaggcttgtggttacataagcaaattggacgacttggactgtgcttctaggaagcaaaacttgtcagtccctgtaagtctttcctcttttttttttgtaacccagattgaaaaagaagagcaggctgctgctgagaaggcagtgaccaaggaggaatttcagggtgaatggactgctcccgctcctgagttcactgctactcagcctgaggttgcagactggtctgaaggtgtacaggtgccctctgtgcctattcagcaattccctactggtatgtatcaggatagaggtgaatcaagctgatattttgcaacttctcagttttattctaactttaatgatctctgtgacttttatactagctttaagaggttttcattccagtgtgctacagcatctgatagactgctgttgggagtggggtaaggaaaaatactacattgaggacagagctgatggctttttttggtattctcttaacagaagactggagcgctcagcctgccacggaagactggtctgcagctcccactgctcaggccactgaatgggtaggagcaaccactgactggtcttaagctgttcttgcataggctcttaagcagcatggaaaaatggttgatggaaaataaacatcagtttctaaaagttgtcttcatttagtttgctttttactccagatcagaatacctgggattgcatatcaaagcataataataaatacatgtctcgacatgagttgtacttctaaagcccactgtagatagtgtatattgcttttcacttcagaatttccctgagcttccttcctgtgtggagaacatgtgtgctgtgaaaatagatgtaagtggttacacatacttagttggtaacctcaggaatacttttccgaggccctgatgatcttgcttttattaccatttgcgtaggtaagttctatagagcttaggtttttatttttgagagtcttcctgtcacttaggttaactattcctggaagccctggagaggcgatggtccttccccacattgagagacattaattgcccctcttgtcagcttgcctacaggttctgggagaggagaggtatgtatgtatttaaaaatgtgatgttctccatatttgtctttgccggggagggggttggggagacagtctttccctgttgcccaggctggagtacagtggcgtgatctcagttcactgcaacctctgcctcctgggtt

SEQ ID NO: 13349 - DNA, 1227 bp, Homo sapiens
catttgttgaagaatcaatctatacaccattaagaaacagcctctgggccgggcatggtggctcacgcctgtaatcccagcactttgggaggccgaggtgggtggatcacgaggtcaggagttcaagaccagcttggccaagatggtgaaaccccatctctactaaaaatacgaaaattagccaggcgtggtggcagttgcctgtaatccccgctactcgggaggctgaggcagagaattgcttgaacccgggaggcagaggttgcagtgagccgagatcgtgccactgcactccagcctaggcaacagagtgagactctgtctcaaaaaaaagagaaacagcctctgcatcaatttgtagaaagactactcttcccactacctgcagccttttgtaacccagtgagatacatgtttattcaaacacaagatatctcaaatcctaacagtttaaagtttataccatgaaaaccagtttttgagacaaggcccatggattttcccaccccagctgcagcattttgctcccctttggctaggcagttatttaggattgaaggagtaaaaagtgttttctttgggccagatttcatcactgccacaaaggaaaatgaaaaattagactggaatttactgaaaccagatatttacgcaacaaccacggacttctttgcatctggtttacccctagttactgaggaaacatcttcaaggagaagcaggatgtgaagatgatgaagttgtggcattgattaaggaagtgttagatactagaatgtggccaactgtgcaagaagatggaggagacgtaatctacaaaggttttgaagatggtatcgtatgactgaaactccagggttcttgtaccagctgccctagttcaatcattactctgaaaaatggaattcagaacatgctgcagtttatattccagaggtagaaggtgtagaacagggtatggatgatgaatcagatgaaaaggaagcaaactcaccttaaaataatctggatattctttgggtacaatagtcggacttatcgataatatataccaagctgttattattaatatgctgaagaacttgaagattaataaaatatgccatttcttcagagtccaaaaaaaagatcgaatgaagaacttatggaaatgtctggcacactatagccaatcattttccactgactgattttatttgaccatctggtttttatatcattaattca

SEQ ID NO: 13350 - DNA, 1240 bp, Homo sapiens
ttgctgagcgggggccaatgagttgaaagccggagcaaggggacttgttttgttcctgcaccccgattttacttacattacccggggcctcgagggtgactcatagagattagccctgagcgtcgacccctcggcgccgccactgcacagcgagagaaggggagtcaagagagacgcttgagtcccttgactgtcctcccctacgagctctctgggaagagagccccagacctgcgaactctgggccgctctgcggccgcttgaacacttcgcgggtcttccgccccgcgctagaggacgcactccgtgacgggaattgcggtctcggccgcccccggcctcaggctttccgggctctgctgcctccagaaaactacaagtcccaggatgctcggcgcgggacggtcacgtgggaggggccgcgggcgcggctaaatagtctccatcggccattttgtgcgagaagccgcagcgccgcctcttctctcgcgccctcgcctcttcctccgcctcctccttcgcctcttcctgcctcctcccggcttccgccgccgccactccagcctaatcccaaccccagggcgaagcgttttcttatttatttccgttttctcgccactacagcctcctgacaaggtgatccgggcgggccccgcaggaattttatcccctcaccggcctcacactagtatcgcatgtccactatccagaacctccaatctttcggtaagatcccgtcgccgccgcctccctcccttgcccggcgcgcatctcggccttttgcccgcctggccaccgcccctaggggccccctttctgcccttcccgcacccctagtggggctttgtctcggcgcccagaaaatggcgacggggcccctggcgaccccttccccgaggacagcgccggactccgagccctcctctcggagccccggccgcgggccctgcgccaccccctgccccgtccttgacccggctctcgcctccgcttctgccccttgaaaccttggcgatcctatttcgtggactcctagatcggccctgctacttgcaaagggtatgccgggccagggaaaccagggatcggcgcccgttctctggcagctcctgggggcacttagggaaagatgcggatgcaagcctctgatctgtcactggccagtggttcagtcttctctgcttgcgtagcaatttgttaaattacgcctcttgatatatatgtaatctacttttttttt

SEQ ID NO: 13351 - DNA, 1199 bp, Homo sapiens
agaagtatgtccgacaagcctggcagaaggcagacatcaatacaaaatgggcagccacacgatgggccaagaagattgaagccagagaaagggtaataacttagggtcatttgaattctggtcctttctttttttggagggttcaagatagtgtgagagggataatttttatttgttgttttttttttaacagaaagccaagatgacagattttgatcgttttaaagttatgaaggcaaagaaaatggtaagatttaagatctgtatttttgtgtaacttagctttaaataataagggagcagtagccaaatcccatttcaggctgccagcttcttggaagctttctgtaaaaaaggagaatttatcttcatttgtatttcatgatgtccctatggaattgttacctttcttcagatgtagttgtagggaaacagactacttaatgccctttctaaaaccagcataaattggattttattgtatgtatacacaataagtgctttcttacattgataattttcagaggaacagaataatcaagaatgaagttaagaagcttcaaaaggcagctctcctgaaagcttctcccaaaaaagcacctggtactaagggtactgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacctgttgacaaatgtatttaagcctttggatttaaagcctgttgaggctggagttaggaggcagattgatagtaggattataataaacattaaataatcagttcctttttttttttttttttttttgagatggagtctcgttctgttgctcaggccggactgcagtggcgctatctcggctcactgtaagttccacctcccgggttcatgccattctcctgcctcagcctcctgagcagctgggactacaggtgcccgccaccgcgcctggctaattttttgtatttttagtagagacggggtttcaccgtgttagccaggatggtctcgctctcctgacctcgt

SEQ ID NO: 13352 - DNA, 1743 bp, Homo sapiens
taaatttaaatcctaatgacttttgattaactttttttagggtatttgaagtataccatacaactgttttgaaaatccagcgtggacaatggctactcaaggtttgtgtcattaaatctttagttactgaattggggctctgcttcgttgccattaagccagtctggctgagatccccctgctttcctctctccctgcttacttgtcaggctaccttttgctccattttctgctcactcctcctaatggcttggtgaaatagcaaacaagccaccagcaggaatctagtctggatgactgcttctggagcctggatgcagtaccattcttccactgattcagtgagtaactgttaggtggttccctaagggattaggtatttcatcactgagctaaccctggctatcattctgcttttcttggctgtctttcagatttgactttatttctaaaaatatttcaatgggtcatatcacagattctttttttttaaattaaagtaacatttccaatctactaatgctaatactgtttcgtatttatagctgatttgatggagttggacatggccatggaaccagacagaaaagcggctgttagtcactggcagcaacagtcttacctggactctggaatccattctggtgccactaccacagctccttctctgagtggtaaaggcaatcctgaggaagaggatgtggatacctcccaagtcctgtatgagtgggaacagggattttctcagtccttcactcaagaacaagtagctggtaagagtattatttttcattgccttactgaaagtcagaatgcagttttgagaactaaaaagttagtgtataatagtttaaataaaatgttgtggtgaagaaaagagagtaatagcaatgtcacttttaccatttaggatagcaaatacttaggtaaatgctgaactgtggatagtgagtgttgaattaaccttttccagatattgatggacagtatgcaatgactcgagctcagagggtacgagctgctatgttccctgagacattagatgagggcatgcagatcccatctacacagtttgatgctgctcatcccactaatgtccagcgtttggctgaaccatcacagatgctgaaacatgcagttgtaaacttgattaactatcaagatgatgcagaacttgccacacgtgcaatccctgaactgacaaaactgctaaatgacgaggaccaggtaagcaatgacatagctagctttttagtctgctttgaagtaaatgctcaaggggagtagtttcagaatgtctacccaataccagtacttgaaaactaacgatgtttctgaattcctgtattacaggtggtggttaataaggctgcagttatggtccatcagctttctaaaaaggaagcttccagacacgctatcatgcgttctcctcagatggtgtctgctattgtacgtaccatgcagaatacaaatgatgtagaaacagctcgttgtaccgctgggaccttgcataacctttcccatcatcgtgagggcttactggccatctttaagtctggaggcattcctgccctggtgaaaatgcttgggtaagaaaacatgtcagaatgcttgaagctaaaaagtagaagagtatactcacaatatttctgatgaggcttttttcttcttcccagttcaccagtggattctgtgttgttttatgccattacaactctccacaaccttttattacatcaa

SEQ ID NO: 13353 - DNA, 1155 bp, Homo sapiens
taacatgttccaacttgagcccttaactttctccacctacccccttccacaaacctgttttcactgtcttctctgtcttagttaatgtcagctttgtctgtccagctgctcaggctaaaacttttctttcatataacacatcctatcagcagctcctgtttgtgggtaggcattttgcctttttttttttttttttttttaaactgctatatctctagcatgtagaacagtgcctggcagcacataataggtgcttaatataatatttgttgaaagaacaagtcagtgagtatttttaatgtgaggtgcaaagagaaaaaaaaatgtatctttgaggtgtggagttttgaagaacttccattttctaagcatttgtgtaatgttggagttacttgttccttttgtaatctgaaagtatgctttaaaaaaaattagtgtacttttgagaattttcattttgctttctattcttccttgctttgtgcatgtttatctagactgctgatcttggacttgatattggtgcccagggagaaccccttggatatcgccaggatggtatgtgtctcatatttctcgattaactccagatcaagctaaagttctaaaacttttatcagaagagccggtttgctcatctgggaaaccagtgttggcagaaaagtagtggcttcaattaaaagcagttcttaaattccagtcagcaacagtatctttaatggagcacagggaattcagagccacacaatgagtagcagtaggattacaccaccaacaaatacatgctactgctaggcctctgcagtgcaggatgttacaatttacctggctttttattctctttttggccagaggactcataatacctttgtctacaagctacccaaggaagataggaaaactcctgtttctaggctcagatctcgggtgggtttttacatagttgcattatcatcagggttttcttgaaaagctaatttaaatctgggtaatgaacatggaggatggcatagaccactaacaattataactgtcttacatttataaccgcatctgcttctacctaattatgaaaccactaaagcgcagattcttactgtgagaaataacatgtcaaccctaagataaaatatgttgaggtttcatggaaatagt

SEQ ID NO: 13354 - DNA, 1659 bp, Homo sapiens
tgccttccttcttgcctattttgttgacaccctgactcttctagatcctagctatcgttcttttcactctggtggatatggccaggatgccttgggtatggaccccatgatggaacatgagatgggtggccaccaccctggtgctgactatccagttgatgggctgccagatctggggcatgcccaggacctcatggatgggctgcctccaggtgacagcaatcagctggcctggtttgatactgacctgtaaatcatcctttaggtaagaagttttaaaaagccagtttgggtaaaatacttttactctgcctacagaacttcagaaagacttggttggtagggtgggagtggtttaggctatttgtaaatctgccacaaaaacaggtatatactttgaaaggagatgtcttggaacattggaatgttctcagatttctggttgttatgtgatcatgtgtggaagttattaactttaatgttttttgccacagcttttgcaacttaatactcaaatgagtaacatttgctgttttaaacattaatagcagcctttctctctttatacagctgtattgtctgaacttgcattgtgattggcctgtagagttgctgagagggctcgaggggtgggctggtatctcagaaagtgcctgacacactaaccaagctgagtttcctatgggaacaattgaagtaaactttttgttctggtcctttttggtcgaggagtaacaatacaaatggattttgggagtgactcaagaagtgaagaatgcacaagaatggatcacaagatggaatttatcaaaccctagccttgcttgttaaatttttttttttttttttttaagaatatctgtaatggtactgactttgcttgctttgaagtagctctttttttttttttttttttttttttgcagtaactgttttttaagtctctcgtagtgttaagttatagtgaatactgctacagcaatttctaatttttaagaattgagtaatggtgtagaacactaattcataatcactctaattaattgtaatctgaataaagtgtaacaattgtgtagcctttttgtataaaatagacaaatagaaaatggtccaattagtttcctttttaatatgcttaaaataagcaggtggatctatttcatgtttttgatcaaaaactatttgggatatgtatgggtagggtaaatcagtaagaggtgttatttggaaccttgttttggacagtttaccagttgccttttatcccaaagttgttgtaacctgctgtgatacgatgcttcaagagaaaatgcggttataaaaaatggttcagaattaaacttttaattcattcgattgtgtcactctttctttttttcttgtcattaataaatggtttgtgagggtggtaagtaagtttatccaactcaactttatcctgaactttatcctgagatagatagatacatagtgaagtaatttgttgtagcgatagagagggccctacttctctagatgcaatttgccaagtttctttagcatttggccctggattacgctggacccctaaaaaagtgtttcagccttgcacattgtgattagttctgggctttggtgggagaaagccaagcagactatccatctatctatctctacccc

SEQ ID NO: 13355 - DNA, 1202 bp, Homo sapiens
tctgttatttttttttgagatggagtttcgctctcgttgcccaggttggagtgcagtggtgcgatcttggctcactgcaacctccgcctcctgagttcaagccattcttgtgccttagcctcctgagtagctgggattataggcgccagctatcatgcccagctgattttttgtatttttagtagagacggggtttcatcatgttggccaggctggtctcaaactcccgacctcaggtgatccacctgccttggcctcccaaagtgctgggattacaggcatgagccaccacccccggccacagcctctgttcttacaaactagtggatacaggtgccggaacaccaggccgtgggccacgtgtttacatgctgctccccagtagagttgctgagtggtttatgtttattccggaaatacatggttcactctgattttacaggtcttccgcaggtaagaatcacctttgattagagtcaggggattcctggcagaatggggagctggagacccacttagatcagtgattgctaagtgtgagctgtgtggcttccctgggccaggcactgagttatgacagtaaatgagacagtccaggtctgggggcagaccaaagagacccaatgtagtaatagatgtaggatatgataccaggtagtgactaggggagagaatgaggtggcagcagaggtgtctttagggaggttataggtgagcagagattgaatggggattgagccatgggaacatatggaggaaaagcttcccaggcagagcaaacagcaagtgcagaggccttggtgagaaggccagtgtggctgcagtgcaggggaccctggggatagtggacgtggatgaagccaggagatagtcaggggacggctgcatcccactggcctgctggctgttgtaaggagtgggtattttaatctgcatatgattgggaactactggaggattctgagtatggaggaagctgcaggggagtgacaagaattgattgatttttagatgatttatttatgagacggtatgttagtctattctcacatggctataaataaatacctaggattgggtaatttacaaagaaaaggtttgattggctcatggttctacagcctgcacaggaagcatggtgctggcatctacttggcttctagggaggcctcaggaaacttacaatcatggtggaaggcaaa

SEQ ID NO: 13356 - DNA, 1200 bp, Homo sapiens
aatgcattccagcctaatgtgtgctaaagaggctgcctccctgtgtcagctcttggcttcattgtcagagcattttagaatttctatatttattcattcattcacttaacaaatagctactgtttccctgtgccgggccctggcaatacaatagcccagccctcaggtggagagacaggttatcaagtgactgcacaaatatcaaaagcagttgcaaataattgtttttagaagcatttttttctttcctgtaggaacaaagatttgttttcattacattgtcaggcttccctttccttgtgtgatgtctgtgtagctctcacacactatgtgggcagaggttatgcctgttttaacaggcatcaaatgctaacacagatggtgaattattaattcctttgttatttctagatgcttatgttttcctcatttgacactgagcaccattgactccttcaggaaacacaggtcttttgaatctctgttctccctctttccttttgtagaaagagcgggatttagaattggccgctcgcatcggccagtcgttgttgaagaagaacaagaccctaaccgagaggaacgagctgctggaggagcaggtggaacacatcagggaggaggtaagacattggaggccgaggcttccagaggggcccgccacaggcctgggagctggaggcatggctgaaggagatgagagaatggagtcctagttggaaggacgctcccgagggcacgaccgcggcctgagcccagaactgtctcttctgaaacgttcacctggggactaaaagccaccttcctgcagctcctgctgctgcttgtgtctcttttctttcctcaggccatgtggatgggatggctaagggcgggcatggtcctcactcagtcgtacatctgtgtgccatgttgggccagccacagtccttgtcctcagagagtctagactctaacgatgcaggctgatcaagatgctccatgcttggcagaagggcacccaggctaacaccacaacgagcaggggttcctgagtcaggctgggcgtgggcagctggagaaggagccctgttaggaggccagctcgtgtacacagaggaaagtggtgactcacattcatcgttgtagtataattttgtgtgtgtaaaacaaaacaagacaaaaatagcctgttgttttcatgatagaaaccctcttatt

SEQ ID NO: 13357 - DNA, 1776 bp, Homo sapiens
tgtgtccacctgtagctagctgaaggatgtgtgcttgcatgtggtgtgttttaagaacaaaacatctgcacgacagctacgggcagttcatcaacacaggagatcttgaataataatcaaggattaattaagtttaaagcgtatcacattttgtaccagtgtcagaatctgggggaggaagaacaattaaaaaagaattaggggtttttattggtaaatccaaattcattcctaaatcaaatgatgaaaatatttgtcgttgttaatactctaacccatttaatatgtgcctgtctcttcaaaacactaggaagccctccactcaggttgagagaaagaataagaatttaaatagggaattaaagccttaaatccaagaaactctatcctttgagctcccaaatgagcagcatgggatgaacacataataccatcttctgcaaagaactttctgtttagataaagaagggggctttggtgcgtggcatgggcttggtgacttcacagtgagccctcacccaacccccctatttcctgccaagaaggatgttttatgtttctctctctctctcttttttttttttttttttttagaacttgctctcttcctgcacccagggctttaggaatcagcccgttgcttctctgtagcaagcatgaggagcctctgatgatcccagtcttgggtgactcactgtctctctgttgtgtctcaaggaagggaggtgcagcagcatcctggcagtcagtggtgacatgcggagagcccacgggtccaggcgtcctggtggtattttggaagggccaaatctctggctttagcactttggaaacttgttgatcttccttggtcttctacggctattcattgcttctggggaatggtgacttgtgaatttttagcagccttttcctatccccaaaacccatttgtataagatgggtttgcttctgctgatgcaactacgtctctaaaatgtccatcttacactccctattgcaattgaagatccaatatgtaagagggtggaggaggaagtgaacatttgtgaccttttgatttgatattctggccatatgtttaaatgggggtatgcttctgattttaaatccagccttcccttgtttgatttcttttaaatgttatctctctttcaactgtgttgtcttatttctatttactgctttccccctctcctccttcccaaataacccctcatgcctgttatttgggatgctcttcccaggctttttgttatttttgtttctagaccttattgcgggaagagaatcgtgattgtttggttgccttctcttcatagcttactccatttttgttttgcttgtggcagtttcttacttattggagttcctgagccattatgttcactgattgagaaagattcataaaggctatttttatgtgttttttttttccttccctcctgctttgcctggagctccccatggctgagagttttctcctgtggccgtggtgctggctgtcacgtcaggtgccatgggagcctgctttgacacacagacccgagtcagaccttaaaaatcagggcaaaccatcttgccttgttcctctagtcaccatcacttttgtactctggatttgtcctgcctacctttaatctgtgtctccagcatttatttttttgtttgtgtcatcgggttcctggttttcttttaagacatagtcaactgtgtggacctgtaggtttggggcagcaaccaattccattgttttcctttttgtcaaatccaaga

SEQ ID NO: 13358 - DNA, 1260 bp, Homo sapiens
gggttggaggtttatagcctcttgtgtgatccttgataccagcaaactggttccaaatcccaggagttatcctcactccaccatggactcactgttgttgtagcacttttgttttcccagtagttaaatgctacctgtgcagctgacatcactggactagatctgggaatagatgaaataatgttgaaaacaaaactttagaggtgccttctggtatcagatgctgcaaggccttgagcatcagagtgtgttaagtcccatctactgtatcaaggccagagtgtggctccatgctcttaggaagggtttcccaaccacggggccagagcccaaaaggtttccccttccctaatatgctaatgaacgaaacatgtaaatctgttttcccctgttaggctagtcttactgtgatgagaagtgtacctggctttccttttcctgggtggagacagctggggcatattcgggtggcattccctctcagtaccagaggccccactgcctgcagctggaggcatgtgaccataagctcctgcttttgctttttgggcttgcatccctcttttctgtgaactctggagaatgctggaattaaaacatttaagcattttgattaaatgagcttgagctcctctgttcttttctaggtgctcttgttctccaactctcctgcctctttctacctctgccctatacattccagctctggagacagagtctgaaactggagtctctggagggatgagaaaaccatctttaattgtaacaaatggggtgggtagacgagcttcagagtgggagcagattgcattgaggttcaactctcccacccatgcctgggagtcaagtcttggagaggagtaacacttggtggtcagcacagctcagagtcagagacaatagccagcaggccagcaaggctggctgtgtgaggcacaggaagcagggcataggtagggagcagagctgggggttctctctctgctggaagatagcagctgccccttggcatatgggggttgcacactgcaccttgtagccagggctgctatttgctgttctgtgaaggagttggccactcattgtgacatgcaggacagtggccttctgagaacctgctgcttgcttgcatagtgcagcacaagtgaggacaggcaggggtgggagcatttatggtgatcagatgtgcctggcaagcccctgttcagacattgctcacattccaaatgttttcgtgtagaatattgcacaggtctgggg

SEQ ID NO: 13359 - DNA, 1224 bp, Homo sapiens
atgtgactgaaggagtcaatctgtgctcatggatgggcttctcagcaatataattctttttattttttatttttctcttcagttttccaaaatgggtcggatagtaagcagtacaatatcatgtgtccctgtaaggaaggttcccaagtaccaagcgaaatctgaatgttaccagactctttaccctaaaatggttaagaaccattgttttaaaggcagaaaactgaggcccagtttgcataatcgtttccttttatgaagcagatttcaagttctcattccattctagttgcttcatacaacaaacagtttggttttattttcaggtctgtggacatgtcattgattacagttaattgtcttgattactgtttatagcttaattatcaaaccagttgtttcttgaatttgtattatgacagggtgcatgtagtctttggactggttatttctggttttgaagtaatcgaacaaattgaaaatctgaagaccgatgctgcaagcagaccatatgcagatgtgcgagttattgactgtggagtacttgccacaaaatcaataaaagatggtaagaacttttttgacagtagatgaagctaagatgcaggtaaagcattgctgaagactgtaactagatttgattagtggaactagtggtatagcaatagcccttggtgcccctgaatcataccctacatgtttaatcttttagcatatcttgtcagatcttactttttcttatttccttgccaccagccttatccacaccaccagtattttgtgtctggattattgccgtagcgtcgtaactgtttaccttgcctccgttctataatcttttgtcagcagcaatagcctcctaactggtctcattgcttatatcctaggcccgctgtggtctgtccttaacagcaaccagagtgatccctttgaaccatagtttgcattcatgtcacgcctgcacagaaccctccaaggactcccatcttcaatcatccaaagcagaagtctttatggtggtctctaaggccctggctggtctggctctctgctgtctctctaaactcttttcccttattcattgccttccaggcacattgaccttttttcagacatgccaaccactcagggattttgtgctgcctattctctttgtctggaacaccctttgttaagatatctgcatgacactgtcccttgctcttaagtctctgttcaaatgtt

SEQ ID NO: 13360 - DNA, 1186 bp, Homo sapiens
accctaccacaggccttgtctggtgtatttgggaagtggaaaagagccctcagttggagggagctgacaacccttggtggagggagggtgcccttgaatgtattaaaactatcacccaaagaaggtatgaaaacagggtaaggtggtcagttgtttgccaggtcaatagacagaaagtacattagaaaacaggacttaggccaaacaaacaatactggatactgaatacaaaacagtatgatttatattaaaggtttccaaaggttgcctgcaaaggagaatattactactagtcagcaggaaaaaaatgcattcagaacccaagcagaaactgccaaatgtaattaggttaagaaaagttacccttgggcagtgtattagttttctattgctgtgtgacaaattaccccaaatttagcagtttaaaaaacaatacccatagcagttctgtagctcatgagtctggcacagtgtggctggattctctgctcagggtcttaaaggctgaaataagggttggcaggacaacattccttcatggaggctctggggaagaatctgcttctaagttcattcaggttgttggcggaattcagttctttgctggctctcagctggaggcccctctctcacctcaaggctgcctgcattccttcttatgtggtcccctccagcttcaaaccagccttcctgctctttctcatgcttcatatctctctcccgtcctcctgttttaggggcatatgattagctcaagcccacagatatattttaaggttgattgtgcgatagaacataattgcaggagtactgtctcatctcatcatattcacgggttctggagattagctcattgaaagtgggaggggcattttcaaattctgcctaccacaggcaataactgcccatctcagctgtaggtggaatttttacccagaaaagataggccctagaagcctcatttcttttctccatggaaaaggacagccctctgctgcagcgttcaacttgtgtgtttactgacagagtgaactacagaaatagcttttcttcctaaaggggattgttctacattttgaagttattttttaataaaattgaattatgttgtgtattgtgcttcttaataggaaatgcattattggactgtttttgtaacatcctgtttattgcaaatagctagtat

SEQ ID NO: 13361 - DNA, 1195 bp, Homo sapiens
tttgcaaaaacttgatatggtatttaaattcagcctttgtaatataaagtctaaatgtaaaaataggttttattaatgaccctgactcattttttatctcaatttattttcttcaagtttctcttaaaatgaaaaaaacaaaaaatgaagtgattttaaagtttgtgaagaaaagtcgcagaaacttaattttgtttctcttcttattttgtagatatccatgacgacattgaaaatgaattttttgtattcaccagatattcttatatgagaagatctattttaaacagtctaaatattttttcttctgttggaccagcatggcaggatttaagcgagggtatgatggaaagattgctggattatatgatctggataaaaccttgggtcgaggccattttgccgtggttaaacttgccaggcatgtctttacgggtgaaaaggtggcagtaaaagttattgacaagacaaaactggacactctagctactggtcatcttttccaggaagtgagatgcatgaaactagtgcagcatcctaacatcgtccgcctttatgaagttattgacacccagaccaaactatatcttattctagaacttggggatggaggagatatgtttgattatataatgaaacatgaggagggtcttaatgaagacttggccaagaagtattttgctcagatagttcatgctatatcttattgccataaactccatgtggttcacagagacttaaaaccagagaatgtagtcttctttgaaaaacaaggtcttgtaaagttgacagactttgggttcagcaacaaatttcaaccagggaagaagctcactacaagctgtggatctcttgcatattccgctccagaaattctgcttggtgatgagtatgatgcacctgcagtaggtaggtaacctcggtccagtatttggccatttgaattctgccagctagagttggtcagatcggttgtttatctaaaaatgatttctagagaatttctgttaaattggccttaactagcaaattgggtttcataaatgccatatatgcctaaagctggcatttcgtttatttcaacctttagatggcaaatgtctaaagtatatttgtgagtacaaaggaaaatgagtaagttatcatttaaagtaatctcttttctgttcattgtcatttttttcttaaggtctga

SEQ ID NO: 13362 - DNA, 1199 bp, Homo sapiens
caaggctactcctaattgttgggagataattctgcatgggtcttttgtgtgtctgcccatcttctgagtaaaggcactgacatcctttgtttcaaattattaaatatcttttggaagatgtttgtgtagcagacggtcttgaagatagtggcagattttttttttttttttttttgctgtccatgataagaaagataatgtttccctcaggttgagcaggtttgctaacagtcccttgaaaagaccagggttaaaagtctgagtttttttttttttagctacgatgcaaatttattgattgtgtagaatccacccaggctcttccacatgttcccatgggacttgaggagtaaggagaactgacacaaatatgaagcccatgctgactgctacacaacgagtaataatgtcctttgtctctgacccaggagtcttgtgtcttctgtcaacaaccatgaaactgtgacaggctaacttattattagctcatacatgtggtaaaatttcaacccctttgtagttcttgacactcatgattcagaatctgatagttaaaatatctatattcatcaaaatctaaatttagaatgaacagttctcctcaggtgagtaatttcatagaggaattctattacttcaatggctttattctaggaatgtattacatacacagaagacacagaaaagacccattagccatttagcctcttccctgctaagacaaggaactgaaatggcactgtgagccaaatagtgtctttgattatttggcagatgtcaaatggtcattatgttgtaggtttccagtaaaaacacagtggaaataaaacaacattttccccaagatattcaaaatatgtatgtggtatttcatctactctaacttgtattcaacactacagggaggatggaaacagtttatatattatattgatgcaaaagttattgtggtttttaccattactctcaatggcaaaaaccgcaataacttttgcaccaacctaatatttctttccggggggacgagataggtcttttaatacgtgaaaataaatttacgttttttatttcaaaatagaaaacatcaaaaatgtcttcagcaaaaatgtaaagttctttttctcttcattttatttctacttgatatgttgaggcattttaaacgtgatgcgaaatacctgactataattgatttgatc

SEQ ID NO: 13363 - DNA, 1226 bp, Homo sapiens
tggctttcctttctcctacacaaaattgaaatatacaagtctctaaatataatacctttaaataaaaggttatttgtccctctgatgtactgaaaaactgtaatttttcagctgaaaattttttaatctaactttgctagttatttttatattgcaatctatattaccaatttaggaagtgatttctgagtctcttacactgtaaaggtgcactttattttctttgtcttccccatcatgtatttattgtgtcttgataactgatattaatctaaattcaatgtgtttttatgtaaaaatttgtcagttgtttagaatatttcactttgtttttgaaacggagtgacaaggcagatttttggttagaggacgggagttgatcactatcattactttttctagtttacctgttttttatatttaaggctgctaagccatgttcagcattttaaatgtggtctatcctgacatacagtgtataacaacataactccttggaacctcctatgtgtggtataattctactcttccaaggaacatgacttcaatactttcagtgattcaggtactgaaaagccttacctaaaaggctgttctttgtttccccctttcatactattcttttccatgacccaggatgcagcaaatgaaacagatttcttctcttaaggggatattaagactgttacttcctagtaagccaagtaataccatatttttattaacatctaacttttgtagatgggtgctaaaattgcatacattttaaccactaaaatagaaaaacaagtggtgctattatgtctcatggcaccagaaatgagctagcacttgggtttgttgttgctgttgtttattaagagtattgtgttaattaaatcattacatacttgaagttatattacaaaaattctagaaggttgattgaactatttttttaggaactaccatcaagtgtagcattttcttgcagttttaaaatgaggaaaacttctttgaaactgtgaaatgctccatgtggtaactggctgctgagaaaacccttcaccaaaaaaataaataaaaattgaataggattgtcatcaagaaggcatctttcgctaacgttgcttgtctaggagaaaggtagctatgtaaataaaaacagtgaactagagcaaatagtggtttaatggttttgttattgcatttttaaaatggttaattagggaatttgtagttgttag

SEQ ID NO: 13364 - DNA, 1171 bp, Homo sapiens
tgtcaagaatgtgggaaaacctttacacgtaaaagaacccttttagatcataagggaatacacagtggagagaagcgctataaatgtaatctatgtgggaaatcttatgatagaaactatcgccttgttaaccatcagaggatccactctacagagagacctttcaaatgtcagtggtgtgggaaagagttcattgggagacataccctttccagtcaccagaggaaacacaccagagcagcacaggctgaacgtagcccgcctgcacggtcttcctctcaggacacaaagttgagattacagaagctaaaaccaagtgaagagatgcccctcgaagactgcaaagaagcttgcagccagagctccaggctcactggactccaggacataagcattgggaaaaagtgccacaaatgcagcatatgtgggaaaacttttaacaagagttcacaactcattagccacaagagatttcatactcgagagaggcccttcaaatgcagcaagtgtggaaagaccttcaggtggtcttcgaacctggctcggcatatgaaaaaccatattagagattagcctgggacctgacagtgacagtgggggtgggttctcagtcccctgctagagaacccttaattataggcattgtggagtaactttgataaagggcccagccctttctgttttggaagctagtgacagaatcccaaggatttgaaagctcggggagtccccagcctgcctgctaggatgtgacgctggggaagtgcagcaccatgtcctttggagcccttctggagactccggcccctaggagtggcctctgcaccatagcctgcggctcccctattcaggtctccttccacaactctgaagagagagaccactgccctttgtggttggacagaatatctgtggcatcatgggctatggctgctggaaaggggccagtgggatcctagatttgtcttcaagtttggcctgtggccatgcctattctgttgactttaaaagcagcagcatcaagaactcctagccttcccaaatgccccctggggagttctggctggggcttcagccttcctggctggcttttggatatctgctagggggttagagtggtctcagcggcaggtggaggagagcaggatgctgggctcaagcgcttggcgtg

SEQ ID NO: 13365 - DNA, 1260 bp, Homo sapiens
aaaaaaggactcagggaccacagagttttcttgaagtagagtttaatttaaagcttattgatcatttgagcaaatctctggagggcagaacaagaaggagcaggcttcagttaacagaagcagccttgagttgccaggatagtggatggaataccaaagaaagagttcacaccagggaggaagcaatgccttctccctggagtctcccaaggggcagctttagaataagggaagaggatttgctggtcaccgtttgctgacatgggtctctatggtgagttcaggcctgaggacagggttgtctgcaaaaccacatggcccttgagaaatgtccttgcagattgggcttcaaactgcttggagcaccaggagagggacttcctggatttcagggatagagagaggagaatggaggcaataggaggagaatgcacttctatcaggcccatcccagtgctgagagagcactccagttgacaggtgccttcagggctggtgaacccatggcctgaagatatggcagcttctcaagggtcgtcagcaggtggcagcactgggctgcccatagtctgctgctccagggagagactctgtggcttcgaaatctatggatttgaattgagacaatggtggccctgatttttgaggccatgactcaggaaagggatgggattctgtggcctcggctggtgtttctaactgtaaaagaggtgaccctgtgatagcacaggacctggccttgtgggtctggctgcttatggttgtgttggcctttttgacctgctggctcttgaatctgccctcatataagtcatcaaatttaatcatccataatctgaaagctaagcacaaggtaggaaatgctgaaatctcaactaaggctccacagcatcagacaaggctacttggtgatgagaacaatcttctgagcattaatctctttcacttgtttggaacttaacttgacgataaatttcttgggtccagtttttattggggtgcattttatttgggattggatggtctcaccaggctgcaccgtcctggaaaattcaaagacatacggacatacaatcagccaaggatgttatgggaagagggagaagatgagttgggtgagaagccaggaaactgagccttagctcagcctctttgaaaagtcctggccattccagggcatggcacagtgtacctgcaccctgggtgctgctatcagttttctcagatgtaaagcaagacgggtgaaccagctggtttcca

SEQ ID NO: 13366 - DNA, 1049 bp, Homo sapiens
ttctgtcttctcttgggaaggctgggcccctggctcctggctttgagaagtaaggttgtgacagaaggaccgggcagggcttgccttggggacctgggttgggacactgacatcaggggagactagcctggaaagactgcagagctgccagctactccctggaaagggcttccccatgctgcctgccgaaattaggaggtagaggtggctgccacatctacctgcaagggccaggcatggttcaaagaggaccctgcattaagctctacacacacatgtgcaggacatgtccagcatggacagagccagagttaagacagtagcaccgaaaatgagcccccattccacagacactggagtcttcactgagcgagacagctgggagctgtcctgcctgtggctacatatctagccattcacagatgtggatatgggaaggacctctttggagctactggggactccctaaccactcgcatgagaacttaattgaatgttacctcttggagggagtctaataacacatgtaggtagaactgaccataaaccctgcctgtgtgtttgaaaaggccagttctcccaaattggtgcccatcttgtctctgaaaagatgggtgatggccagggtctgctgattgatgaatcagatgaatcaggaagatagacaaacacacacacacacacacacaccccaccaggatgagtctgccctctattcaccccatttgaagcctgtggtgtctgtgaccactgctgaaggtctgagcagcgttctggtgctcctaaaccccattccagtggttgctgaagcagcatcttctgcacaaagcccaacagaagggttcttatccccgtttggtataagaagtggattcaccacccactccctccacgtgcctttgttcctctctttggcccatttccccagcgtctactggcgtcaggattggcaggagcacaggcactcagcagagcatgcccctgcaagacctcagtgttagggccccccttccagctccaggcaaaagggcatgagtcctggccccaag

SEQ ID NO: 13367 - DNA, 1312 bp, Homo sapiens
gaagcagcccggaagggaaagagaaaagagtagaaccaagggacctccagatgggagcggcggccggtgagtagtctagagccaggggcattgtagcagcctggatacatgacctgaacacgtcttgacctttgctttctacgtgtgggtttcaacacccatgtggctttttcttgtattctttaaatatgtatctggcttaggatcacctcatagaagagaaagaattcacagtgaagcagaaacaagccactgaccagcgtactcccaacctgaaccttctttttctcaccctctccctcaagtaaacatcttgctgacttgagcagtgtgattgccgtagcaaagcagagtggcccccagggatcccgctctgttgggcccacaggaggagccgatgaagctgatccaaggagtgaggacaagcgctgcagagggacgttcgctaaaagccttctaggggccgcacatgctctaacacggacataaggatgccctgaatttctgcagctgaggccatatagtctggtgaccaagtatttgggtcctggcttcagtctttggttgaaatgtctgcttggctacttattaccgcacctactaccaaaatatgaccttgagcagtaacttctttaagcctcagttttttcatctgaaaacgggaatgataatctaaatcacaaagttaatggaaggattaaatgagggtgatgaataggaatgtatagcgtctggccctggtatggctttataaatgttagctgtgttggagctgtgcttttcaaaccattggtcacagccattcatggtttgcaaccagcatgtttttcaagaaaaatgtttaatgcattacatattgcaggataagtattgttttatgaagcttagggagttgtgtgtatatgtgttctggaatgcaacagaaaaatgtttcctcttgtgggttacaatatagaggtatgaaatctctgatgaggagagacagtgttatctggcccgctatgaagagacacatttgcataggctgctccctgaggctctggctttctacatctgatgatacagggagcagggaacagcctgttctcgttctgtggggctcagctgagtctgttctgcacagactcttccttcctcgggagccttagtcctaatacattcattttggagtgttggtgagtttgttcacagatcacagctcatgtgtcacccagactgacctgggccaaaaggcccatcacacaccctgcaagagcttctggtgtcgactatgacccccttaccaggcatcaaccatttttgttcgttctct

SEQ ID NO: 13368 - DNA, 2259 bp, Homo sapiens
actccattcacctgtcgctgcggacatccctccccagaaaccacagcaatgcagtgcttgactgaaagtatgattgttcttgttttcagggaatagaacaattgaaaaaggaagagagaagatgggctaaaaaaacaaaatggatgaacatgaaagccgtttttggccaccccttctctctaggctgggccagcccctttgccacgccagaccaagggaaggcagacccgtaccagtatgtggtctgaaggaccccgaccggcatggccactcagacacaagtccacaccacagcactaccgtcccatccgttctcatgaatgtttaaatcgaaaaagcaaaacaactactcttaaaactttttttatgtctcaagtaaaatggctgagcattgcagagaaaaaaaaaagtccccacattttattttttaaaaaccatcctttcgatttcttttggtgaccgaagctgctctcttttccttttaaaatcacttctctggcctctggtttctctctgctgtctgtctggcatgactaatgtagagggcgctgtctcgcgctgtgcccattctactaactgagtgagacatgacgctgtgcgtggatggaatagtctggacacctggtgggggatgcatgggaaagccaggagggccctgacctcccactgcccaggaggcagtggcgggctccccgatgggacataaaacctcaccgaagatggatgcttaccccttgaggcctgagaagggcaggatcagaagggaccttggcacagcgacctcatcccccaagtggacacggtttgcctgctaactcgcaaagcaattgcctgccttgtactttatgggcttggggtgtgtagaatgattttgcgggggagtggggagaaagatgaaagaggtcttatttgtattctgaatcagcaattatattccctgtgattatttggaagagtgtgtaggaaagacgtttttccagttcaaaatgccttatacaatcaagaggaaaaaaaattacacaatttcaggcaagctacgttttcctttgtttcatctgcttcctctctcaccaccccatctccctctcttccccagcaagatgtcaattaagcagtgtgaattctgactgcaataggcaccagtgcccaacacatacagccccaccatcatccccttctcattttataaacctcaaagtggattcactttctgatagttaacccccataaatgtgcacgtacctgtgtcttatctatattttaacctgggagactgttgtcctggcatggagatgaccatgatgctggggttacctcacagtccccaccctttcaaagttgacatatggccatcccattggccagaatccacagacacacctaagcctgtggcactgggacagaatagattttccatttgagaggcacttcctgtgtcagtcttgtttgaaggaggtggtgatggtggatagaggtgaaggaggtagggagtgccctccaagtgcaaaaataacaaatatgattattgaccatcggggaattctcacacattgatttgttttttaagcaattgccagaaacccccttttttagcttttgcttggggtgggggtaggagttaaggtttattcaatcctgtcctgggtagggcgaaagttaatctagccatgtgatttttcagaaaagtaagtggaacatgctgccacttttcaattctgtcagtgcttccacatggaaacaaaatgcaataaaatttttccaaaacctgttctgatttagctctctcttgaggtgttacccttagtgggaggccgactatccacaatctacttgagttttctctggttgggtgtttgtttcattgctctgtctcttgaatgaggatactttattttttttgttttaaaatgcatttatggtccctctcttgaaccagcttgccccaccaggcctctttcctttgctttctgcagcctgaatcaattcctttgtgctgatgggctctcctaagagctttcctgagtcagttaactttacctcgtgtctacggtgctattcatgcgatacgggcgaggctgagatgctaagattaaaaagaaaagaatgctgttttagatcaagttgatagcatttgttttccatatgcttttttaaaattttttcataacatacagctcagttaggtgtatgaaagaagtgttattgtattaaataactagagcagggctacagctctggccctcccctagggggaagaga

SEQ ID NO: 13369 - DNA, 1108 bp, Homo sapiens
ttggccataactattcatattggcatcatcttcaattgaagtatgtgcatggttggttctacagctatggagcttaattaccatttaaagtatcatcagcttttttcttccctggctgtctgagattagaccgccatcatgaacgacacggtagctatctgcactagaaagttcatgaccaaccgactacttagaggaaacaaatggtcattgatgtcattcaccccgggaaggcaacagtgcctaaggcagaaatttgggaaaaactagccaaaatgtacaataccacactggatgtcatctttgtatttggattcagaactcattttggtggtggcaagacaactggctttggcatgatttatgattccctggattatgcaaagaaaaatgaacccaaacatagacttgcaagacttggcctgtatgagaagaaaaatacctcaagaaagcaatgaaaggaacgcaagaacagaatgaagaaagtcagggggactgcaaaggccaatgttggtgccggcaaaaaagccaaaggagtaaaggtgctgcaatgatgttctctgtggctgttgtggatttttcacaagaagattaataaaccataaattttcatgtgaaaaaaaatcattgaacaattgctattattaaaaagtcaaaaataatagatgctggtgagattgcagagaaaagggaacacttatacactgctggtgggaatgtaaattagttcagccacagtgaaaagtactgatgttttctcagagaatttaaaatagaaccaccatttgacccagcaatcccactattgggtatatacccagaggaatataaatcattctactgtaaagacacatgcacacgtatgttcactgcagcactcttaacaatagcaaagccatagaatcaacctagatgtccatcaatggtgaactaaataaagaaaatatggtacatatacaccacagaatactatgcagccataataaagaatgaaatcatgtcctttgcagcaacatggatggaactggaggccattaccctaagtgaattaacacaggaacagaaaaccaaatccacgtgttctcacttataagtgggagctaagcat

SEQ ID NO: 13370 - DNA, 1183 bp, Homo sapiens
ttgcatttgcaggccctctcccatgtaagaaacctgaggatggtctcataaaatgagtactcacctaggtcaggcacagtggctcacgcctgtaatcccagcactttgggaggccaaaacgggtggatcacgaggtcaggcatttgagaccagcctggccaacatagtgaaaccccatctcaactaaaaatacaaaattagtcaggtgtggtggtgggcacctgtaatcccagctacttgggctgaggcaggagaatcacaggaacctaggaggtggaggttgcagtgagtcgagatcacgccactgcactctagcccgggcgacagtgcgacactccctgtcaaaaaaaaaaaagagtactcaccagattgtgccattttgtttcatgaattatacaggccctggttaactgggacccagtggatcaaacagtgcttgccaatgagcaggtggatgaacatggctgttcatggcgttctggagcaaaggtggaacagaagtacctcagacaatggtttattaagacaaccgcttatgcaaaggtgagtgtcagcctggaggctccccactaatgccttacatgctggcaggcaacaccaaaggcttctgggtatgagagagcctcactgttggggttgagctctaggaagggctgggagccatggatgtacagacaggaagcagctgagcctcatcactcacttagctggtgatgggctggtatcttcaactgtaagtcaagtatagcacctagaggtcattgtaggccattgtttgctgacgtttcaacttactgccacagaggtcaaaaatcatccataattatatcagtgataaagctttaaaaaagagagaggggggcctttaaaaaaagagagagaaaagtgtcttcaactgtgtagttctgatgagacctccagaaagatagaatgaaatctcagataagtaaatggacttttggtttattaactttggtgcatgtctttcccacccaactctagacttcacatgcttaaatttttcaatggaggtccagaagagattatctaaaagaattgaagagatggccggcctccatgagagaaggccaagtgaaaatgaactaagccaggcgctaaagcttgataaactggttcttgggccttagttttctcatcaatacaatgagcaggttggaccaag

SEQ ID NO: 13371 - DNA, 1149 bp, Homo sapiens
tatttttaatgcaaaatattcaatccttgcctcagagattctgattcagttgatctcaaggccaggaatcttttttcacaagcaacccagaggattctaaagatagtatatgaatcataaagccctgacatctagggatatagttggaataattatgttagaggaaaccctcatctggctttgggaaacatgattgatttgcacagcaacctttttaatactcttaactttactttttcacatctttggggtgagatgatctctaatcttcagccattttttggatggagggctgtcttgcctcagccatttagacttctttttggtctaggataatcacatatgcctgaccacacattcctgtctgaccttttaatttacagtttttaataatgtcactgaaatgagacccatgttataagagttaagtccttagtaaatctgacctactttggtatgagagtgtttatacaaatatgttttagttattttctagtggactctgctggccaggtggtggcaaaccaggaaggcgtgttccgaagcaattgcatggattgtctagatagaaccaatgtgatccagagtttgttagctcgtcgttcacttcaggcccaacttcaggtgcgaatgctttttttttttttaattgaaaaacaacacagcaaaaaattaaacatctttaaaacccagtaacaaaaaatattcacattgcccacaccctaacccagctctttttatttttgtgtcttgcccatggatgtcacattttccataactagggtcagtctgtgtatgcacagttttcacttttgccattttcccttagcatttatgtaatcacagtttctggtggttgtattgttgtgccgtaatttactaagccattcagattgctacatttttggtttataaataacaccgtagagaatatatctgtatatgttattattaacttgaattatttccttcatgttaattcctagaagtggaattactgggttaaagagaataaatatattattttccaagagcgtcataccagtttacactgacaccaataatgaatcagtaaatccatttcattgaactcttcccagcatttgatattttaattttttttttgtttttccttgagaaagtgtctgg

SEQ ID NO: 13372 - DNA, 2602 bp, Homo sapiens
gattcctggggcccaacagttgatgctttatcaagccctgcagaagattctggtactagccagggtttgagaaccactggtttaaaccttaattaagaggttcttatatttttcctgtgaatgtgctagtaaactttaatgttgccaaaatgtgctaaacagctgaaaactgggtctgatatcaacaaacgacttatttagctttttgtttcttaatatcaacaggtgacacttggacagaaacactggcctatgtgctcttctggggagttgcaagcattggaacattttttatcattctttacaatggcaaagattttgtcgatgctcccagactggtccagaaagaaaagatagactgaatttgtatttgtggaaagcggcttggcttggaagattccattgtgcagaactggagtctttactgacccgctttccacatcagcccaaggtctttttaatgcctttatccaaaagcacatcttgtgctccatgcaggatgatgacagaattgatctgatgttactgccttgatggtctctttactattgggacagttagatttataatttgaagctattctgtaattaaaatataacctgaattcagcttgcagaatggaagctgaatctgttcattgtattctattgattgtcaatttaattagctgttgcagaataagtaatatattttaaaaacctagctcctttcattatttaaaacagcaaaattatttttgtagctcagtttcattattgtcattgtagaagcggtcactattagcaggcatacttttccacacatctttggacttttcttaaaagttcagtaataagctaactgtgtttataaaatgtaagtctcttacagacatcaagtagtttgatgagacagtctgtgacttcatgataggaaagaggaggatgaggtctggggttctttaaagtctctggtgggctgcctcatgactttaatcagcttgaactgccagtgcaccagcagtttaggtgtgatgagagaattcagatatactttatctttttaaaaaagtgtaaataaaatcaaagaatgtaaagtctatctcttacgctagaggtccaaagctgcctctgttttaaagattatcccaatgtggaagatgcccatgactggtcagctacttcctcctatacattttggtttctttgagggtcactcattgagacacgcaggcctctgagagggtcttgttctagatttcatattgcacttggagggtaacagctgctttttcacgcatggtactcttgatgtttttcactctgtcaaggattttgttggctatcaatgaatgtgtctaaaacttagtgcttccaggtagttatagtactccaaatcaaggaccaacttaaacgttaatttttgtgcaaaaacaaacctgaaaaatatgcttcggaaactgtgcatagttctaattgtaagtcagattgtatattcaaattgtaattaagagatttaaatattagaacggtatgtaaggtagtataattaccactattttaaataattcagttaaacactgctgcaatatttcagtgttgtgcttgaaaatatgtacagtttttttccaatattaataccttatgttgtccttaaatatttctaaaagcgcctttatttcagcattacctttttttcatcactatcttttataaaacattaatataagtcgttacttttagaaactaaaggaaataatagctggaaaaccctctgtagtttaaaatcagtcattaaactcacaatagggtaagtaaatatagccacctgttaacatgtaaataagcataatttgttccaaagatggaatattgaaacttagttcatgtctgctgtaaaatattatttaaatgctgctgggcatttcacttaaagaacttaatgtcaacagctacaacaaagaccaaatctgaactgctaatgtggctgctttgtagggaatggactaatatcagtgtgttagatcttaaggtatcagtatttcagaatcctgcgacgattttatttctaaattcatgtactgtatgtccataagtgaaaataaaatgtcatattcttttctattattggtatcattcatgtactttgaaagtgatgtttttctttttgatcttagaatgctaaaaatcatgcaaaatgatagacggtttggctctgtgtccccacccacccaaatctcatctcaaattgtaatccctacgtgttgagggaggtacctggtgggaggtggttggatcatgggggatggtttcccccatgctgttttcatgagtttgcacgaggtctgatggtttaaaagtgtttggcatttacccccttgctcgctcactttcctgccaccgtgttaagatgtgctttgctttcccttcaccttctgccatgatgaagttttgtgaggcctccccagccatgcggaactgtgagtcaaacctcttttctttatatgttacccagtctcaggtagttctttacagcagtgtgaagacaaattaatacacaaagcaatgcatgatcatcatagaaaaattagagtaagcaagaaaatcagtagcttctgcaattt

SEQ ID NO: 13373 - DNA, 1254 bp, Homo sapiens
atacaagccaagaagtcttccaagcacaaagccctaaaagtgaccatcactgtcctgaccgtctttgtcttgtctcagtttccctacaactgcattttgttggtgcagaccattgacgcctatgccatgttcatctccaactgtgccgtttccaccaacattgacatctgcttccaggtcacccagaccatcgccttcttccacagttgcctgaaccctgttctctatgtttttgtgggtgagagattccgccgggatctcgtgaaaaccctgaagaacttgggttgcatcagccaggcccagtgggtttcatttacaaggagagagggaagcttgaagctgtcgtctatgttgctggagacaacctcaggagcactctccctctgaggggtcttctctgaggtgcatggttcttttggaagaaatgagaaatacagaaacagtttccccactgatgggaccagagagagtgaaagagaaaagaaaactcagaaagggatgaatctgaactatatgattacttgtagtcagaatttgccaaagcaaatatttcaaaatcaactgactagtgcaggaggctgttgattggctcttgactgtgatgcccgcaattctcaaaggaggactaaggaccggcactgtggagcaccctggctttgccactcgccggagcatcaatgccgctgcctctggaggagcccttggattttctccatgcactgtgaacttctgtggcttcagttctcatgctgcctcttccaaaaggggacacagaagcactggctgctgctacagaccgcaaaagcagaaagtttcgtgaaaatgtccatctttgggaaattttctaccctgctcttgagcctgataacccatgccaggtcttatagattcctgatctagaacctttccaggcaatctcagacctaatttccttctgttctccttgttctgttctgggccagtgaaggtccttgttctgattttgaaacgatctgcaggtcttgccagtgaacccctggacaactgaccacacccacaaggcatccaaagtctgttggcttccaatccatttctgtgtcctgctggaggttttaacctagacaaggattccgcttattccttggtatggtgacagtgtctctccatggcctgagcagggagattataacagctgggttcgcaggagccagccttggccctgttgtaggcttgttctgttgagtggcacttgctttgggtccaccgtctgtctgc

SEQ ID NO: 13374 - DNA, 2404 bp, Homo sapiens
gctgggcctcttgcattcggcttccttggagcagcctcttctggcagaaagccatcaggtgctcaatcatcttctcctggccaaggctctgaccatgcttagtactggaatagaggtggccaggcccccagcgactcttcttggcctgatgtttgtcctcacaggcatgccacgtggcctgagatgattcagaacaaatcatgctaactttgaatccatccagccacttgcaaatgataatcagaagtcagcttgttcactgttagaaagaaactaacaaaagagaacccagagcaatctagaatctttgagtgcttggctttccaaggatactgcggagactctggccaagctgatgaccttctgaagtgtcactggcaccatatgcaacaagaaccaccattcactgagtagctaatgggtttggggcctgggacattccatctgaggtccttcctgaacatgtcactccacagcagaggaccggttgcagcttacccagaaccactcctccaggagagctggatgttttgcgtgcaacaccttgagcactgactgctattgttcaaaaaaagcctttgctgcattcggaggactgccccgtgccctgaggtgacttcctaactatgtggtttcattagcgaatttattttttgtgctgggtggacatttgtattttgttaggttgctgtttaagctcaagtttgctgtgctctctgcagctacaaaacatcttggcatatttaagagtggcttttataaatagctttattctgatattaatcagattcccaactttactgagaattaaggactggggtactttaaagaaatgcaaatagcaattgaagaaccactgctgcaggtggtagccctggctagactgaattacactagaaatcagccagaaggaagcgtccttgggatcccagatcactctttttttttttttttaaaaggggcagccccttgatggctcatctctctgaataacagttacgtcttcatatcgataccagatgccttcttcatcatgccactgaagccactcaccaccttcaagaacatgccaacctctgtcagattcacttacccacaaacaaggaggcacgtttggcacaaagtgttgtcctccaggtccaagtggactctacagagtgcttgacctcaacacactggattccaggtggactggaccaagagcaggcaaagacacgggaactgaaaaactccacagggtttggagaatagaaatgaaaagccacgtcatataactcaagaataaatggtgttttggaaattttaaaattatcatcgaaggtggtgaaactatttcaggcccaaatgaaaggaaatcgccagttggggatgaaatcacagagcctgtgttttatgatatggttggatgtccactgatgaaattttaaaggagtttcagttttaaaagtgcgcatgattctacatatgagaattctttaggccaagaaactgtccttggctcagaggtgttgggaattaaagcagagagaagccattcgtgatgcttagaaccaaggatggtcatgtacacaaagaccatcgagacggccattcttgtttacaaaacacttaccaagaaagcactttgtaggggaactttagtaagttcttctcatttcattatgtttcttccaaggaaacaggagagactgaattaataattctctctttcctcttaagcacttttaaaataataaagtacatcttgaaatttggggaggcatctctgatttaaaaaaagaaaaaggctgcttgatgtatgttatgcagagacactctgcctctggtggctgcagagcaatacccaagcctcatttggaaggctcaacatttggaattgcactttaattgattaatcctcaattcatgtggccttacgggatggtgggtctgggaccccaattcattcttatctgccaaagaattatctagaagcacatcaaataccagcaccccacctgctcaatgggggtggaaaacttttgtatccctaagcatattattttatagtgtctgccatgccatgtggaaatactttatttttaacctcaggatttaaataaagtaaacactatgacatttagacatttgtctctcatttttttgggacataaagtgcaccacgaagttatacagagctgagttggggttgagctgtgctgctgggaaatagagcatcttttatggtggcttttcaggaggacttgagccagcagatgttctgggaagtttccaggtggcctggcacctggctgcttcctggcctgctgtgagggtggtgtttagacctgcctgagacagcctgtctttcaatccatgctgttgtgccctatgggcttctagcctcagctcaaatgtccagatc

SEQ ID NO: 13375 - DNA, 1223 bp, Homo sapiens
gagagaaggtttactttcaaagatggtgtatggtttaggaacagcccaaacttctcttataaacggtaccctctgccacctactagccacagtcccaagtccgtgaccatctatttctattttgtcaactattaatactgtagggtcatatagcttccaagatcttgatgtagctgtgagttggctggaaagatggcaaaagaatgaaagttaacgattcttagatctaaacatttctaaagtttgactgcacatttgtgatgacttacttaatggtgacaaatgcattatttatcacctatacagtatctctatacttaaaacatgaagtgacaataatgggtgtattgacatacattcattatgtatgtcatagcacgtagctagatttcataataaaatggtgaatgattgagcatacttttttctttctgttacagaatctgttcccagctataccaccaaagtgtcttttagccttcaactttgatatccatcagaagactgcaaatctcactattctctggagctatatataaatctttgttatgatcatgtcatataggaagaatggcttgtgcttaaggacaaagtctagaaaccactatcatagttgctaaaaaaaatggttttcaaatgtcaaatacatgagtatctccctccatggactggagaattgaaaaattggtttgtatattgatatttccaggttcatttgcatatacttttttccaaataatgcacatttaatatgttttaaaatgtcttatttttaagaattataactaaaagaccaaatactgaagttaagtgcattgttttcaggaatcaaaagataaaggggccgggtgtggtggctcacacctgtaatcccagcactttgggaggccgaagtgggtggatcacctgaggtccggagttcgaggctggtttggccagcatggcgaaaccccatctctactaaaaatacaaaaaattagctgggcatggtggcagttgcctgtaatcctagctactcaggaggctgaggcaggagaatcgcttgaacctgggaggtggagttgcagtgagccgagatcatgcgactgcactccagcctgggtgacagagccagactctgtctcaaaaaaaaaaaaaaagaaaagaaaaagataaagggattgtgaaaagagcatttatattggactaatcagatgagagtgttttgttattttgaaagagtt

SEQ ID NO: 13376 - DNA, 1149 bp, Homo sapiens
cctgacctcaggtgatccacccgcctcagcctcccaaagtgctgggattacaggagtgagccactgtgcccagccatgtcctatcttttaaatacacattttgtggggattttccttgagtcctttgtaatttggacacgtcattttaaagttggatgtcccttactgggagtaacatcaaacattgcatgacgacatgcagctgtgaggatctgcctgagaggaggtgttagtgtccactccatggcctcctgtactctctgcctatgactagggagctctcatttccccatcaggcctctgaaaagtctatactttaaaactggctctatattactgttggattattccacactggaattccactggtgatgctgatatcatgtggtcaaatgtgacttttaaaggtaagccagaacttgggataacagaggttattttatgtgaggaattttgcagtttaaaacgcacaggtgataatgtgatacttcccatgctttctcgaatagatttgtaagccttatggacaatcctattgataatgcccaatgtgaagatggcaatgaaataatggaaagtgaacgggatcgccaacattttgataaagaagttatgaaagcctatattgaagaccttaaagaaagaggtgggttactcatatttaaaattatttaaaattagtgtacagacgtccacttatgtaatacatttgttaatagaagtcaaattgacaaaaagtttattggttgaggggcacgttacttcgtaaattatttttccatttaccctccaacacactccaaatgatacatttccttaaaatatcaaattgtgctagtccatttgaatgcttgatgaatcatccactgtttgacagagaggctgggaaacgtgcacttaaaatgttagggttgcgttactaaccatacgtgagtttttaactaaacgatattgacaaaatagtatcctaagttactagaaaaataagatgtcgtttcaaaatccgtttacattcaacttttgaaaaagttatctcacataaatcaagaacacatataaaaatcacaaaagggaaagcacaggatggccaatttgcgcatagatgcatttagttttggttcccatagggtggtgagaatacagaggggc

SEQ ID NO: 13377 - DNA, 1120 bp, Homo sapiens
cctggcaggtgagcgtgaggaccaaaggcaggcacatctgcggcggcaccctggtcaccgccacgtgggtgctgacggcaggccactgcatttccaggtgaggagcggcacgcggggctgggggccggccccctcaagcacacacagttccattgccccggcaatttggcgacaaagaaacaaaactcacagtgaagccggagtgcatcggtcgtcttgctgtaggcatgtctaagtcgggcagacaaaccaagtttgagagtgatcaaggaagggtttttggtgatggcgatggggtggtagggacagtggcccgggaggttgaggccagtttcagaaacattggaaatgtatggaaaaggcacaaaggatgtttcccaggccttctcttagaggcatctcttccacagccgtttccattacagtgtcaagatgggagatcggagtgtctataatgaaaacacaagtgtggtggtctcagtccaaagagcttttgtccaccctaagttctcaacagttacaaccattcgaaatgaccttgcccttctccagctccaacatcctgtgaattttacctcaaacatccagcctatctgcatccctcaggagaatttccaggtggaaggtaggaccaggtgctgggtgaccggatggggcaaaacaccagaacgtggtgagacttcaaggcaggaagcaaacttggggcagagaggaggcacccttactcctggagtagacatgaaggccacagaaaggggcagggaggcaaactgcctggtgagtggcaggtggtgaggggcacgcagtttagcagcagtcagggtcatggttcctggttggcttgggtgacatcagaaactgggttgagttcttttgttgcaacacaaatatttgatggcagccatttaggaagacttctgtcctggaactggagttgctcagccaggagaagaagaaacacatgggcaacatctccttctgtggattcgtgggggcactgtgcttgactggtttgggggatttttaggttccctggacagagcaagatgctataaagttctccccaggaacagctcagagggtgatgagctgtctgccagtcagagctgctcctcattcg

SEQ ID NO: 13378 - DNA, 1240 bp, Homo sapiens
tcaatttaaccatccttaaaatgaggacagagagggtatatgggataagggatatctgctggtcgcaaagcccccttgcagtcgcaagttggtgtatatcccctctcccttccagactgctcccggccgcgcctcccttgcccatgaaggtggccatccgcagcgtggccgtgaccaaggagcgcagccacgtgctggtgggcctggaggatggcaagctcatcgtggtggtcgcggggcagccctctgaggtgaggatggggcgggggtggggaggcccctcgaacggggcggggcgtggcgcggcgatcccagctgatcctactcaacccttacgcccaccaggtgcgcagcagccagttcgcgcggaagctgtggcggtcctcgcggcgcatctcccaggtgtcctcgggagagacggaatacaaccctactgaggcgcgctgaacctggccagtccggctgctcgggccccgcccccggcaggcctggcccgggaggccccgcccagaagtcggcgggaacaccccggggtgggcagcccaggggggtgagcggggcccaccctgcccagctcagggattggcgggcgatgttaccccctcagggattggcgggcggaagtcccgcccctcgccggctgaggggccgccctgagggccagcactggcgtctgcggccgcagcagcactttttgcacagtctggggcggggttccccggcttccaagtcgctgtttcgtcaaagcacgagggccgcctgtggccttaattcctaacggcggccccggttctcccttctcggcaataaaccaggcctagttttgtagctgctccgtctccgagtgtgcgttcgcgcgcagcgtctcggcctgccatggccaccgtcccagggtcgccgtctgagtctggcctggctcgcgttcccctggcccgtgaccccctctgggcccactcgccccccctccgcgtggccgtcgctgaactggggcctcagtttacccggcagtgtagcccctgccccacatctcgccccggcttgtggtttccccacgatctcttcatggggtcgccttcgcacgccattcgtccacaaccgcaacccggccaggcgccccgcaggcgcgtttgcattccttcgccgggcaggggcgacaacacccgaggccgcgcccctccagctcggccctgccacctcattgtcttgcctacttcttgggccgccctgtggcgccgctgtg

SEQ ID NO: 13379 - DNA, 1210 bp, Homo sapiens
cagtccagacttggtggcggagacaggacacaagtgccatggtagacagtgccatggtctttcttcctgtgccctggataattggataaaaaaaattggatttagtgccgtggtagacaggaggtgcaaatggaccccaaaaaggaagagatcaagaagtcttcccagagtagaagattcttgccaatatgtcagatggagaagggagattggcaagagcagaagtctggaaggttatgagaacagggtgcatctaggaaggacaaggtgtccagagtggtaagcaaaggggaagaagtagatgaaaatggaaaaataggccagacagctcctgatgctgtggtataagcttttgactctaatagtagggactactggcttcaaatctttttggcaacaaagtttaggtgaggctacccagggaccctagcctttgttccttgctcctgacctgatctgtcttttcttccacaggtaagatcctgaggaggcaggagagggacagggaaggagtatgggtaggggcaggaggagccctggcccccaatacctcctcccctttcctcctggagtctccaagaggtctcaggcagcatcatcccagtctactgtacccttctggccactgtggtcctcggtctgcttgcctacatggccttcaagtggtaggtggtctgggcactgccctgtggcacccccttccctgtctggactcccaaccaattccctgtcttgaaggtgggggcaggttggtaggtctccctttctccccacagctggcgctcacataaacaaagacagcagctggccaaagctcgaactgcagagctgggaggtctcaacaaggaccagatgcatggggatagcagtgtcttcctggactctcctagcagtctggagccctgtgcccccagccagggtgagcccctttcccagaactgcctcaccacccagcccttgtgtgatcctcatgtctcctgccccaggaccacatcctgagcttgggtgccgacttcaccttgatctccctcggcagcaccaggagaaagtggagcggctgttagaggtgtcacgtgaacctgacaagggctggcggggactggcagaccatctgggctaccaagctgaggctgtagaaatcatggcccaaggccaggtgtgagcctacacactgctgagggactgggctatccaagaagacagtggtgcc

SEQ ID NO: 13380 - DNA, 1724 bp, Homo sapiens
tgaacccttaccggaaacctgactgcaaagtgggaagaattaccacaactgaagactttaaacatctggctcgcaaggtactccccttgcttttggtagcccaccaggcaatgttctgggcaaactgtgtaccttctaagaagcccttttcatcatagaaagtatttttttttttcttgtcagatgtcagagctggggacccaggaacggggagggaaggtttggggagggatgcgtaccttacatgacagcagtagttctctaagaaattttcagagctcagcttgtcctttctggtgatcatagcaccagcctgccccaacatctacccccttattaacttcctgtcttggtgagaagggccctgaagcagcaggctggattaccacccctgtcctccccctcatataatttctgctctgattggtggctgtggtctctcttcctgtgccctggacagctgactcacggtgttatgaataaggagctgaagtactgtaagaatcctgaggacctggagtgcaatgagaatgtgaaacacaaaaccaaggagtacattaagaagtacatgcagaagtttggggctgtttacaaacccaaagaggacactgaattagagtgactgttgggccagggtgggaggatgggtggtcaggtaagacagactctagggagaggaaatcctgtgggcctttctgtcccacccctgtcagcactgtgctactgatgatacatcaccctggggaattcaaccctgcagatgtcaactgaaggccacaaaaatgaactccatctacaagtgattacctagttgtgagctgttggcatgtggttagaagccatcagaggtgcaagggcttagaaaagaccctggccagacctgactccactcttaaacctgggtcttctccttggcggtgctgtcagcgcacagacccatgcgcatccccacccacaaccctttaccctgatgatctgtattatattttaatgtatatgtgaatatattgaaaataatttgttttttcctggtttttgtttggttttcgttttgcttttagcctctacatgctaggatcacaggaagactttgtaaggacagtttaagttctcctgcaaggtttaatttgttatcatgtaaatattctaaagcaggctgccttgtggttttggccagccttgtgctatgttgataagattgatttactgcttaaaatcactttactttatccaatttttactgaactttttatgtaaaaaaataaaatcaattaaagaacttggcatgtgtgttccctaaaagttaatcaagcatatttgtgtgtaatgatgtcactggaagaaggagagatagtgagtggccttaggtgtgtgaagtccaaggttaatccctgtgattggattttattacaggacttgttcattctccacaggtcctactatgactggggcagacatttgcacatttgccaggtgactgacacttgtaggcttgggatcttttggctgtgctcaggcattgggtcaatttgcacatgcattccagagcaaaagaagcagcatctagggcctctttggcactaggcttctttattttggttaattatcagtcaagagaaaggcaaatttatcttctcccttgatactttctcctggctggagagaagcattgaatcttttctcccccatggacttgatttttctgagcccactggaatgctttt

SEQ ID NO: 13381 - DNA, 1109 bp, Homo sapiens
tggtgaaaccctgtctctactaaaaatacaaaagattagccaggcgtggcagctagcgcctgtactcccagctacttgggaggctgagacaggagaattgcttgaacccaggaggcagaggttgcagtgagccaagatcatgccattgcattccagcctgggtgacagagtgagactctgtctcaaaaaaaaaaaaaaaagtcaactgtacaaagtgatgtaatttttttttatgtttaatcagattataaagactttggaacacttgcccattcctactaaaaatatgttggaggaaagcaaagtacttccaattattcaacgctggtctcagactaagactgctgtccctccgttgagtgaaggagatgggtattctagtgagaatacatcgcgtgctcatacaccactcaacacacctgatccttccaccaagctgagcacagaagctgacacagacactcccaagaaactaatgtttcgcagactgaaaattataagtgaaaatagcatggacagtgcaatctctgatgcaaccagtgagctagaaggcaaggatggcaaagaggatcttgatcaattagaaaatgtccctgtagaggaagaggaagaattgcagtcacaacagctactcccacaacagctgcctgaatgcaaagttgatagtgaaaccaacatagaagctagtaagctacctacatctgaaccagaagctgacgctgaaatagagcccaaagagagcaacggcacaaaactagaagaacctattaatgaagaaacaccatcccaagatgaagaggagggtgtgtctgatgtggagagtgaaaggagccaagaacagccagataaaacagtggatataagtgatttggccaccaaactcctggacagttggaaagacctaaaggtaaggaagcatcttttgttcatttcaacttgaattactcaggtttagagttctacaaacctaagcaaaattaactactttttttagccatgcatatttctgaaaaatggaatactgtctctcttactgttttatttataagtgtctcaaacatcctctaaaccgtggcaagagtcatattagccaaactaatatacaaatg

SEQ ID NO: 13382 - DNA, 1161 bp, Homo sapiens
tggggtttcaccatgttggccaggctggtctcaaactcctggcctcccaaagtgctgacattacagtcgtgagccactgtgcccagccagtcttttaataatcaaatgtttccttttaagtatcctgtattaatcattttatgtctgcttatactaatgcatgtttgtttgttctatgtgccaattaaacatttacatataagtaatagttctctgaactatttaagcaattttattcttaatccaaacatgtatatgatctcttattttcatattactaggtattctcataaaatggaagaattgtttatttcttggctagttttgtctcccaaagaaagatgattggaaaaataatgaatatttttaaagagcagttttcagacatttctattagtaatagcagacttgttggaatctcttcaagttatggtttttgtttgtttgattttgtttagactggtatgacttttgtgtgtattgccaacagttttgtatggtttacttccacatagctgacttctttcctatgctctttgaacagaaaagaagcccagaaatgtttctgcggatcagccaattgccggggttacctgggaggagaaaacagagtcagcatcagagcagcaggagggaaaatgaagaaggaacgatctcgtaagaaggattcagtaagtttgcatttttctttcaactttcacaataaaaaatttaaaaagcgaggtggcttttctgattgaaggttataaagtcatactactgccaccagagaaatccaagatcagatgagttgttaccagaaaagagatgcaattgctatttttatttcagattcatagagattggaattgggtactgagaactattaaagtattattgaaaacacctggactaatagtttttcagattctttaaaactcctaagtacaagtaaaacatatcttttctccctgatagctcactatgtctgctgtacgtttctaatctcttgttattggtttgtctttgtttggtactctaaactttgagtgttcttcaaatctctgaaaatcctcttttgagtgtgagaaaagttttgagaggaagtaggtaacctaagaccaacaggagtagtcacagatgctctttttatttaatgaaacagcagttgatagcctcatt

SEQ ID NO: 13383 - DNA, 1116 bp, Homo sapiens
gcttctgttaatcattttgatgatttatatcaacctattgggagttcaggtattgcttcatctcttcagagtcttccaccaggaataaaggtggacagtctaactctcttgaaatgcggagagaacacatctccagttctggatgcagtgctaaagagtaaaaaaagttcagagtttttaaagcatgcagggaaagaaacaatagtagaagtaggtagtgaccttcctgattcaggaaagggatttgcttccagggagaacaggcgtaataatgggttatctgggaaatgtttgcaagaggctcaagaagaagggaattccatattgcctgaaagaagaggaagaccagaaatctctttagatgaaagaggagaaggaggacatgtgcatacttctgatgactcagaagttgtattttcttcttgtgatttgaatttaaccatggaagacagtgatggtgtaacttatgcattaaagtgtgacagtagtggtcatgccccagaaattgtgtctacagttcatgaagattattctggctcttctgaaagttcaaatgatgaaagtgattcagaagatacagattcggatgatagcagtattccaagaaaccgtctccagtctgttgtggttgtgccaaagaattctactttgcccatggaagaaacaagtccttgttcttctcggagcagtcaaagttatagacactattctgaccattgggaagatgagagattggagtcaaggagacatttgtatgaggaaaaatttgaaagtatagcaagtaaagcctgtcctcaaactgataagtttttccttcataaaggaacagagaagaatccggaaatttcttttacacagtccagtagaaaacaaatagataatcgcctgcctgaactttctcatcctcagagtgatggggttgatagtacaagtcatacagatgtgaaatctgaccctctgggtcacccaaattcagaggaaaccgtgaaagccaaaataccttctaggcagcaagaagagctgccaatttattcttctgattttgaagatgtcccaaataagtcttggcaacagaccactttccaaaacaggccagatagtagactgggaaaaaca

SEQ ID NO: 13384 - DNA, 1537 bp, Homo sapiens
gcatgatcttggctcagtgcaatttctgtctcccaggctcaagcaatcctcccaacttagccttccttttaaaaattatttttcattttttgagatggagttttgctcttgttgcccaggctggagtgcaatggcacgactttggctcactgcaacctccacctcccgggttcaagtgattctcagcctcccgagtagctgggattacaggcacgcaccaccatgctcggctaattttgtatttttagtagagatggggtttcaccatgttggccaggctggtctcgagctcctgacctcaggtggtctgcccacctcggcctcccaaagtgctgggattacaggcgtgagccaccgcacctggcctaaaaattatttttaagagagatgaggttttgctatgttacccagggtggtctcgaactcctgaactcaagtgatcctcccaatttagcctcttaaagtgttgggattacaagtgtgggccactacacccagccttattttatgtgttaatctctgactctgcctgggatcttctcacaaatgtattcttcaaaaacgaatcgtctcttcaggattttttttttttttttaaagacagccatcaccacagctggagtgcagtggtgtgatcatggctacctgcagcctcgacctcctgggctcaggtgatcctcccacctcagcctcccaggtagctgggactataagtgcacgccaccatgtctggctatttttttgtattttttatagagacagggtttcaccatgttgcccagtgtagtctcaatcccctgggctcaagccatcagccggcctcagcctcccaaagtgctgggattacaggtgtgaaccaccacacctaggcaggaaaaattctttgcattcctattttcccactaaactgagttgcttatcgtcctctttgctgccttactatatatatttctattcttatatttactccattatgttggtattacttttgttacaaatttcttttttgtgacttacaggaagctgagctttttgagggcagggatgctgctttattcaaatttggtctccagcccttagcacagtatgtgacactatcttgagtaaatatttgttaaactaaatgtaactgagtgtgaaggaatggacaatccatatagaatatacctgtaggtagtaagtatcccaagttttaatacaaataactattatttcaatcgtttttaagtatttatgatttctttttattcttttgcatgttttcttggctgaatggaaatagagaagaagaaaatgaggtaagtataatttaactagtcattcaatgattatgagatggaccactaaacacattttagaaattgggtaaaagctgaaaacactcaaaatgtagctatcattttgaatgtgaaatgaagtaatagtttttaattttgtttttagagccatggtaacttatcccagtgagggatgttgtgtatctcagaaaaatggtttttaaactttagagcttcaagagatttaggaaaggtagaga
